US007777022B2

(12) United States Patent
Bentwich et al.

(10) Patent No.: US 7,777,022 B2
(45) Date of Patent: Aug. 17, 2010

(54) BIOINFORMATICALLY DETECTABLE GROUP OF NOVEL REGULATORY VIRAL AND VIRAL ASSOCIATED OLIGONUCLEOTIDES AND USES THEREOF

(75) Inventors: Itzhak Bentwich, D.N. Misgav (IL); Amir Avniel, Moshav Magshimim (IL)

(73) Assignee: Rosetta Genomics, Ltd., Rehovot (IL)

( * ) Notice: Subject to any disclaimer, the term of this patent is extended or adjusted under 35 U.S.C. 154(b) by 1229 days.

(21) Appl. No.: 10/709,739

(22) Filed: May 26, 2004

(65) Prior Publication Data

US 2007/0042381 A1    Feb. 22, 2007

Related U.S. Application Data

(63) Continuation-in-part of application No. 10/708,952, filed on Apr. 2, 2004, now abandoned, which is a continuation-in-part of application No. PCT/IL03/00998, filed on Nov. 26, 2003, which is a continuation-in-part of application No. 10/707,003, filed on Oct. 30, 2003, now abandoned, which is a continuation of application No. 10/604,984, filed on Aug. 29, 2003, said application No. 10/707,003 is a continuation-in-part of application No. 10/605,838, filed on Oct. 30, 2003, now abandoned, which is a continuation of application No. 10/604,944, filed on Aug. 28, 2003, now Pat. No. 7,217,807, said application No. 10/605,838 is a continuation of application No. 10/605,840, filed on Oct. 30, 2003, now abandoned, which is a continuation of application No. 10/604,943, filed on Aug. 28, 2003, which is a continuation-in-part of application No. 10/604,942, filed on Aug. 28, 2003, which is a continuation of application No. 10/310,188, filed on Dec. 5, 2002, now abandoned, said application No. 10/604,942 is a continuation-in-part of application No. 10/604,945, filed on Aug. 27, 2003, which is a continuation of application No. 10/303,778, filed on Nov. 26, 2002, now abandoned.

(60) Provisional application No. 60/521,433, filed on Apr. 26, 2004, provisional application No. 60/457,788, filed on Mar. 27, 2003, provisional application No. 60/441,230, filed on Jan. 16, 2003, provisional application No. 60/441,241, filed on Jan. 17, 2003.

(51) Int. Cl.
*C07N 21/04* (2006.01)
*C12N 15/00* (2006.01)

(52) U.S. Cl. ............... 536/24.5; 536/24.32; 536/24.33; 435/320.1

(58) Field of Classification Search ............ None
See application file for complete search history.

(56) References Cited

U.S. PATENT DOCUMENTS 5,541,308 A * 7/1996 Hogan et al. ............ 536/23.1

| 6,573,099 | B2 | 6/2003 | Graham |
|---|---|---|---|
| 6,720,138 | B2 | 4/2004 | Sharma et al. |
| 2002/0086356 | A1 | 7/2002 | Tuschl et al. |
| 2003/0108923 | A1 | 6/2003 | Tuschl et al. |
| 2003/0228691 | A1 | 12/2003 | Lewis et al. |
| 2004/0053411 | A1 | 3/2004 | Cullen et al. |
| 2004/0086884 | A1 | 5/2004 | Beach et al. |
| 2005/0222067 | A1* | 10/2005 | Pfeffer et al. ............ 514/44 |
| 2006/0293267 | A1* | 12/2006 | Zamore et al. ............ 514/44 |

FOREIGN PATENT DOCUMENTS

| WO | WO 01/68836 | | 9/2001 |
|---|---|---|---|
| WO | WO 02/44321 | | 6/2002 |
| WO | WO 02/057437 | * | 7/2002 |
| WO | WO 02/094185 | | 11/2002 |
| WO | WO 01/75164 | | 2/2003 |
| WO | WO 03/029459 | | 4/2003 |
| WO | WO 03/070884 | | 8/2003 |
| WO | WO 03/070903 | | 8/2003 |
| WO | WO 03/070918 | | 8/2003 |
| WO | WO 03/074654 | | 9/2003 |
| WO | WO 2004/009779 | | 1/2004 |
| WO | WO 2004/031412 | | 4/2004 |

OTHER PUBLICATIONS

Buck et al (BioTechniques 27: 528-536, 1999).*

(Continued)

*Primary Examiner*—Richard Schnizer
(74) *Attorney, Agent, or Firm*—Polsinelli Shughart PC; Teddy C. Scott, Jr.

(57) ABSTRACT

The present invention relates to a first group of novel viral and human associated oligonucleotides, here identified as "Genomic Address Messenger" or "GAM" oligonucleotide, and a second group of novel operon-like viral and human polynucleotides, here identified as "Genomic Record" or "GR" polynucleotide. GAM oligonucleotides selectively inhibit translation of known "target" genes, many of which are known to be involved in various viral diseases. Nucleic acid molecules are provided respectively encoding 1,655 viral and 105,537 human GAM precursor oligonucleotides, and 190 viral and 14,813 human GR polynucleotides, as are vectors and probes both comprising the nucleic acid molecules, and methods and systems for detecting GAM oligonucleotides and GR polynucleotides and specific functions and utilities thereof, for detecting expression of GAM oligonucleotides and GR polynucleotides, and for selectively enhancing and selectively inhibiting translation of the respective target genes thereof.

6 Claims, 32 Drawing Sheets

OTHER PUBLICATIONS

Lee, R. C., R. L. Feinbaum and V. Ambros. The *C. elegans* heterochronic gene lin-4 encodes small RNAs with antisense complementarity to lin-14 Cell Dec. 3, 1993 843-854 75.

Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.

Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.

Lu, C. and R. Bablanian. Characterization of small nontranslated polyadenylylated RNAs in vaccinia virus-infected cells Proc Natl Acad Sci U S A Mar. 5, 1996 2037-2042 93.

Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

Engdahl HM, Hjalt TA, Wagner EG. A two unit antisense RNA cassette test system for silencing of target genes. Nucleic Acids Res. Aug. 15, 1997 3218-27 25.

Smith, D. S., P. A. Humphrey and W. J. Catalona. The early detection of prostate carcinoma with prostate specific antigen: the Washington University experience Cancer Nov. 1, 1997 1852-1856 80.

Dsouza, M., N. Larsen and R. Overbeek. Searching for patterns in genomic data Trends Genet Dec. 1997 497-498 13.

Moss, E. G., R. C. Lee and V. Ambros. The cold shock domain protein LIN-28 controls developmental timing in *C. elegans* and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila* Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae*-*C. elegans* genomic alignment Genome Res Aug. 2000 1115-1125 10.

Kennerdell, J. R. and R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in *Drosophila* embryos Curr Biol Oct. 5, 2000 1191-1200 10.

Anandalakshmi, R., R. Marathe, X. GE, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34.

Hutvagner, G., J. Mclachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001, 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in *Dictyostelium*: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the BLAST-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/ Suspensor1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-LIKE1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. Mcauliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with Arabidopsis development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 RNA Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.

Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.

Lim, L. P., N. C. Lau, E. G. Weinstein, A. Abdelhakim, S. Yekta, M. W. Rhoades, C. B. Burge and D. P. Bartel. The microRNAs of *Caenorhabditis elegans* Genes Dev Apr. 15, 2003 991-1008 17.

Xu, P., S. Y. Vernooy, M. Guo and B. A. Hay. The *Drosophila* microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in Arabidopsis by microRNA-guided mRNA degradation Curr Biol Apr. 29, 2003 784-789 13.

Masse, E., N. Majdalani and S. Gottesman. Regulatory roles for small RNAs in bacteria Curr Opin Microbiol Apr. 2003 120-124 6.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.

Boutet, S., F. Vazquez, J. Liu, C. Beclin, M. Fagard, A. Gratias, J. B. Morel, P. Crete, X. Chen and H. Vaucheret. Arabidopsis HEN1: a genetic link between endogenous miRNA controlling development and siRNA controlling transgene silencing and virus resistance Curr Biol May 13, 2003 843-848 13.

Ambros, V., R. C. Lee, A. Lavanway, P. T. Williams and D. Jewell. MicroRNAs and other tiny endogenous RNAs in *C. elegans* Curr Biol May 13, 2003 807-818 13.

Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of *C. elegans* microRNAs Mol Cell May 2003 1253-1263 11.

Abrahante, J. E., A. L. Daul, M. Li, M. L. Volk, J. M. Tennessen, E. A. Miller and A. E. Rougvie. The *Caenorhabditis elegans* hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The *C elegans* hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. and K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of *Drosophila* microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of *Drosophila* metamorphosis Dev Biol Jul. 1, 2003 1-8 259.

Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the *C. elegans* let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic penes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. ADAMs family members as amyloid precursor protein alpha-secretases J Neurosci Res Nov. 1, 2003 342-352 74.

Kawasaki, H. and K. Taira, Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.

Aukerman, M. J. and H. Sakai. Regulation of flowering time and floral organ identity by a MicroRNA and its APETALA2-like target genes Plant Cell Nov. 2003 2730-2741 15.

Finnegan, E. J. and M. A. Matzke. The small RNA world J Cell Sci Dec. 1, 2003 4689-4693 116.

Enright, A. J., B. John, U. Gaul, T. Tuschl, C. Sander and D. S. Marks. MicroRNA targets in *Drosophila* Genome Biol Epub 2003 Dec. 12, 2003 R1 5.

Rosok, O. and M. Sioud. Systematic identification of sense-antisense transcripts in mammalian cells Nat Biotechnol Jan. (Epub Dec. 14, 2003) 2004 104-108 22.

Yi, R., Y. Qin, I. G. Macara and B. R. Cullen. Exportin-5 mediates the nuclear export of premicroRNAs and short hairpin RNAs Genes Dev Dec. 15, 2003 3011-3016 17.

Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.

Ye, K., L. Malinina and D. J. Patel. Recognition of small interfering RNA by a viral suppressor of RNA silencing Nature Dec. 18, 2003 874-878 426.

Johnston, R. J. and O. Hobert. A microRNA controlling left/right neuronal asymmetry in *Caenorhabditis elegans* Nature Dec. 18, 2003 845-849 426.

Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of *Drosophila* MicroRNA targets PLoS Biol Dec. 2003 E60 1.

Konforti, B. The news and you Nat Struct Biol 2003 147 10.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The *C. elegans* microRNA let-7 binds to imperfect let-7 complementary sites from the lin-41 3'UTR Genes Dev Jan. 15, 2004 132-137 18.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20 years it took to recognize the importance of tiny RNAs Cell Jan. 23, 2004 S93-96, 92 p following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The Arabidopsis double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Colciaghi, F., E. Marcello, B. Borroni, M. Zimmermann, C. Caltagirone, F. Cattabeni, A. Padovani and M. Di Luca. Platelet App, Adam 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Sempere, L. F., S. Freemantle, I. Pitha-Rowe, E. Moss, E. Dmitrovsky and V. Ambros. Expression profiling of mammalian microRNAs uncovers a subset of brain-expressed microRNAs with possible roles in murine and human neuronal differentiation Genome Biol Epub 2004 Feb. 16, 2004 R13 5.

Scacheri, P. C., O. Rozenblatt-Rosen, N. J. Caplen, T. G. Wolfsberg, L. Umayam, J. C. Lee, C. M. Hughes, K. S. Shanmugam, A. Bhattacharjee, M. Meyerson and F. S. Collins. Short interfering RNAs can induce unexpected and divergent changes in the levels of untargeted proteins in mammalian cells Proc Natl Acad Sci U S A Feb. 17, 2004 1892-1897 101.

Xie, Z., L. K. Johansen, A. M. Gustafson, K. D. Kasschau, A. D. Lellis, D. Zilberman, S. E. Jacobsen and J. C. Carrington. Genetic and functional diversification of small RNA pathways in plants PLoS Biol May (Epub Feb. 18, 2004) 2004 E104 2.

Cawley, S., S. Bekiranov, H. H. Ng, P. Kapranov, E. A. Sekinger, D. Kampa, A. Piccolboni, V. Sementchenko, J. Cheng, A. J. Williams, R. Wheeler, B. Wong, J. Drenkow, M. Yamanaka, S. Patel, S. Brubaker, H. Tammana, G. Helt, K. Struhl and T. R. Gingeras. Unbiased mapping of transcription factor binding sites along human chromosomes 21 and 22 points to widespread regulation of noncoding RNAs Cell Feb. 20, 2004 499-509 116.

Dandekar, D. H., K. N. Ganesh and D. Mitra. HIV-1 Tat directly binds to NFkappaB enhancer sequence: role in viral and cellular gene expression Nucleic Acids Res Feb. 23, 2004 1270-1278 32.

Hutvagner, G., M. J. Simard, C. C. Mello and P. D. Zamore. Sequence-specific inhibition of small RNA function PLoS Biol Apr. (Epub Feb. 24, 2004) 2004 E98 2.

Schmittgen, T. D., J. Jiang, Q. Liu and L. Yang. A high-throughput method to monitor the expression of microRNA precursors Nucleic Acids Res Feb. 25, 2004 e43 32.

Stremlau, M., C. M. Owens, M. J. Perron, M. Kiessling, P. Autissier and J. Sodroski. The cytoplasmic body component TRIM5alpha restricts HIV-1 infection in Old World monkeys Nature Feb. 26, 2004 848-853 427.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Doench, J. G. and P. A. Sharp. Specificity of microRNA target selection in translational repression Genes Dev Mar. 1, 2004 504-511 18.

Liang, X. S., J. Q. Lian, Y. X. Zhou and M. B. Wan. Inhibitor RNA blocks the protein translation mediated by hepatitis C virus internal ribosome entry site in vivo World J Gastroenterol Mar. 1, 2004 664-667 10.

Calin, G. A., C. Sevignani, C. D. Dumitru, T. Hyslop, E. Noch, S. Yendamuri, M. Shimizu, S. Rattan, F. Bullrich, M. Negrini and C. M. Croce. Human microRNA genes are frequently located at fragile sites and genomic regions involved in cancers Proc Natl Acad Sci U S A Mar. 2, 2004 2999-3004 101.

Juarez, M. T., J. S. Kui, J. Thomas, B. A. Heller and M. C. Timmermans. microRNA-mediated repression of rolled leaf1 specifies maize leaf polarity Nature Mar. 4, 2004 84-88 428.

Kidner, C. A. and R. A. Martienssen. Spatially restricted microRNA directs leaf polarity through ARGONAUTE1 Nature Mar. 4, 2004 81-84 428.

Zamore, P. D. Plant RNAi: How a viral silencing suppressor inactivates siRNA Curr Biol Mar. 9, 2004 R198-200 14.

Wang, J. F., H. Zhou, Y. Q. Chen, Q. J. Luo and L. H. Qu. Identification of 20 microRNAs from *Oryza sativa* Nucleic Acids Res Mar. 12, 2004 1688-1695 32.

Jack, T. Molecular and genetic mechanisms of floral control Plant Cell Epub 2004 Mar. 12, 2004 S1-17 16 Suppl.

Roth, M. E., L. Feng, K. J. McConnell, P. J. Schaffer, C. E. Guerra, J. P. Affourtit, K. R. Piper, L. Guccione, J. Hariharan, M. J. Ford, S. W. Powell, H. Krishnaswamy, J. Lane, L. Guccione, G. Intrieri, J. S. Merkel, C. Perbost, A. Valerio, B. Zolla, C. D. Graham, J. Hnath, C. Michaelson, R. Wang, B. Ying, C. Halling, C. E. Parman, D. Raha, B. Orr, B. Jedrzkiewicz, J. Liao, A. Tevelev, M. J. Mattessich, D. M. Kranz, M. Lacey, J. C. Kaufman, J. Kim, D. R. Latimer and P. M. Lizardi. Expression profiling using a hexamer-based universal microarray Nat Biotechnol Apr. (Epub Mar. 14, 2004) 2004 418-426 22.

Rajewsky, N. And N. D. Socci. Computational identification of microRNA targets Dev Biol Mar. 15, 2004 529-535 267.

Winkler, W. C., A. Nahvi, A. Roth, J. A. Collins and R. R. Breaker. Control of gene expression by a natural metabolite-responsive ribozyme Nature Mar. 18, 2004 281-286 428.

Kuwabara, T., J. Hsieh, K. Nakashima, K. Taira and F. H. Gage. A small modulatory dsRNA specifies the fate of adult neural stem cells Cell Mar. 19, 2004 779-793 116.

Chen, X. A microRNA as a translational repressor of APETALA2 in *Arabidopsis* flower development Science Mar. 26, 2004 2022-2025 303.

Carmell, M. A. and G. J. Hannon. RNase III enzymes and the initiation of gene silencing Nat Struct Mol Biol Mar. 2004 214-218 11.

Davidson, B. L. and H. L. Paulson. Molecular medicine for the brain: silencing of disease genes with RNA interference Lancet Neurol Mar. 2004 145-149 3.

Kawasaki, H., R. Wadhwa and K. Taira. World of small RNAs: from ribozymes to siRNA and miRNA Differentiation Mar. 2004 58-64 72.

Meister, G., M. Landthaler, Y. Dorsett and T. Tuschl. Sequence-specific inhibition of microRNA- and siRNA-induced RNA silencing Rna Mar. 2004 544-550 10.

Nelson, P. T., A. G. Hatzigeorgiou and Z. Mourelatos. miRNP:mRNA association in polyribosomes in a human neuronal cell line Rna Mar. 2004 387-394 10.

Floyd, S. K. and J. L. Bowman. Gene regulation: ancient microRNA target sequences in plants Nature Apr. 1, 2004 485-486 428.

Lee, Y. S., K. Nakahara, J. W. Pham, K. Kim, Z. He, E. J. Sontheimer and R. W. Carthew. Distinct roles for *Drosophila* Dicer-1 and Dicer-2 in the siRNA/miRNA silencing pathways Cell Apr. 2, 2004 69-81 117.

Tijsterman, M. and R. H. Plasterk. Dicers at RISC; the mechanism of RNAi Cell Apr. 2, 2004 1 3 117.

MacDiarmid, R. RNA Silencing in Productive Virus Infections Annu Rev Phytopathol Apr. 12, 2004.

Chen, J., W. X. Li, D. Xie, J. R. Peng and S. W. Ding. Viral virulence protein suppresses RNA silencing-mediated defense but upregulates the role of microrna in host gene expression Plant Cell May (Epub Apr. 20, 2004) 2004 1302-1313 16.

Yekta, S., I. H. Shih and D. P. Bartel. MicroRNA-directed cleavage of HOXB8 mRNA Science Apr. 23, 2004 594-596 304.

Lamontagne, B., R. N. Hannoush, M. J. Damha and S. Abou Elela. Molecular requirements for duplex recognition and cleavage by eukaryotic RNase III: discovery of an RNA-dependent DNA cleavage activity of yeast Rnt1p J Mol Biol Apr. 23, 2004 401-418 338.

Barrick, J. E., K. A. Corbino, W. C. Winkler, A. Nahvi, M. Mandal, J. Collins, M. Lee, A. Roth, N. Sudarsan, I. Jona, J. K. Wickiser and R. R. Breaker. New RNA motifs suggest an expanded scope for riboswitches in bacterial genetic control Proc Natl Acad Sci U S A Apr. 27, 2004 6421-6426 101.

Pfeffer, S., M. Zavolan, F. A. Grasser, M. Chien, J. J. Russo, J. Ju, B. John, A. J. Enright, D. Marks, C. Sander and T. Tuschl. Identification of virus-encoded microRNAs Science Apr. 30, 2004 734-736 304.

Dorsett, Y. and T. Tuschl. siRNAs: applications in functional genomics and potential as therapeutics Nat Rev Drug Discov Apr. 2004 318-329 3.

Mallory, A. C. and H. Vaucheret. MicroRNAs: something important between the genes Curr Opin Plant Biol Apr. 2004 120-125 7.

Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.

Storz, G., J. A. Opdyke and A. Zhang. Controlling mRNA stability and translation with small, noncoding RNAs Curr Opin Microbiol Apr. 2004 140-144 7.

Kim, V. N. MicroRNA precursors in motion: exportin-5 mediates their nuclear export Trends Cell Biol Apr. 2004 156-159 14.

Jabri, E. RISCy business Nat Struct Mol Biol Apr. 2004 300 11.

Nakahara, K. and R. W. Carthew. Expanding roles for miRNAs and siRNAs in cell regulation Curr Opin Cell Biol Apr. 2004 127-133 16.

Ota, A., H. Tagawa, S. Karnan, S. Tsuzuki, A. Karpas, S. Kira, Y. Yoshida and M. Seto. Identification and characterization of a novel gene, C13orf25, as a target for 13q31-q32 amplification in malignant lymphoma Cancer Res May 1, 2004 3087-3095 64.

Marillonnet, S., A. Giritch, M. Gils, R. Kandzia, V. Klimyuk and Y. Gleba. In planta engineering of viral RNA replicons: efficient assembly by recombination of DNA modules delivered by *Agrobacterium* Proc Natl Acad Sci U S A May 4, 2004 6852-6857 101.

Kiriakidou, M., P. T. Nelson, A. Kouranov, P. Fitziev, C. Bouyioukos, Z. Mourelatos and A. Hatzigeorgiou. A combined computational-experimental approach predicts human microRNA targets Genes Dev May 15, 2004 1165-1178 18.

Vaucheret, H., F. Vazquez, P. Crete and D. P. Bartel. The action of ARGONAUTE1 in the miRNA pathway and its regulation by the miRNA pathway are crucial for plant development Genes Dev May 15, 2004 1187-1197 18.

Chapman, E. J., A. I. Prokhnevsky, K. Gopinath, V. V. Dolja and J. C. Carrington. Viral RNA silencing suppressors inhibit the microRNA pathway at an intermediate step Genes Dev May 15, 2004 1179-1186 18.

Pooggin, M. and T. Hohn. Fighting geminiviruses by RNAi and vice versa Plant Mol Biol May 2004 149-152 55.

Bartel, D. P. and C. Z. Chen. Micromanagers of gene expression: the potentially widespread influence of metazoan microRNAs Nat Rev Genet May 2004 396-400 5.

Dunoyer, P., C. H. Lecellier, E. A. Parizotto, C. Himber and O. Voinnet. Probing the microRNA and small interfering RNA pathways with virus-encoded suppressors of RNA silencing Plant Cell May (Epub Apr. 14, 2004(2004 1235-1250 16.

Murphy E, et al. Suppression of immediate-early viral gene expression by herpesvirus-coded microRNAs: Implications for latency. PNAS, 2008:105(14):5453-8.

* cited by examiner

FIG. 13

| ROW | PRIMER SEQUENCE | SEQ ID NO | SEQUENCED SEQENCE | SEQ ID NO | PREDICTED GAM RNA | SEQ ID NO | DIST-ANCE | GAM-NAME |
|---|---|---|---|---|---|---|---|---|
| 1* | AATTGCTTGAAC | 4204948 | CCAGGAAGTGGA | 4204977 | AATTGCTTGAACCCAGGAAGTGGA | 4205006 | 0 | 25-A |
| 2* | ACTGCACTCC | 4204949 | AGCCTGGGC | 4204978 | ACTGCACTCCAGCCTGGGCTAC | 4205007 | 0 | 351661-A |
| 3 | CACTGCACTC | 4204950 | CAGCCCGAGCAACA | 4204979 | CACTGCACTCCAGCCCGAGCAA | 4205008 | 0 | 351946-A |
| 4 | CTAGACTGAAG | 4204951 | CTCCTTGAGGAC | 4204980 | CTAGACTGAAGCTCCTTGAGGA | 4205009 | 0 | 352759-A |
| 5 | GAAGTTTGAAG | 4204952 | CCTGTTGTTCA | 4204981 | GAAGTTTGAAGCCTGTTGTTCA | 4205010 | 0 | 4426-A |
| 6 | TCACTGCAAC | 4204953 | CTCCACCA | 4204982 | (TCACTGCAACCTCCACCACGTG), (TCACTGCAACCTCCACCAGCCT) | 4205011, 4205094 | 0 | (357950-A), (352721-A) |
| 7* | TCTAAGAGAAAG | 4204954 | GAAGTTCAGA | 4204983 | TCTAAGAGAAAGGAAGTTCAGA | 4205012 | 0 | 337950-A |
| 8 | GGGCAGTGGA | 4204955 | GCTGGAA | 4204984 | GGGCGTGGAGCTGGAATGATGT | 4205013 | 1 | 351996-A |
| 9 | AATTGCTTGAAC | 4204956 | CCAAGAAGTGGA | 4204985 | AATCACTTGAACCCAAGAAGTG | 4205014 | 2 | 351874-A |
| 10 | AGCAGCCCA | 4204957 | GGGTTTTGT | 4204986 | AGCAAGACCAGGGTTTTGTGTT | 4205015 | 2 | 352083-A |
| 11 | AGGCAAGACG | 4204958 | GACCAGA | 4204987 | AGGCAGAGAGGACCAGAGACT | 4205016 | 2 | 351944-A |
| 12 | AGGGAAAGAAT | 4204959 | TAATGTGAA | 4204988 | GGGAAATAATTAATGTGAAGTC | 4205017 | 2 | 353325-A |
| 13 | AGGGAAAGAAT | 4204960 | TAATGTGAG | 4204989 | AGGAAAAAAATTAATGTGAGTC | 4205018 | 2 | 352649-A |
| 14 | ATTCAGTTG | 4204961 | CCCATGTTT | 4204990 | (ATTCATTGCCCATGTTTG), (TATTCATGCCCATGGTGA) | 4205095, 4205019 | 2 | A),(352957-A,352960-A) |
| 15 | CTAGACTGAAG | 4204962 | CTCCTTGAGG | 4204991 | CTGGACTGAGCTCCTTGAGGCC | 4205020 | 2 | 352288-A |
| 16 | TTCAGAGTGGT | 4204963 | TAAGTTCTG | 4204992 | TTCTGATGGTTAAGTTCTGTCA | 4205021 | 2 | 353875-A |
| 17 | TTCAGAGTGGT | 4204964 | TAAGTTCTGC | 4204993 | TTCAAGTGTTTAAGTTCTGCTT | 4205022 | 2 | 351940-A |
| 18 | AGCAGCCCA | 4204965 | GAAGGAAGC | 4204994 | AGGCCAAGAAGGAAGCAGAGG | 4205023 | 3 | 352496-A |
| 19 | AGTTTGCCTTG | 4204966 | TAAGAAAAG | 4204995 | AGTTTGTGTAAGAAAAGC | 4205024 | 3 | 352518-A |
| 20 | ATCAGAGGGTG | 4204967 | GGTGCTAA | 4204996 | ATTAGGAGAGTGGGTGCTAAGT | 4205025 | 3 | 352511-A |
| 21 | ATGGTGGGAG | 4204968 | AGTTTGTCAGT | 4204997 | TGGAGGAGAGTTTGTCAGTATAG | 4205026 | 3 | 353484-A |
| 22 | CCCAGGAAG | 4204969 | TGGAGCCTGGGC | 4204998 | CCCGGGTGGAGCCTGGGCTGTG | 4205027 | 3 | 351990-A |
| 23 | GGGCAGTGGA | 4204970 | GGTCCGT | 4204999 | AGGGCAGGAGGTCCGTCCCTTC | 4205028 | 3 | 353860-A |
| 24 | GGGCAGTGGA | 4204971 | TCTAGAC | 4205000 | GTGACAGTGAATCTAGACAGAC | 4205029 | 3 | 352810-A |
| 25 | TCAAGCTCATTC | 4204972 | CACTAAA | 4205001 | CTCAGCTCATCCACTAAATCCC | 4205030 | 3 | 353184-A |
| 26 | TGGAAAGTT | 4204973 | GGTTGTATGGTT | 4205002 | GGAATGGTGGTTGTATGGTTG | 4205031 | 3 | 353855-A |
| 27 | TGGAGAGTT | 4204974 | CCATATTTTG | 4205003 | TGATAGATCCATATTTTGGTAA | 4205032 | 3 | 352004-A |
| 28 | TGGAGAGTT | 4204975 | GTTTGTACAGT | 4205004 | TGGGTTTTGTTTGTACAGTGTA | 4205033 | 3 | 353160-A |
| 29 | TCACTGCAAC | 4204976 | CTCCACC | 4205005 | TCACTGCAACCTCCACCTTCCG | 4205034 | 0 | 353856-A |

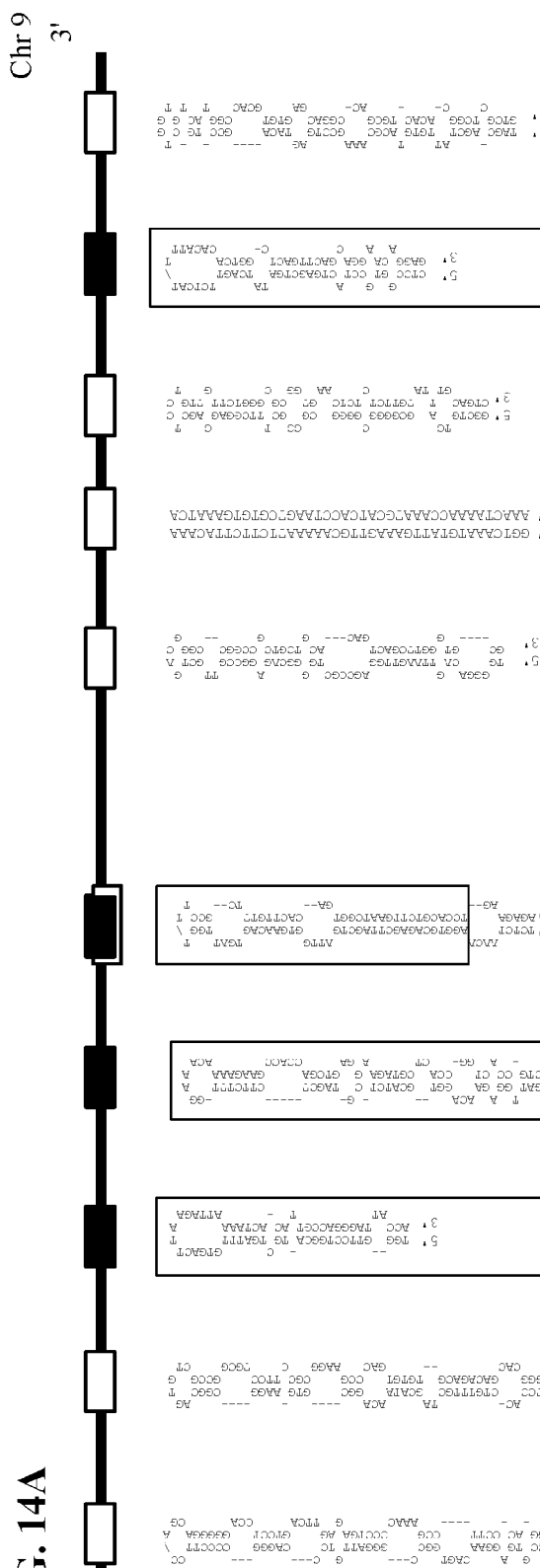
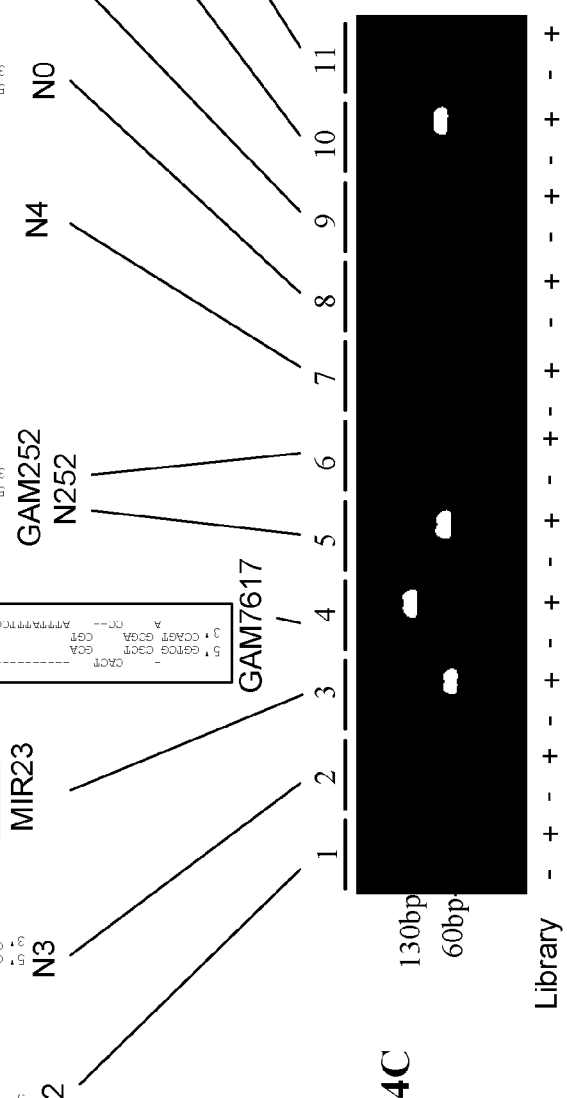
FIG. 14A
FIG. 14B
FIG. 14C

FIG. 15A

EST72223 (705 nt.)

EST72223 sequence:

CCCTTATTAGAGGATTCTGCTCATGCCAGG**GTGAGGTAGTAAGTTGTATTG
TTGTGGGGTAGGGATATTAGGCCCCAATTAGAAGATAACTATACAACT** MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG GAM25
**GCTTCAGTGAGCTGAGAACACGCCACTGCACTCCAGTCCTGGGCAAC
AGAGCAAGACTCTGTCTC**AGGAAAAAAAAAG

FIG. 15B

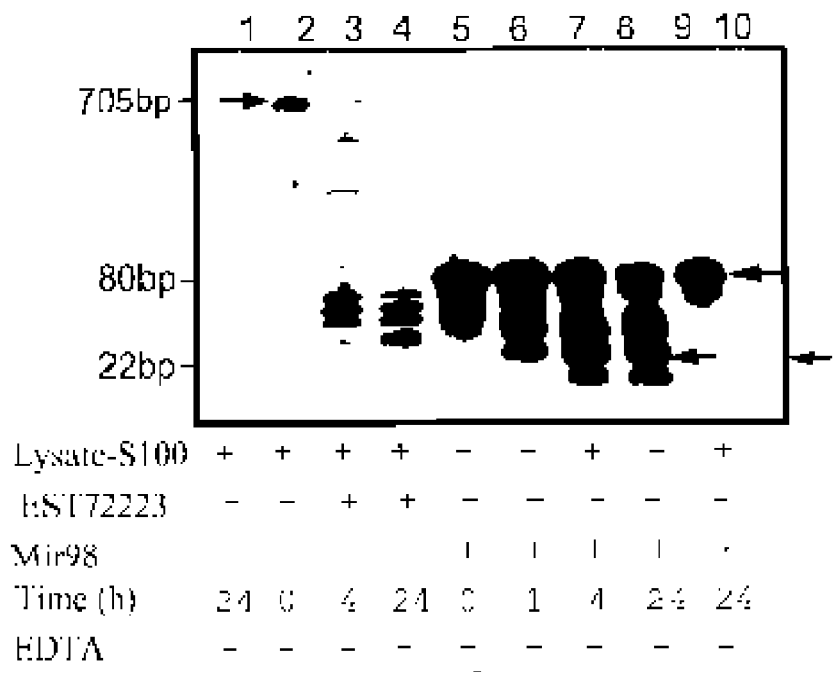

FIG. 18C

| MIRNA NAME | HELA | BRAIN | LIVER | THYMUS | TESTES | PLACENTA | REFERENCE |
|---|---|---|---|---|---|---|---|
| HSA-MIR-124A | 1879 | 65517 | 7025 | 3099 | 2672 | 2498 | 1,3 |
| HSA-MIR-9 | 642 | 42659 | 3504 | 4455 | 4485 | 2313 | 2,3 |
| HSA-MIR-128A | 2015 | 27701 | 4940 | 4876 | 5166 | 2495 | 3 |
| HSA-MIR-129 | 503 | 22573 | 1175 | 2213 | 5364 | 2017 | 3 |
| HSA-MIR-128B | 1168 | 21969 | 3954 | 4819 | 5383 | 2027 | |
| HSA-MIR-122A | 1051 | 447 | 65518 | 2644 | 617 | 570 | 1,3 |
| HSA-MIR-194 | 501 | 910 | 65518 | 4737 | 2342 | 7952 | 3 |
| HSA-MIR-148 | 413 | 620 | 38436 | 5250 | 6204 | 2711 | |
| HSA-MIR-192 | 452 | 606 | 20650 | 1628 | 1263 | 2607 | |
| HSA-MIR-96 | 887 | 3100 | 1477 | 44800 | 2266 | 5466 | |
| HSA-MIR-150 | 648 | 1463 | 5295 | 65518 | 29728 | 5280 | |
| HSA-MIR-205 | 551 | 615 | 1646 | 65518 | 2645 | 39072 | |
| HSA-MIR-182 | 662 | 1944 | 1091 | 25771 | 2034 | 3683 | |
| HSA-MIR-183 | 1026 | 1123 | 1286 | 8754 | 1681 | 2138 | |
| HSA-MIR-204 | 525 | 3898 | 1757 | 6535 | 64859 | 6233 | |
| HSA-MIR-10B | 410 | 433 | 477 | 3871 | 23083 | 738 | |
| HSA-MIR-154 | 438 | 733 | 1914 | 3309 | 14750 | 9637 | |
| HSA-MIR-134 | 448 | 617 | 698 | 763 | 2250 | 997 | |
| HSA-MIR-224 | 3233 | 11061 | 7684 | 32305 | 5377 | 65518 | |
| HSA-MIR-210 | 844 | 2280 | 10703 | 6864 | 15288 | 62452 | |
| HSA-MIR-221 | 625 | 9325 | 3520 | 20212 | 10608 | 54287 | |
| HSA-MIR-141 | 696 | 805 | 1220 | 4063 | 2000 | 46845 | |
| HSA-MIR-23A | 1312 | 3492 | 2990 | 6021 | 11173 | 40076 | |
| HSA-MIR-200C | 556 | 595 | 1027 | 10636 | 1478 | 33532 | |
| HSA-MIR-136 | 465 | 725 | 709 | 776 | 3100 | 8840 | |

1 LAGOS-QUINTANA ET AL., CURRENT BIOLOGY 12:735 (2002)
2 KRICHEVSKY ET AL., RNA 9:1274 (2003)
3 SEMPERE ET AL., GENOME BIOLOGY 5:R13 (2004)

FIG. 19A

5'UTR SEQUENCE (5' TO 3') OF HIV-1 (U5-R)

GGTCTCTCTGGTTAGACCAGATCTCTGAGCCTGGGAGCTCTCTGGCTAACT
AGGGAACCCACTGCTTAAGCCTCAATAAAGCTTGCCTTGAGTGCTTCAAGTA
GTGTGTGCCCGTCTGTTGTGTGACTCTGGTAACTAGAGATCCCTCAGACCCTT
TTAGTCAGTGTGGAAAATCTCTAGCAGTGGCGCCCGAACAGGGACCTGAAAG
CGAAAGGGAAACCAGAGGAGCTCTCTCGA**CGCAGGACTCGGCTTGCTGAA
GCGCGCACGGCAAGAGGCGAGGGGCGG**GCGACTGGTGAGTACGCCAAAAA
TTTTGACTAGCGGAGGCTAGAAGGAGAGAG

FIG. 19B

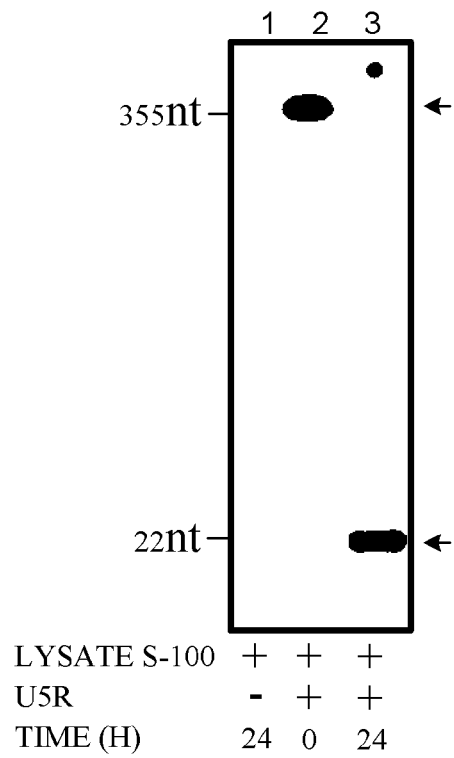

LYSATE S-100   +   +   +
U5R            −   +   +
TIME (H)      24   0  24

FIG. 19C

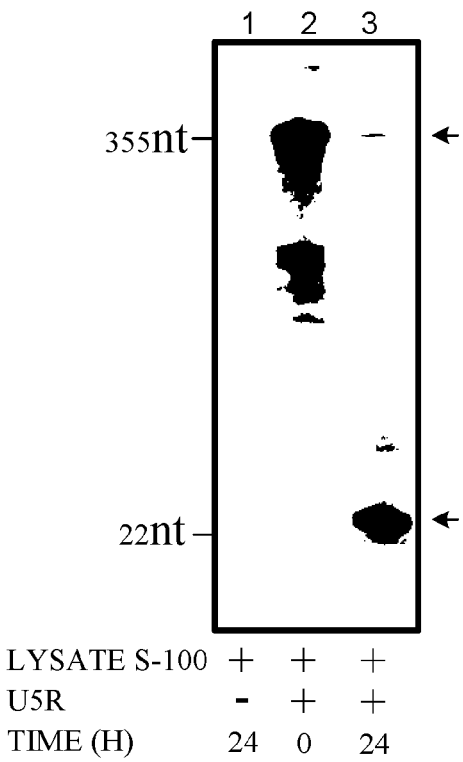

LYSATE S-100   +   +   +
U5R            −   +   +
TIME (H)      24   0  24

FIG. 21B

| R O W | PRIMER SEQUENCE | SEQ ID NO | SEQUENCED PRIMER | SEQ ID NO | GAM RNA SEQUENCE | SEQ ID NO | GAM PRECURSOR SEQUENCE | SEQ ID NO | CHR | STRAND | START OFFSET |
|---|---|---|---|---|---|---|---|---|---|---|---|
| 1 | GGAAAGAAT | 4205051 | GGAAAGAATG TGGGTGCA | 4205059 | GGAAAGGAAA GTGGGTGCAC | 4205067 | GACAGTGGCAATGGGGAAAGGAAAGTGG GTGCACTCAAGCTGCTGGCAGAAGTCAGCTAG GCAAGATGTGTAACTGGTTCAACTTCTGC ATAGAGGAGAATGTAGGTCCTTTCCATTCT AATATAGATGTTC | 4205075 | 11 | + | 6527398 |
| 2 | GCAAGCGGCG | 4205052 | GCAAGAGGCG AGAAGCAGA | 4205060 | GCAAGAGTGA GAAGCAGA | 4205068 | CCCAGGTTCTGCAAGAGTGAGAAGCAGAA AGCCTACTTTGCGTTGCCTCTACCTGAGGA GAAGAAGCCAGGTGTGCTCTCAGATGGTC GGGGTAGTGCTTGGG | 4205076 | 20 | + | 10164522 |
| 3 | GGAAAGAAT | 4205053 | GGAAAGAATT AATGTGAG | 4205061 | GGAAAGGATA ATGTGAG | 4205069 | ATTCTTCATGTTTGGCTAAAAGAGACTCCA ACTGCTTGGCCTCTTTCTGAACCTACTATT AAGAGGAAAGGATAATGTAGGCAGGCTA GTATGGACCTGTTTACTCCGATTTCATCAA ATGGAGCTT | 4205077 | 21 | + | 24398831 |
| 4 | GGAAAGAAT | 4205054 | GGAAAGAATT AATGTGAA | 4205062 | GGAAAGATAA TGTGAA | 4205070 | GCTAGAGAGTTGAGACCGAGTGAAGGCCA CACCTCCGAGGGAAAGATAATGTGAAGG CTCTCCCACTGACATGTCACATGCTTTCT ACTTGACTGGGCTTCCCTAAACTTGGGTAA TTTTTCAGC | 4205078 | 6 | + | 50974009 |
| 5 | CTTTTTGCCTG | 4205055 | CTTTTTGCCTG GGCAGGGC | 4205063 | CTTTTTGCAGG GCAGGGC | 4205071 | CCTTCTCAACTTCAGTCCTTTTTGCAGGGC AGGGCTTACTCAGGAAACTTATTGCAAG GTAAGTCAAGTTCCTTAAGGTCTGGCCACT CAGAG | 4205079 | 5 | - | 65170275 |
| 6 | CTCTCTGT | 4205056 | CTCTCTGGTT AGTACTTGGA | 4205064 | CTAGTCTGGTT AGTACTTGGA | 4205072 | AGGGTCTAGTCTGGTTAGTACTTGATGA GAGAGACCAAATAGCAAATACTTAAAATG TCTTTTCTAAGGAAATTAAATTGGCTCCT | 4205080 | 11 | + | 88695685 |
| 7 | GCAAGAGGCG | 4205057 | GCAAGAGGCG AGAAGCAGT | 4205065 | GCAGAGGCAG AAGCAGT | 4205073 | TCTTGCCTTGCAACTGTCCATAAAATCTGCCC TGGCTTTCTGCCTGACTGCACACTAAGAAT CATGCACAGAAAGCAGAGGCAGAAGCAG TGATTGGTAAGG | 4205081 | 1 | + | 193722202 |
| 8 | CTCTCTGGTTA | 4205058 | CTCTCTGGTT AGTAATAGG | 4205066 | CTCTCTGGAGA GTAATAGG | 4205074 | CTTTGAGAAAAAGAGGCTTGTTATATTCC AAGCATGAGATGATTATTAGAAACACTTA TTTTCTGTTTCTCTCTGGAGGTAATAGGCA TAACCCCTTATCAGGG | 4205082 | 2 | - | 240247210 |

BIOINFORMATICALLY DETECTABLE GROUP OF NOVEL REGULATORY VIRAL AND VIRAL ASSOCIATED OLIGONUCLEOTIDES AND USES THEREOF

CROSS REFERENCE TO RELATED APPLICATIONS

This application claims the benefit of U.S. Provisional Application No. 60/521,433, filed Apr. 26, 2004, and this application is a continuation-in-part of U.S. application Ser. No. 10/708,952, filed Apr. 2, 2004, now abandoned which is a continuation-in-part of International Application No. PCT/IL03/00998, filed Nov. 26, 2003, which is a continuation-in-part of U.S. application Ser. No. 10/707,003, filed Oct. 30, 2003, now abandoned which is a continuation of U.S. application Ser. No. 10/604,984, filed Aug. 29, 2003, which claims the benefit of U.S. Provisional Application No. 60/457,788, filed Mar. 27, 2003, and U.S. application Ser. No. 10/707,003 is a continuation-in-part of U.S. application Ser. No. 10/605,838, filed Oct. 30, 2003, now abandoned which is a continuation of U.S. application Ser. No. 10/604,944, filed Aug. 28, 2003, now U.S Pat. No. 7,217,807 which claims the benefit of U.S. Provisional Application No. 60/441,230 filed Jan. 16, 2003, and U.S. application Ser. No. 10/605,838 is a continuation of U.S. application Ser. No. 10/605,840, filed Oct. 30, 2003, now abandoned which is a continuation of U.S. application Ser. No. 10/604,943, filed Aug. 28, 2003, which claims the benefit of U.S. Provisional Application No. 60/441,241, filed Jan. 17, 2003, and U.S. application Ser. No. 10/604,943 is a continuation-in-part of U.S. application Ser. No. 10/604, 942, filed Aug. 28, 2003, which is a continuation of U.S. application Ser. No. 10/310,188, filed Dec. 5, 2002, now abandoned and U.S. application Ser. No. 10/604,942 is a continuation-in-part of U.S. application Ser. No. 10/604,945, filed Aug. 27, 2003, which is a continuation of U.S. application Ser. No. 10/303,778 filed Nov. 26, 2002 now abandoned.

REFERENCES CITED

Altschul, S. F., Gish, W., Miller, W., Myers, E. W., and Lipman, D. J. (1990). Basic local alignment search tool. J. Mol. Biol. 215, 403-410.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth, J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Krichevsky, A. M., King, K. S., Donahue, C. P., Khrapko, K., and Kosik, K. S. (2003). A microRNA array reveals extensive regulation of microRNAs during brain development. RNA. 9, 1274-1281.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in *Caenorhabditis elegans*. Science 294, 858-862.

Lockhart, D. J., Dong, H., Byrne, M. C., Follettie, M. T., Gallo, M. V., Chee, M. S., Mittmann, M., Wang, C., Kobayashi, M., Horton, H., and Brown, E. L. (1996). Expression monitoring by hybridization to high-density oligonucleotide arrays. Nat. Biotechnol. 14, 1675-1680.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger J. C., Rougvie, A. E., Horvitz, H. R., and Ruvkun, G. (2000). The 21-nucleotide let-7 RNA regulates developmental timing in *Caenorhabditis elegans*. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in *C. elegans*. Cell 75, 855-862.

BACKGROUND OF THE INVENTION

1. Field of the Invention

The present invention relates to a group of bioinformatically detectable novel viral oligonucleotides and to a group of bioinformatically detectable novel human oligonucleotides associated with viral infections, both are identified here as "Genomic Address Messenger" (GAM) oligonucleotides.

All of abovementioned oligonucleotides are believed to be related to the microRNA (miRNA) group of oligonucleotides.

2. Description of Prior Art miRNA oligonucleotides are short ~22 nucleotide (nt)-long, non-coding, regulatory RNA oligonucleotides that are found in a wide range of species. miRNA oligonucleotides are believed to function as specific gene translation repressors and are sometimes involved in cell differentiation.

The ability to detect novel miRNA oligonucleotides is limited by the methodologies used to detect such oligonucleotides. All miRNA oligonucleotides identified so far either present a visibly discernable whole body phenotype, as do Lin-4 and Let-7 (Wightman, B., Ha, I., and Ruvkun, G., Cell 75: 855-862 (1993); Reinhart et al. Nature 403: 901-906 (2000)), or produce sufficient quantities of RNA so as to be detected by standard molecular biological techniques.

Ninety-three miRNA oligonucleotides have been discovered in several species (Lau et al., Science 294: 858-862 (2001), Lagos-Quintana et al., Science 294: 853-858 (2001)) by sequencing a limited number of clones (300 by Lau and 100 by Lagos-Quintana) of size-fractionated small segments of RNA. miRNAs that were detected in these studies therefore represent the more prevalent among the miRNA oligonucleotide family and cannot be much rarer than 1% of all small ~20 nt-long RNA oligonucleotides.

The aforementioned studies provide no basis for the detection of miRNA oligonucleotides which either do not present a visually discernable whole body phenotype, or are rare (e.g. rarer than 0.1% of all of the size-fractionated, ~20 nt-long RNA segments that were expressed in the tissues examined), and therefore do not produce large enough quantities of RNA to be detected by standard biological techniques.

To date, miRNA oligonucleotides have not been detected in viruses.

The following U.S. patents relate to bioinformatic detection of genes: U.S. Pat. No. 348,935, entitled "Statistical algorithms for folding and target accessibility prediction and design of nucleic acids", U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, TABLES AND COMPUTER PROGRAM LISTING

A sequence listing is attached to the present invention, comprising 4,204,915 genomic sequences, is contained in a file named SEQ_LIST.txt (622912 KB, 25-May-04), and is hereby incorporated by reference herein.

Tables relating to genomic sequences are attached to the present application, appear in the following files (size, creation date) included on CD, incorporated herein: TABLE_1.txt (113 MB, 24-May-04), TABLE_2A.txt (619 MB, 25-May-04), TABLE_2B.txt (515 MB, 25-May-04), TABLE_3.txt (19.4 MB, 24-May-04), TABLE_4.txt (56.2 MB, 24-May-04), TABLE_5.txt (12.1 MB, 24-May-04), TABLE_6.txt (377 MB, 24-May-04), TABLE_7.txt (587 MB, 24-May-04), TABLE_8_A.txt (619 MB, 24-May-04), TABLE_8_B.txt (619 MB, 24-May-04), TABLE_8_C.txt (583 MB, 24-May-04), TABLE_9.txt (3.64 MB, 24-May-04), TABLE_10.txt (98.5 MB, 24-May-04), and TABLE_11.txt (79.8 MB, 25-May-04), all of which are incorporated by reference herein. Further, additional tables relating to genomic sequences are attached to the present application, appear in the following files (size, creation date) attached to the application, incorporated herein: TABLE_12.txt (188 KB, 25-May-04), TABLE_13.txt (140 KB, 25-May-04) and TABLE_14.txt (39 KB, 25-May-04) are incorporated by reference herein.

means of complementary hybridization to binding sites in untranslated regions of these human target genes. It is believed that this novel group of viral oligonucleotides represents a pervasive viral mechanism of attacking hosts, and therefore knowledge of this novel group of viral oligonucleotides may be useful in preventing and treating viral diseases.

Additionally, the present invention relates to a novel group of 6272 bioinformatically detectable human regulatory RNA oligonucleotides, which repress expression of viral target genes, by means of complementary hybridization to binding sites in untranslated regions of these viral target genes. It is believed that this novel group of human oligonucleotides represents a pervasive novel anti-viral host defense mechanism, and therefore knowledge of this novel group of human oligonucleotides may be useful in preventing and treating viral diseases.

Furthermore, the present invention relates to a novel group of 104,504 bioinformatically detectable human regulatory RNA oligonucleotides, which repress expression of human target genes associated with viral diseases, by means of complementary hybridization to binding sites in untranslated regions of these human target genes. It is believed that this novel group of human oligonucleotides represents a pervasive novel host response mechanism, and therefore knowledge of this novel group of human oligonucleotides may be useful in preventing and treating viral diseases.

Additionally, the present invention relates to a novel group of 1,406 bioinformatically detectable viral regulatory RNA oligonucleotides, which repress expression of viral target genes, by means of complementary hybridization to binding sites in untranslated regions of these viral target genes. It is believed that this novel group of viral oligonucleotides represents a pervasive novel internal viral regulation mechanism, and therefore knowledge of this novel group of viral oligonucleotides may be useful in preventing and treating viral diseases.

LENGTHY TABLES

The patent contains a lengthy table section. A copy of the table is available in electronic form from the USPTO web site (http://seqdata.uspto.gov/?pageRequest=docDetail&DocID=US07777022B2). An electronic copy of the table will also be available from the USPTO upon request and payment of the fee set forth in 37 CFR 1.19(b)(3).

A computer program listing constructed and operative in accordance with a preferred embodiment of the present invention is enclosed on an electronic medium in computer readable form, and is hereby incorporated by reference herein. The computer program listing is contained in 7 files, the name, sizes and creation date of which are as follows: AUXILARY_FILES.txt (117K, 14-Nov.-03); EDIT_DISTANCE.txt (144K, 24-Nov-03); FIRST-K.txt (96K, 24-Nov-03); HAIRPIN_PREDICTION.txt (19K, 25-Mar-04); TWO_PHASED_SIDE_SELECTOR.txt (4K, 14-Nov-03); TWO_PHASED_PREDICTOR.txt (74K, 14-Nov-03), and BS_CODE.txt (118K, 11-May-04).

SUMMARY OF THE INVENTION

The present invention relates to a novel group of 659 bioinformatically detectable viral regulatory RNA oligonucleotides, which repress expression of human target genes, by Also disclosed are 190 novel microRNA-cluster like viral polynucleotides and 14,813 novel microRNA-cluster like human polynucleotides, both referred to here as Genomic Record (GR) polynucleotides.

In various preferred embodiments, the present invention seeks to provide improved method and system for detection and prevention of viral diseases, which are mediated by the abovementioned groups of novel oligonucleotides.

Accordingly, the invention provides several substantially pure nucleic acids (e.g., genomic DNA, cDNA or synthetic DNA) each comprising a novel GAM oligonucleotide, vectors comprising the DNAs, probes comprising the DNAs, a method and system for selectively modulating translation of known target genes utilizing the vectors, and a method and system utilizing the GAM probes to modulate expression of target genes.

The present invention represents a scientific breakthrough, disclosing novel miRNA-like oligonucleotides the number of which is dramatically larger than previously believed existed. Prior-art studies reporting miRNA oligonucleotides ((Lau et al., Science 294:858-862 (2001), Lagos-Quintana et al., Science 294: 853-858 (2001)) discovered 93 miRNA oligonucleotides in several species, including 21 in human, using conventional molecular biology methods, such as cloning and sequencing.

BRIEF DESCRIPTION OF SEQUENCE LISTING APPENDIX

Reference is made to the appendix submitted herein. The appendix contains the following: Sequence_001.txt (25,165,878 kb); Sequence_002.txt (25,165,824 kb); Sequence_003.txt (25,165,824 kb); Sequence_004.txt (25,165,824 kb); Sequence_005.txt (25,165,824 kb); Sequence_006.txt (25,165,824 kb); Sequence_007.txt (25,165,824 kb); Sequence_008.txt (25,165,824 kb); Sequence_009.txt (25,165,824 kb); Sequence_010.txt (25,165,824 kb); Sequence_011.txt (25,165,824 kb); Sequence_012.txt (25,165,824 kb); Sequence_013.txt (25,165,824 kb); Sequence_014.txt (25,165,824 kb); Sequence_015.txt (25,165,824 kb); Sequence_016.txt (25,165,824 kb); Sequence_017.txt (25,165,824 kb); Sequence_018.txt (25,165,824 kb); Sequence_019.txt (25,165,824 kb); Sequence_020.txt (25,165,824 kb); Sequence_021.txt (25,165,824 kb); Sequence_022.txt (25,165,824 kb); Sequence_023.txt (25,165,824 kb); Sequence_024.txt (25,165,824 kb); Sequence_025.txt (25,165,824 kb); and Sequence_026.txt (8,761,241 kb), all of which were created on Jan. 1, 2006, which together are a sequence listing in accordance with 37 C.F.R. §§1.821-1.825, the contents of which are incorporated by reference herein.

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size-fractionated) of RNA. miRNA oligonucleotides detected in these studies therefore, represent the more prevalent among the miRNA oligonucleotide family, and are typically not be much rarer than 1% of all small ~20 nt-long RNA oligonucleotides present in the tissue from the RNA was extracted.

Recent studies state the number of miRNA oligonucleotides to be limited, and describe the limited sensitivity of available methods for detection of miRNA oligonucleotides: "The estimate of 255 human miRNA oligonucleotides is an upper bound implying that no more than 40 miRNA oligonucleotides remain to be identified in mammals" (Lim et al., Science, 299:1540 (2003)); "Estimates place the total number of vertebrate miRNA genes at about 200-250" (Ambros et al. Curr. Biol. 13:807-818 (2003)); and "Confirmation of very low abundance miRNAs awaits the application of detection methods more sensitive than Northern blots" (Ambros et al. Curr. Biol. 13:807-818 (2003)).

The oligonucleotides of the present invention represent a revolutionary new dimension of genomics and of biology: a dimension comprising a huge number of non-protein-coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein-coding regions of the genome, holding non-protein-coding regions to be of little consequence, often dubbing them "junk DNA".

Indeed, only in November, 2003 has this long held belief as to the low importance of non-protein-coding regions been vocally challenged. As an example, an article titled "The Unseen Genome—Gems in the Junk" (Gibbs, W. W. Sci. Am. 289:46-53 (2003)) asserts that the failure to recognize the importance of non-protein-coding regions "may well go down as one of the biggest mistakes in the history of molecular biology." Gibbs further asserts that "what was damned as junk because it was not understood, may in fact turn out to be the very basis of human complexity." The present invention provides a dramatic leap in understanding specific important roles of non-protein-coding regions.

An additional scientific breakthrough of the present invention is a novel conceptual model disclosed by the present invention, which conceptual model is preferably used to encode in a genome the determination of cell differentiation, utilizing oligonucleotides and polynucleotides of the present invention.

Using the bioinformatic engine of the present invention, 1,655 viral GAM oligonucleotides and their respective precursors and targets have been detected and 105,537 human GAM oligonucleotides and their respective precursors and targets have been detected. These bioinformatic predictions are supported by robust biological studies. These bioinformatic predictions are supported by robust biological studies. Microarray experiments validated expression of 1,637 of the human GAM oligonucleotides of the present invention. Of these, 938 received an extremely high score: over six standard deviations higher than the background "noise" of the microarray, and over two standard deviations above their individual "mismatch" control probes and 69 received a high score: over four standard deviations higher than the background "noise" of the microarray. Further, 38 GAM oligonucleotides were sequenced.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases, the target genes may be known and fully characterized, however in alternative embodiments of the present invention, unknown or less well characterized genes may be targeted.

A "Nucleic acid" is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides.

"Substantially pure nucleic acid", "Isolated Nucleic Acid", "Isolated Oligoucleotide" and "Isolated Polynucleotide" are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids.

An "Oligonucleotide" is defined as a nucleic acid comprising 2-139 nts, or preferably 16-120 nts. A "Polynucleotide" is defined as a nucleic acid comprising 140-5000 nts, or preferably 140-1000 nts.

A "Complementary" sequence is defined as a first nucleotide sequence which reverses complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

"Hybridization", "Binding" and "Annealing" are defined as hybridization, under in vivo physiological conditions, of a first nucleic acid to a second nucleic acid, which second nucleic acid is at least partially complementary to the first nucleic acid.

A "Hairpin Structure" is defined as an oligonucleotide having a nucleotide sequence that is 50-140 nts in length, the first half of which nucleotide sequence is at least partially complementary to the second part thereof, thereby causing the nucleic acid to fold onto itself, forming a secondary hairpin structure.

A "Hairpin-Shaped Precursor" is defined as a Hairpin Structure which is processed by a Dicer enzyme complex, yielding an oligonucleotide which is about 19 to about 24 nts in length.

"Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin-shaped precursor yielding an oligonucleotide that is approximately 22 nt in length; (4) the oligonucleotide binds complementarily to at least one binding site, having a nucleotide sequence that is at least partially complementary to the oligonucleotide, which binding site is located in the mRNA of a target gene, preferably in the untranslated region (UTR) of a target gene, such that the binding inhibits translation of the target protein.

A "Translation inhibitor site" is defined as the minimal nucleotide sequence sufficient to inhibit translation.

The present invention describes novel GAM oligonucleotides, detected using a bioinformatic engine described hereinabove. The ability of this detection engine has been demonstrated using stringent algorithmic criteria, showing that the engine has both high sensitivity, indicated by the high detection rate of published miRNA oligonucleotides and their targets, as well as high specificity, indicated by the low amount of "background" hairpin candidates passing its filters. Laboratory tests, based both on sequencing of predicted GAM oligonucleotides and on microarray experiments, validated 1672 of the GAM oligonucleotides in the present invention. Further, almost all of the viral target genes (2,055 of the 2,195) and almost all of the human target genes (588 out of 657) described in the present invention are bound by one or more of the 1672 human GAM oligonucleotides validated by the microarray experiments.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOs: 1-1672 and 1673-119264.

There is further provided in accordance with another preferred embodiment of the present invention a bioinformatically detectable isolated oligonucleotide having a nucleotide sequence selected from the group consisting of SEQ ID NOs: 1-1672 and 1673-119264.

There is still further provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-1672 and 1673-119264.

There is additionally provided in accordance with another preferred embodiment of the present invention a bioinformatically detectable oligonucleotide having a nucleotide sequence selected from the group consisting of SEQ ID NOs: 3362235-4097720.

There is moreover provided in accordance with another preferred embodiment of the present invention a bioinformatically detectable isolated oligonucleotide which anneals to a portion of a mRNA transcript of a target gene associated with B19 virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 2.

There is further provided in accordance with another preferred embodiment of the present invention a bioinformatically detectable isolated oligonucleotide which anneals to a portion of a mRNA transcript of a target gene associated with Barmah Forest virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 3.

There is still further provided in accordance with another preferred embodiment of the present invention a bioinformatically detectable isolated oligonucleotide which anneals to a portion of a mRNA transcript of a target gene associated with BK polyomavirus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 4.

There is additionally provided in accordance with another preferred embodiment of the present invention a bioinformatically detectable isolated oligonucleotide which anneals to a portion of a mRNA transcript of a target gene associated with Bunyamwera virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 5.

There is moreover provided in accordance with another preferred embodiment of the present invention a bioinformatically detectable isolated oligonucleotide which anneals to a portion of a mRNA transcript of a target gene associated with Colorado tick fever virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 6.

There is further provided in accordance with another preferred embodiment of the present invention a bioinformatically detectable isolated oligonucleotide which anneals to a portion of a mRNA transcript of a target gene associated with Crimean-Congo hemorrhagic fever virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 7.

There is still further provided in accordance with another preferred embodiment of the present invention a bioinformatically detectable isolated oligonucleotide which anneals to a portion of a mRNA transcript of a target gene associated with Dengue virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 8.

There is additionally provided in accordance with another preferred embodiment of the present invention a bioinformatically detectable isolated oligonucleotide which anneals to a portion of a mRNA transcript of a target gene associated with Dobrava virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 9.

There is moreover provided in accordance with another preferred embodiment of the present invention a bioinformatically detectable isolated oligonucleotide which anneals to a portion of a mRNA transcript of a target gene associated with Eastern equine encephalitis virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 10.

There is further provided in accordance with another preferred embodiment of the present invention a bioinformatically detectable isolated oligonucleotide which anneals to a portion of a mRNA transcript of a target gene associated with Hepatitis A virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 11.

There is still further provided in accordance with another preferred embodiment of the present invention a bioinformatically detectable isolated oligonucleotide which anneals to a portion of a mRNA transcript of a target gene associated with Hepatitis B virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 12.

There is additionally provided in accordance with another preferred embodiment of the present invention a bioinformatically detectable isolated oligonucleotide which anneals to a portion of a mRNA transcript of a target gene associated with Hepatitis C virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 13.

There is moreover provided in accordance with another preferred embodiment of the present invention a bioinformatically detectable isolated oligonucleotide which anneals to a portion of a mRNA transcript of a target gene associated with Hepatitis D virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 14.

There is further provided in accordance with another preferred embodiment of the present invention a bioinformatically detectable isolated oligonucleotide which anneals to a portion of a mRNA transcript of a target gene associated with Hepatitis E virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 15.

There is still further provided in accordance with another preferred embodiment of the present invention a bioinformatically detectable isolated oligonucleotide which anneals to a portion of a mRNA transcript of a target gene associated with Human adenovirus A infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 16.

There is additionally provided in accordance with another preferred embodiment of the present invention a bioinformatically detectable isolated oligonucleotide which anneals to a portion of a mRNA transcript of a target gene associated with Human adenovirus B (HAdV-B) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 17.

There is moreover provided in accordance with another preferred embodiment of the present invention a bioinformatically detectable isolated oligonucleotide which anneals to a portion of a mRNA transcript of a target gene associated with Human adenovirus C infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 18.

There is further provided in accordance with another preferred embodiment of the present invention a bioinformatically detectable isolated oligonucleotide which anneals to a portion of a mRNA transcript of a target gene associated with Human adenovirus D infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 19.

There is still further provided in accordance with another preferred embodiment of the present invention a bioinformatically detectable isolated oligonucleotide which anneals to a portion of a mRNA transcript of a target gene associated with Human adenovirus E infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 20.

There is additionally provided in accordance with another preferred embodiment of the present invention a bioinformatically detectable isolated oligonucleotide which anneals to a portion of a mRNA transcript of a target gene associated with Human adenovirus F infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 21.

There is moreover provided in accordance with another preferred embodiment of the present invention a bioinformatically detectable isolated oligonucleotide which anneals to a portion of a mRNA transcript of a target gene associated with Human astrovirus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 22.

There is further provided in accordance with another preferred embodiment of the present invention a bioinformatically detectable isolated oligonucleotide which anneals to a portion of a mRNA transcript of a target gene associated with Human coronavirus 229E infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 23.

There is still further provided in accordance with another preferred embodiment of the present invention a bioinformatically detectable isolated oligonucleotide which anneals to a portion of a mRNA transcript of a target gene associated with Human coronavirus OC43 (HCoV-OC43) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 24.

There is additionally provided in accordance with another preferred embodiment of the present invention a bioinformatically detectable isolated oligonucleotide which anneals to a portion of a mRNA transcript of a target gene associated with Human echovirus 1 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 25.

There is moreover provided in accordance with another preferred embodiment of the present invention a bioinformatically detectable isolated oligonucleotide which anneals to a portion of a mRNA transcript of a target gene associated with Human enterovirus A infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 26.

There is further provided in accordance with another preferred embodiment of the present invention a bioinformatically detectable isolated oligonucleotide which anneals to a portion of a mRNA transcript of a target gene associated with Human enterovirus B infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 27.

There is still further provided in accordance with another preferred embodiment of the present invention a bioinformatically detectable isolated oligonucleotide which anneals to a portion of a mRNA transcript of a target gene associated with Human enterovirus C infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 28.

There is additionally provided in accordance with another preferred embodiment of the present invention a bioinformatically detectable isolated oligonucleotide which anneals to a portion of a mRNA transcript of a target gene associated with Human enterovirus D infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 29.

There is moreover provided in accordance with another preferred embodiment of the present invention a bioinformatically detectable isolated oligonucleotide which anneals to a portion of a mRNA transcript of a target gene associated with Human enterovirus E infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 30.

There is further provided in accordance with another preferred embodiment of the present invention a bioinformatically detectable isolated oligonucleotide which anneals to a portion of a mRNA transcript of a target gene associated with Human erythrovirus V9 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 31.

There is still further provided in accordance with another preferred embodiment of the present invention a bioinformatically detectable isolated oligonucleotide which anneals to a portion of a mRNA transcript of a target gene associated with Human herpesvirus 1 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 32.

There is additionally provided in accordance with another preferred embodiment of the present invention a bioinformatically detectable isolated oligonucleotide which anneals to a portion of a mRNA transcript of a target gene associated with Human herpesvirus 10 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 33.

There is moreover provided in accordance with another preferred embodiment of the present invention a bioinformatically detectable isolated oligonucleotide which anneals to a portion of a mRNA transcript of a target gene associated with Human herpesvirus 2 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 34.

There is further provided in accordance with another preferred embodiment of the present invention a bioinformatically detectable isolated oligonucleotide which anneals to a portion of a mRNA transcript of a target gene associated with Human herpesvirus 3 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 35.

There is still further provided in accordance with another preferred embodiment of the present invention a bioinformatically detectable isolated oligonucleotide which anneals to a portion of a mRNA transcript of a target gene associated with Human herpesvirus 4 (Epstein-Barr virus) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 36.

There is additionally provided in accordance with another preferred embodiment of the present invention a bioinformatically detectable isolated oligonucleotide which anneals to a portion of a mRNA transcript of a target gene associated with Human herpesvirus 5 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 37.

There is moreover provided in accordance with another preferred embodiment of the present invention a bioinformatically detectable isolated oligonucleotide which anneals to a portion of a mRNA transcript of a target gene associated with Human herpesvirus 6 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 38.

There is further provided in accordance with another preferred embodiment of the present invention a bioinformatically detectable isolated oligonucleotide which anneals to a portion of a mRNA transcript of a target gene associated with Human herpesvirus 6B infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 39.

There is still further provided in accordance with another preferred embodiment of the present invention a bioinformatically detectable isolated oligonucleotide which anneals to a portion of a mRNA transcript of a target gene associated with Human herpesvirus 7 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 40.

There is additionally provided in accordance with another preferred embodiment of the present invention a bioinformatically detectable isolated oligonucleotide which anneals to a portion of a mRNA transcript of a target gene associated with Human herpesvirus 9 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 41.

There is moreover provided in accordance with another preferred embodiment of the present invention a bioinformatically detectable isolated oligonucleotide which anneals to a portion of a mRNA transcript of a target gene associated with Human immunodeficiency virus 1 (HIV-1) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 42.

There is further provided in accordance with another preferred embodiment of the present invention a bioinformatically detectable isolated oligonucleotide which anneals to a portion of a mRNA transcript of a target gene associated with Human immunodeficiency virus 2 (HIV-2) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 43.

There is still further provided in accordance with another preferred embodiment of the present invention a bioinformatically detectable isolated oligonucleotide which anneals to a portion of a mRNA transcript of a target gene associated with Human metapneumovirus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 44.

There is additionally provided in accordance with another preferred embodiment of the present invention a bioinformatically detectable isolated oligonucleotide which anneals to a portion of a mRNA transcript of a target gene associated with Human papillomavirus type 11 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 45.

There is moreover provided in accordance with another preferred embodiment of the present invention a bioinformatically detectable isolated oligonucleotide which anneals to a portion of a mRNA transcript of a target gene associated with Human papillomavirus type 16 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 46.

There is further provided in accordance with another preferred embodiment of the present invention a bioinformatically detectable isolated oligonucleotide which anneals to a portion of a mRNA transcript of a target gene associated with Human papillomavirus type 17 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 47.

There is still further provided in accordance with another preferred embodiment of the present invention a bioinformatically detectable isolated oligonucleotide which anneals to a portion of a mRNA transcript of a target gene associated with Human papillomavirus type 18 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 48.

There is additionally provided in accordance with another preferred embodiment of the present invention a bioinformatically detectable isolated oligonucleotide which anneals to a portion of a mRNA transcript of a target gene associated with Human papillomavirus type 18, complete genome infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 49.

There is moreover provided in accordance with another preferred embodiment of the present invention a bioinformatically detectable isolated oligonucleotide which anneals to a portion of a mRNA transcript of a target gene associated with Human papillomavirus type 19 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 50.

There is further provided in accordance with another preferred embodiment of the present invention a bioinformatically detectable isolated oligonucleotide which anneals to a portion of a mRNA transcript of a target gene associated with Human papillomavirus type 31 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 51.

There is still further provided in accordance with another preferred embodiment of the present invention a bioinformatically detectable isolated oligonucleotide which anneals to a portion of a mRNA transcript of a target gene associated with Human papillomavirus type 45 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 52.

There is additionally provided in accordance with another preferred embodiment of the present invention a bioinformatically detectable isolated oligonucleotide which anneals to a portion of a mRNA transcript of a target gene associated with Human papillomavirus type 5 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 53.

There is moreover provided in accordance with another preferred embodiment of the present invention a bioinformatically detectable isolated oligonucleotide which anneals to a portion of a mRNA transcript of a target gene associated with Human papillomavirus type 6 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 54.

There is further provided in accordance with another preferred embodiment of the present invention a bioinformatically detectable isolated oligonucleotide which anneals to a portion of a mRNA transcript of a target gene associated with Human papillomavirus type 8 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 55.

There is still further provided in accordance with another preferred embodiment of the present invention a bioinformatically detectable isolated oligonucleotide which anneals to a portion of a mRNA transcript of a target gene associated with Human parainfluenza virus 1 strain Washington/1964 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 56.

There is additionally provided in accordance with another preferred embodiment of the present invention a bioinformatically detectable isolated oligonucleotide which anneals to a portion of a mRNA transcript of a target gene associated with Human parainfluenza virus 2 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 57.

There is moreover provided in accordance with another preferred embodiment of the present invention a bioinformatically detectable isolated oligonucleotide which anneals to a portion of a mRNA transcript of a target gene associated with Human parainfluenza virus 3 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 58.

There is further provided in accordance with another preferred embodiment of the present invention a bioinformatically detectable isolated oligonucleotide which anneals to a portion of a mRNA transcript of a target gene associated with Human parechovirus 2 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 59.

There is still further provided in accordance with another preferred embodiment of the present invention a bioinformatically detectable isolated oligonucleotide which anneals to a portion of a mRNA transcript of a target gene associated with Human respiratory syncytial virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 60.

There is additionally provided in accordance with another preferred embodiment of the present invention a bioinformatically detectable isolated oligonucleotide which anneals to a portion of a mRNA transcript of a target gene associated with Human rhinovirus 89 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 61.

There is moreover provided in accordance with another preferred embodiment of the present invention a bioinformatically detectable isolated oligonucleotide which anneals to a portion of a mRNA transcript of a target gene associated with Human rhinovirus B infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 62.

There is further provided in accordance with another preferred embodiment of the present invention a bioinformatically detectable isolated oligonucleotide which anneals to a portion of a mRNA transcript of a target gene associated with Human T-lymphotropic virus 1 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 63.

There is still further provided in accordance with another preferred embodiment of the present invention a bioinformatically detectable isolated oligonucleotide which anneals to a portion of a mRNA transcript of a target gene associated with Human T-lymphotropic virus 2 infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 64.

There is additionally provided in accordance with another preferred embodiment of the present invention a bioinformatically detectable isolated oligonucleotide which anneals to a portion of a mRNA transcript of a target gene associated with Influenza A virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 65.

There is moreover provided in accordance with another preferred embodiment of the present invention a bioinformatically detectable isolated oligonucleotide which anneals to a portion of a mRNA transcript of a target gene associated with Influenza B virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 66.

There is further provided in accordance with another preferred embodiment of the present invention a bioinformatically detectable isolated oligonucleotide which anneals to a portion of a mRNA transcript of a target gene associated with Japanese encephalitis virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 67.

There is still further provided in accordance with another preferred embodiment of the present invention a bioinformatically detectable isolated oligonucleotide which anneals to a portion of a mRNA transcript of a target gene associated with JC virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 68.

There is additionally provided in accordance with another preferred embodiment of the present invention a bioinformatically detectable isolated oligonucleotide which anneals to a portion of a mRNA transcript of a target gene associated with Machupo virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 69.

There is moreover provided in accordance with another preferred embodiment of the present invention a bioinformatically detectable isolated oligonucleotide which anneals to a portion of a mRNA transcript of a target gene associated with Marburg virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 70.

There is further provided in accordance with another preferred embodiment of the present invention a bioinformatically detectable isolated oligonucleotide which anneals to a portion of a mRNA transcript of a target gene associated with Measles virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 71.

There is still further provided in accordance with another preferred embodiment of the present invention a bioinformatically detectable isolated oligonucleotide which anneals to a portion of a mRNA transcript of a target gene associated with Molluscum contagiosum virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 72.

There is additionally provided in accordance with another preferred embodiment of the present invention a bioinformatically detectable isolated oligonucleotide which anneals to a portion of a mRNA transcript of a target gene associated with Murray Valley encephalitis virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 73.

There is moreover provided in accordance with another preferred embodiment of the present invention a bioinformatically detectable isolated oligonucleotide which anneals to a portion of a mRNA transcript of a target gene associated with Norwalk virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 74.

There is further provided in accordance with another preferred embodiment of the present invention a bioinformatically detectable isolated oligonucleotide which anneals to a portion of a mRNA transcript of a target gene associated with Poliovirus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 75.

There is still further provided in accordance with another preferred embodiment of the present invention a bioinformatically detectable isolated oligonucleotide which anneals to a portion of a mRNA transcript of a target gene associated with Puumala virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 76.

There is additionally provided in accordance with another preferred embodiment of the present invention a bioinformatically detectable isolated oligonucleotide which anneals to a portion of a mRNA transcript of a target gene associated with Respiratory syncytial virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 77.

There is moreover provided in accordance with another preferred embodiment of the present invention a bioinformatically detectable isolated oligonucleotide which anneals to a portion of a mRNA transcript of a target gene associated with Reston Ebola virus (REBOV) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 78.

There is further provided in accordance with another preferred embodiment of the present invention a bioinformatically detectable isolated oligonucleotide which anneals to a portion of a mRNA transcript of a target gene associated with Rubella virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 79.

There is still further provided in accordance with another preferred embodiment of the present invention a bioinformatically detectable isolated oligonucleotide which anneals to a portion of a mRNA transcript of a target gene associated with SARS coronavirus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 80.

There is additionally provided in accordance with another preferred embodiment of the present invention a bioinformatically detectable isolated oligonucleotide which anneals to a portion of a mRNA transcript of a target gene associated with Seoul virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 81.

There is moreover provided in accordance with another preferred embodiment of the present invention a bioinformatically detectable isolated oligonucleotide which anneals to a portion of a mRNA transcript of a target gene associated with Sin Nombre virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 82.

There is further provided in accordance with another preferred embodiment of the present invention a bioinformatically detectable isolated oligonucleotide which anneals to a portion of a mRNA transcript of a target gene associated with Tula virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 83.

There is still further provided in accordance with another preferred embodiment of the present invention a bioinformatically detectable isolated oligonucleotide which anneals to a portion of a mRNA transcript of a target gene associated with Uukuniemi virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 84.

There is additionally provided in accordance with another preferred embodiment of the present invention a bioinformatically detectable isolated oligonucleotide which anneals to a portion of a mRNA transcript of a target gene associated with Vaccinia virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 85.

There is moreover provided in accordance with another preferred embodiment of the present invention a bioinformatically detectable isolated oligonucleotide which anneals to a portion of a mRNA transcript of a target gene associated with Variola virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 86.

There is further provided in accordance with another preferred embodiment of the present invention a bioinformatically detectable isolated oligonucleotide which anneals to a portion of a mRNA transcript of a target gene associated with West Nile virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 87.

There is still further provided in accordance with another preferred embodiment of the present invention a bioinformatically detectable isolated oligonucleotide which anneals to a portion of a mRNA transcript of a target gene associated with Western equine encephalomyelitis virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 88.

There is additionally provided in accordance with another preferred embodiment of the present invention a bioinformatically detectable isolated oligonucleotide which anneals to a portion of a mRNA transcript of a target gene associated with Yellow fever virus infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 89.

There is moreover provided in accordance with another preferred embodiment of the present invention a bioinformatically detectable isolated oligonucleotide which anneals to a portion of a mRNA transcript of a target gene associated with Zaire Ebola virus (ZEBOV) infection, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 13 row 90.

There is further provided in accordance with another preferred embodiment of the present invention a method for treatment of a disease involving a tissue in which a protein is pathologically expressed to an undesirable extent, the protein having a messenger RNA, the method including: providing a material which modulates activity of a microRNA oligonucleotide which binds complementarily to a segment of the messenger RNA, and introducing the material into the tissue, causing modulation of the activity of the microRNA oligonucleotide and thereby modulating expression of the protein in a desired manner.

There is still further provided in accordance with another preferred embodiment of the present invention a method for treatment of a disease involving tissue in which a protein is pathologically expressed to an undesirable extent, the protein having a messenger RNA, the method including: providing a material which at least partially binds a segment of the messenger RNA that is bound complementarily by a microRNA oligonucleotide, thereby modulating expression of the protein, and introducing the material into the tissue, thereby modulating expression of the protein.

There is additionally provided in accordance with another preferred embodiment of the present invention a method for treatment of a disease involving a tissue in which a protein is pathologically over-expressed, the protein having a messenger RNA, the method including: providing a microRNA oligonucleotide which binds complementarily to a segment of the messenger RNA, and introducing the microRNA oligonucleotide into the tissue, causing the microRNA oligonucleotide to bind complementarily to a segment of the messenger RNA and thereby inhibit expression of the protein.

There is moreover provided in accordance with another preferred embodiment of the present invention a method for treatment of a disease involving a tissue in which a protein is pathologically over-expressed, the protein having a messenger RNA, the method including: providing a chemically-modified microRNA oligonucleotide which binds complementarily to a segment of the messenger RNA, and introducing the chemically-modified microRNA oligonucleotide into the tissue, causing the microRNA oligonucleotide to bind complementarily to a segment of the messenger RNA and thereby inhibit expression of the protein.

There is further provided in accordance with another preferred embodiment of the present invention a method for treatment of a disease involving a tissue in which a protein is pathologically under-expressed, the protein having a messenger RNA, the method including: providing an oligonucleotide that inhibits activity of a microRNA oligonucleotide which binds complementarily to a segment of the messenger RNA, and introducing the oligonucleotide into the tissue, causing inhibition of the activity of the microRNA oligonucleotide and thereby promotion of translation of the protein.

There is still further provided in accordance with another preferred embodiment of the present invention a method for treatment of a disease involving a tissue in which a protein is pathologically under-expressed, the protein having a messenger RNA, the method including: providing a chemically-modified oligonucleotide that inhibits activity of a microRNA oligonucleotide which binds complementarily to a segment of the messenger RNA, and introducing the chemically-modified oligonucleotide into the tissue, causing inhibition of the activity of the microRNA oligonucleotide and thereby promotion of translation of the protein.

There is additionally provided in accordance with another preferred embodiment of the present invention a method for diagnosis of a disease involving a tissue in which a protein is expressed to abnormal extent, the protein having a messenger RNA, the method including: assaying a microRNA oligonucleotide which at least partially binds a segment of the messenger RNA and modulates expression of the protein, thereby providing an indication of at least one parameter of the disease.

There is moreover provided in accordance with another preferred embodiment of the present invention a method for detection of expression of an oligonucleotide, the method including: determining a first nucleotide sequence of a first oligonucleotide, which first nucleotide sequence is not complementary to a genome of an organism, receiving a second nucleotide sequence of a second oligonucleotide whose expression is sought to be detected, designing a third nucleotide sequence that is complementary to the second nucleotide sequence of the second oligonucleotide, and a fourth nucleotide sequence that is complementary to a fifth nucleotide sequence which is different from the second nucleotide sequence of the second oligonucleotide by at least one nucleotide, synthesizing a first oligonucleotide probe having a sixth nucleotide sequence including the third nucleotide sequence followed by the first nucleotide sequence of the first oligonucleotide, and a second oligonucleotide probe having a seventh nucleotide sequence including the fourth nucleotide sequence followed by the first nucleotide sequence of the first oligonucleotide, locating the first oligonucleotide probe and the second oligonucleotide probe on a microarray platform, receiving an RNA test sample from at least one tissue of the organism, obtaining size-fractionated RNA from the RNA test sample, amplifying the size-fractionated RNA, hybridizing the adaptor-linked RNA with the first and second oligonucleotide probes on the microarray platform, and determining expression of the first oligonucleotide in the at least one tissue of the organism, based at least in part on the hybridizing.

There is further provided in accordance with another preferred embodiment of the present invention a bioinformatically detectable isolated polynucleotide which is endogenously processed into a plurality of hairpin-shaped precursor oligonucleotides, each of which is endogenously processed into a respective oligonucleotide, which in turn anneals to a portion of a mRNA transcript of a target gene, wherein binding of the oligonucleotide to the mRNA transcript represses expression of the target gene.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the target gene does not encode a protein.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein a function of the oligonucleotide includes modulation of cell type.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide is maternally transferred by a cell to at least one daughter cell of the cell, and a function of the oligonucleotide includes modulation of cell type of the daughter cell.

There is further provided in accordance with another preferred embodiment of the present invention a method for bioinformatic detection of microRNA oligonucleotides, the method including: bioinformatically detecting a hairpin-shaped precursor oligonucleotide, bioinformatically detecting an oligonucleotide which is endogenously processed from the hairpin-shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

BRIEF DESCRIPTION OF DRAWINGS

FIG. 13 is a summary table of laboratory results validating expression of novel human oligonucleotides detected by a bioinformatic oligonucleotide detection engine constructed and operative in accordance with a preferred embodiment of the present invention, thereby validating its efficacy;

FIG. 14A is a schematic representation of an "operon-like" cluster of novel human hairpin sequences detected by a bioinformatic oligonucleotide detection engine constructed and operative in accordance with a preferred embodiment of the present invention, and non-GAM hairpin sequences used as negative controls thereto;

FIG. 14B is a schematic representation of secondary folding of hairpins of the operon-like cluster of FIG. 14A. The hairpins shown are as follows: N2 (SEQ ID NO: 4205040), N3 (SEQ ID NO: 4205041), MIR23 (SEQ ID NO: 4205042), GAM22 (SEQ ID NO: 4205043), GAM7617 (SEQ ID NO: 4205044), N252 (SEQ ID NO: 4205045), N4 (SEQ ID NO: 4205046), N0 (SEQ ID NO: 4205047), N6 (SEQ ID NO: 4205048), MIR24 (SEQ ID NO: 4205049), and N7 (SEQ ID NO: 4205050).

FIG. 14C is a picture of laboratory results demonstrating expression of novel oligonucleotides of FIGS. 14A and 14B and lack of expression of the negative controls, thereby validating efficacy of bioinformatic detection of GAM oligonucleotides and GR polynucleotides detected by a bioinformatic oligonucleotide detection engine, constructed and operative in accordance with a preferred embodiment of the present invention;

FIG. 15A is an annotated sequence of EST72223 (SEQ ID NO: 4205035) comprising known human microRNA oligonucleotide MIR98 and novel human oligonucleotide GAM25 PRECURSOR detected by the oligonucleotide detection system of the present invention. Additionally annotated in EST72223 are the miRNA-98 hairpin in bold (SEQ ID NO: 4205036), the sequence of the mature miRNA-98 in bold and underline (SEQ ID NO: 4205037), the sequence of the GAM25 hairpin in bold (SEQ ID NO: 4205038), and the sequence of the mature miRNA of GAM25 in bold and underline (SEQ ID NO: 4205039).

FIGS. 15B, 15C and 15D are pictures of laboratory results demonstrating laboratory confirmation of expression of known human oligonucleotide MIR98 and of novel bioinformatically-detected human GAM25 RNA respectively, both of FIG. 15A, thus validating the bioinformatic oligonucleotide detection system of the present invention;

FIG. 18C is a summary table demonstrating detection of known microRNA oligonucleotides using a microarray constructed and operative in accordance with a preferred embodiment of the present invention.

FIG. 19 presents pictures of laboratory results demonstrating laboratory confirmation of "dicing" of four novel bioinformatically-detected HIV1 GAM PRECURSORSs into their corresponding mature GAM RNAs. FIG. 19A shows the sequence of HIV (U5-R) (SEQ ID NO: 4205083). Annotated in SEQ ID NO: 4205083 are: nucleotides 1-57 (SEQ ID NO: 4205084) in bold; the bold, underlined sequence of nucleotides 2-23 (SEQ ID NO: 4205085); the bold sequence of nucleotides 30-77 (SEQ ID NO: 4205086); and the bold, underlined sequence of nucleotides 60-77 (SEQ ID NO: 4205087). FIG. 19B shows an HIV TRANSCRIPT SEQUENCE (SEQ ID NO: 4205088). Annotated in SEQ ID NO: 4205088 is the underlined sequence of nucleotides 42-65 (SEQ ID NO: 4205089). Also shown in FIG. 19D is a sequence named "GAM RNA" (SEQ ID NO: 4205090).

FIG. 21B is a table of laboratory results validating expression of novel human oligonucleotides in human cells infected with HIV, that are detected by a bioinformatic oligonucleotide detection engine constructed and operative in accordance with a preferred embodiment of the present invention, thereby validating its efficacy;

BRIEF DESCRIPTION OF SEQUENCES

A Sequence Listing of genomic sequences of the present invention designated SEQ ID NO:1 through SEQ ID: 4,204,915 is attached to this application, and is hereby incorporated herein. The genomic listing comprises the following nucleotide sequences: nucleotide sequences of 1,655 viral and 105,537 human GAM precursors of respective novel oligonucleotides of the present invention; nucleotide sequences of 117,017 human and 2,246 viral GAM RNA oligonucleotides of respective novel oligonucleotides of the present invention; and nucleotide sequences of 527,821 human and 197,218 viral target gene binding sites of respective novel oligonucleotides of the present invention.

DETAILED DESCRIPTION

Figure 1:
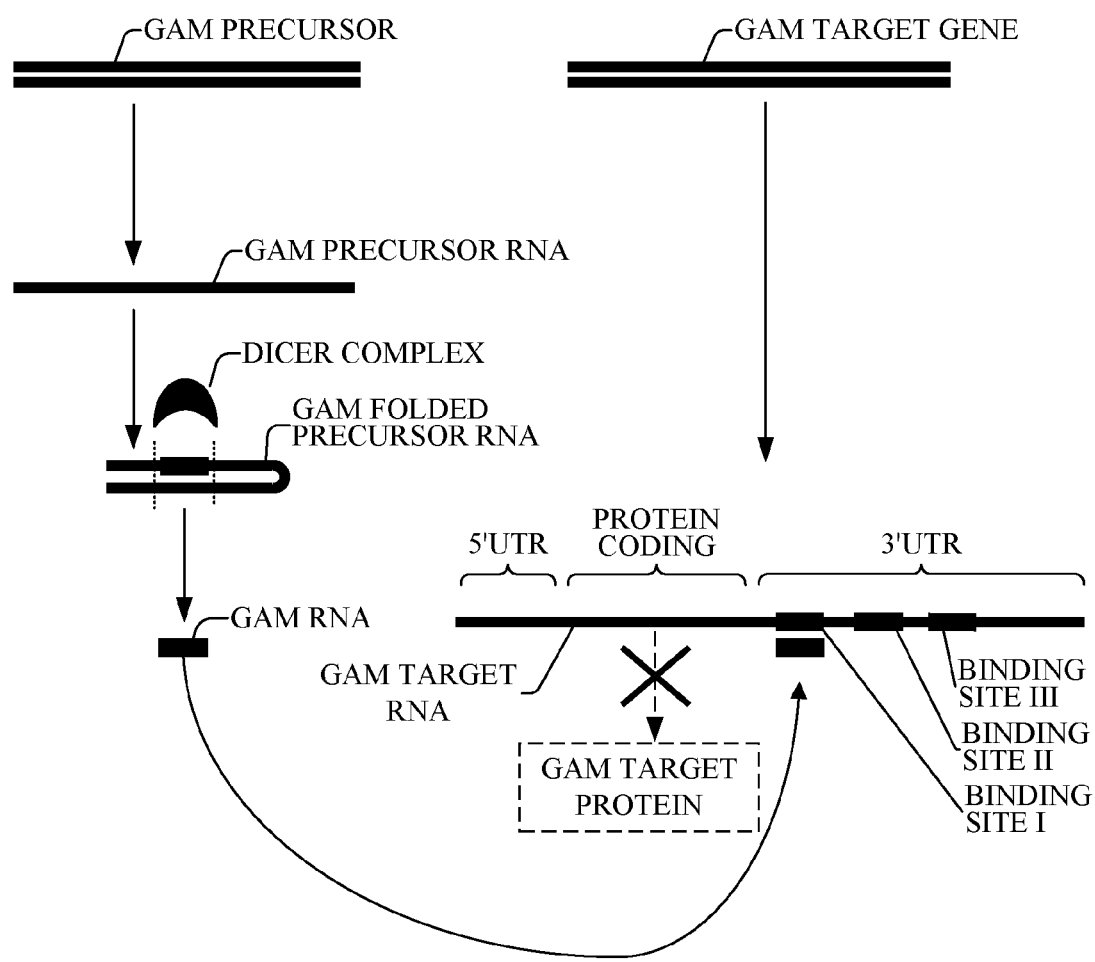
FIG. 1 is a simplified diagram illustrating a mode by which an oligonucleotide of a novel group of oligonucleotides of the present invention modulates expression of known target genes.

Reference is now made to FIG. 1, which is a simplified diagram describing a plurality of novel, bioinformatically-detected oligonucleotide of the present invention referred to here as the Genomic Address Messenger (GAM) oligonucleotide, which modulates expression of respective target genes whose function and utility are known in the art.

GAM is a novel, bioinformatically detectable, regulatory, non-protein-coding, miRNA-like oligonucleotide. The method by which GAM is detected is described with additional reference to FIGS. 1-8.

The GAM PRECURSOR is preferably encoded by a viral genome. Alternatively or additionally, the GAM PRECURSOR is encoded by the human genome. The GAM TARGET GENE is a gene encoded by the human genome. Alternatively or additionally, the GAM TARGET GENE is a gene encoded by a viral genome.

The GAM PRECURSOR encodes a GAM PRECURSOR RNA. Similar to other miRNA oligonucleotides, the GAM PRECURSOR RNA does not encode a protein.

GAM PRECURSOR RNA folds onto itself, forming GAM FOLDED PRECURSOR RNA, which has a two-dimensional "hairpin" structure. As is well-known in the art, this "hairpin structure" is typical of RNA encoded by known miRNA precursor oligonucleotides and is due to the full or partial complementarity of the nucleotide sequence of the first half of an miRNA precursor to the nucleotide sequence of the second half thereof.

A complementary sequence is a sequence which is reversed and wherein each nucleotide is replaced by a complementary nucleotide, as is well known in the art (e.g. ATGGC is the complementary sequence of GCCAT).

An enzyme complex composed of Dicer RNaseIII together with other necessary proteins, designated DICER COMPLEX, cuts the GAM FOLDED PRECURSOR RNA yielding a single-stranded, ~22 nt-long RNA segment designated GAM RNA.

GAM TARGET GENE encodes a corresponding messenger RNA, designated GAM TARGET RNA. As is typical of mRNA of a protein-coding gene, each GAM TARGET RNAs of the present invention comprises three regions: a 5' untranslated region, a protein-coding region and a 3' untranslated region, designated 5'UTR, PROTEIN-CODING and 3'UTR, respectively.

GAM RNA binds complementarily to one or more target binding sites located in the untranslated regions of each of the GAM TARGET RNAs of the present invention. This complementary binding is due to the partial or full complementarity between the nucleotide sequence of GAM RNA and the nucleotide sequence of each of the target binding sites. As an illustration, FIG. 1 shows three such target binding sites, designated BINDING SITE I, BINDING SITE II and BINDING SITE III, respectively. It is appreciated that the number of target binding sites shown in FIG. 1 is only illustrative and that any suitable number of target binding sites may be present. It is further appreciated that although FIG. 1 shows target binding sites only in the 3'UTR region, these target binding sites may instead be located in the 5'UTR region or in both the 3'UTR and 5'UTR regions.

The complementary binding of GAM RNA to target binding sites on GAM TARGET RNA, such as BINDING SITE I, BINDING SITE II and BINDING SITE III, inhibits the translation of each of the GAM TARGET RNAs of the present invention into respective GAM TARGET PROTEIN, shown surrounded by a broken line.

It is appreciated that the GAM TARGET GENE in fact represents a plurality of GAM target genes. The mRNA of each one of this plurality of GAM target genes comprises one or more target binding sites, each having a nucleotide sequence which is at least partly complementary to GAM RNA and which when bound by GAM RNA causes inhibition of translation of the GAM target mRNA into a corresponding GAM target protein.

The mechanism of the translational inhibition that is exerted by GAM RNA on one or more GAM TARGET GENEs may be similar or identical to the known mechanism of translational inhibition exerted by known miRNA oligonucleotides.

The nucleotide sequence of each of a plurality of GAM oligonucleotides that are described by FIG. 1 and their respective genomic sequences and genomic locations are set forth in Tables 1-3, hereby incorporated herein. Specifically, in Table 1, line 241237, GAM RNA (miRNA) as set forth in SEQ ID NO: 117937 is shown as predicted from human herpesvirus 5.

| GAM SEQ-ID | GAM NAME | GAM RNA SEQUENCE | GAM ORGANISM | GAM POS |
|---|---|---|---|---|
| 117937 | GAM501831 | AGTGACGGTGAGATCCAGGCTG | Human herpesvirus 5 | A |

In Table 2, lines 4474648-4474741, describes GAM PRECURSOR RNA (hairpin) as set forth in SEQ ID NO: 4204050 and as it relates to FIGS. 1-8.

| GAM NAME | GAM ORGANISM | PRECUR SEQ-ID | PRECURSOR SEQUENCE | GAM DESCRIPTION |
|---|---|---|---|---|
| GAM501831 | Human herpesvirus 5 | 4204050 | GACAGCCTCC GGATCACATG GTTACTCAGC GTCTGCCAGC CTAAGTGACG GTGAGATCCA GGCTGTC | FIG. 1 further provides a conceptual description of another novel, bioinformatically-detected viral oligonucleotide of the present invention, encoded by the Human herpesvirus 5 genome, referred to here as the Genomic Address Messenger 501831 (GAM501831) oligonucleotide, which modulates expression of respective target genes whose function and utility are known in the art. GAM501831 is a novel, bioinformatically detectable, regulatory, non-protein-coding, miRNA-like oligonucleotide. The method by which GAM501831 is detected is described with additional reference to FIGS. 1-8. |

-continued

| GAM NAME | GAM ORGANISM | PRECUR SEQ-ID | PRECURSOR SEQUENCE | GAM DESCRIPTION |
|---|---|---|---|---|
| | | | | The GAM501831 precursor, herein designated GAM PRECURSOR, is encoded by the Human herpesvirus 5 genome, which is a DNA virus. GAM501831 target gene, herein designated GAM TARGET GENE, is a target gene encoded by a target organism specified in Tables 6-7. The GAM501831 precursor, herein designated GAM PRECURSOR, encodes a GAM501831 precursor RNA, herein designated GAM PRECURSOR RNA. Similar to other miRNA oligonucleotides, the GAM501831 precursor RNA does not encode a protein. GAM501831 precursor RNA folds onto itself, forming GAM501831 folded precursor RNA, herein designated GAM FOLDED PRECURSOR RNA, which has a two-dimensional "hairpin" structure. As is well-known in the art, this "hairpin structure" is typical of RNA encoded by known miRNA precursor oligonucleotides and is due to the full or partial complementarity of the nucleotide sequence of the first half of an miRNA precursor to the nucleotide sequence of the second half thereof. A nucleotide sequence that is identical or highly similar to the nucleotide sequence of the GAM501831 precursor RNA is designated SEQ ID NO:4204050, and is provided hereinbelow with reference to the sequence listing section. The nucleotide sequence designated SEQ ID NO:4204050 is located from position 164118 to position 164184 relative to the source sequence NC_001347 (GenBank, NCBI), on the "+" strand on the genome of Human herpesvirus 5. A schematic representation of a predicted secondary folding of GAM501831 folded precursor RNA, herein designated GAM FOLDED PRECURSOR RNA is set forth in Table 4 incorporated herein. An enzyme complex composed of Dicer RNaseIII together with other necessary proteins, designated DICER COMPLEX, cuts the GAM501831 folded precursor RNA yielding a single-stranded, ~22 nt-long RNA segment designated GAM501831 RNA, herein designated GAM RNA. Table 5 provides two possible nucleotide sequences of GAM501831 RNA: a nucleotide sequence that is highly likely to be identical or extremely similar to the nucleotide sequence of GAM501831 RNA and an alternative nucleotide sequence thereof, hereby incorporated herein. GAM501831 target gene, herein designated GAM TARGET GENE, encodes a corresponding messenger RNA, designated GAM501831 target RNA, herein designated GAM TARGET RNA. As is typical of mRNA of a protein-coding gene, GAM501831 target RNA comprises three regions: a 5' untranslated region, a protein-coding region and a 3' untranslated region, designated 5'UTR, PROTEIN-CODING and 3'UTR, respectively. GAM501831 RNA, herein designated GAM RNA binds complementarily to one or more target binding sites located in the untranslated regions of GAM501831 target RNA. This complementary binding is due to the partial or full complementarity between the nucleotide sequence of GAM501831 RNA and the nucleotide sequence of each of the target binding sites. As an illustration, FIG. 1 shows three such target binding sites, designated BINDING SITE I, BINDING SITE II and BINDING SITE III, respectively. It is appreciated that the number of target binding sites shown in FIG. 1 is only illustrative and that any suitable number of target binding sites may be present. It is further appreciated that although FIG. 1 shows target binding sites only in the 3'UTR region, these target binding sites may instead be located in the 5'UTR region or in both the 3'UTR and 5'UTR regions. The complementary binding of GAM501831 RNA, herein designated GAM RNA to target binding sites on GAM501831 target RNA, herein designated GAM TARGET RNA, such as BINDING SITE I, BINDING SITE II and BINDING SITE III, inhibits the translation of GAM501831 target RNA into respective GAM501831 target protein, herein designated GAM TARGET PROTEIN, shown surrounded by a broken line. It is appreciated that the GAM501831 target gene, herein designated GAM TARGET GENE, in fact represents a plurality of GAM501831 target genes. The mRNA of each one of this plurality of GAM501831 target genes comprises one or more target binding sites, each having a nucleotide sequence which is at least partly complementary to GAM501831 RNA, herein designated GAM RNA and which when bound by GAM501831 RNA causes inhibition of translation of the GAM501831 target mRNA into a corresponding GAM501831 target protein. The mechanism of the translational inhibition that is exerted by GAM501831 RNA, herein designated GAM RNA on one or more GAM501831 target genes, herein collectively designated GAM TARGET GENE, may be similar or identical to the known mechanism of translational inhibition exerted by known miRNA oligonucleotides. The nucleotide sequence of GAM501831 precursor RNA, herein designated GAM PRECURSOR RNA, its respective genomic source and genomic location and a schematic representation of a predicted secondary folding of GAM501831 folded precursor RNA, herein designated GAM FOLDED PRECURSOR RNA are set forth in Tables 3-4, hereby incorporated herein. The nucleotide sequences of a "diced" GAM501831 RNA, herein designated GAM RNA from GAM501831 folded precursor RNA are set forth in Table 5, hereby incorporated herein. The nucleotide sequences of target binding sites, such |

-continued

| GAM NAME | GAM ORGANISM | PRECUR SEQ-ID | PRECURSOR SEQUENCE | GAM DESCRIPTION |
|---|---|---|---|---|
| | | | | as BINDING SITE I, BINDING SITE II and BINDING SITE III of FIG. 1, found on GAM501831 target RNA, herein designated GAM TARGET RNA, and a schematic representation of the complementarity of each of these target binding sites to GAM501831 RNA, herein designated GAM RNA are set forth in Tables 6-7, hereby incorporated herein. It is appreciated that the specific functions and accordingly the utilities of GAM501831 RNA are correlated with and may be deduced from the identity of the GAM501831 target gene inhibited thereby, and whose functions are set forth in Table 8, hereby incorporated herein. |

Table 3, lines 320140-320141, shows data relating to the source and location of the GAM oligonucleotide, specifically the GAM PRECURSOR (hairpin) and its position in the genomic sequence of Herpes virus 5.

The nucleotide sequences of target binding sites, such as BINDING SITE I, BINDING SITE II, and BINDING SITE III, that are found on GAM TARGET RNAs of each of a plurality of GAM oligonucleotides that are described by FIG.

| GAM NAME | PRECUR SEQ-ID | GAM ORGANISM | SOURCE | STRAND | SRC-START OFFSET | SRC-END OFFSET |
|---|---|---|---|---|---|---|
| GAM501831 | 420405 | Human herpesvirus 5 | NC_001347 | + | 164118 | 164184 |

The nucleotide sequence of GAM PRECURSOR RNAs, and a schematic representation of a predicted secondary folding of GAM FOLDED PRECURSOR RNAs, of each of a plurality of GAM oligonucleotides that are described by FIG. 1 are set forth in Table 4, hereby incorporated herein. Table 4, lines 599770-599773, shows a schematic representation of the GAM folded precursor as set forth in SEQ ID NO: 4204050, beginning at the 5' end (beginning of upper row) to the 3' end (beginning of lower row), where the hairpin loop is positioned at the right part of the drawing.

1, and a schematic representation of the complementarity of each of these target binding sites to each of a plurality of GAM RNAs that are described by FIG. 1 are set forth in Tables 6-7, hereby incorporated herein. Table 6 shows data relating to the SEQ ID NO: of the GAM target binding site sequence to the TARGET gene name as bound by the GAM RNA as set forth in SEQ ID NO: 117937. Table 6, lines 2093282 and 2093283 relate to target binding site SEQ ID NO: 2034243; lines 6630926 and 6630927 relate to target binding site SEQ ID NO: 3983175; lines 2093540 and

| GAM NAME | PRECUR SEQ-ID | GAM ORGANISM | PRECURSOR-SEQUENCE | GAM FOLDED PRECURSOR RNA |
|---|---|---|---|---|
| GAM501831 | 4204050 | Human herpes virus 5 | GACAGCCTCCGGATCACATG GTTACTCAGCGTCTGCCAGC CTAAGTGACGGTGAGATCCA GGCTGTC | CC    A    G    C  C  CTGCCA<br>GACAGCCT GGATC CAT GTTACT AG GT<br>CTGTCGGA  CCTAG GTG CAGTGA TC CG<br>--    A    G    A - ------ |

The nucleotide sequence of "diced" GAM RNAs of each of a plurality of GAM oligonucleotides that are described by FIG. 1 are set forth in Table 5, hereby incorporated herein. Table 5, lines 239916 and 239917 shows the mature GAM RNA as set forth in SEQ ID NO: 117937 as sliced by DICER from the GAM PRECURSOR sequence (hairpin) as set forth in SEQ ID NO: 4204050.

2093541 relate to target binding site SEQ ID NO: 2034310 lines 6638580 and 6638581 relate to target binding site SEQ ID NO: 3985198; line 6630929 relates to target binding site SEQ ID NO: 3983175; line 2093543 relates to target binding site SEQ ID NO: 2034310; line 6638583 relates to target binding site SEQ ID NO: 3985198; lines 2087866 and 2087867 relate to target binding site SEQ ID NO: 2032849;

| GAM NAME | GAM ORGANISM | GAM RNA SEQUENCE | PRECUR SEQ-ID | GAM POS |
|---|---|---|---|---|
| GAM501831 | Human herpesvirus 5 | AGTGACGGTGAGATCCAGGCTG | 4204050 | A | lines 663308 and 663309 relate to target binding site SEQ ID NO: 3983798; and line 2058344 relates to SEQ ID NO: 2024974.

that are described by FIG. 1 are correlated with and may be deduced from the identity of the GAM TARGET GENES inhibited thereby, and whose functions are set forth in Table 8,

| TARGET BINDING SITE SEQ-ID | TARGET ORGANISM | TARGET | TARGET BINDING SITE SEQUENCE |
|---|---|---|---|
| 2034243 | Human herpesvirus 5 | NC_001347 190696 - 193236 gene | GCGTGCACCTGCTGCCGCCACT |
| 3983175 | Human herpesvirus 5 | NC_001347 190696 - 193236 gene | GCGTGCACCTGCTGCCGCCACT |
| 2034310 | Human herpesvirus 5 | NC_001347 190696 - 193236 gene | GCTGATCGCCGTCACT |
| 3985198 | Human herpesvirus 5 | NC_001347 190696 - 193236 gene | GCTGATCGCCGTCACT |
| 3983175 | Human herpesvirus 5 | NP_040085.1 gene | GCGTGCACCTGCTGCCGCCACT |
| 2034310 | Human herpesvirus 5 | NP_040085.1 gene | GCTGATCGCCGTCACT |
| 3985198 | Human herpesvirus 5 | NP_040085.1 gene | GCTGATCGCCGTCACT |
| 2032849 | Human herpesvirus 5 | NC_001347 54824 - 56095 gene | GTCGCCGTCACT |
| 3983798 | Human herpesvirus 5 | NC_001347 54824 - 56095 gene | GTCGCCGTCACT |
| 2024974 | Human | SFTPA1 | TCCATCCTGAGGC |

Table 7, lines 6493595-6493625 shows data relating to target-genes and binding sites of GAM oligonucleotides.

hereby incorporated herein Table 8C, lines 4766438-4766618

| GAM NAME | GAM ORGANISM | GAM RNA SEQUENCE | TARGET BS-SEQ | TARGET | TARGET REF-ID | TARGET ORGANISM | BINDING SITE DRAW (UPPER: UTR TARGET; LOWER: GAM) | GAM POS |
|---|---|---|---|---|---|---|---|---|
| GAM501831 | Human herpes virus 5 | AGTGACGG TGAGATCC AGGCTG | GCGTGCAC CTGCTGCC GCCACT | NC_0013 47 1906 96 - 19 3236 gene | NC_001347 93237 - 193 637 | 1 Human herpes virus 5 | 3 -- G C C GCTG C<br>GC TG A CT CCG CACT<br>CG AC T GA GGC GTGA<br>GT G C A GT-- A | A |
| GAM501831 | Human herpes virus 5 | AGTGACGG TGAGATCC AGGCTG | GCGTGCAC CTGCTGCC GCCACT | NP_0400 85.1 gene | NC_001347 93237 - 193 637 | 1 Human herpes virus 5 | 3 -- G C C GCTG C<br>GC TG A CT CCG CACT<br>CG AC T GA GGC GTGA<br>GT G C A GT-- A | A |
| GAM501831 | Human herpes virus 5 | AGTGACGG TGAGATCC AGGCTG | GCTGATCG CCGTCACT | NC_0013 47 1906 96 - 19 3236 gene | NC_001347 93237 - 193 637 | 1 Human herpes virus 5 | 3 -- - - G--<br>GC TG ATC CCGTCACT<br>CG AC TAG GGCAGTGA<br>GT G C AGT | A |
| GAM501831 | Human herpes virus 5 | AGTGACGG TGAGATCC AGGCTG | GCTGATCG CCGTCACT | NP_0400 85.1 gene | NC_001347 93237 - 193 637 | 1 Human herpes virus 5 | 3 -- - - G--<br>GC TG ATC CCGTCACT<br>CG AC TAG GGCAGTGA<br>GT G C AGT | A |
| GAM501831 | Human herpes virus 5 | AGTGACCC TGAGATCC AGGCTG | GTCGCCCT CACT | NC_0013 47 5482 4 - 560 95 gene | NC_001347 4423 - 5482 3 | 5 Human herpes virus 5 | 3 -- - -------<br>GTC G CCGTCACT<br>CGG C GGCAGTGA<br>GT A CTAGAGT | A |
| GAM501831 | Human herpes virus 5 | GCCTCCGG ATCACATG GTTACT | TCCATCCT GAGGC | SFTPA1 | NM_005411 | 3 Human herpes virus 5 | 3 -- -- ----- T<br>T CCAT CC GAGGC<br>A GGTA GG CTCCG<br>TC TT CACTA C | B |

It is appreciated that the specific functions and accordingly the utilities of each of a plurality of GAM oligonucleotides that are described by FIG. 1 are correlated with and may be deduced from the identity of the GAM TARGET GENES inhibited thereby, and whose functions are set forth in Table 8, shows data relating to the function and utilities of GAM RNA as set forth in SEQ ID NO: 117937.

| GAM NAME | GAM RNA SEQUENCE | GAM ORGANISM | TARGET | TARGET ORGANISM | GAM FUNCTION | GAM POS |
|---|---|---|---|---|---|---|
| GAM501831 | AGTGACGG TGAGATCC AGGCTG | Human herpesvirus 5 | NC_001347 190696 - 193236 gene | Human herpesvirus 5 | GAM501831 is a viral miRNA-like oligonucleotide that is encoded by the Human herpesvirus 5 genome, which targets a viral target gene NC_001347 190696 - 193236 gene (UTR reference: NC_001347 193237 - 193637) as part of an internal viral regulation mechanism. NC_001347 190696 - 193236 gene BINDING SITE 1 and NC_001347 190696 - 193236 gene BINDING SITE 2 are viral target binding sites that are found in the untranslated regions of mRNA encoded by the NC_001347 190696 - 193236 gene gene, corresponding to target binding sites such as BINDING SITE I, BINDING SITE II or BINDING SITE III of FIG. 1. The nucleotide sequences of NC_001347 190696 - 193236 gene BINDING SITE 1 and NC_001347 190696 - 193236 gene BINDING SITE 2, and the complementary secondary structure to the nucleotide sequence of GAM501831 RNA are set forth in Tables 6-7, hereby incorporated herein. A function of GAM501831 is to inhibit NC_001347 190696 - 19323 6 gene, a GAM501831 viral target gene which is associated with Human herpesvirus 5 infection, as part of an internal viral regulation mechanism. Accordingly, the utilities of GAN501831 include the diagnosis, prevention and treatment of Human herpesvirus 5 infection and associated clinical conditions. | A |
| GAM501831 | AGTGACGG TGAGATCC AGGCTG | Human herpesvirus 5 | NC_001347 190696 - 193236 gene | Human herpesvirus 5 | GAM501831 is a viral miRNA-like oligonucleotide that is encoded by the Human herpesvirus 5 genome, which targets a viral target gene NC_001347 190696 - 193236 gene (UTR reference: NC_001347 193237 - 193637) as part of an internal viral regulation mechanism. NC_001347 190696 - 193236 gene BINDING SITE 1 and NC_001347 190696 - 193236 gene BINDING SITE 2 are viral target binding sites that are found in the untranslated regions of mRNA encoded by the NC_001347 190696 - 193236 gene gene, corresponding to target binding sites such as BINDING SITE I, BINDING SITE II or BINDING SITE III of FIG. 1. The nucleotide sequences of NC_001347 190696 - 193236 gene BINDING SITE 1 and NC_001347 190696 - 193236 gene BINDING SITE 2, and the complementary secondary structure to the nucleotide sequence of GAM501831 RNA are set forth in Tables 6-7, hereby incorporated herein. Another function of GAM501831 is to inhibit NC_001347 190696 - 193236 gene, a GAM501831 viral target gene which is associated with Human herpesvirus 5 infection, as part of an internal viral regulation mechanism. Accordingly, the utilities of GAM501831 include the diagnosis, prevention and treatment of Human herpesvirus 5 infection and associated clinical conditions. | A |
| GAM501831 | AGTGACGG TGAGATCC AGGCTG | Human herpesvirus 5 | NC_001347 54824 - 56095 gene | Human herpesvirus 5 | GAM501831 is a viral miRNA-like oligonucleotide that is encoded by the Human herpesvirus 5 genome, which targets a viral target gene NC_001347 54824 - 56095 gene (UTR reference: NC_001347 54423 - 54823) as part of an internal viral regulation mechanism. NC_001347 54824 - 56095 gene BINDING SITE is a viral target binding site that is a found in the the 3' untranslated region | A |

| GAM NAME | GAM RNA SEQUENCE | GAM ORGANISM | TARGET | TARGET ORGANISM | GAM FUNCTION | GAM POS |
|---|---|---|---|---|---|---|
| | | | | | of mRNA encoded by the NC_001347 54824 - 56095 gene gene, corresponding to a target binding site such as BINDING SITE I, BINDING SITE II or BINDING SITE III of FIG. 1. The nucleotide sequences of NC_001347 54824 - 56095 gene BINDING SITE, and the complementary secondary structure to the nucleotide sequence of GAM501831 RNA are set -continued

| GAM NAME | GAM RNA SEQUENCE | GAM ORGANISM | TARGET | TARGET ORGANISM | GAM FUNCTION | GAM POS |
|---|---|---|---|---|---|---|
| | | | | | the diagnosis, prevention and treatment of Human herpesvirus 5 infection and associated clinical conditions. | |
| GAM501831 | AGTGACGG TGAGATCC AGGCTG | Human herpesvirus 5 | NP__040085.1 gene | Human herpesvirus 5 | GAM501831 is a viral miRNA-like oligonucleotide that is encoded by the Human herpesvirus 5 genome, which targets a viral target gene NP__040085.1 gene (UTR reference: NC__001347 193237 - 193637) as part of an internal viral regulation mechanism. NP__040085.1 gene BINDING SITE 1 and NP__040085.1 gene BINDING SITE 2 are viral target binding sites that are found in the untranslated regions of mRNA encoded by the NP__040085.1 gene gene, corresponding to target binding sites such as BINDING SITE I, BINDING SITE II or BINDING SITE III of FIG. 1. The nucleotide sequences of NP__040085.1 gene BINDING SITE 1 and NP040085.1 gene BINDING SITE 2, and the complementary secondary structure to the nucleotide sequence of GAM501831 RNA are set forth in Tables 6-7, hereby incorporated herein. Another function of GAM501831 is to inhibit NP__040085.1 gene, a GAM501831 viral target gene which is associated with Human herpesvirus 5 infection, as part of an internal viral regulation mechanism. Accordingly, the utilities of GAM501831 include the diagnosis, prevention and treatment of Human herpesvirus 5 infection and associated clinical conditions. | A |
| GAM501831 | GCCTCCGG ATCACATG GTTACT | Human herpesvirus 5 | SFTPA1 | Human | GAM501831 is a viral miRNA-like oligonucleotide that is encoded by the Human herpesvirus 5 genome, which targets a human host gene Surfactant, pulmonary- associated protein A1 (SFTPA1, Accession number: NM__005411) as part of a viral host-attacking mechanism. SFTPA1 BINDING SITE is a human target binding site that is a found in the the 3' untranslated region of mRNA encoded by the SFTPA1 gene, corresponding to a target binding site such as BINDING SITE I, BINDING SITE II or BINDING SITE III of FIG. 1. The nucleotide sequences of SFTPA1 BINDING SITE, and the complementary secondary structure to the nucleotide sequence of GAM501831 RNA are set forth in Tables 6-7, hereby incorporated herein. Another function of GAM501831 is to inhibit SFTPA1, a GAM501831 human target gene which is involved in lipids and carbohydrates metabolisim. SFTPA1 is associated with Human herpesvirus 5 infection, and therefore GAM501831 is associated with the above-mentioned infection, as part of a novel viral mechanism of attacking a host. Accordingly, the utilities of GAM501831 include the diagnosis, prevention and treatment of Human herpesvirus 5 infection and associated clinical conditions. The function of SFTPA1 and its association with various diseases and clinical conditions has been established by previous studies, as described hereinabove with reference to GAM336913. | B |
| GAM501831 | GCCTCCGG ATCACATG | Human herpesvirus 5 | SFTPA1 | Human | GM501831 is a viral miRNA-like oligonucleotide that is encoded by the Human herpevirus 5 genome, which targets a human host gene Surfactant, pulmonary- associated A1 (SFTPA1, Accession number: NM__005411) as part of a viral host-attacking | B |

-continued

| GAM NAME | GAM RNA SEQUENCE | GAM ORGANISM | TARGET | TARGET ORGANISM | GAM FUNCTION | GAM POS |
|---|---|---|---|---|---|---|
| | | | | | mechanism. SFTPA1 BINDING SITE is a human target binding site that is a found in the 3' untranslated region of mRNA encoded by the SFTPA1 gene, corrsponding to a target binding site such as BINDING SITE I, BINDING SITE II or BINDING SITE III of FIG. 1. The nucleotide sequences of SFTPA1 BINDING SITE, and the complementary secondary structure to the nucleotide sequence of GAM501831 RNA are set forth in Table 6-7, hereby incorporated herein. Another function of GAM501831 is to inhibit SFTPA1, a GAM501831 human target gene which is involved in lipids and carbohydrates metabolism. SFTPA1 is associated with Human herpevirus 5 infection, and therefore GAM501831 is associated with the above-mentioned infection, as part of a novel viral mechanism of attacking a host. Accordingly, the utilities of GAM501831 include the diagnosis, prevention and treatment of Human herpevirus 5 infection and associated clinical conditions. The function of SFTPA1 and its association with various diseases and clinical conditions has been established by previous studies,a s described hereinabove with reference to GAM366913. | |

Figure 9:
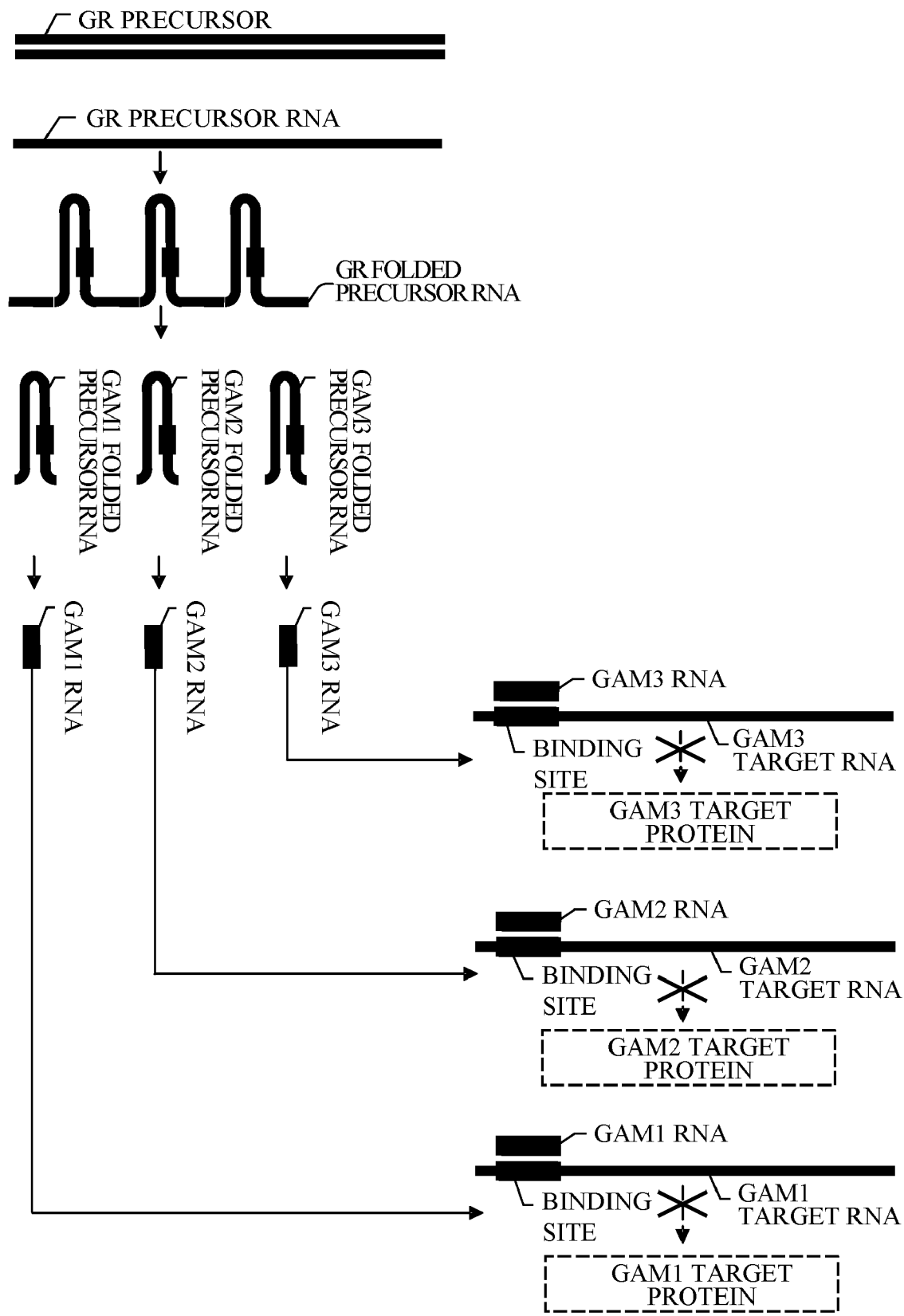
FIG. 9 is a simplified diagram describing a novel bioinformatically-detected group of regulatory polynucleotides, referred to here as Genomic Record (GR) polynucleotides, each of which encodes an "operon-like" cluster of novel microRNA-like oligonucleotides, which in turn modulate expression of one or more target genes.

Studies documenting the well known correlations between each of a plurality of GAM TARGET GENES that are described by FIG. 1 and the know gene functions and related discusses are listed in Table 9, hereby incorporated herein. FIG. 9, lines 40832-40882, shows the GAM target genes and information related to the target gene.

prises alphanumeric data representing genomic sequences and preferably including annotations such as information indicating the location of known protein-coding regions relative to the genomic sequences.

Protein function data 106 comprises information from scientific publications e.g. physiological functions of known

| | | |
|---|---|---|
| SFTPA1 | Human | Bruns, G.; Strob, H.; Veldman, G. M.; Latt, S. A.; Floros, J. The 35 kd pulmonary surfactant-associated protein is encoded on chromosome 10. Hum. Genet. 76: 58-62, 1987. |
| SFTPA1 | Human | Fisher, J. H.; Kao, F. T.; Jones, C.; White, R. T.; Benson, B. J.; Mason, R. J.: The coding sequence for the 32,000-dalton pulmonary surfactant-associated protein A is located on chromosome 10 and identifies two separate restriction-fragment-length polymorphisms. Am. J. Hum. Genet. 40: 503-511, 1987. |
| SFTPA1 | Human | Floros, J.; DiAngelo, S.; Koptides, M.; Karinch, A. M.; Rogan, P. K.; Nielsen, H.; Spragg, R. G.; Watterberg, K.; Deiter, G.: Human SP-A locus: allele frequencies and linkage disequilibrium between the two surfactant protein A genes. Am. J. Resp. Cell Molec. Biol. 15: 489-498, 1996. |
| SFTPA1 | Human | Floros, J.; Hoover, R. R.: Genetics of the hydrophilic surfactant proteins A and D. Biochim. Biophys. Acta 1408: 312-322, 1998. |
| SFTPA1 | Human | Glasser, S. W.; Korfhagen, T. R.; Weaver, T.; Pilot-Matias, T.; Fox, J. L.; Whitsett, J. A.: cDNA and deduced amino acid sequence of human pulmonary surfactant-associated proteolipid SPL(Phe). Proc. Nat. Acad. Sci. 84: 4007-4011, 1987. |
| SFTPA1 | Human | Haataja, R.; Ramet, M.; Marttila, R.; Hallman, M.: Surfactant proteins A and B as interactive genetic determinants of neonatal respiratory distress syndrome. Hum. Molec. Genet. 9: 2751-2760, 2000. |
| SFTPA1 | Human | Kolble, K.; Lu, J.; Mole, S. E.; Kaluz, S.; Reid, K. B. M.: Assignment of the human pulmonary surfactant protein D gene (SFTP4) to 10q22-q23 close to the surfactant protein A gene cluster. Genomics 17: 294-298, 1993. |
| SFTPA1 | Human | Latt, S. A.: Personal Communication. Boston, Mass. Jun. 3, 1987. |
| SFTPA1 | Human | Moore, K. J.; D*Amore-Bruno, M. A.; Korfhagen, T. R.; Glasser, S. N.; Whitsett, J. A.; Jenkins, N. A.; Copeland, N. G.: Chromosomal localization of three pulmonary surfactant protein genes in the mouse. Genomics 12: 388-393, 1992. |
| SFTPA1 | Human | Ramet, N.; Haataja, R.; Marttila, R.; Floros, J.; Hallman, M.: Association between the surfactant protein A (SP-A) gene locus and respiratory-distress syndrome in the Finnish population. Am. J. Hum. Genet. 66: 1569-1579, 2000. |
| SFTPA1 | Human | Ramet, M.; Lofgren, J.; Albo, O.-P.; Hallman, M.: Surfactant protein-A gene locus associated with recurrent otitis media. J. Pediat. 138: 266-268, 2001. |
| SFTPA1 | Human | Selman, M.; Lin, H.-M.; Montano, M.; Jenkins, A. L.; Estrada, A.; Lin, Z.; Wang, G.; DiAngelo, S. L.; Guo, X.; Umstead, T. M.; Lang, C. M.; Pardo, A.; Phelps, D. S.; Floros, J.: Surfactant protein A and B genetic variants predispose to idiopathic pulmonary fibrosis. Hum. Genet. 113: 542-550, 2003. |
| SFTPA1 | Human | White, R. T.; Damm, D.; Miller, J.; Spratt, K.; Schilling, J.; Hawgood, S.; Benson, B.; Cordell, B.: Isolation and characterization of the human pulmonary surfactant apoprotein gene. Nature 317: 361-363, 1985. |

The present invention discloses a novel group of viral and human oligonucleotides, belonging to the miRNA-like oligonucleotide group, here termed GAM oligonucleotides, for which a specific complementary binding has been determined bioinformatically.

Figure 2:
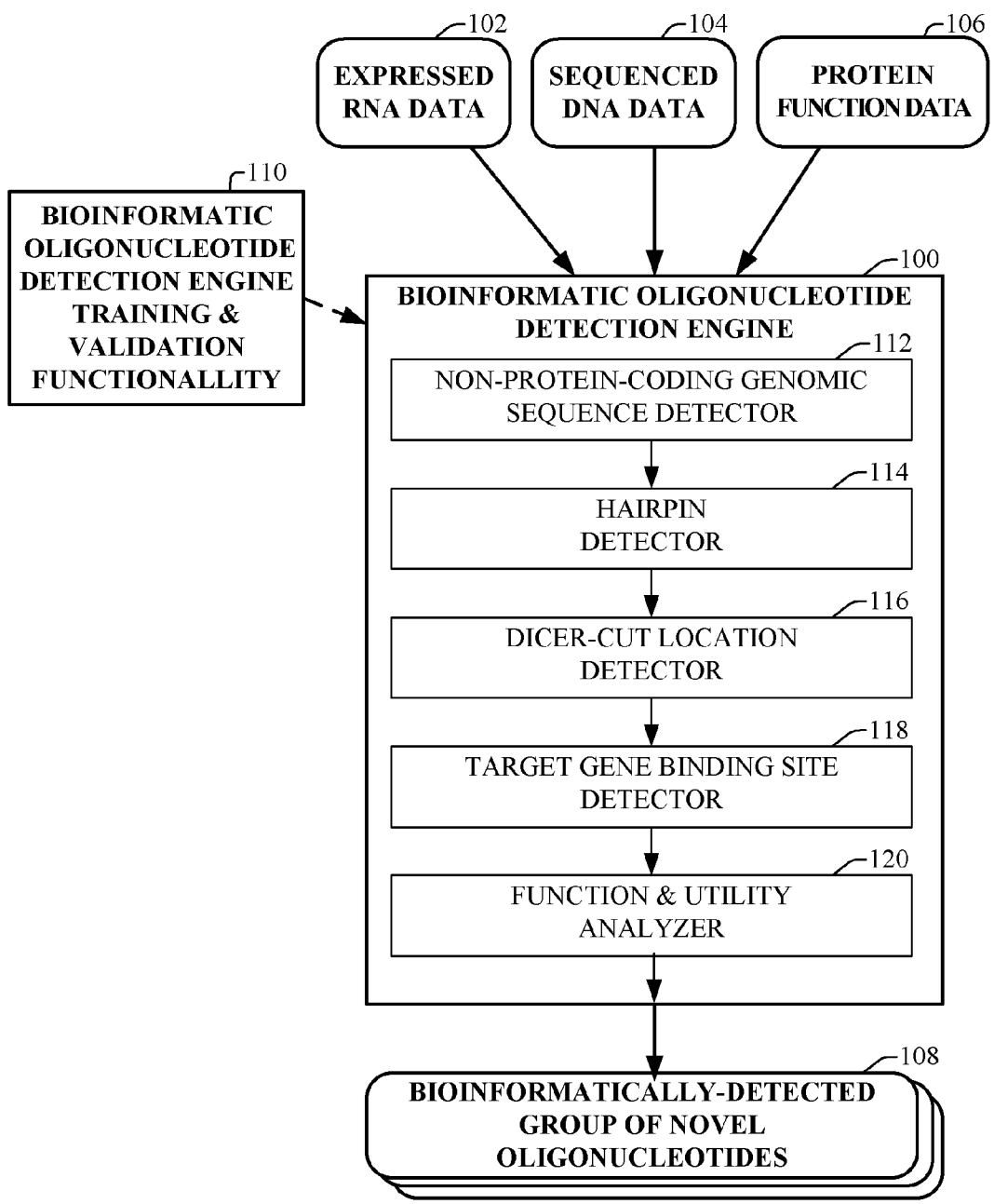
FIG. 2 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention.

Reference is now made to FIG. 2, which is a simplified block diagram illustrating a bioinformatic oligonucleotide detection system and method constructed and operative in accordance with a preferred embodiment of the present invention.

An important feature of the present invention is a bioinformatic oligonucleotide detection engine 100, which is capable of bioinformatically detecting oligonucleotides of the present invention.

The functionality of the bioinformatic oligonucleotide detection engine 100 includes receiving expressed RNA data 102, sequenced DNA data 104, and protein function data 106; performing a complex process of analysis of this data as elaborated hereinbelow, and based on this analysis provides information, designated by reference numeral 108, identifying and describing features of novel oligonucleotides.

Expressed RNA data 102 comprises published expressed sequence tags (EST) data, published mRNA data, as well as other published RNA data. Sequenced DNA data 104 com-proteins and their connection, involvement and possible utility in treatment and diagnosis of various diseases.

Expressed RNA data 102 and sequenced DNA data 104 may preferably be obtained from data published by the National Center for Biotechnology Informatiion (NCBI) at the National Institute of Health (NIH) (Jenuth, J. P. (2000). Methods Mol. Biol. 132:301-312 (2000), herein incorporated by reference) as well as from various other published data sources. Protein function data 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of bioinformatically-detected group of novel oligonucleotides 108 by the bioinformatic oligonucleotide detection engine 100, bioinformatic oligonucleotide detection engine training & validation functionality 110 is operative. This functionality uses one or more known miRNA oligonucleotides as a training set to train the bioinformatic oligonucleotide detection engine 100 to bioinformatically recognize miRNA-like oligonucleotides, and their respective potential target binding sites. Bioinformatic oligonucleotide detection engine training & validation functionality 110 is further described hereinbelow with reference to FIG. 3.

The bioinformatic oligonucleotide detection engine 100 preferably comprises several modules which are preferably activated sequentially, and are described as follows:

A non-protein-coding genomic sequence detector 112 operative to bioinformatically detect non-protein-coding genomic sequences. The non-protein-coding genomic sequence detector 112 is further described herein below with reference to FIGS. 4A and 4B.

A hairpin detector 114 operative to bioinformatically detect genomic "hairpin-shaped" sequences, similar to GAM FOLDED PRECURSOR RNA (FIG. 1). The hairpin detector 114 is further described herein below with reference to FIGS. 5A and 5B.

A Dicer-cut location detector 116 operative to bioinformatically detect the location on a GAM FOLDED PRECURSOR RNA which is enzymatically cut by DICER COMPLEX (FIG. 1), yielding "diced" GAM RNA. The Dicer-cut location detector 116 is further described herein below with reference to FIGS. 6A-6C.

A target gene binding site detector 118 operative to bioinformatically detect target genes having binding sites, the nucleotide sequence of which is partially complementary to that of a given genomic sequence, such as a nucleotide sequence cut by DICER COMPLEX. The target gene binding site detector 118 is further described hereinbelow with reference to FIGS. 7A and 7B.

A function & utility analyzer, designated by reference numeral 120, is operative to analyze the function and utility of target genes in order to identify target genes which have a significant clinical function and utility. The function & utility analyzer 120 is further described hereinbelow with reference to FIG. 8

According to an embodiment of the present invention, the bioinformatic oligonucleotide detection engine 100 may employ a cluster of 40 personal computers (PCs; XEON®, 2.8 GHz, with 80 GB storage each) connected by Ethernet to eight servers (2-CPU, XEON™ 1.2-2.2 GHz, with ~200 GB storage each) and combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise software that utilizes a commercial database software program, such as MICROSOFT™ SQL Server 2000.

According to a preferred embodiment of the present invention, the bioinformatic oligonucleotide detection engine 100 may employ a cluster of 80 Servers (XEON®, 2.8 GHz, with 80 GB storage each) connected by Ethernet to eight servers (2-CPU, XEON™ 1.2-2.2 GHz, with ~200 GB storage each) and combined with storage device (Promise Technology Inc., RM8000) connected to an 8-disks, 2 Terabytes total. A preferred embodiment of the present invention may also preferably comprise software that utilizes a commercial database software program, such as MICROSOFT™ SQL Server 2000. It is appreciated that the abovementioned hardware configuration is not meant to be limiting and is given as an illustration only. The present invention may be implemented in a wide variety of hardware and software configurations.

The present invention discloses 1,655 viral and 105,537 human novel oligonucleotides of the GAM group of oligonucleotides, which have been detected bioinformatically and 190 viral and 14,813 human novel polynucleotides of the GR group of polynucleotides, which have been detected bioinformatically. Laboratory confirmation of bioinformatically predicted oligonucleotides of the GAM group of oligonucleotides, and several bioinformatically predicted polynucleotides of the GR group of polynucleotides, is described hereinbelow with reference to FIGS. 13-15D, FIG. 18 and Table 12.

Laboratory confirmation of bioinformatically predicted oligonucleotides of the viral GAM group of oligonucleotides, and several bioinformatically predicted viral polynucleotides of the GR group of polynucleotides, is described hereinbelow with reference to FIGS. 19-20.

Figure 3:
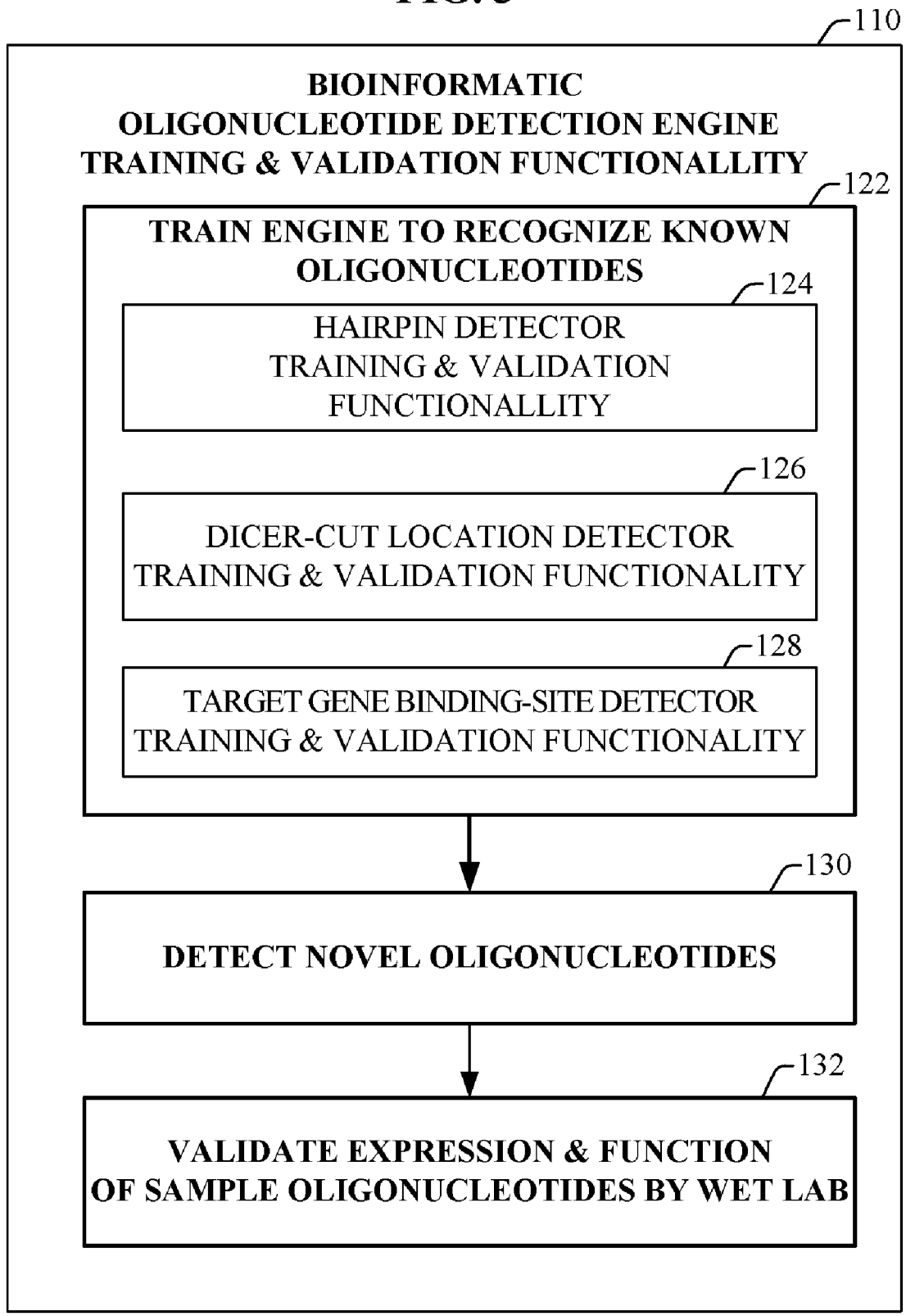
FIG. 3 is a simplified flowchart illustrating operation of a mechanism for training of a computer system to recognize the novel oligonucleotides of the present invention, which mechanism is constructed and operative in accordance with a preferred embodiment of the present invention.

Reference is now made to FIG. 3, which is a simplified flowchart illustrating operation of a preferred embodiment of the bioinformatic oligonucleotide detection engine training & validation functionality 110 described hereinabove with reference to FIG. 2.

bioinformatic oligonucleotide detection engine training & validation functionality 110 begins by training the bioinformatic oligonucleotide detection engine 100 (FIG. 2) to recognize one or more known miRNA oligonucleotides, as designated by reference numeral 122. This training step comprises hairpin detector training & validation functionality 124, further described hereinbelow with reference to FIG. 5A, Dicer-cut location detector training & validation functionality 126, further described hereinbelow with reference to FIGS. 6A and 6B, and target gene binding site detector training & validation functionality 128, further described hereinbelow with reference to FIG. 7A.

Next, the bioinformatic oligonucleotide detection engine training & validation functionality 110 is operative bioinformatically detect novel oligonucleotides, using bioinformatic oligonucleotide detection engine 100 (FIG. 2), as designated by reference numeral 130. Wet lab experiments are preferably conducted in order to validate expression and preferably function of some samples of the novel oligonucleotides detected by the bioinformatic oligonucleotide detection engine 100, as designated by reference numeral 132. FIGS. 13A-15D, FIG. 18 and Table 12 illustrate examples of wet lab validation of sample novel human oligonucleotides bioinformatically-detected in accordance with a preferred embodiment of the present invention. Laboratory confirmation of bioinformatically predicted oligonucleotides of the viral GAM group of oligonucleotides, and several bioinformatically predicted viral polynucleotides of the GR group of polynucleotides, is described hereinbelow with reference to FIGS. 19-20.

Figure 4A:
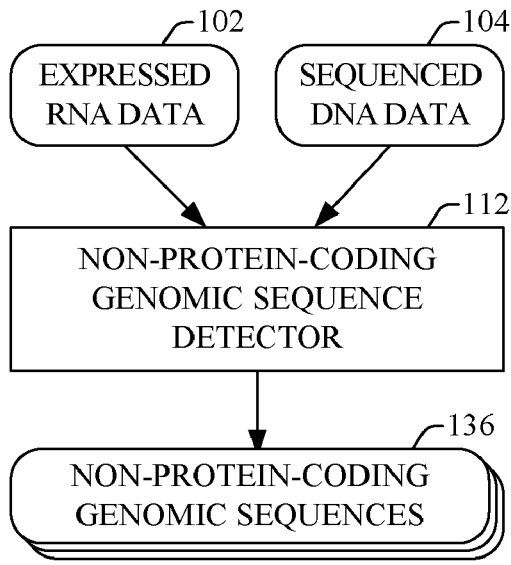
FIG. 4A is a simplified block diagram of a non-coding genomic sequence detector constructed and operative in accordance with a preferred embodiment of the present invention.

Reference is now made to FIG. 4A, which is a simplified block diagram of a preferred implementation of the non-protein-coding genomic sequence detector 112 described hereinabove with reference to FIG. 2. The non-protein-coding genomic sequence detector 112 preferably receives at least two types of published genomic data: Expressed RNA data 102 and sequenced DNA data 104. The expressed RNA data 102 may include, inter alia, EST data, EST clusters data, EST genome alignment data and mRNA data. Sources for expressed RNA data 102 include NCBI dbEST, NCBI UniGene clusters and mapping data, and TIGR gene indices (Kirkness F. and Kerlavage, A. R., Methods Mol. Biol. 69:261-268 (1997)). Sequenced DNA data 104 may include sequence data (FASTA format files), and feature annotations (GenBank file format) mainly from NCBI databases. Based on the abovementioned input data, the non-protein-coding genomic sequence detector 112 produces a plurality of non-protein-coding genomic sequences 136. Preferred operation of the non-protein-coding genomic sequence detector 112 is described hereinbelow with reference to FIG. 4B.

Figure 4B:
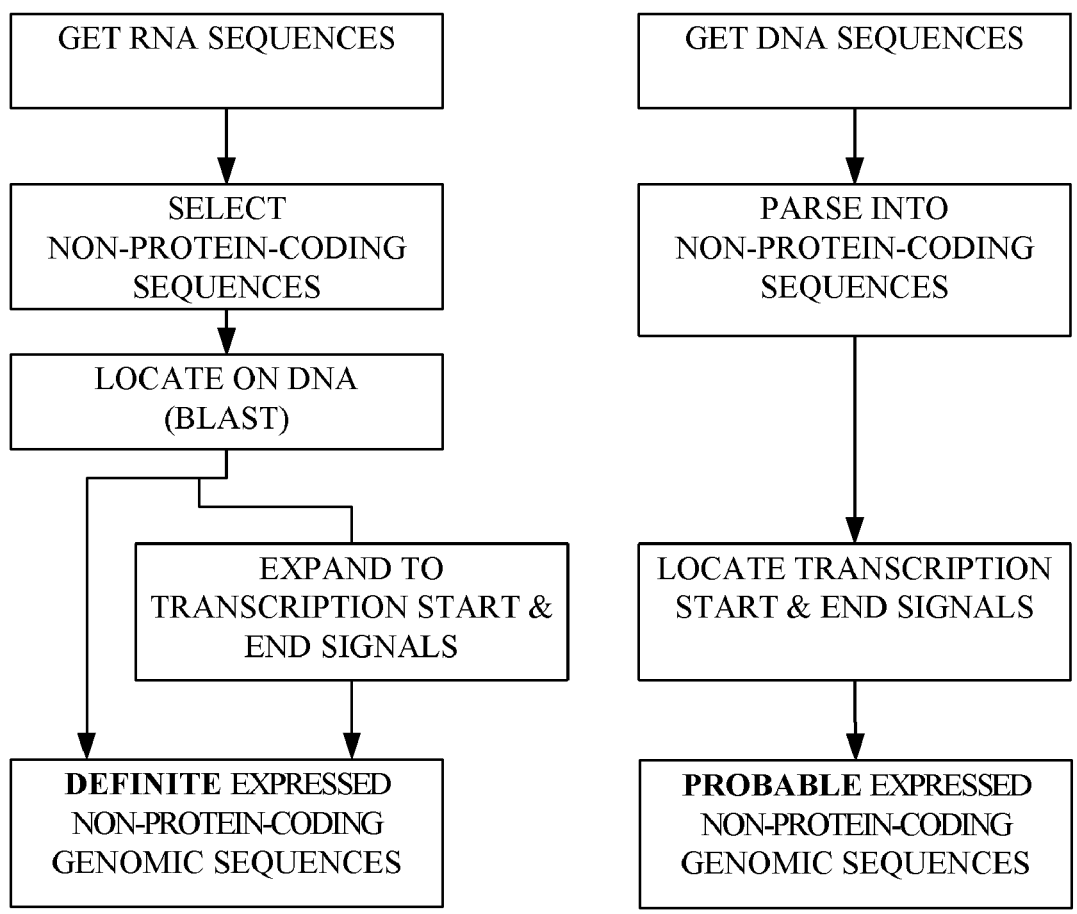
FIG. 4B is a simplified flowchart illustrating operation of a non-coding genomic sequence detector constructed and operative in accordance with a preferred embodiment of the present invention.

Reference is now made to FIG. 4B, which is a simplified flowchart illustrating a preferred operation of the non-protein-coding genomic sequence detector 112 of FIG. 2. Detection of non-protein-coding genomic sequences 136, generally preferably progresses along one of the following two paths:

A first path for detecting non-protein-coding genomic sequences 136 (FIG. 4A) begins with receipt of a plurality of known RNA sequences, such as EST data. Each RNA sequence is first compared with known protein-coding DNA sequences, in order to select only those RNA sequences which are non-protein-coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein-coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein-coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBI's GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting non-protein-coding genomic sequences 136 (FIG. 4A) begins with receipt of DNA sequences. The DNA sequences are parsed into non-protein-coding sequences, using published DNA annotation data, by extracting those DNA sequences which are between known protein-coding sequences. Next, transcription start and end signals are sought. If such signals are found, and depending on their robustness, probable expressed non-protein-coding genomic sequences are obtained.

Such an approach is especially useful for identifying novel GAM oligonucleotides which are found in proximity to other known miRNA oligonucleotides, or other wet lab validated GAM oligonucleotides. Since, as described hereinbelow with reference to FIG. 9, GAM oligonucleotides are frequently found in clusters; sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides.

It is appreciated that in detecting non-human GAM oligonucleotides of the present invention, the bioinformatic oligonucleotide detection engine 100 utilizes the input genomic sequences, without filtering protein-coding regions detected by the non-protein-coding genomic sequence detector 112. Hence, non-protein-coding genomic sequences 136 refers to GENOMIC SEQUENCES only.

Figure 5A:
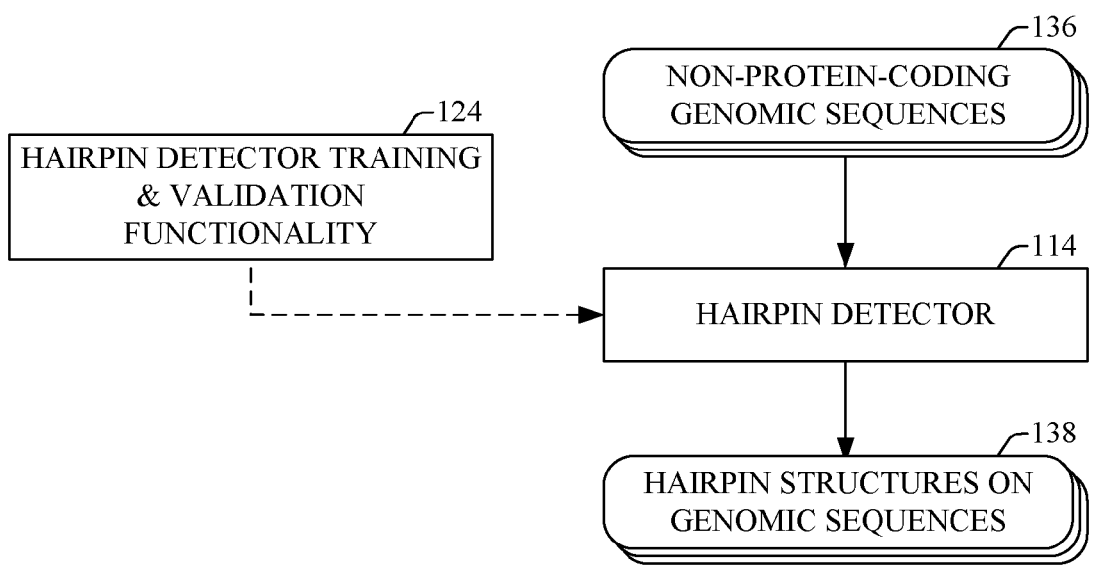
FIG. 5A is a simplified block diagram of a hairpin detector constructed and operative in accordance with a preferred embodiment of the present invention.

Reference is now made to FIG. 5A, which is a simplified block diagram of a preferred implementation of the hairpin detector 114 described hereinabove with reference to FIG. 2.

The goal of the hairpin detector 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 1.

The hairpin detector 114 (FIG. 2) receives a plurality of non-protein-coding genomic sequences 136 (FIG. 4A). Following operation of hairpin detector training & validation functionality 124 (FIG. 3), the hairpin detector 114 is operative to detect and output hairpin-shaped sequences, which are found in the non-protein-coding genomic sequences 136. The hairpin-shaped sequences detected by the hairpin detector 114 are designated hairpin structures on genomic sequences 138. A preferred mode of operation of the hairpin detector 114 is described hereinbelow with reference to FIG. 5B.

hairpin detector training & validation functionality 124 includes an iterative process of applying the hairpin detector 114 to known hairpin-shaped miRNA precursor sequences, calibrating the hairpin detector 114 such that it identifies a training set of known hairpin-shaped miRNA precursor sequences, as well as other similarly hairpin-shaped sequences. In a preferred embodiment of the present invention, the hairpin detector training & validation functionality 124 trains the hairpin detector 114 and validates each of the steps of operation thereof described hereinbelow with reference to FIG. 5B

The hairpin detector training & validation functionality 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a background set of about 1000 hairpin-shaped sequences found in expressed non-protein-coding human genomic sequences. The background set is expected to comprise some valid, previously undetected hairpin-shaped miRNA-like precursor sequences, and many hair-pin-shaped sequences which are not hairpin-shaped miRNA-like precursors.

In a preferred embodiment of the present invention the efficacy of the hairpin detector 114 (FIG. 2) is confirmed. For example, when a similarity threshold is chosen such that 87% of the known hairpin-shaped miRNA precursors are successfully predicted, only 21.8% of the 1000 background set of hairpin-shaped sequences are predicted to be hairpin-shaped miRNA-like precursors.

Figure 5B:
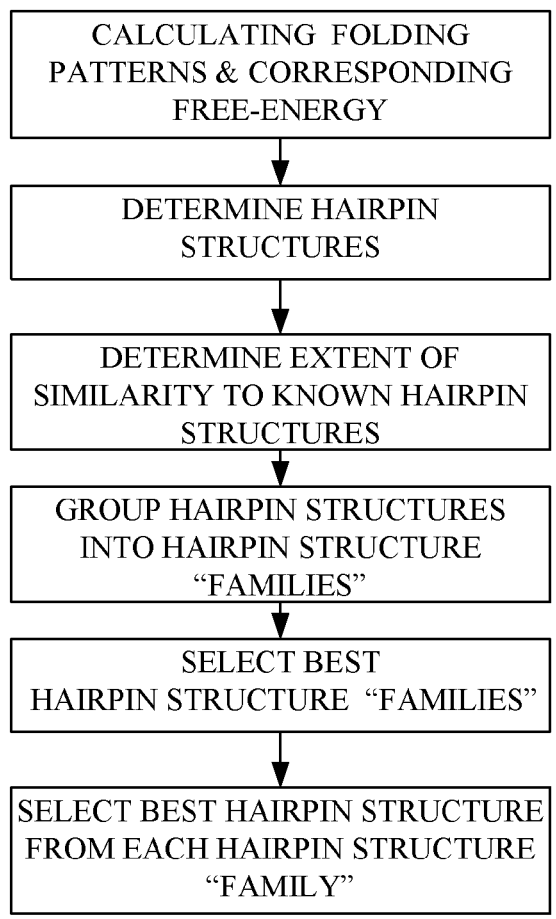
FIG. 5B is a simplified flowchart illustrating operation of a hairpin detector constructed and operative in accordance with a preferred embodiment of the present invention.

Reference is now made to FIG. 5B, which is a simplified flowchart illustrating preferred operation of the hairpin detector 114 of FIG. 2. The hairpin detector 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415 (2003), the disclosure of which is hereby incorporated by reference. This algorithm is operative to calculate probable secondary structure folding patterns of the non-protein-coding genomic sequences 136 (FIG. 4A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the hairpin detector 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The hairpin detector 114 then assesses the hairpin structures found by the previous step, comparing them to hairpin structures of known miRNA precursors, using various characteristic hairpin structure features such as its free-energy and its thermodynamic stability, the amount and type of mismatched nucleotides and the existence of sequence repeat-elements, number of mismatched nucleotides in positions 18-22 counting from loop, and Percent of G nucleotide. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a multiplicity of terms, where each term is a function of one of the abovementioned hairpin structure features. The parameters of each function are found heuristically from the set of hairpin structures of known miRNA precursors, as described hereinabove with reference to hairpin detector training & validation functionality 124 (FIG. 3). The selection of the features and their function parameters is optimized so as to achieve maximized separation between the distribution of similarity scores validated miRNA precursor hairpin structures, and the distribution of similarity scores of hairpin structures detected in the background set mentioned hereinabove with reference to FIG. 5B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free-energy. A second stage is preferably more stringent, and preferably employs a full calculation of the weighted sum of terms described hereinabove. The second stage preferably is performed only on the subset of hairpin structures that survived the first stage.

The hairpin detector 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the hairpin detector 114 attempts to group hairpin structures into "families" of closely related hairpin structures. As is known in the art, a secondary structure folding algorithm typically provides multiple alternative folding patterns, for a given genomic sequence and indicates the free-energy of each alternative folding pattern. It is a particular feature of the present invention that the hairpin detector 114 preferably assesses the various hairpin structures appearing in the various alternative folding patterns and groups' hairpin structures which appear at identical or similar sequence locations in various alternative folding patterns into common sequence location based "families" of hairpins. For example, all hairpin structures whose center is within 7 nucleotides of each other may be grouped into a "family". Hairpin structures may also be grouped into a "family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable. Our tests suggest that only about 50% of the hairpin structures, predicted by the MFOLD algorithm with default parameters, are members of sufficiently stable families, comparing to about 90% of the hairpin structures that contain known miRNAs. This percent depends on the size of the fraction that was fold. In an alternative embodiment of the present invention we use fractions of size 1000 nts as preferable size. Different embodiment uses other sizes of genomics sequences, more or less strict demand for representation in the alternative secondary structure folding patterns.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free-energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 6A:
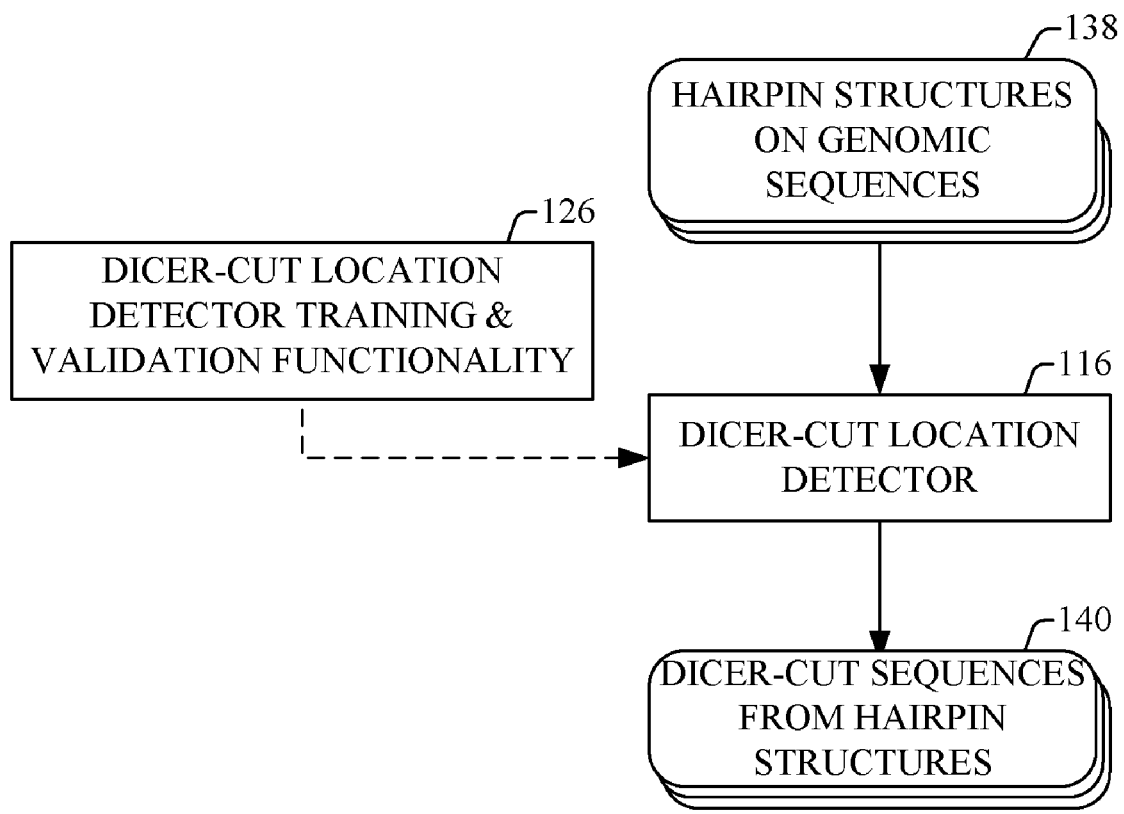
FIG. 6A is a simplified block diagram of a Dicer-cut location detector constructed and operative in accordance with a preferred embodiment of the present invention.
Figure 6B:
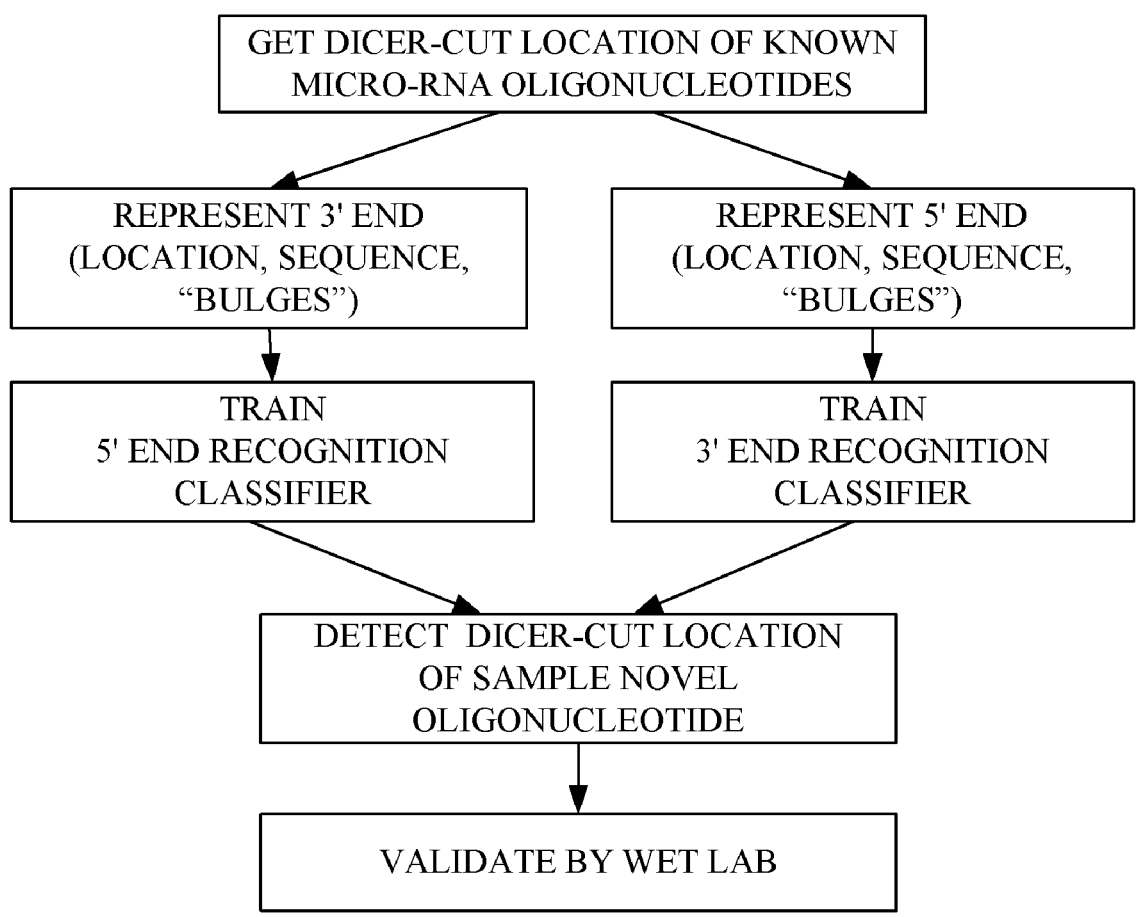
FIG. 6B is a simplified flowchart illustrating training of a Dicer-cut location detector constructed and operative in accordance with a preferred embodiment of the present invention.
Figure 6C:
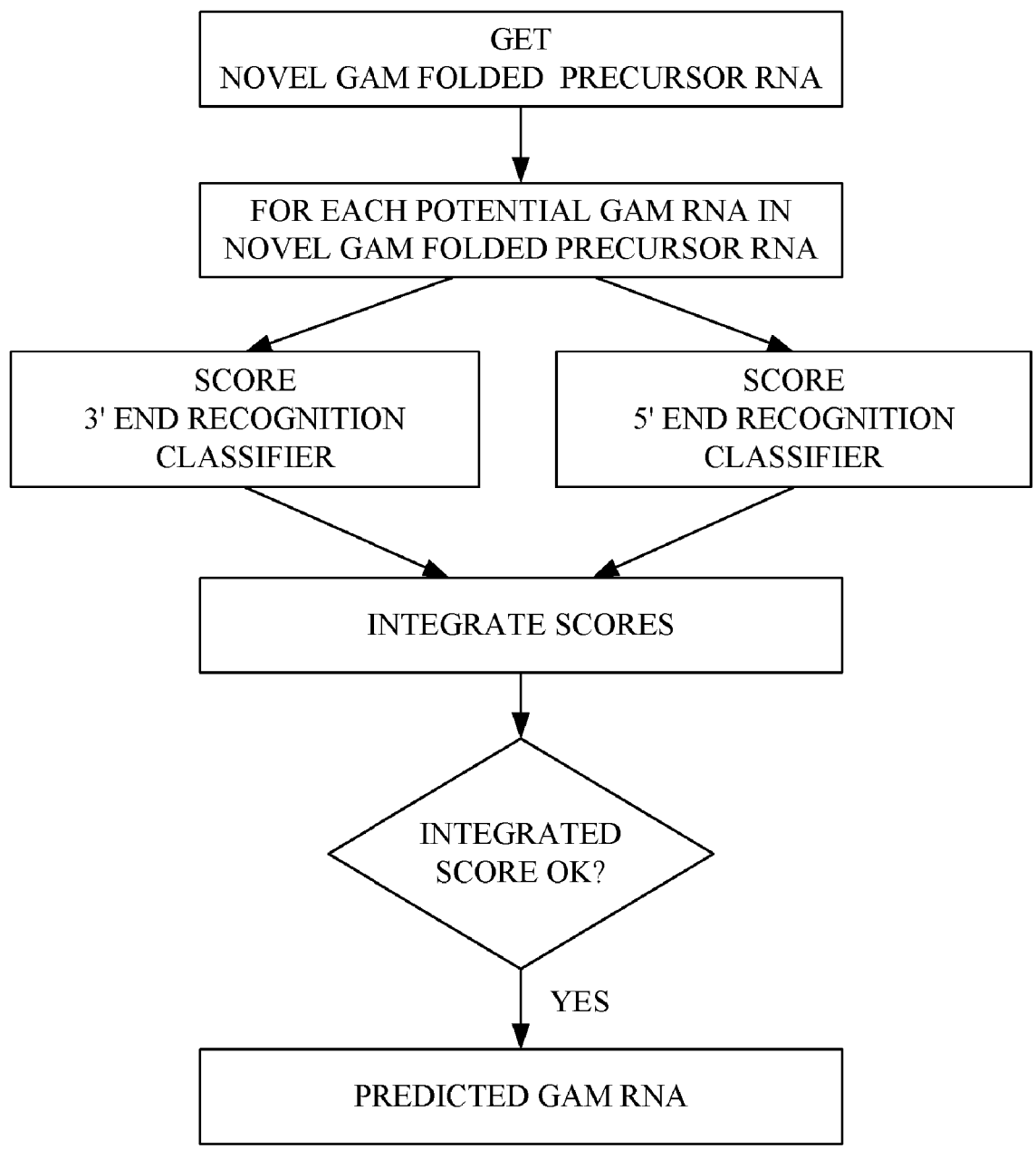
FIG. 6C is a simplified flowchart illustrating operation of a Dicer-cut location detector constructed and operative in accordance with a preferred embodiment of the present invention.

Reference is now made to FIGS. 6A-6C, which together describe the structure and operation of the Dicer-cut location detector 116, described hereinabove with reference to FIG. 2.

Reference is now made to FIG. 6A, which is a simplified block diagram of a preferred implementation of the Dicer-cut location detector 116. The goal of the Dicer-cut location detector 116 is to detect the location in which the DICER COMPLEX, described hereinabove with reference to FIG. 1, dices GAM FOLDED PRECURSOR RNA, yielding GAM RNA.

The Dicer-cut location detector 116 therefore receives a plurality of hairpin structures on genomic sequences, designated by reference numeral 138 (FIG. 5A), and following operation of Dicer-cut location detector training & validation functionality 126 (FIG. 3), is operative to detect a plurality of Dicer-cut sequences from hairpin structures, designated by reference numeral 140.

Reference is now made to FIG. 6B, which is a simplified flowchart illustrating a preferred implementation of Dicer-cut location detector training & validation functionality 126.

A general goal of the Dicer-cut location detector training & validation functionality 126 is to analyze the Dicer-cut locations of known diced miRNA on respective hairpin-shaped miRNA precursors in order to determine a common pattern in these locations, which can be used to predict Dicer-cut locations on GAM folded precursor RNAs.

The Dicer-cut locations of known miRNA precursors are obtained and studied. Locations of the 5' and/or 3' ends of the known diced miRNA oligonucleotides are preferably represented by their respective distances from the 5' end of the corresponding hairpin-shaped miRNA precursor. Additionally or alternatively, the 5' and/or 3' ends of the known diced miRNA oligonucleotides are preferably represented by the relationship between their locations and the locations of one or more nucleotides along the hairpin-shaped miRNA precursor. Additionally or alternatively, the 5' and/or 3' ends of the known diced miRNA oligonucleotides are preferably represented by the relationship between their locations and the locations of one or more bound nucleotide pairs along the hairpin-shaped miRNA precursor. Additionally or alternatively, the 5' and/or 3' ends of the known diced miRNA oligonucleotides are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides are preferably represented by their respective distances from the loop located at the center of the corresponding hairpin-shaped miRNA precursor.

One or more of the foregoing location metrics may be employed in the Dicer-cut location detector training & validation functionality 126. Additionally, metrics related to the nucleotide content of the diced miRNA and/or of the hairpin-shaped miRNA precursor may be employed.

In a preferred embodiment of the present invention, Dicer-cut location detector training & validation functionality 126 preferably employs standard machine learning techniques known in the art of machine learning to analyze existing patterns in a given "training set" of examples. Standard machine learning techniques are capable, to a certain degree, of detecting patterns in examples to which they have not been previously exposed that are similar to those in the "training set". Such machine learning techniques include, but are not limited to neural networks, Bayesian Modeling, Bayesian Networks, Support Vector Machines (SVM), Genetic Algorithms, Markovian Modeling, Maximum Likelihood Modeling, Nearest Neighbor Algorithms, Decision Trees and other techniques, as is well-known in the art.

In accordance with an embodiment of the present invention, two or more classifiers or predictors based on the above-mentioned machine learning techniques are separately trained on the abovementioned training set, and are used jointly in order to predict the Dicer-cut location. As an example, FIG. 6B illustrates operation of two classifiers, a 3' end recognition classifier and a 5' end recognition classifier. Most preferably, the Dicer-cut location detector training & validation functionality 126 implements a "best-of-breed" approach employing a pair of classifiers based on the abovementioned Bayesian Modeling and Nearest Neighbor Algorithms, and accepting only "potential GAM RNAs" that score highly on one of these predictors. In this context, "high scores" means scores that have been demonstrated to have low false positive value when scoring known miRNA oligonucleotides. Alternatively, the Dicer-cut location detector training & validation functionality 126 may implement operation of more or less than two classifiers.

Predictors used in a preferred embodiment of the present invention are further described hereinbelow with reference to FIG. 6C. A computer program listing of a computer program implementation of the Dicer-cut location detector training & validation functionality 126 is enclosed on an electronic medium in computer-readable form, and is hereby incorporated by reference herein.

When evaluated on the abovementioned validation set of 440 published miRNA oligonucleotides using k-fold cross validation (Mitchell, 1997) with k=3, the performance of the resulting predictors is as follows: In 70% of known miRNA oligonucleotides, a 5' end location is correctly determined by a Support Vector Machine predictor within up to two nucleotides; a Nearest Neighbor (EDIT DISTANCE) predictor achieves 56% accuracy ($247/440$); and a Two-Phased Predictor that uses Bayesian modeling (TWO PHASED) achieves 80% accuracy ($352/440$) when only the first phase is used. When the second phase (strand choice) is implemented by a naive Bayesian model, the accuracy is 55% ($244/440$), and when the K-nearest-neighbor modeling is used for the second phase, $374/440$ decisions are made and the accuracy is 65% ($242/374$). A K-nearest-neighbor predictor (FIRST-K) achieves 61% accuracy ($268/440$). The accuracies of all predictors are considerably higher on top-scoring subsets of published miRNA oligonucleotides.

Finally, in order to validate the efficacy and accuracy of the Dicer-cut location detector 116, a sample of novel oligonucleotides detected thereby is preferably selected, and validated by wet lab experiments. Laboratory results validating the efficacy of the Dicer-cut location detector 116 are described hereinbelow with reference to FIGS. 13-15D, FIG. 18 and also in the enclosed file Table 12.

Laboratory confirmation of bioinformatically predicted oligonucleotides of the viral GAM group of oligonucleotides, and several bioinformatically predicted viral polynucleotides of the GR group of polynucleotides, is described hereinbelow with reference to FIGS. 19-20.

Reference is now made to FIG. 6C, which is a simplified flowchart illustrating an operation of a Dicer-cut location detector 116 (FIG. 2), constructed and operative in accordance with a preferred embodiment of the present invention. The Dicer-cut location detector 116 preferably comprises a machine learning computer program module, which is trained to recognize Dicer-cut locations on known hairpin-shaped miRNA precursors, and based on this training, is operable to detect Dicer-cut locations of novel GAM RNA (FIG. 1) on GAM FOLDED PRECURSOR RNA (FIG. 1). In a preferred embodiment of the present invention, the Dicer-cut location module preferably utilizes machine learning algorithms, including but not limited to Support Vector Machine, Bayesian modeling, Nearest Neighbors, and K-nearest-neighbor algorithms that are known in the art.

When initially assessing a novel GAM FOLDED PRECURSOR RNA, each 19-24 nt-long segment thereof is considered to be a potential GAM RNA, because the Dicer-cut location is initially unknown.

For each such potential GAM RNA, the location of its 5' end or the locations of its 5' and 3' ends are scored by at least one recognition classifier or predictor, operating on features such as the following: Locations of the 5' and/or 3' ends of the known diced miRNA oligonucleotides, which are preferably represented by their respective distances from the 5' end of the corresponding hairpin-shaped miRNA precursor. Additionally or alternatively, the 5' and/or 3' ends of the known diced miRNA oligonucleotides, which are preferably represented by the relationship between their locations and the locations of one or more nucleotides along the hairpin-shaped miRNA precursor. Additionally or alternatively, the 5' and/or 3' ends of the known diced miRNA oligonucleotides, which are preferably represented by the relationship between their locations and the locations of one or more bound nucleotide pairs along the hairpin-shaped miRNA precursor. Additionally or alternatively, the 5' and/or 3' ends of the known diced miRNA oligonucleotides, which are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides, which are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides, which are preferably represented by their respective distances from the loop located at the center of the corresponding hairpin-shaped miRNA precursor. Additionally or alternatively, metrics related to the nucleotide content of the diced miRNA and/or of the hairpin-shaped miRNA precursor.

In a preferred embodiment of the present invention, the Dicer-cut location detector 116 (FIG. 2) may use a Support Vector Machine predictor.

In another preferred embodiment of the present invention, the Dicer-cut location detector 116 (FIG. 2) preferably employs an "EDIT DISTANCE" predictor, which seeks sequences that are similar to those of known miRNA oligonucleotides, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the Dicer-cut location detector 116 (FIG. 2) preferably uses a "TWO PHASE" predictor, which predicts the Dicer-cut location in two distinct phases: (a) selecting a double-stranded segment of the GAM FOLDED PRECURSOR RNA (FIG. 1) comprising the GAM RNA by naive Bayesian modeling and (b) detecting which strand of the double-stranded segment contains GAM RNA (FIG. 1) by employing either naive or K-nearest-neighbor modeling. K-nearest-neighbor modeling is a variant of the "FIRST-K" predictor described hereinbelow, with parameters optimized for this specific task. The "TWO PHASE" predictor may be operated in two modes: either utilizing only the first phase and thereby producing two alternative Dicer-cut location predictions, or utilizing both phases and thereby producing only one final Dicer-cut location.

In still another preferred embodiment of the present invention, the Dicer-cut location detector 116 preferably uses a "FIRST-K" predictor, which utilizes a K-nearest-neighbor algorithm. The similarity metric between any two sequences is $1-E/L$, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 1) are not significantly different, these locations are further ranked by a Bayesian model, similar to the one described hereinabove.

In accordance with an embodiment of the present invention, scores of two or more of the abovementioned classifiers or predictors are integrated, yielding an integrated score for each potential GAM RNA. As an example, FIG. 6C illustrates an integration of scores from two classifiers, a 3' end recognition classifier and a 5' end recognition classifier, the scores of which are integrated to yield an integrated score. Most preferably, the INTEGRATED SCORE of FIG. 6C preferably implements a "best-of-breed" approach employing a pair of classifiers and accepting only "potential GAM RNAs" that score highly on one of the abovementioned "EDIT DISTANCE" or "TWO PHASE" predictors. In this context, "high scores" means scores that have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

In a preferred embodiment of the present invention, PREDICTED GAM RNAs comprising a low complexity nucleotide sequence (e.g., ATATATA) may optionally be filtered out, because there is a high probability that they are part of a repeated element in the DNA, and are therefore not functional, as is known in the art. For each PREDICTED GAM RNA sequence, the number of occurrences of each two nt combination (AA, AT, AC) comprised in that sequence is counted. PREDICTED GAM RNA sequences where the sum of the two most probable combinations is higher than a threshold, preferably 8-10, are filtered out. As an example, when the threshold is set such that 2% of the known miRNA oligonucleotides are filtered out, 30% of the predicted GAM RNAs are filtered out.

Figure 7A:
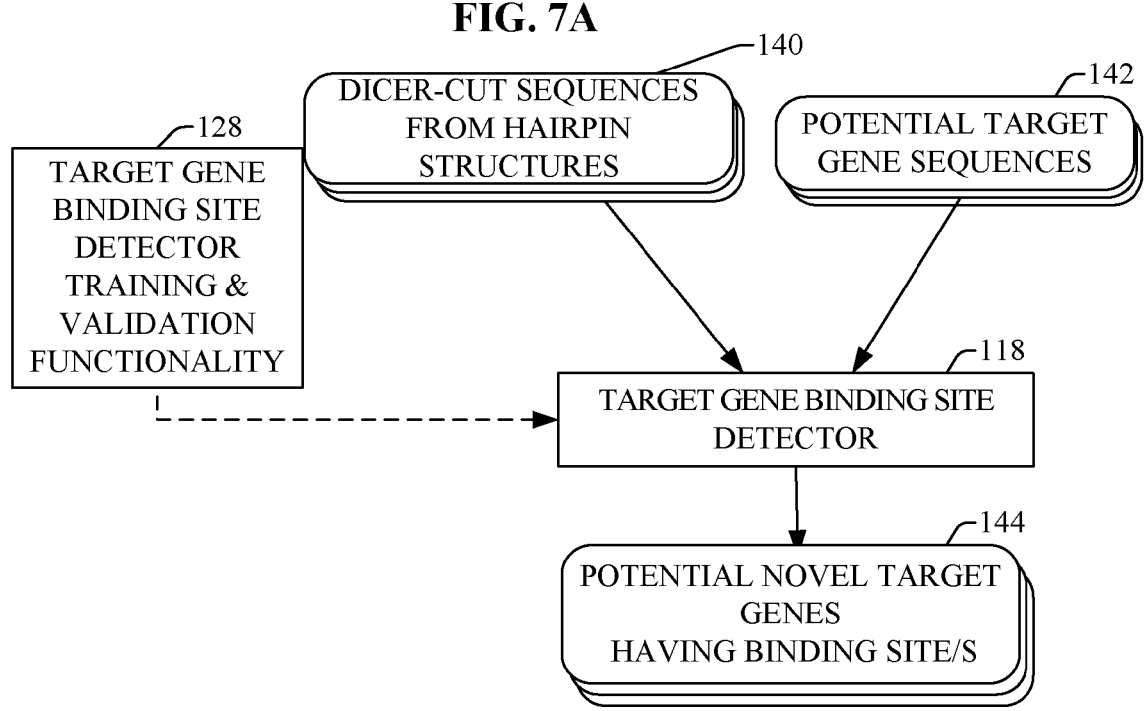
FIG. 7A is a simplified block diagram of a target gene binding site detector constructed and operative in accordance with a preferred embodiment of the present invention.

Reference is now made to FIG. 7A, which is a simplified block diagram of a preferred implementation of the target gene binding site detector 118 described hereinabove with reference to FIG. 2. The goal of the target gene binding site detector 118 is to detect one or more binding sites located in 3'UTRs of the mRNA of a known gene, such as BINDING SITE I, BINDING SITE II and BINDING SITE III (FIG. 1), the nucleotide sequence of which binding sites is partially or fully complementary to a GAM RNA, thereby determining that the abovementioned known gene is a target gene of the GAM RNA.

The target gene binding site detector 118 (FIG. 2) receives a plurality of Dicer-cut sequences from hairpin structures 140 (FIG. 6A) and a plurality of potential target gene sequences 142, which are derived from sequenced DNA data 104 (FIG. 2).

The target gene binding site detector training & validation functionality 128 (FIG. 3) is operative to train the target gene binding site detector 118 on known miRNA oligonucleotides and their respective target genes and to build a background model for an evaluation of the probability of achieving similar results randomly (P value) for the target gene binding site detector 118 results. The target gene binding site detector training & validation functionality 128 constructs the model by analyzing both heuristically and computationally the results of the target gene binding site detector 118.

Following operation of target gene binding site detector training & validation functionality 128 (FIG. 3), the target gene binding site detector 118 is operative to detect a plurality of potential novel target genes having binding site/s 144, the nucleotide sequence of which is partially or fully complementary to that of each of the plurality of Dicer-cut sequences from hairpin structures 140. Preferred operation of the target gene binding site detector 118 is further described hereinbelow with reference to FIG. 7B.

Figure 7B:
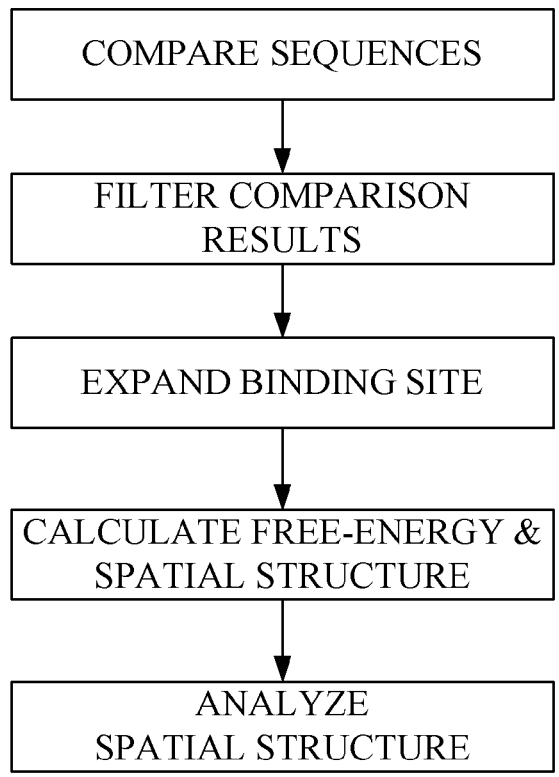
FIG. 7B is a simplified flowchart illustrating operation of a target gene binding site detector constructed and operative in accordance with a preferred embodiment of the present invention.

Reference is now made to FIG. 7B, which is a simplified flowchart illustrating a preferred operation of the target gene binding site detector 118 of FIG. 2.

In an embodiment of the present invention, the target gene binding site detector 118 first compares nucleotide sequences of each of the plurality of Dicer-cut sequences from hairpin structures 140 (FIG. 6A) to the potential target gene sequences 142 (FIG. 7A), such as 3' side UTRs of known mRNAs, in order to find crude potential matches. This step may be performed using a simple alignment algorithm such as BLAST.

Then, the target gene binding site detector 118 filters these crude potential matches, to find closer matches, which more closely resemble published miRNA oligonucleotide binding sites.

Next, the target gene binding site detector 118 expands the nucleotide sequences of the 3'UTR binding site found by the sequence comparison algorithm (e.g. BLAST or EDIT DISTANCE). A determination is made whether any sub-sequence of the expanded sequence may improve the match. The best match is considered the alignment.

Free-energy and spatial structure are computed for the resulting binding sites. Calculation of spatial structure may be performed by a secondary structure folding algorithm based on free-energy minimization, such as the MFOLD algorithm described in Mathews et al. (J. Mol. Biol. 288: 911-940 (1999)) and Zuker (Nucleic Acids Res. 31: 3406-3415 (2003)), the disclosure of which is hereby incorporated by reference. Free-energy, spatial structure and the above preferences are reflected in scoring. The resulting scores are compared with scores characteristic of known binding sites of published miRNA oligonucleotides, and each binding site is given a score that reflects its resemblance to these known binding sites.

Finally, the target gene binding site detector 118 analyzes the spatial structure of the binding site. Each 3'UTR-GAM oligonucleotide pair is given a score. Multiple binding sites of the same GAM oligonucleotides to a 3'UTR are given higher scores than those that bind only once to a 3'UTR.

In a preferred embodiment of the present invention, performance of the target gene binding site detector 118 may be improved by integrating several of the abovementioned logical steps, using the methodology described hereinbelow.

For each of the Dicer-cut sequence from hairpin structures 140, its starting segment, e.g. a segment comprising the first 8 nts from its 5' end, is obtained. For each starting segment, all of the 9 nt segments that are highly complementary to the starting segment are calculated. These calculated segments are referred to here as "potential binding site end segments". In a preferred embodiment of the present invention, for each 8 nt starting segment, the potential binding site end segments are all 9 nt segments whose complementary sequence contains a 7-9 nt sub-sequence that is not different from the starting segment by more than an insertion, deletion or replacement of one nt. Calculation of potential binding site end segments is preferably performed by a pre-processing tool that maps all possible 8 nt segments to their respective 9 nt segments.

Next, the mRNAs 3'UTRs is parsed into all the segments, with the same length as the potential binding site end segments, preferably 9 nt segments, comprised in the 3'UTR. Location of each such segment is noted, stored in a performance-efficient data structure and compared to the potential binding site end segments calculated in the previous step.

The target gene binding site detector 118 then expands the binding site sequence, preferably in the binding site 5' direction (i.e. immediately upstream), assessing the degree of its alignment to the Dicer-cut sequence from hairpin structures 140. Preferably, an alignment algorithm is implemented which uses specific weighting parameters based on an analysis of known miRNA oligonucleotide binding sites. As an example, it is apparent that a good match of the 3' end of the binding site is critically important, a match of the 5' end is less important but can compensate for a small number of mismatches at the 3' end of the binding site, and a match of the middle portion of the binding site is much less important.

Next, the number of binding sites found in a specific 3'UTR, the degree of alignment of each of these binding sites, and their proximity to each other are assessed and compared to these properties found in known binding sites of published miRNA oligonucleotides. In a preferred embodiment, the fact that many of the known binding sites are clustered is used to evaluate the P value of obtaining a cluster of a few binding sites on the same target gene 3'UTR in the following way. It scans different score thresholds and calculates for each threshold the number and positions of possible binding sites with a score above the threshold. It then gets a P value for each threshold from a preprocessed calculated background matrix, described hereinbelow, and a number and positions of binding sites combination. The output score for each Dicer-cut sequences from hairpin structures 140 and potential target gene sequences 142 is the minimal P value, normalized with the number of threshold trails using a Bernoulli distribution. A preference of low P value pairs is made.

As mentioned hereinabove, for each target gene, a preprocessed calculated background matrix is built. The matrix includes rows for each number of miRNA oligonucleotide binding sites (in the preferred embodiment, the matrix includes 7 rows to accommodate 0 to 6 binding sites), and columns for each different score threshold (in the preferred embodiment, the matrix includes 5 columns for 5 different thresholds). Each matrix cell, corresponding to a specific number of binding sites and thresholds, is set to be the probability of getting equal or higher number binding sites and an equal or higher score using random 22 nt-long sequences with the same nucleotide distribution as known miRNA oligonucleotides (29.5% T, 24.5% A, 25% G and 21% C). Those probabilities are calculated by running the above procedure for 10000 random sequences that preserved the known miRNA nucleotide distribution (these sequence will be also referred to as miRNA oligonucleotide random sequences). The P value can be estimated as the number of random sequences that obeys the matrix cell requirement divided by the total number of random sequences (10000). In the preferred embodiment, 2 matrices are calculated. The P values of the second matrix are calculated under a constraint that at least two of the binding site positions are under a heuristically-determined constant value. The values of the second matrix are calculated without this constraint. The target gene binding site detector 118 uses the second matrix if the binding site positions agree with the constraint. Otherwise, it uses the first. In an alternative embodiment, only one matrix is calculated without any constraint on the binding sites positions.

A test performed using the target gene binding site detector 118 shows that all of the known miRNA oligonucleotide target genes are found using this algorithm with a P value of less than 0.5%. Running known miRNA oligonucleotides against 3400 potential 3'UTR of target gene sequences yields on average 32 target genes for each miRNA oligonucleotide with a P value less than 0.5%, while background sequences, as well as inverse or complement sequence of known miRNA oligonucleotide (which preserve their high order sequence statistics) found, as expected, 17 target genes on average. This result reflects that the algorithm has the ability to detect real target genes with 47% accuracy.

Finally, orthology data may optionally be used to further prefer binding sites based on their conservation. Preferably, this may be used in cases such as (a) where both the target mRNA and miRNA oligonucleotide have orthologues in another organism, e.g. Human-Mouse orthology, or (b) where a miRNA oligonucleotide (e.g. viral miRNA oligonucleotide) targets two mRNAs in orthologous organisms. In such cases, binding sites that are conserved are preferred.

In accordance with another preferred embodiment of the present invention, binding sites may be searched by a reverse process. Sequences of K (preferably 22) nucleotides in a UTR of a target gene are assessed as potential binding sites. A sequence comparison algorithm, such as BLAST or EDIT DISTANCE variant, is then used to search elsewhere in the genome for partially or fully complementary sequences that are found in known miRNA oligonucleotides or computationally-predicted GAM oligonucleotides. Only complementary sequences that meet predetermined spatial structure and free-energy criteria as described hereinabove, are accepted. Clustered binding sites are strongly preferred and potential binding sites and potential GAM oligonucleotides that occur in evolutionarily-conserved genomic sequences are also preferred. Scoring of candidate binding sites takes into account free-energy and spatial structure of the binding site complexes, as well as the aforesaid preferences.

UTRs of GAM viral target genes were preferably extracted directly from annotation of UTR records. Alternatively, UTR of GAM viral target genes were preferably extracted by taking the sequences spanned from last coding position to the 3' end of the mRNA sequence annotation. Alternatively, UTR of GAM viral target genes were preferably extracted by taking 400 nts downstream to the end-coding region of the mRNA sequence. All of abovementioned methods were applied on complete viral genomes data in GeneBank format from the NCBI RefSeq database, version 18-Jan.-2004

(ftp://ftp.ncbi.nih.gov/refseq/release/viral).

Figure 8:
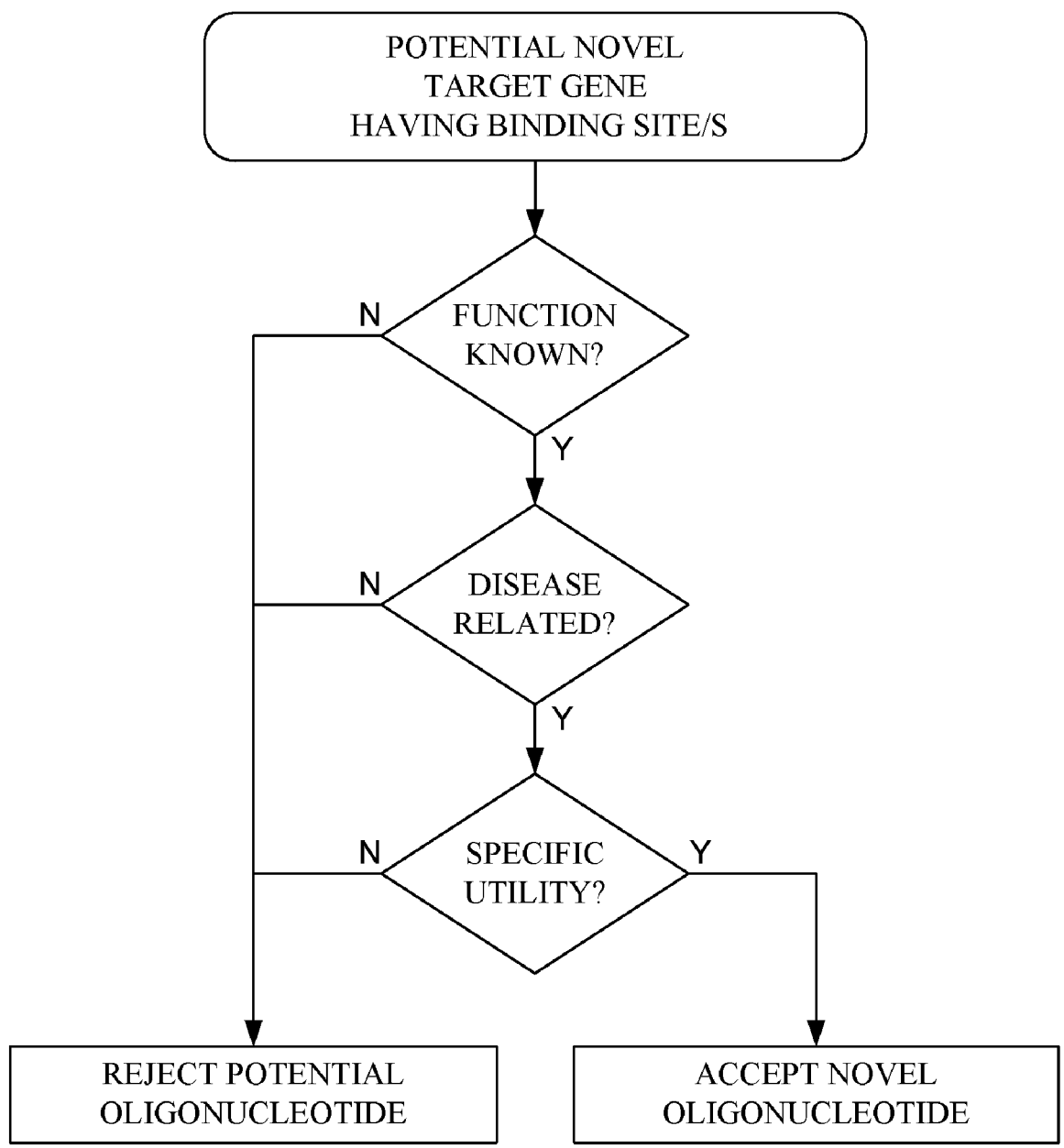
FIG. 8 is a simplified flowchart illustrating operation of a function and utility analyzer constructed and operative in accordance with a preferred embodiment of the present invention.

Reference is now made to FIG. 8, which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The function & utility analyzer 120 preferably receives as input a plurality of potential novel target genes having binding site/s 144 (FIG. 7A), generated by the target gene binding site detector 118 (FIG. 2). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published, as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Reference is now made to FIG. 9, which is a simplified diagram describing each of a plurality of novel bioinformatically-detected regulatory polynucleotide referred to in this Table as the Genomic Record (GR) polynucleotide. GR encodes an operon-like cluster of novel miRNA-like oligonucleotides, each of which in turn modulates expression of at least one target gene. The function and utility of at least one target gene is known in the art.

The GR PRECURSOR is a novel, bioinformatically-detected, regulatory, non-protein-coding polynucleotide. The method by which the GR PRECURSOR is detected is described hereinabove with additional reference to FIGS. 1-9.

GR PRECURSOR is preferably encoded by a viral genome and contains a cluster of novel viral oligonucleotides, which preferably bind to human target genes or to virus genes. Alternatively or additionally, GR PRECURSOR is encoded by the human genome and contains a cluster of novel human oligonucleotides, which preferably bind to viral target genes or to human genes.

The GR PRECURSOR encodes GR PRECURSOR RNA that is typically several hundred to several thousand nts long. The GR PRECURSOR RNA folds spatially, forming the GR FOLDED PRECURSOR RNA. It is appreciated that the GR FOLDED PRECURSOR RNA comprises a plurality of what is known in the art as hairpin structures. Hairpin structures result from the presence of segments of the nucleotide sequence of GR PRECURSOR RNA in which the first half of each such segment has a nucleotide sequence which is at least a partial, and sometimes an accurate, reverse-complement sequence of the second half thereof, as is well known in the art.

The GR FOLDED PRECURSOR RNA is naturally processed by cellular enzymatic activity into a plurality of separate GAM precursor RNAs, herein schematically represented by GAM1 FOLDED PRECURSOR RNA through GAM3 FOLDED PRECURSOR RNA. Each GAM folded precursor RNA is a hairpin-shaped RNA segment, corresponding to GAM FOLDED PRECURSOR RNA of FIG. 1.

The abovementioned GAM folded precursor RNAs are diced by DICER COMPLEX of FIG. 1, yielding schematically represented by GAM1 RNA through GAM3 RNA, short RNA segments of about 22 nts in length. Each GAM RNA corresponds to GAM RNA of FIG. 1.

GAM1 RNA, GAM2 RNA and GAM3 RNA each bind complementarily to binding sites located in the untranslated regions of their respective target genes, designated GAM1 TARGET RNA, GAM2 TARGET RNA and GAM3 TARGET RNA, respectively. These target binding sites correspond to BINDING SITE I, BINDING SITE II and BINDING SITE III of FIG. 1. The binding of each GAM RNA to its target RNA inhibits the translation of its respective target proteins, designated GAM1 TARGET PROTEIN, GAM2 TARGET PROTEIN and GAM3 TARGET PROTEIN, respectively.

It is appreciated that the specific functions, and accordingly the utilities, of the GR polynucleotide are correlated with and may be deduced from the identity of the target genes that are inhibited by GAM RNAs that are present in the operon-like cluster of the polynucleotide. Thus, for the GR polynucleotide, schematically represented by GAM1 TARGET PROTEIN through GAM3 TARGET PROTEIN that are inhibited by the GAM RNA. The function of these target genes is elaborated in Table 8, hereby incorporated herein.

Figure 10:
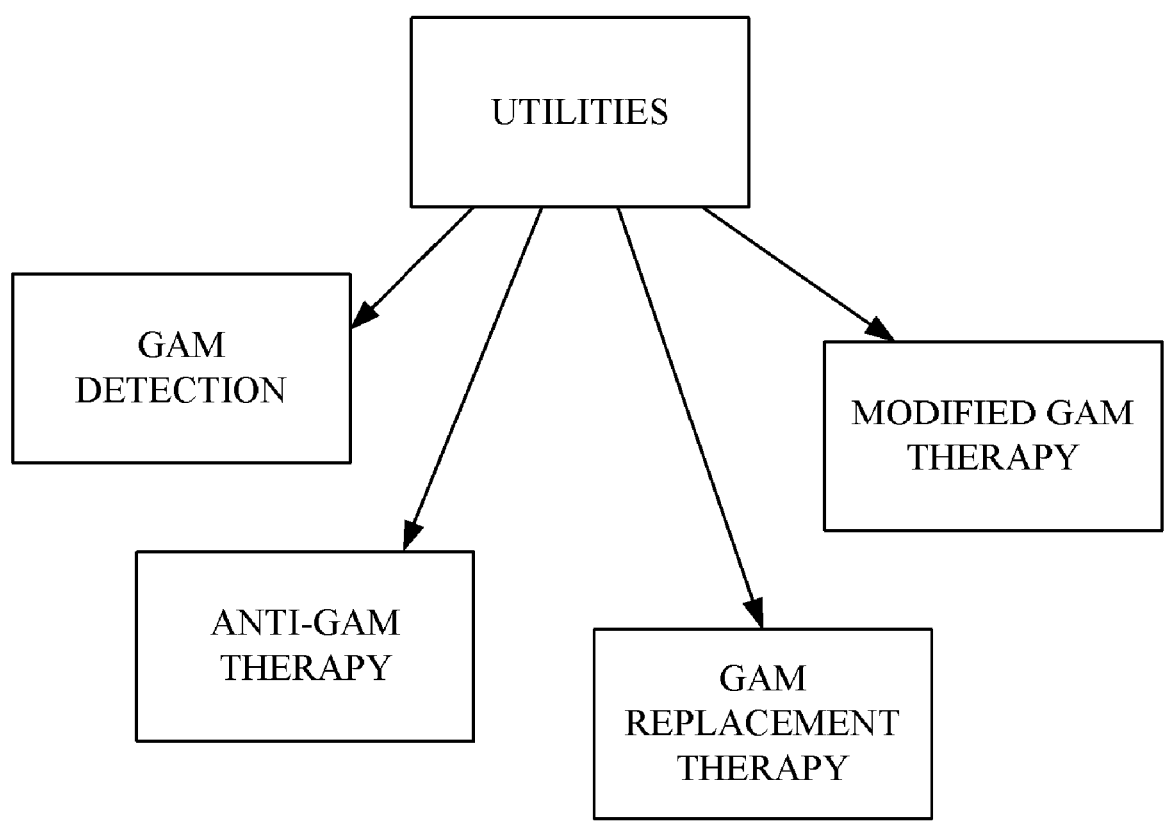
FIG. 10 is a block diagram illustrating different utilities of novel oligonucleotides and novel operon-like polynucleotides, both of the present invention.

Reference is now made to FIG. 10, which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides, each of the GR polynucleotide encoding a plurality of GAM oligonucleotides.

The present invention further discloses a very large number of known target genes, which are bound by, and the expression of which is modulated by each of the novel oligonucleotides of the present invention. Published scientific data referenced by the present invention provides specific, substantial, and credible evidence that the abovementioned target genes modulated by novel oligonucleotides of the present invention, are associated with various diseases. Specific novel oligonucleotides of the present invention, target genes thereof and diseases associated therewith, are described hereinbelow with reference to Tables 1 through 12. It is therefore appreciated that a function of GAM oligonucleotides and GR polynucleotides of the present invention is modulation of expression of target genes related to known viral diseases, and that therefore utilities of novel oligonucleotides of the present invention include diagnosis and treatment of the abovementioned diseases.

FIG. 10 describes various types of diagnostic and therapeutic utilities of novel oligonucleotides of the present invention. A utility of novel oligonucleotide of the present invention is detection of GAM oligonucleotides and of GR polynucleotides. It is appreciated that since GAM oligonucleotides and GR polynucleotides modulate expression of disease related target genes, that detection of expression of GAM oligonucleotides in clinical scenarios associated with said viral diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the abovementioned related viral diseases, for disease diagnosis and prevention purposes, and for monitoring disease progress.

Another utility of novel oligonucleotides of the present invention is anti-GAM therapy, a mode of therapy which allows up regulation of a viral disease-related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific viral disease. Anti-GAM therapy is further discussed hereinbelow with reference to FIGS. 11A and 11B.

A further utility of novel oligonucleotides of the present invention is GAM replacement therapy, a mode of therapy which achieves down regulation of a viral disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific viral disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art.

Yet a further utility of novel oligonucleotides of the present invention is modified GAM therapy. Disease conditions are likely to exist, in which a mutation in a binding site of a GAM RNA prevents natural GAM RNA to effectively bind inhibit a viral disease related target gene, causing up regulation of that target gene, and thereby contributing to the disease pathology.

In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art.

Figure 11A:
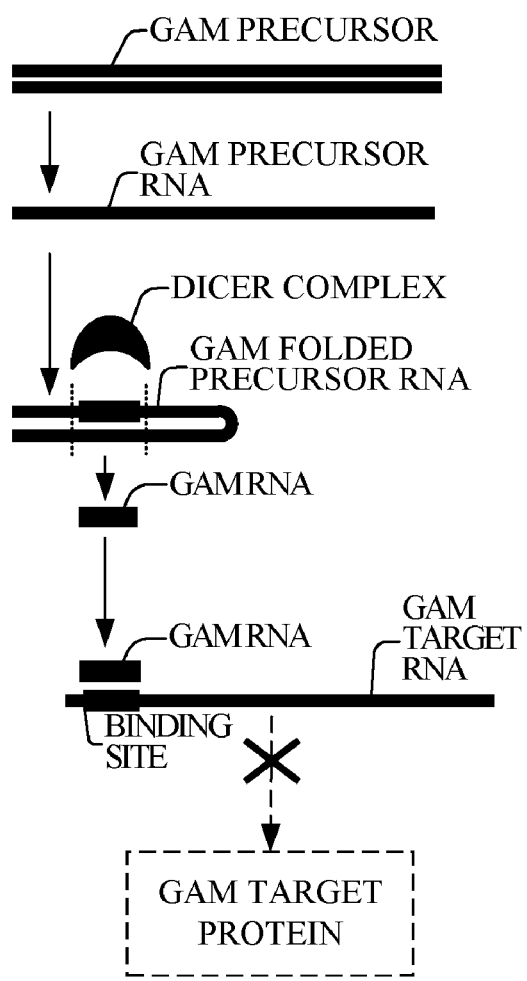
FIGS. 11A and 11B are simplified diagrams which, when taken together, illustrate a mode of oligonucleotide therapy applicable to novel oligonucleotides of the present invention.
Figure 11B:
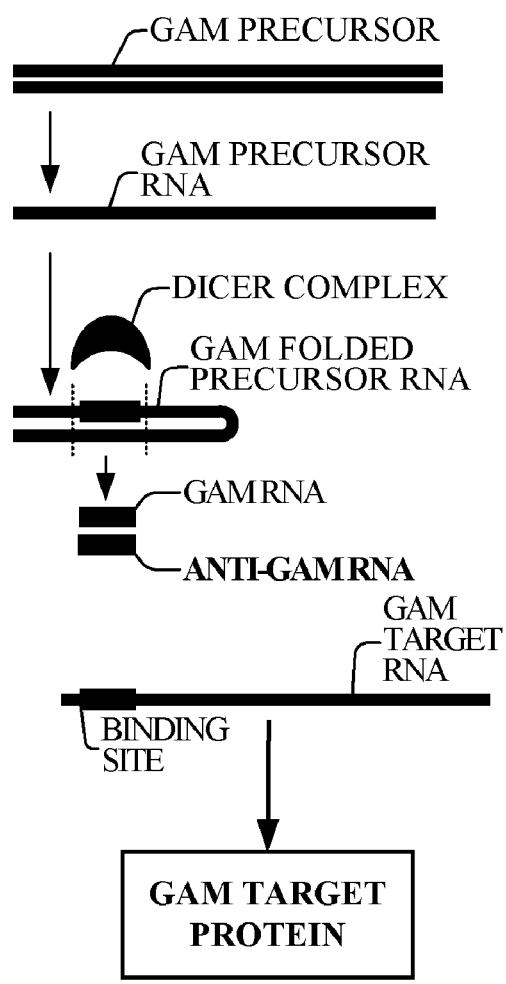

Reference is now made to FIGS. 11A and 11B, which are simplified diagrams which when taken together illustrate anti-GAM therapy mentioned hereinabove with reference to FIG. 10. A utility of novel GAMs of the present invention is anti-GAM therapy, a mode of therapy which allows up regulation of a viral disease-related target gene of a novel GAM of the present invention, by lowering levels of the novel GAM which naturally inhibits expression of that target gene. FIG. 11A shows a normal GAM inhibiting translation of a target gene by binding of GAM RNA to a BINDING SITE found in an untranslated region of GAM TARGET RNA, as described hereinabove with reference to FIG. 1.

FIG. 11B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific viral disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 12A:
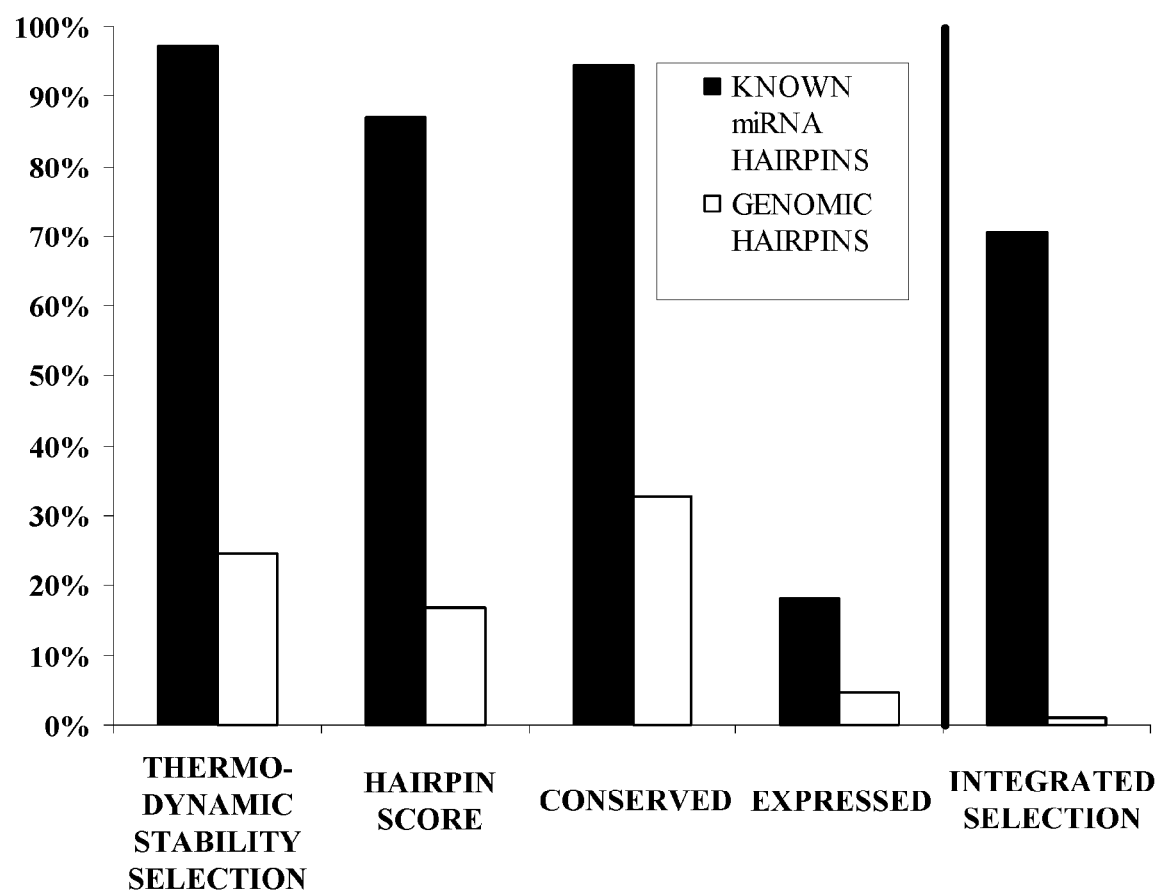
FIG. 12A is a bar graph illustrating performance results of a hairpin detector constructed and operative in accordance with a preferred embodiment of the present invention.

Reference is now made to FIG. 12A, which is a bar graph illustrating performance results of the hairpin detector 114 (FIG. 2) constructed and operative in accordance with a preferred embodiment of the present invention.

FIG. 12A illustrates efficacy of several features used by the hairpin detector 114 to detect GAM FOLDED PRECURSOR RNAs (FIG. 1). The values of each of these features is compared between a set of published miRNA precursor oligonucleotides, represented by shaded bars, and a set of random hairpins folded from the human genome denoted hereinbelow as a hairpin background set, represented by white bars. The published miRNA precursor oligonucleotides set is taken from RFAM database, Release 2.1 and includes 148 miRNA oligonucleotides from *H. Sapiens*. The background set comprises a set of 10,000 hairpins folded from the human genome.

It is appreciated that the hairpin background set is expected to comprise some valid, previously undetected hairpin-shaped miRNA precursor-like GAM FOLDED PRECURSOR RNAs of the present invention, and many hairpin-shaped sequences that are not hairpin-shaped miRNA-like precursors.

For each feature, the bars depict the percent of known miRNA hairpin precursors (shaded bars) and the percent of background hairpins (white bars) that pass the threshold for that feature. The percent of known miRNA oligonucleotides that pass the threshold indicates the sensitivity of the feature, while the corresponding background percent implies the specificity of the feature, although not precisely, because the background set comprises both true and false examples.

The first bar pair, labeled Thermodynamic Stability Selection, depicts hairpins that have passed the selection of "families" of closely related hairpin structures, as described hereinabove with reference to FIG. 5B.

The second bar pair, labeled Hairpin Score, depicts hairpins that have been selected by hairpin detector 114 (FIG. 5B), regardless of the "families" selection.

The third bar pair, labeled Conserved, depicts hairpins that are conserved in human, mouse and rat, (UCSC Goldenpath™ HG16 database).

The fourth bar pair, labeled Expressed, depicts hairpins that are found in EST blocks.

The fifth bar pair, labeled Integrated Selection, depicts hairpin structures predicted by a preferred embodiment of the present invention to be valid GAM PRECURSORs. In a preferred embodiment of the present invention, a hairpin may be considered to be a GAM PRECURSOR if its hairpin detector score is above 0, and it is in one of the following groups: a) in an intron and conserved or b) in an intergenic region and conserved or c) in an intergenic region and expressed, as described below. Further filtering of GAM precursor may be obtained by selecting hairpins with a high score of Dicer-cut location detector 116 as described hereinabove with reference to FIGS. 6A-6C, and with predicted miRNA oligonucleotides, which pass the low complexity filter as described hereinabove, and whose targets are selected by the target gene binding site detector 118 as described hereinabove with reference to FIGS. 7A-7B.

It is appreciated that these results validate the sensitivity and specificity of the hairpin detector 114 (FIG. 2) in identifying novel GAM FOLDED PRECURSOR RNAs, and in effectively distinguishing them from the abundant hairpins found in the genome.

Figure 12B:
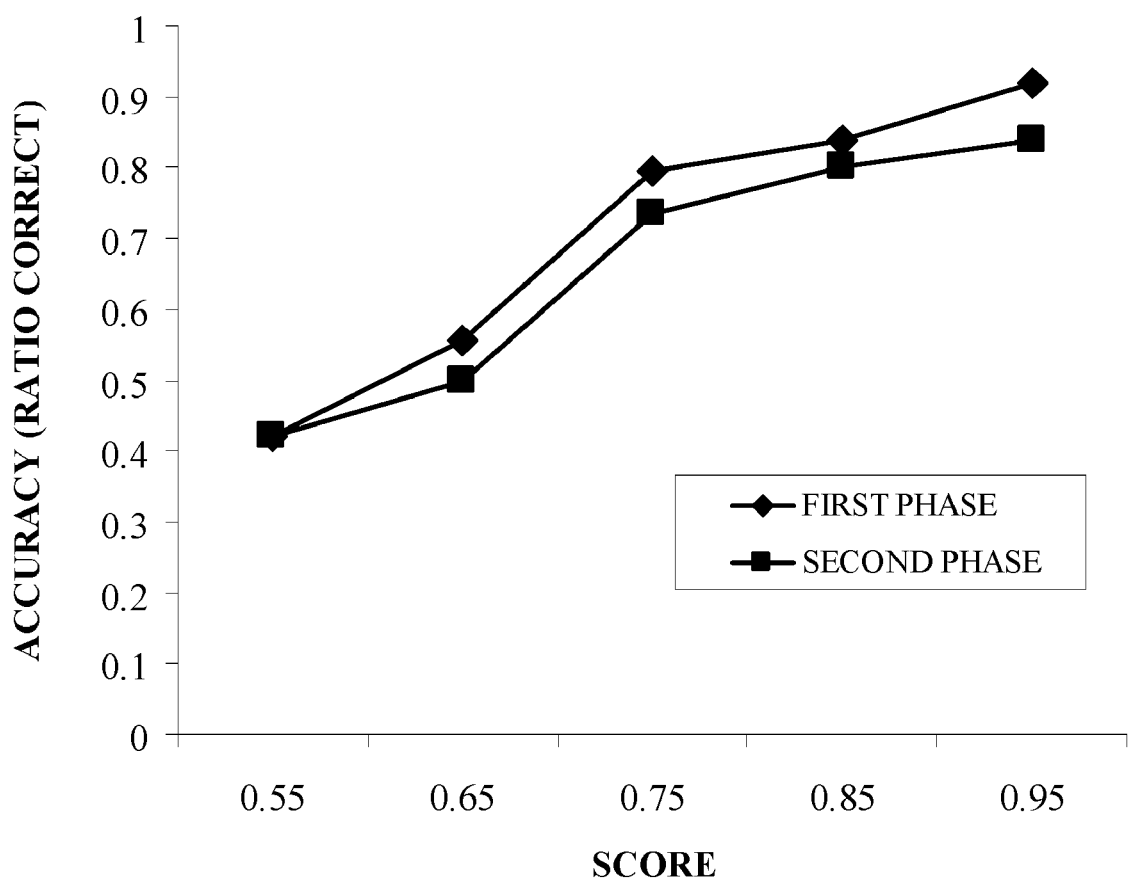
FIG. 12B is a line graph illustrating accuracy of a Dicer-cut location detector constructed and operative in accordance with a preferred embodiment of the present invention.

Reference is now made to FIG. 12B, which is a line graph illustrating accuracy of a Dicer-cut location detector 116 (FIG. 2) constructed and operative in accordance with a preferred embodiment of the present invention.

To determine the accuracy of the Dicer-cut location detector 116, a stringent training and test set was chosen from the abovementioned set of 440 known miRNA oligonucleotides, such that no two miRNA oligonucleotides in the set are homologous. This was performed to get a lower bound on the accuracy and avoid effects of similar known miRNA oligonucleotides appearing in both the training and test sets. On this stringent set of size 204, mfold cross validation with k=3 was performed to determine the percent of known miRNA oligonucleotides in which the Dicer-cut location detector 116 described hereinabove predicted the correct miRNA oligonucleotide up to two nucleotides from the correct location. The accuracy of the TWO PHASED predictor is depicted in the graph. The accuracy of the first phase of the TWO PHASED predictor is depicted by the upper line, and that of both phases of the TWO PHASED predictor is depicted by the lower line. Both are binned by the predictor score, where the score is the score of the first stage.

It is appreciated that these results validate the accuracy of the Dicer-cut location detector 116.

Figure 12C:
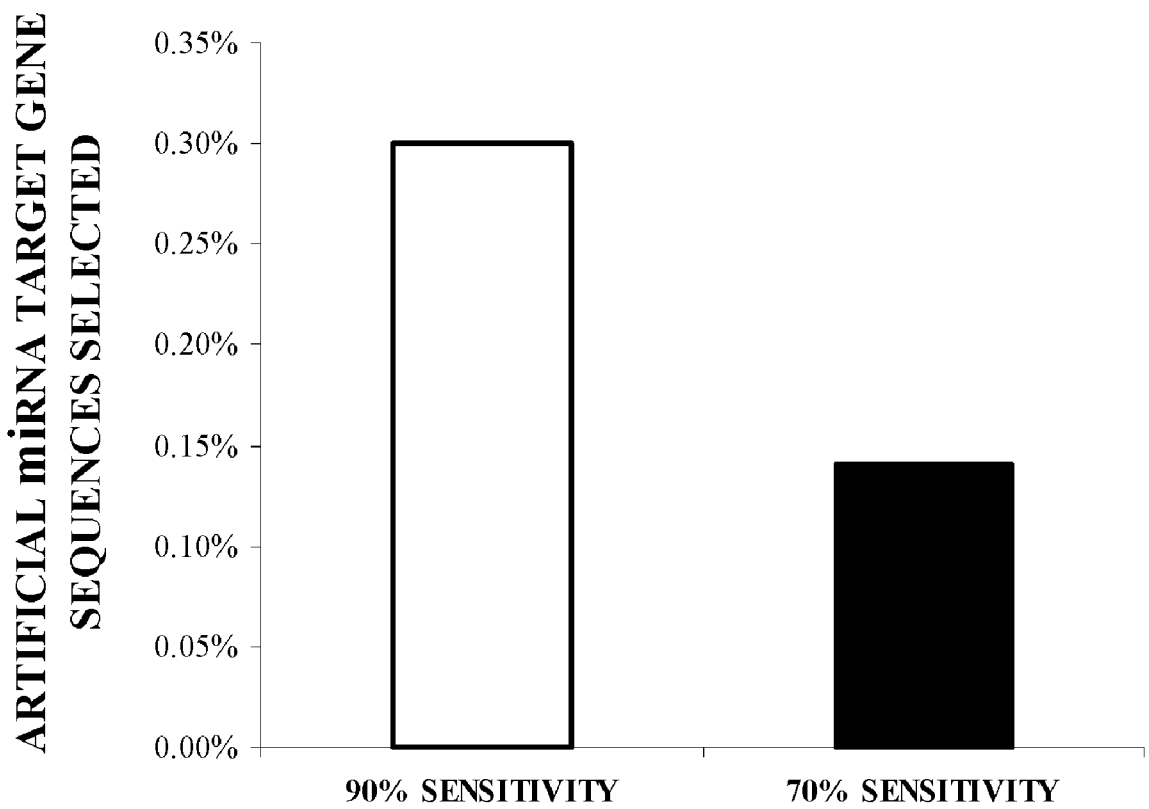
FIG. 12C is a bar graph illustrating performance results of the target gene binding site detector 118, constructed and operative in accordance with a preferred embodiment of the present invention.

Reference is now made to FIG. 12C, which is a bar graph illustrating the performance results of the target gene binding site detector 118 (FIG. 7A) constructed and operative in accordance with a preferred embodiment of the present invention.

FIG. 12C illustrates specificity and sensitivity of the target gene binding site detector 118. The values presented are the result of testing 10000 artificial miRNA oligonucleotide sequences (random 22 nt sequences with the same base composition as published miRNA oligonucleotide sequence). Adjusting the threshold parameters to fulfill 90% sensitivity of validated, published miRNA-3'UTR pairs, requires the P VAL of potential target gene sequences-Dicer-cut sequences to be less than 0.01 and also the P VAL of potential target ortholog gene sequences-Dicer-cut sequences to be less than 0.05. The target gene binding site detector 118 can filter out 99.7% of potential miRNA/gene pairs, leaving only the 0.3% that contain the most promising potential miRNA/gene pairs. Limiting the condition for the P VAL of potential target ortholog gene sequences-Dicer-cut sequences to be less than 0.01 reduces the sensitivity ratio to 70% but filters out more then 50% of the remaining 0.3%, to a final ratio of less than 0.15%.

It is appreciated that these results validate the sensitivity and specificity of the target gene binding site detector 118.

Reference is now made to FIG. 13, which is a summary table of laboratory results validating the expression of 29 novel human GAM RNA oligonucleotides in HeLa cells or, alternatively, in liver or thymus tissues detected by the bioinformatic oligonucleotide detection engine 100 (FIG. 2).

As a positive control, we used a reference set of eight known human miRNA oligonucleotides: hsa-MIR-21; hsa-MIR-27b; hsa-MIR-186; hsa-MIR-93; hsa-MIR-26a; hsa-MIR-191; hsa-MIR-31; and hsa-MIR-92. All positive controls were successfully validated by sequencing.

The table of FIG. 13 lists all GAM RNA predictions whose expression was validated. The field "Primer Sequence" contains the "specific" part of the primer; the field "Sequenced sequence" represents the nucleotide sequence detected by cloning (excluding the hemispecific primer sequence); the field "Predicted GAM RNA" contains the GAM RNA predicted sequence; the field "Distance" indicates the distance from the Primer; the number of mismatches between the "specific" region of the primer and the corresponding part of the GAM RNA sequence; the field "GAM Name" contains GAM RNA PRECURSOR ID followed by "A" or "B", which represents the GAM RNA position on the precursor as elaborated in the attached Tables.

A primer was designed such that its first half, the 5' region, is complementary to the adaptor sequence and its second half, the 3' region, anneals to the 5' terminus of GAM RNA sequence, yielding a hemispecific primer (as elaborated hereinbelow in the Methods section). A sample of 13 predicted GAM RNA sequences was examined by PCR using hemispecific primers and a primer specific to the 3' adaptor. PCR products were cloned into plasmid vectors and then sequenced. For all 13 predicted GAM RNA sequences, the GAM RNA sequence found in the hemispecific primer plus the sequence observed between the hemispecific primer and the 3' adaptor was completely included in the expected GAM RNA sequence (rows 1-7, and 29). The rest are GAM RNA predictions that were verified by cloning and sequencing, yet, by using a primer that was originally designed for a slightly different prediction.

It is appreciated that failure to detect a predicted oligonucleotide in the lab does not necessarily indicate a mistaken bioinformatic prediction. Rather, it may be due to technical sensitivity limitation of the lab test, or because the predicted oligonucleotides are not expressed in the tissue examined, or at the development phase tested. The observed GAM RNAs may be strongly expressed in HeLa cells while the original GAM RNAs are expressed at low levels in HeLa cells or not expressed at all. Under such circumstances, primer sequences containing up to three mismatches from a specific GAM RNA sequence may amplify it. Thus, we also considered cases in which differences of up to 3 mismatches in the hemispecific primer occur.

The 3' terminus of observed GAM RNA sequences is often truncated or extended by one or two nucleotides. Cloned sequences that were sequenced from both 5' and 3' termini have an asterisk appended to the row number.

Interestingly, the primer sequence followed by the observed cloned sequence is contained within five GAM RNA sequences of different lengths, and belong to 24 precursors derived from distinct loci (Row 29). Out of these, one precursor appears four times in the genome and its corresponding GAM Names are 351973-A, 352169-A, 352445-A and 358164-A.

The sequence presented in Row 29 is a representative of the group of five GAM RNAs. The full list of GAM RNA sequences and their corresponding precursors is as follows (each GAM RNA sequence is followed by the GAM Name): TCACTGCAACCTCC ACCTCCCA (352092, 352651,355761) (SEQ ID NO. 4204916), TCACTGCAAC-CTCCACCTCCCG (351868, 352440, 351973, 352169, 352445, 358164, 353737, 352382, 352235, 352232, 352268, 351919, 352473, 352444, 353638, 353004, 352925, 352943) (SEQ ID NO: 4204917), TCACTGCAACCTCCACCTC CTG (358311) (SEQ ID NO: 4204918), TCACTGCA ACCTCCACCTTCAG (353323) (SEQ ID NO: 4204919), and TCACTGCAACCTCCACCTTCCG (353856) (SEQ ID NO: 4204920).

Method Section

Cell Lines

Three common human cell lines, obtained from Dr. Yonat Shemer at Soroka Medical Center, Be'er Sheva, Israel, were used for RNA extraction; Human Embryonic Kidney HEK-293 cells, Human Cervix Adenocarcinoma HeLa cells and Human Prostate Carcinoma PC3 cells.

RNA Purification

Several sources of RNA were used to prepare libraries:

Total HeLa S100 RNA was prepared from HeLa S100 cellular fraction (4C Biotech, Belgium) through an SDS (1%)-Proteinase K (200 g/ml) 30 minute incubation at 37 C followed by an acid Phenol-Chloroform purification and isopropanol precipitation (Sambrook et al; Molecular Cloning—A Laboratory Manual).

Total HeLa, HEK-293 and PC3 cell RNA was prepared using the standard Tri-Reagent protocol (Sigma) according to the manufacturer's instructions, except that 1 volume of isopropanol was substituted with 3 volumes of ethanol.

Nuclear and Cytoplasmic RNA was prepared from HeLa or HEK-293 cells in the following manner:

Cell were washed and harvested in ice-cold PBS and precipitated in a swing-out rotor at 1200 rpm at 4 C for 5 minutes. Pellets were loosened by gentle vortexing. 4 ml of "NP40 lysis buffer" (10 mM Tris HCl, 5 mM MgCl2, 10 mM NaCl, 0.5% Nonidet P40, 1 mM Spermidine, 1 mM DTT, 140 U/ml rRnasine) was then added per 5*107 cells. Cells and lysis buffer were incubated for 5 minutes on ice and centrifuged in a swing-out rotor at 500×g at 4 C for 5 minutes. Supernatant, termed cytoplasm, is carefully removed to a tube containing SDS (1% final) and proteinase-K (200 g/ml final). Pellet, termed nuclear fraction, is rewashed and incubated with a similar amount of fresh lysis buffer. Lysis is monitored visually under a microscope at this stage, typically for 5 minutes. Nuclei are pelleted in a swing-out rotor at 500×g at 4 C for 5 minutes. Supernatant is pooled, incubated at 37 C for 30 minutes, Phenol/Chloroform-extracted, and RNA is alcohol-precipitated (Sambrook et al). Nuclei are loosened and then homogenized immediately in >10 volumes of Tri-Reagent (Sigma). Nuclear RNA is then prepared according to the manufacturer's instructions.

Total Tissue RNA

Total tissue RNA was obtained from Ambion USA, and included Human Liver, Thymus, Placenta, Testes and Brain.

RNA Size Fractionation

RNA used for libraries was always size-fractionated. Fractionation was done by loading up to 500 microgram RNA per YM100 Amicon Microcon column (Millipore) followed by a 500×g centrifugation for 40 minutes at 4 C. Flow-through "YM100" RNA is about one quarter of the total RNA and was used for library preparation or fractionated further by loading onto a YM30 Amicon Microcon column (Millipore) followed by a 13,500×g centrifugation for 25 minutes at 4 C. Flow-through "YM30" was used for library preparation "as is" and consists of less than 0.5% of total RNA. Additional size fractionation was achieved during library preparation.

Library Preparation

Two types of cDNA libraries, designated "One-tailed" and "Ligation", were prepared from the one of the abovementioned fractionated RNA samples. RNA was dephosphorylated and ligated to an RNA (designated with lowercase letters)-DNA (designated with UPPERCASE letters) hybrid 5'-phosphorylated, 3'idT blocked 3'-adapter (5'-P-uuuAAC-CGCATCCTTCTC-idT-3' (SEQ ID NO: 4204921), Dharmacon #P-002045-01-05) (as elaborated in Elbashir et al., Genes Dev. 15:188-200 (2001)) resulting in ligation only of RNase III type cleavage products. 3'-Ligated RNA was excised and purified from a half 6%, half 13% polyacrylamide gel to remove excess adapter with a Nanosep 0.2 microM centrifugal device (Pall) according to instructions, and precipitated with glycogen and 3 volumes of ethanol. Pellet was resuspended in a minimal volume of water.

For the "Ligation" library, a DNA (UPPERCASE)-RNA (lowercase) hybrid 5'-adapter (5'-TACTAATACGACTCAC-Taaa-3' (SEQ ID NO: 4204922) Dharmacon #P-002046-01-05) was ligated to the 3'-adapted RNA, reverse transcribed with "EcoRI-RT": (5'-GACTAGCTGGAATTCAAGGAT-GCGGTTAAA-3') (SEQ ID NO: 4204923), PCR-amplified with two external primers essentially as in Elbashir et al. (2001), except that primers were "EcoRI-RT" and "PstI Fwd" (5'-CAGCCAACGCTGCAGATACGACTCACTAAA-3') (SEQ ID NO: 4204924). This PCR product was used as a template for a second round of PCR with one hemispecific and one external primer or with two hemispecific primers.

For the "One-tailed" library, the 3'-adapted RNA was annealed to 20 pmol primer "EcoRI RT" by heating to 70 C and cooling 0.1 C/sec to 30 C and then reverse-transcribed with Superscript II RT (according to manufacturer's instructions, Invitrogen) in a 20 microliters volume for 10 alternating 5 minute cycles of 37 C and 45 C. Subsequently, RNA was digested with 1 microliter 2M NaOH and 2 mM EDTA at 65 C for 10 minutes. cDNA was loaded on a polyacrylamide gel, excised and gel-purified from excess primer as above (invisible, judged by primer run alongside) and resuspended in 13 microliters of water. Purified cDNA was then oligo-dC tailed with 400U of recombinant terminal transferase (Roche Molecular Biochemicals), 1 microliter 100 microM dCTP, 1 microliter 15 mM $CoCl_2$, and 4 microliters reaction buffer, to a final volume of 20 microliters for 15 minutes at 37 C. Reaction was stopped with 2 microliters 0.2M EDTA and 15 microliters 3M NaOAc pH 5.2. Volume was adjusted to 150 microliters with water, Phenol:Bromochloropropane 10:1 extracted and subsequently precipitated with glycogen and 3 volumes of ethanol. C-tailed cDNA was used as a template for PCR with the external primers "T3-PstBsg(G/I)18" (5'-AAT-TAACCCTCACTAAAGGCTGCAGGTGCAG-GIGGGIIGGGIIGGGIIGN-3' (SEQ ID NO: 4204925) where I stands for Inosine and N for any of the 4 possible deoxynucleotides), and with "EcoRI Nested" (5'-GGAAT-TCA AGGATGCGGTTA-3') (SEQ ID NO: 4204926). This PCR product was used as a template for a second round of PCR with one hemispecific and one external primer or with two hemispecific primers.

Primer Design and PCR

Hemispecific primers were constructed for each predicted GAM RNA oligonucleotide by an in-house program designed to choose about half of the 5' or 3' sequence of the GAM RNA corresponding to a TM of about 30-34 C constrained by an optimized 3' clamp, appended to the cloning adapter sequence (for "One-tailed" libraries, 5'-GGN-NGGGNNG (SEQ ID NO: 4204927) on the 5' end or TTTAACCGCATC-3' (SEQ ID NO: 4204947) on the 3' end of the GAM RNA; for "Ligation" libraries, the same 3' adapter and 5'-CGACTCACTAAA (SEQ ID NO: 4204928) on the 5' end of the GAM RNA). Consequently, a fully complementary primer of a TM higher than 60 C was created covering only one half of the GAM RNA sequence permitting the unbiased elucidation by sequencing of the other half.

For each primer, the following criteria were used: Primers were graded according to the TM of the primer half and the nucleotide content of 3 nucleotides of the 3' clamp from worst to best, roughly: GGG-3'<CCC-3'<TTT-3'/AAA-3'<GG-3'<CC-3'<a TM lower than 30<a TM higher than 34<TT-3'/AA-3'<3G/C nucleotide combination<3 A/T nucleotide combination<any combination of two/three different nucleotides<any combination of three/three different nucleotides.

Validation PCR Product by Southern Blot

GAM RNA oligonucleotides were validated by hybridization of Polymerase Chain Reaction (PCR)-product Southern blots with a probe to the predicted GAM RNA.

PCR product sequences were confirmed by Southern blot (Southern E. M., Biotechnology 1992, 24:122-139 (1975)) and hybridization with DNA oligonucleotide probes synthesized as complementary (antisense) to predicted GAM RNA oligonucleotides. Gels were transferred onto a Biodyne PLUS 0.45 m (PaII) positively charged nylon membrane and UV cross-linked. Hybridization was performed overnight with DIG-labeled probes at 42 C in DIG Easy-Hyb buffer (Roche). Membranes were washed twice with 2×SSC and 0.1% SDS for 10 minutes at 42 C and then washed twice with 0.5×SSC and 0.1% SDS for 5 min at 42 C. The membrane was then developed by using a DIG luminescent detection kit (Roche) using anti-DIG and CSPD reaction, according to the manufacturer's protocol. All probes were prepared according to the manufacturer's (Roche Molecular Biochemicals) protocols: Digoxigenin (DIG) labeled antisense transcripts were prepared from purified PCR products using a DIG RNA labeling kit with T3 RNA polymerase. DIG-labeled PCR was prepared by using a DIG PCR labeling kit. 3'-DIG-tailed oligo ssDNA antisense probes, containing DIG-dUTP and dATP at an average tail length of 50 nts were prepared from 100 pmole oligonucleotides with the DIG Oligonucleotide Labeling Kit. Control reactions contained all of the components of the test reaction except library template.

Validation of PCR Product by Nested PCR on the Ligation

To further validate predicted GAM PCR product sequence derived from hemi-primers, a PCR-based diagnostic technique was devised to amplify only those products containing at least two additional nucleotides of the non hemi-primer defined part of the predicted GAM RNA oligonucleotide. In essence, a diagnostic primer was designed so that its 3' end, which is the specificity determining side, was identical to the desired GAM RNA oligonucleotide, 2-10 nts (typically 4-7, chosen for maximum specificity) further into its 3' end than the nucleotide stretch primed by the hemi-primer. The hemi-primer PCR product was first ligated into a T-cloning vector (pTZ57/T or pGEM-T) as described hereinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3' of the mature GAM RNA oligonucleotide adjacent to the 3' adapter. Alternatively, following analysis of the diagnostic PCR reaction on an agarose gel, positive ligation reactions (containing a band of the expected size) were transformed into E. coli. Using this same diagnostic technique and as an alternative to screening by Southern blot colony hybridization, transformed bacterial colonies were screened by colony—PCR (Gussow, D. and Clackson, T, Nucleic Acids Res. 17:4000 (1989)) with the nested primer and the vector primer, prior to plasmid purification and sequencing.

Validation of PCR Product by Cloning and Sequencing

PCR products were inserted into pGEM-T (Promega) or pTZ57/T (MBI Fermentas), heat-shock transformed into competent JM109 E. coli (Promega) and seeded on LB-Ampicilin plates with IPTG and XgaI. White and light blue colonies were transferred to duplicate gridded plates, one of which was blotted onto a membrane (Biodyne Plus, PaII) for hybridization with DIG tailed oligo probes (according to instructions, Roche) complementary to the expected GAM. Plasmid DNA from positive colonies was sequenced.

It is appreciated that the results summarize in FIG. 13 validate the efficacy of the bioinformatic oligonucleotide detection engine 100 of the present invention.

Reference is now made to FIG. 14A, which is a schematic representation of a novel human GR polynucleotide, located on chromosome 9, comprising 2 known human miRNA oligonucleotides—MIR24 and MIR23, and 2 novel GAM oligonucleotides, herein designated GAM7617 and GAM252 (later discovered by other researchers as hsa-mir-27b), all marked by solid black boxes. FIG. 14A also schematically illustrates 6 non-GAM hairpin sequences, and one non-hairpin sequence, all marked by white boxes, and serving as negative controls. By "non-GAM hairpin sequences" is meant sequences of a similar length to known miRNA precursor sequences, which form hairpin secondary folding pattern similar to miRNA precursor hairpins, and yet which are assessed by the bioinformatic oligonucleotide detection engine 100 not to be valid GAM PRECURSOR hairpins. It is appreciated that FIG. 14A is a simplified schematic representation, reflecting only the order in which the segments of interest appear relative to one another, and not a proportional distance between the segments.

Reference is now made to FIG. 14B, which is a schematic representation of secondary folding of each of the MIRs and GAMs of the GR MIR24, MIR23, GAM7617 and GAM252, and of the negative control non-GAM hairpins, herein designated N2, N3, N252, N4, N6 and N7. N0 is a non-hairpin control, of a similar length to that of known miRNA precursor hairpins. It is appreciated that the negative controls are situated adjacent to and in between real miRNA oligonucleotides and GAM predicted oligonucleotides and demonstrates similar secondary folding patterns to that of known MIRs and GAMs.

Reference is now made to FIG. 14C, which is a picture of laboratory results of a PCR test upon a YM100 size-fractionated "ligation" library, utilizing a set of specific primer pairs located directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 14C demonstrates expression of hairpin precursors of known miRNA oligonucleotides hsa-mir23 and hsa-mir24, and of novel bioinformatically-detected GAM7617 and GAM252 hairpins predicted bioinformatically by a system constructed and operative in accordance with a preferred embodiment of the present invention. FIG. 14C also shows that none of the 7 controls (6 hairpins designated N2, N3, N23, N4, N6 and N7 and 1 non-hairpin sequence designated N0) were expressed. N252 is a negative control sequence partially overlapping GAM252.

In the picture, test lanes including template are designated "+" and the control lane is designated "−". The control reaction contained all the components of the test reaction except library template. It is appreciated that for each of the tested hairpins, a clear PCR band appears in the test ("+") lane, but not in the control ("−") lane.

FIGS. 14A through 14C, when taken together validate the efficacy of the bioinformatic oligonucleotide detection engine in: (a) detecting known miRNA oligonucleotides; (b) detecting novel GAM PRECURSOR hairpins which are found adjacent to these miRNA oligonucleotides, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotides since hairpins are highly abundant in the genome. Other miRNA prediction programs have not been able to address this challenge successfully.

Reference is now made to FIG. 15A, which is an annotated sequence of an EST comprising a novel GAM oligonucleotides detected by the oligonucleotide detection system of the present invention. FIG. 15A shows the nucleotide sequence of a known human non-protein-coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the bioinformatic oligonucleotide detection engine 100 (FIG. 2) of the present invention.

The sequences of the precursors of the known MIR98 and of the predicted GAM25 precursors are marked in bold, the sequences of the established miRNA 98 and of the predicted miRNA-like oligonucleotide GAM25 are underlined.

Figure 15D:
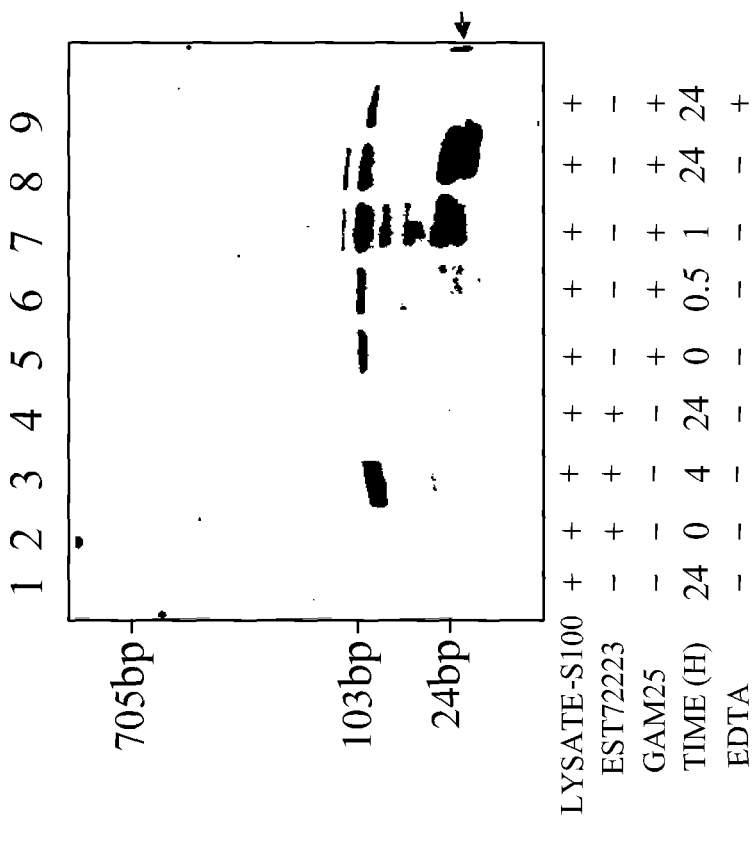
Figure 15C:
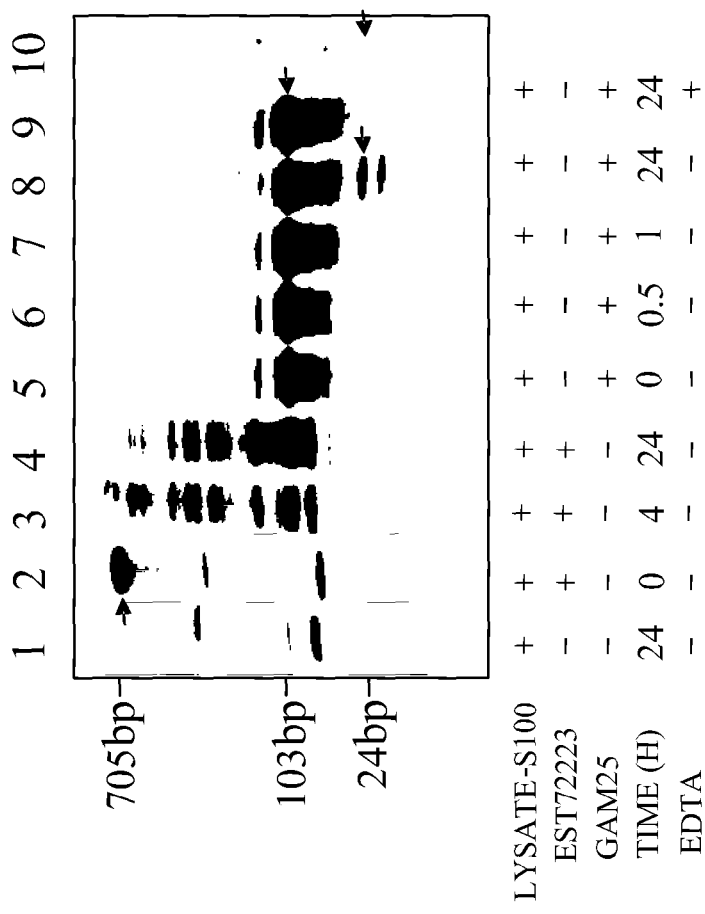

Reference is now made to FIGS. 15B, 15C and 15D, which are pictures of laboratory results, which when taken together demonstrate laboratory confirmation of expression of the bio-informatically-detected novel oligonucleotide of FIG. 15A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with either a 102 nt antisense MIR98 probe or a 145 nt antisense GAM25 precursor transcript probe respectively. The Northern blot results of these experiments demonstrated processing of EST72223 RNA by Hela lysate (lanes 2-4, in FIGS. 15B and 15C), into ~80 bp and ~22 bp segments, which reacted with the MIR98 precursor probe (FIG. 15B), and into ~100 bp and ~24 bp segments, which reacted with the GAM25 precursor probe (FIG. 15C). These results demonstrate the processing of EST72223 by Hela lysate into MIR98 precursor and GAM25 precursor. It is also appreciated from FIG. 15C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, "diced" segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in vitro RNA cleavage assays with T7 RNA polymerase, including a m7G (5')ppp(5')G-capping reaction using the T7-mMessage mMachine kit (Ambion). Purified PCR products were used as template for the reaction. These were amplified for each assay with specific primers containing a T7 promoter at the 5' end and a T3 RNA polymerase promoter at the 3' end. Capped RNA transcripts were incubated at 30 C in supplemented, dialysis concentrated, Hela S100 cytoplasmic extract (4 C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 microgram/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 m M EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1×TBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their "diced" segments is mediated by Dicer enzyme, found in Hela lysate. Other RNases do not utilize divalent cations and are thus not inhibited by EDTA. The molecular sizes of EST72223, MIR-98 and GAM25 and their corresponding precursors are indicated by arrows.

FIG. 15D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 15C and 15D, a RNA band parallel to a marker of 24 base was excised from the gel and cloned as in Elbashir et al (2001) and sequenced. Ninety clones corresponded to the sequence of mature GAM25 oligonucleotide, three corresponded to GAM25* (the opposite arm of the hairpin with a 1-3 nt 3' overhang) and two to the hairpin-loop.

GAM25 was also validated endogenously by sequencing from both sides from a HeLa YM100 total-RNA "ligation" libraries, utilizing hemispecific primers as described in FIG. 13.

Taken together, these results validate the presence and processing of a novel miRNA-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223), 102 nt (MIR98 precursor), 125 nt (GAM25 precursor) long. EST72223 was PCR-amplified with T7-EST 72223 forward primer: 5'-TAATACGACTCACTATAGGCCCTTATTA-GAGGATTCTGCT-3' (SEQ ID NO: 4204929) and T3-EST72223 reverse primer: 5"-AATTAACCCTCAC-TAAAGGTTTTTTTTTCCTGAGACAGAGT-3'. (SEQ ID NO: 4204930). MIR98 was PCR-amplified using EST72223 as a template with T7MIR98 forward primer: 5'-TAATAC-GACTCACTATAGGGTGAGGTAGTAAGTTGTATTGTT-3' (SEQ ID NO: 4204931) and T3MIR98 reverse primer: 5'-AATTAACCCTCACTAAAGGGAAAGTAG-TAAGTTGTATAGTT-3' (SEQ ID NO: 4204932). GAM25 was PCR-amplified using EST72223 as a template with GAM25 forward primer: 5'-GAGGCAGGAGAATTGCT-TGA-3' (SEQ ID NO: 4204933) and T3-EST72223 reverse primer: 5'-AATTAACCCTCACTAAAGGCCTGAGACA-GAGTCTTGCTC-3' (SEQ ID NO: 4204934).

It is appreciated that the data presented in FIGS. 15A, 15B, 15C and 15D when taken together validate the function of the bioinformatic oligonucleotide detection engine 100 of FIG. 2. FIG. 15A shows a novel GAM oligonucleotide bioinformatically-detected by the bioinformatic oligonucleotide detection engine 100, and FIGS. 15C and 15D show laboratory confirmation of the expression of this novel oligonucleotide. This is in accord with the engine training and validation methodology described hereinabove with reference to FIG. 2.

Figure 16A:
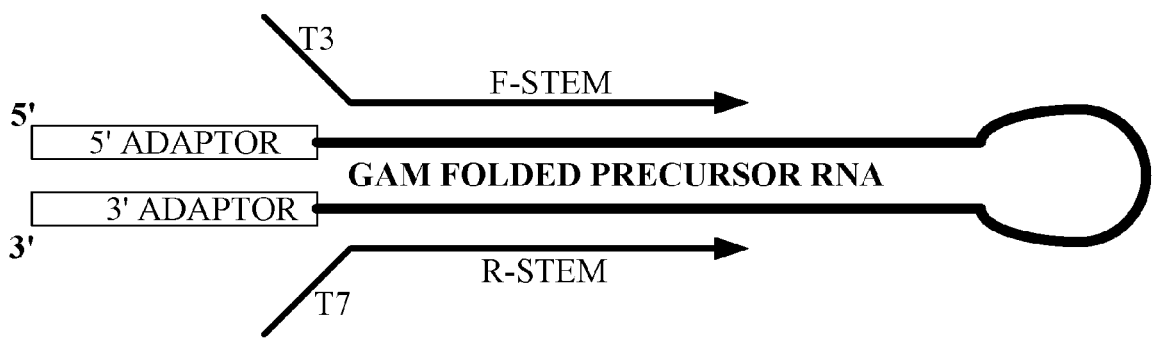
FIGS. 16A, 16B and 16C are schematic diagrams which, when taken together, represent methods of designing primers to identify specific hairpin oligonucleotides in accordance with a preferred embodiment of the present invention.
Figure 16B:
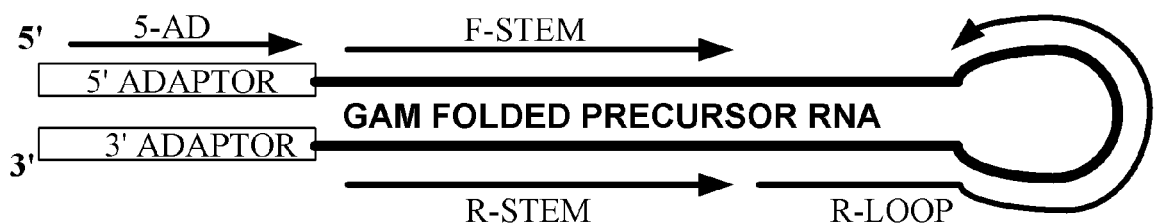
Figure 16C:
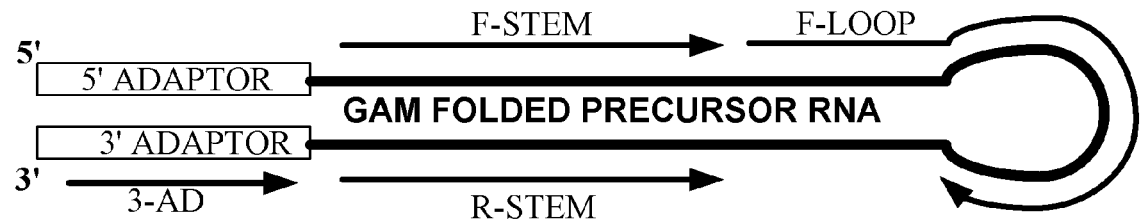

Reference is now made to FIGS. 16A-C, which schematically represent three methods that are employed to identify GAM FOLDED PRECURSOR RNA from libraries. Each method involves the design of specific primers for PCR amplification followed by sequencing. The libraries include hairpins as double-stranded DNA with two different adaptors ligated to their 5' and 3' ends.

Reference is now made to FIG.16A, which depicts a first method that uses primers designed to the stems of the hairpins. Since the stem of the hairpins often has bulges, mismatches, as well as G-T pairing, which is less significant in DNA than is G-U pairing in the original RNA hairpin, the primer pairs were engineered to have the lowest possible match to the other strand of the stem. Thus, the F-Stem primer, derived from the 5'stem region of the hairpin, was chosen to have minimal match to the 3'stem region of the same hairpin. Similarly, the R-stem primer, derived from the 3'region of the hairpin (reverse complementary to its sequence),was chosen to have minimal match to the 5'stem region of the same hairpin. The F-Stem primer was extended in its 5'sequence with the T3 primer (5'-ATTAACCCTCAC-TAAAGGGA-3' (SEQ ID NO: 4204935)) and the R-Stem primer was extended in its 5' sequence with the T7 primer (5'-TAATACGACTCACTATAGGG (SEQ ID NO: 4204936). The extension is needed to obtain a large enough fragment for direct sequencing of the PCR product. Sequence data from the amplified hairpins is obtained in two ways. One way is the direct sequencing of the PCR products using the T3 primer that matches the extension of the F-Stem primer. Another way is the cloning of the PCR products into a plasmid, followed by PCR screening of individual bacterial colonies using a primer specific to the plasmid vector and either the R-Loop (FIG. 16B) or the F-Loop (FIG. 16C) primer. Positive PCR products are then sent for direct sequencing using the vector-specific primer.

Reference is now made to FIG. 16B, which depicts a second method in which R-Stem primer and R-Loop primers are used in a nested-PCR approach. First, PCR is performed with the R-Stem primer and the primer that matches the 5' adaptor sequence (5-ad primer). PCR products are then amplified in a second PCR using the R-Loop and 5-ad primers. As mentioned hereinabove, sequence data from the amplified hairpins is obtained in two ways. One way is the direct sequencing of the PCR products using the 5-ad primer. Another way is the cloning of the PCR products into a plasmid, followed by PCR screening of individual bacterial colonies using a primer specific to the plasmid vector and F-Stem primer. Positive PCR products are then sent for direct sequencing using the vector-specific primer. It should be noted that optionally an extended R-Loop primer is designed that includes a T7 sequence extension, as described hereinabove (FIG. 16A) for the R-Stem primer. This is important in the first sequencing option in cases where the PCR product is too short for sequencing.

Reference is now made to FIG. 16C, which depicts a third method, which is the exact reverse of the second method described hereinabove (FIG. 16B). F-Stem and F-Loop primers are used in a nested-PCR approach. First, PCR is performed with the F-Stem primer and the primer that matches the 3' adaptor sequence (3-ad primer). PCR products are then amplified in a second PCR using the F-Loop and 3-ad primers. As in the other two methods, sequence data from the amplified hairpins is obtained in two ways. One way is the direct sequencing of the PCR products using the F-Loop primer. Another way is the cloning of the PCR products into a plasmid, followed by PCR screening of individual bacterial colonies using a primer specific to the plasmid vector and R-Stem primer. Positive PCR products are then sent for direct sequencing using the vector-specific primer. It should be noted that optionally an extended F-Loop primer is designed that includes a T3 sequence extension, as described hereinabove (FIG. 16A) for the F-Stem primer. This is important in the first sequencing option in cases where the PCR product is too short for sequencing and also in order to enable the use of T3 primer.

In an embodiment of the present invention, the three methods mentioned hereinabove may be employed to validate the expression of GAM FOLDED PRECURSOR RNA.

Figure 17A:
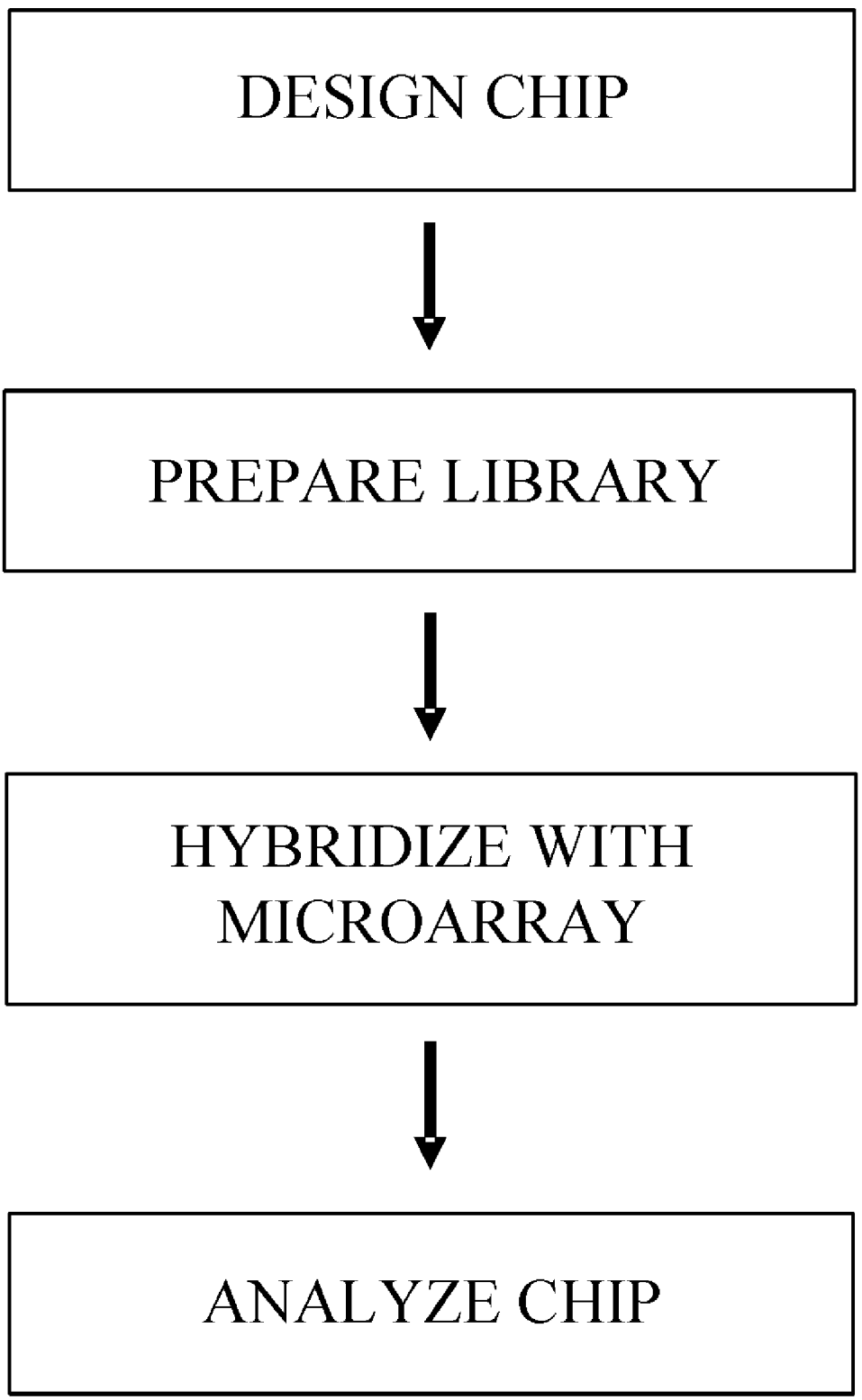
FIG. 17A is a simplified flowchart illustrating construction of a microarray constructed and operative to identify novel oligonucleotides of the present invention, in accordance with a preferred embodiment of the present invention.

Reference is now made to FIG. 17A, which is a flow chart with a general description of the design of the microarray to identify expression of published miRNA oligonucleotides, and of novel GAM oligonucleotides of the present invention.

Figure 17B:
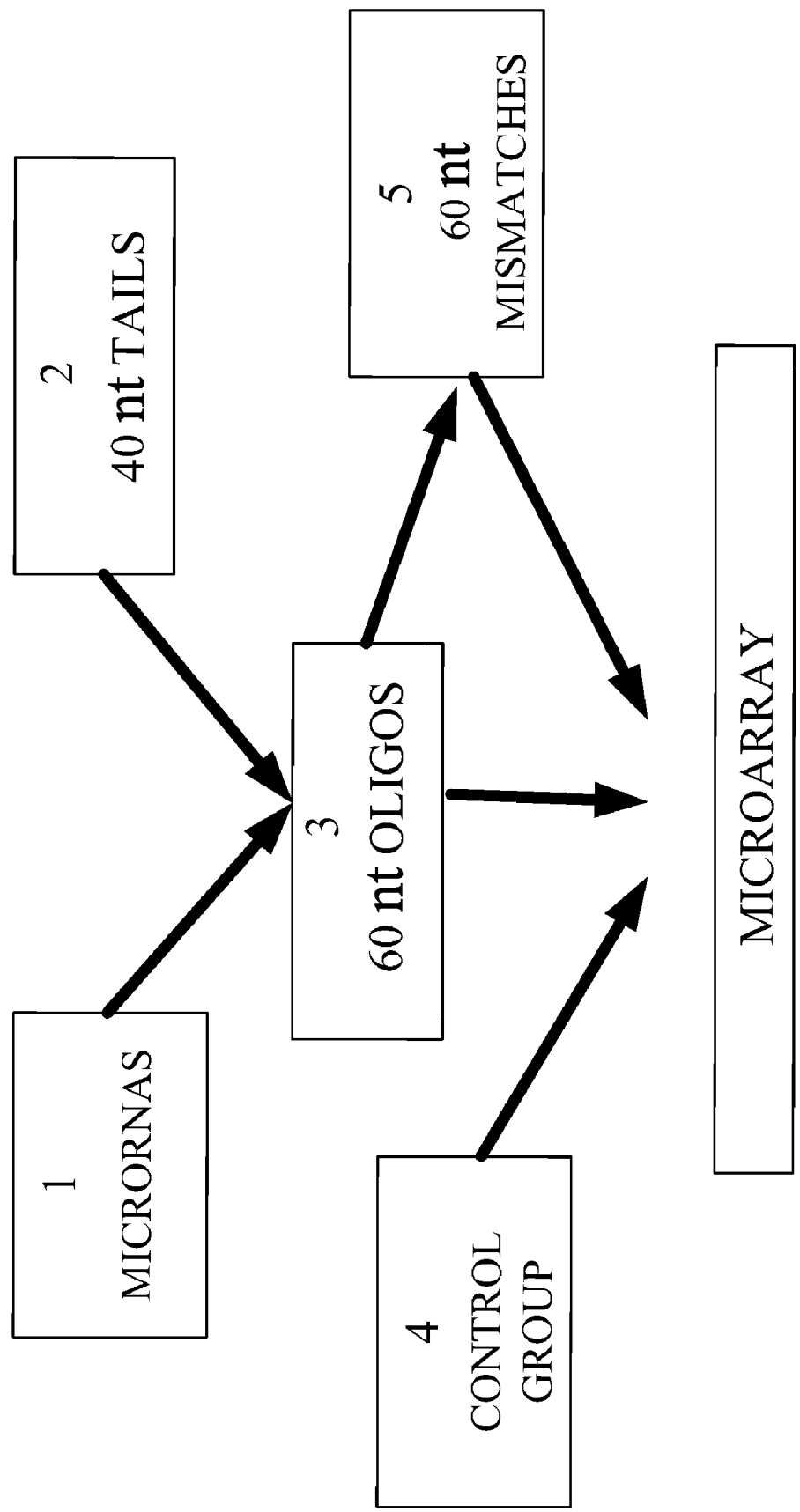
FIG. 17B is a simplified block diagram illustrating design of a microarray constructed and operative to identify novel oligonucleotides of the present invention, in accordance with a preferred embodiment of the present invention.
Figure 17C:
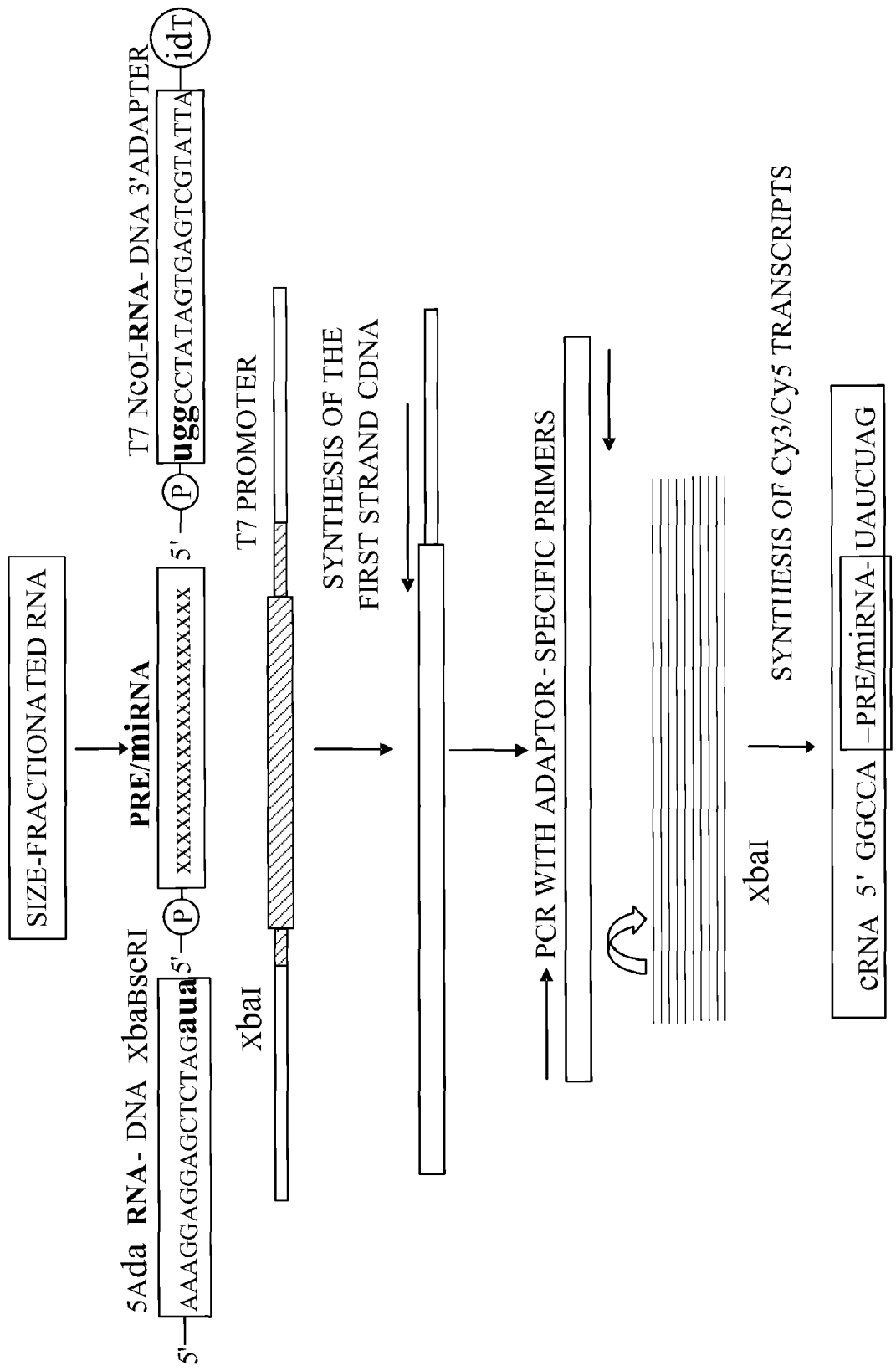
FIG. 17C is a flowchart illustrating a mode of preparation and amplification of a cDNA library in accordance with a preferred embodiment of the present invention.

A microarray that identifies miRNA oligonucleotides is designed (FIG. 17B). The DNA microarray is prepared by Agilent according to their SurePrint Procedure (reference describing their technology can be obtained from the Agilent website, http://www.agilent.com). In this procedure, the oligonucleotide probes are synthesized on the glass surface. Other methods can also be used to prepare such microarray including the printing of pre-synthesized oligonucleotides on glass surface or using the photolithography method developed by Affymetrix (Lockhart D J et al., Nat Biotechnol. 14:1675-1680 (1996)). The 60-mer sequences from the design are synthesized on the DNA microarray. The oligonucleotides on the microarray, termed "probes" are of the exact sequence as the designed 60-mer sequences. Importantly, the 60-mer sequences and the probes are in the sense orientation with regards to the miRNA oligonucleotides. Next, a cDNA library is created from size-fractionated RNA, amplified, and converted back to RNA (FIG. 17C). The resulting RNA is termed "cRNA". The conversion to RNA is done using a T7 RNA polymerase promoter found on the 3' adaptor (FIG. 17C; T7 NcoI-RNA-DNA 3'Adaptor). Since the conversion to cRNA is done in the reverse direction compared to the orientation of the miRNA oligonucleotides, the cRNA is reverse complementary to the probes and is able to hybridize to it. This amplified RNA is hybridized with the microarray that identifies miRNA oligonucleotides, and the results are analyzed to indicate the relative level of miRNA oligonucleotides (and hairpins) that are present in the total RNA of the tissue (FIG. 18).

Reference is now made to FIG. 17B, which describes how the microarray to identify miRNA oligonucleotides is designed. miRNA oligonucleotide sequences or potential predicted miRNA oligonucleotides are generated by using known or predicted hairpins as input. Overlapping potential miRNA oligonucleotides are combined to form one larger sub-sequence within a hairpin.

To generate non-expressed sequences (tails), artificial sequences are generated that are 40 nts in length, which do not appear in the respective organism genome, do not have greater than 40% homology to sequences that appear in the genome, and with no 15-nucleotide window that has greater than 80% homology to sequences that appear in the genome.

To generate probe sequences, the most probable miRNA oligonucleotide sequences are placed at position 3 (from the 5' end) of the probe. Then, a tail sub-sequence to the miRNA oligonucleotide sequence was attached such that the combined sequence length will meet the required probe length (60 nts for Agilent microarrays).

The tails method provides better specificity compared to the triplet method. In the triplet method, it cannot be ascertained that the design sequence, and not an uncontrolled window from the triplet probe sequence, was responsible for hybridizing to the probe. Further, the tails method allows the use of different lengths for the potential predicted miRNA oligonucleotide (of combined, overlapping miRNA oligonucleotides).

Hundreds of control probes were examined in order to ensure the specificity of the microarray. Negative controls contain probes which should have low intensity signal. For other control groups, the concentration of certain specific groups of interest in the library are monitored. Negative controls include tail sequences and non-hairpin sequences. Other controls include mRNA for coding genes, tRNA, and snoRNA.

For each probe that represents known or predicted miRNA oligonucleotides, additional mismatch probes were assigned in order to verify that the probe intensity is due to perfect match (or as close as possible to a perfect match) binding between the target miRNA oligonucleotide cRNA and its respective complementary sequence on the probe. Mismatches are generated by changing nucleotides in different positions on the probe with their respective complementary nucleotides (A<->T, G<->C, and vice versa). Mismatches in the tail region should not generate a significant change in the intensity of the probe signal, while mismatches in the miRNA oligonucleotide sequences should induce a drastic decrease in the probe intensity signal. Mismatches at various positions within the miRNA oligonucleotide sequence enable us to detect whether the binding of the probe is a result of perfect match or, alternatively, nearly perfect match binding.

Based on the above scheme, we designed a DNA microarray prepared by Agilent using their SurePrint technology. Table 11 is a detailed list of microarray chip probes Known miRNA Oligonucleotides:

The miRNA oligonucleotides and their respective precursor sequences are taken from Sanger Database to yield a total of 186 distinct miRNA oligonucleotide and precursor pairs. The following different probes are constructed:

1. Single miRNA Oligonucleotide Probes:

From each precursor, 26-mer containing the miRNA oligonucleotide were taken, then assigned 3 probes for each extended miRNA oligonucleotide sequence: 1. the 26-mer are at the 5' of the 60-mer probe, 2. the 26-mer are at the 3' of the 60-mer probe, 3. the 26-mer are in the middle of the 60-mer probe. Two different 34-mer subsequences from the design tails are attached to the 26-mer to accomplish 60-mer probe. For a subset of 32 of Single miRNA oligonucleotide probes, six additional mismatches mutations probes were designed:

4 block mismatches at 5' end of the miRNA oligonucleotide;
6 block mismatches at 3' end of the miRNA oligonucleotide;
1 mismatch at position 10 of the miRNA oligonucleotide;
2 mismatches at positions 8 and 17 of the miRNA oligonucleotide;
3 mismatches at positions 6, 12 and 18 of the miRNA oligonucleotide; and
6 mismatches at different positions out of the miRNA oligonucleotide.

2. Duplex miRNA Oligonucleotide Probes:

From each precursor, a 30-mer containing the miRNA oligonucleotide was taken, then duplicated to obtain 60-mer probe. For a subset of 32 of probes, three additional mismatch mutation probes were designed:

2 mismatches on the first miRNA oligonucleotide;
2 mismatches on the second miRNA oligonucleotide; and
2 mismatches on each of the miRNA oligonucleotides.

3. Triplet miRNA Oligonucleotide Probes:

Following Krichevsky's work (Krichevsky et al., RNA 9:1274-1281 (2003)), head to tail ~22-mer length miRNA oligonucleotide sequences were attached to obtain 60-mer probes containing up to three repeats of the same miRNA oligonucleotide sequence. For a subset of 32 probes, three additional mismatch mutation probes were designed:

2 mismatches on the first miRNA oligonucleotide;
2 mismatches on the second miRNA oligonucleotide; and
2 mismatches on each of the miRNA oligonucleotides.

4. Precursor with miRNA Oligonucleotide Probes:

For each precursor, 60-mer containing the miRNA oligonucleotide were taken.

5. Precursor without miRNA Oligonucleotide Probes:

For each precursor, a 60-mer containing no more then 16-mer of the miRNA oligonucleotide was taken. For a subset of 32 probes, additional mismatch probes containing four mismatches were designed.

Control Groups:

1. 100 60-mer sequences from representative ribosomal RNAs.
2. 85 60-mer sequences from representatives tRNAs.
3. 19 60-mer sequences from representative snoRNA.
4. 294 random 26-mer sequences from human genome not contained in published or predicted precursor sequences, placing them at the probe's 5' and attached 34-mer tail described above.
5. Negative Control: 182 different 60-mer probes contained different combinations of 10 nt-long sequences, in which each 10 nt-long sequence is very rare in the human genome, and the 60-mer combination is extremely rare.

Predicted GAM RNAs:

There are 8381 pairs of predicted GAM RNA and their respective precursors. From each precursor, a 26-mer containing the GAM RNA was placed at the 5' of the 60-mer probe and a 34-mer tail was attached to it. For each predicted probe, a mutation probes with 2 mismatches at positions 10 and 15 of the GAM RNA were added.

For a subset of 660 predicted precursors, up to 2 probes each containing one side of the precursor including any possible GAM RNA in it were added.

Microarray Analysis:

Based on known miRNA oligonucleotide probes, a preferred position of the miRNA oligonucleotide on the probe was evaluated, and hybridization conditions adjusted and the amount of cRNA to optimize microarray sensitivity and specificity ascertained. Negative controls are used to calculate background signal mean and standard deviation. Different probes of the same miRNA oligonucleotide are used to calculate signal standard deviation as a function of the signal.

For each probe, BG_Z_Score=(log(probe signal)−mean of log(negative control signal))/(log(negative control signal) standard deviation) were calculated.

For a probe with a reference probe with 2 mismatches on the miRNA oligonucleotide, MM_Z_Score MM_Z_Score= (log(perfect match signal)−log(reference mismatch signal))/ (standard deviation of log(signals) as the reference mismatch log(signal)) were calculated.

BG_Z_Score and MM_Z_Score are used to decide whether the probe is on and its reliability.

Reference is now made to FIG. 17C, which is a flowchart describing how the cDNA library was prepared from RNA and amplified. The general procedure was performed as described previously (Elbashir S M, Lendeckel W, Tuschl T. RNA interference is mediated by 21- and 22-nucleotide RNAs. Genes Dev. 2001 15:188-200) with several modifications, which will be described hereinbelow.

First, the starting material is prepared. Instead of starting with standard total RNA, the total RNA was size-fractionated using an YM-100 Microcon column (Millipore Corporation, Billerica, Mass., USA) in the present protocol. Further, the present protocol uses human tissue or cell lines instead of a *Drosophila* in vitro system as starting materials. Finally, 3 micrograms of size-fractionated total RNA was used for the ligation of adaptor sequences.

Libraries used for microarray hybridization are listed hereinbelow: "A" library is composed of a mix of libraries from Total HeLa YM100 RNA and Nuclear HeLa YM100 RNA; "B" library is composed of a mix of libraries from Total HEK293 YM100 RNA and Nuclear HEK293 YM100 RNA; "C" library is composed of a mix of YM100 RNA libraries from Total PC3, Nuclear PC3 and from PC3 cells in which Dicer expression was transiently silenced by Dicer specific siRNA; "D" library is prepared from YM100 RNA from Total Human Brain (Ambion Cat#7962); "E" library is prepared from YM100 RNA from Total Human Liver (Ambion Cat#7960); "F" library is prepared from YM100 RNA from Total Human Thymus (Ambion Cat#7964); "G" library is prepared from YM100 RNA from Total Human Testis (Ambion Cat#7972); and "H" library is prepared from YM100 RNA from Total Human Placenta (Ambion Cat#7950).

Library letters appended by a numeral "1" or "2" are digested by XbaI (NEB); Library letters affixed by a numeral "3" are digested by Xba1 and SpeI (NEB); Library letters appended by a numeral "4" are digested by Xba1 and the transcribed cRNA is then size-fractionated by YM30, retaining the upper fraction consisting of 60 nts and longer; Library letters affixed by a numeral "5" are digested by Xba1 and the transcribed cRNA is then size-fractionated by YM30 retaining the flow-through fraction consequently concentrated with YM10 consisting of 30 nts-60 nts; Library letters affixed by a numeral "6" are digested by Xba1 and the DNA is fractionated on a 13% native acrylamide gel from 40-60 nt, electroeluted on a GeBaFlex Maxi column (GeBa Israel), and lyophilized; Library letters affixed by a numeral "7" are digested by Xba1 and the DNA is fractionated on a 13% native acrylamide gel from 80-160 nt, electroeluted and lyophilized.

Next, unique RNA-DNA hybrid adaptor sequences with a T7 promoter were designed. This step is also different than other protocols that create libraries for microarrays. Most protocols use complements to the polyA tails of mRNA with a T7 promoter to amplify only mRNA. However, in the present invention, adaptors are used to amplify all of the RNA within the size-fractionated starting material. The adaptor sequences are ligated to the size-fractionated RNA as described in FIG. 13, with subsequent gel-fractionation steps. The RNA is then converted to first strand cDNA using reverse transcription.

Next, the cDNA is amplified using PCR with adaptor-specific primers. At this point, there is the optional step of removing the tRNA, which is likely to be present because of its low molecular weight, but may add background noise in the present experiments. All tRNA contain the sequence ACC at their 3' end, and the adaptor contains GGT at its 5' end. This sequence together (GGTACC) is the target site for NcoI restriction digestion. Thus, adding the restriction enzyme NcoI either before or during PCR amplification will effectively prevent the exponential amplification of the cDNA sequences that are complements of the tRNAs.

The amplified DNA is restriction enzyme-digested with Xba1 (and, optionally, with Pst or SpeI) to remove the majority of the adaptor sequences that were initially added to the RNA. Using the first set of RNA-DNA hybrid adaptors listed below, the first two sets of primers listed below, and Xba1 restriction digest yields the following cRNA products: 5'GGCCA-PRE/miRNA-UAUCUAG, where PRE is defined as GAM PRECURSOR (palindrome). Using the second set of RNA-DNA hybrid adaptors listed below, the second set of primers listed below, and Xba1 and Pst restriction digest yields the following, smaller cRNA products: 5'GG-PRE/miRNA-C*.

Then, cDNA is transcribed to cRNA utilizing an RNA polymerase e.g. T7 dictated by the promoter incorporated in the adaptor. cRNA may be labeled in the course of transcription with aminoallyl or fluorescent nucleotides such as Cy3- or Cy5-UTP and CTP among other labels, and cRNA sequences thus transcribed and labeled are hybridized with the microarray.

The following RNA-DNA hybrid adaptors are included in the present invention:

```
Name: T7 NcoI-RNA-DNA 3'Adapter
Sequence:
5' (5phos)rUrGrGCCTATAGTGAGTCGTATTA(3InvdT)3'
(SEQ ID NO: 4204937)

2. Name: 5Ada RNA-DNA XbaBseRI
Sequence:
5' AAAGGAGGAGCTCTAGrArUrA 3' or option-ally:
(SEQ ID NO: 4204938)

3. Name: 5Ada MC RNA-DNA PstAtaBser
Sequence:
5' CCTAGGAGGAGGACGTCTGrCrArG 3'
(SEQ ID NO: 4204939)

4. Name: 3'Ada nT7 MC RNA-DNA
Sequence:
5' (5phos) rCrCrUATAGTGAGTCGTATTATCT(3InvdT)3'
(SEQ ID NO: 4204940)
```

The following DNA primers are included in the present invention:

```
1. Name: T7 NcoI-RT-PCR primer
Sequence: 5' TAATACGACTCACTATAGGCCA 3'
(SEQ ID NO: 4204941)

2. Name: T7NheI SpeI-RT-PCR primer
Sequence: 5' GCTAGCACTAGTTAATACGACTCACTATAGGCCA 3'
(SEQ ID NO: 4204942)

3. Name: 5Ada XbaBseRl Fwd
Sequence: 5' AAAGGAGGAGCTCTAGATA 3'
(SEQ ID NO: 4204943)

4. Name: Pst-5Ada XbaBseRl Fwd
Sequence: 5' TGACCTGCAGAAAGGAGGAGCTCTAGATA 3'
(SEQ ID NO: 4204944)
or optionally:

5. Name: 5Ada MC PstAtaBser fwd
Sequence: 5' ATCCTAGGAGGAGGACGTCTGCAG 3'
(SEQ ID NO: 4204945)

6. Name: RT nT7 MC XbaI
Sequence: 5' GCTCTAGGATAATACGACTCACTATAGG 3'
(SEQ ID NO: 4204946).
```

Figure 18A:
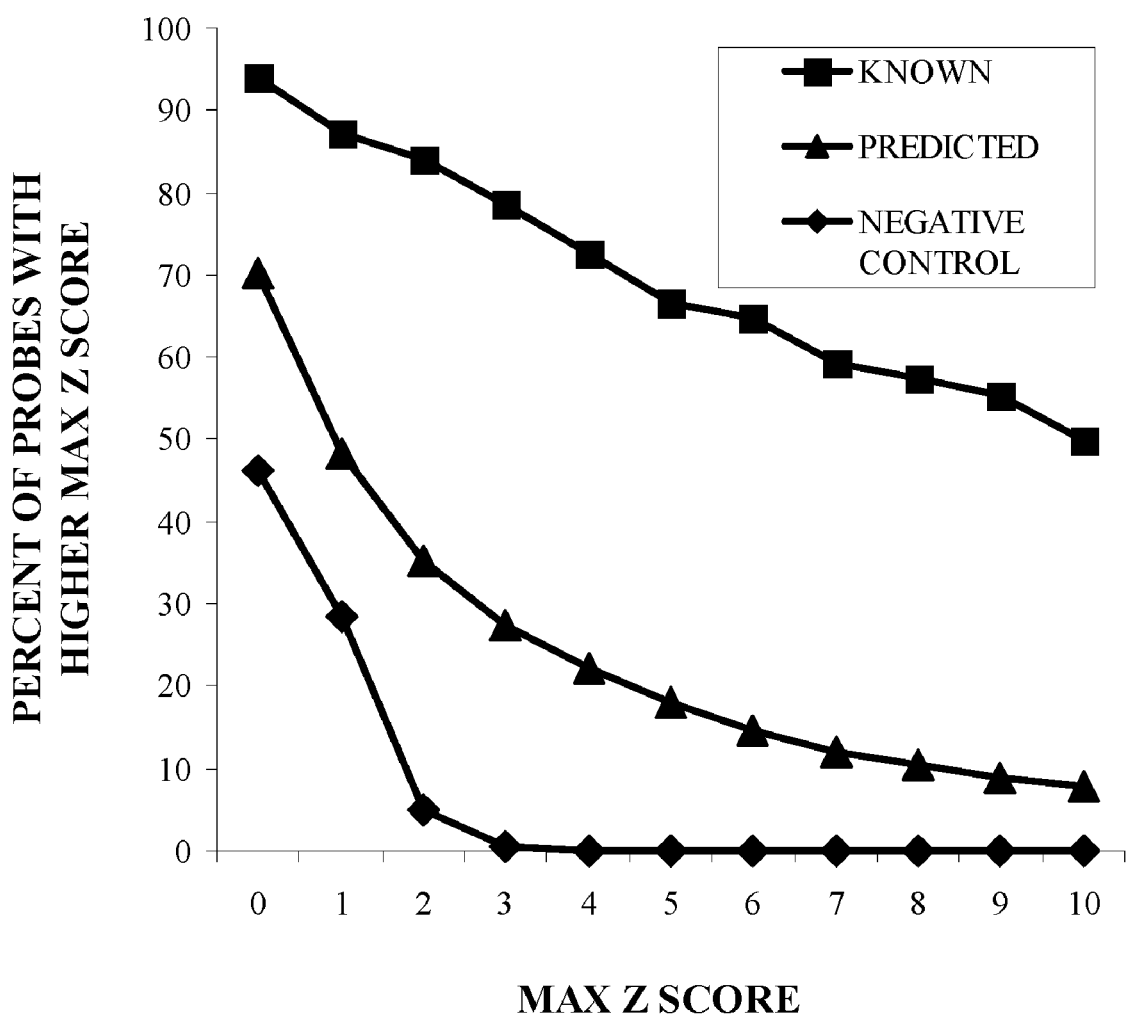
FIG. 18A is a line graph showing results of detection of known microRNA oligonucleotides and of novel GAM oligonucleotides, using a microarray constructed and operative in accordance with a preferred embodiment of the present invention.

Reference is now made to FIG. 18A, which demonstrates the detection of known miRNA oligonucleotides and of novel GAM oligonucleotides, using a microarray constructed and operative in accordance with a preferred embodiment of the present invention. Based on negative control probe intensity signals, we evaluated the background, non-specific, logarithmic intensity distribution, and extracted its mean, designated BG_mean, and standard deviation, designated BG_std. In order to normalize intensity signals between different microarray experiments, a Z score, which is a statistical measure that quantifies the distance (measured in standard deviations) that a data point is from the mean of a data set, was calculated for each probe with respect to the negative control using the following Z score formula: Z=(logarithm of probe signal BG_mean)/BG_std. We performed microarray experiments using RNA extracted from several different tissues and we calculated each probes maximum Z score. FIG. 18A shows the percentages of known, predicted and negative control groups that have a higher max Z score than a specified threshold as a function of max Z score threshold. The negative control group plot, included as a reference, considers probe with a max Z score greater then 4 as a reliable probe with meaningful signals. The sensitivity of our method was demonstrated by the detection of almost 80% of the known published miRNA oligonucleotides in at least one of the examined tissues. At a threshold of 4 for the max Z score, 28% of the predicted GAMs are present in at least one of the examined tissues.

Figure 18B:
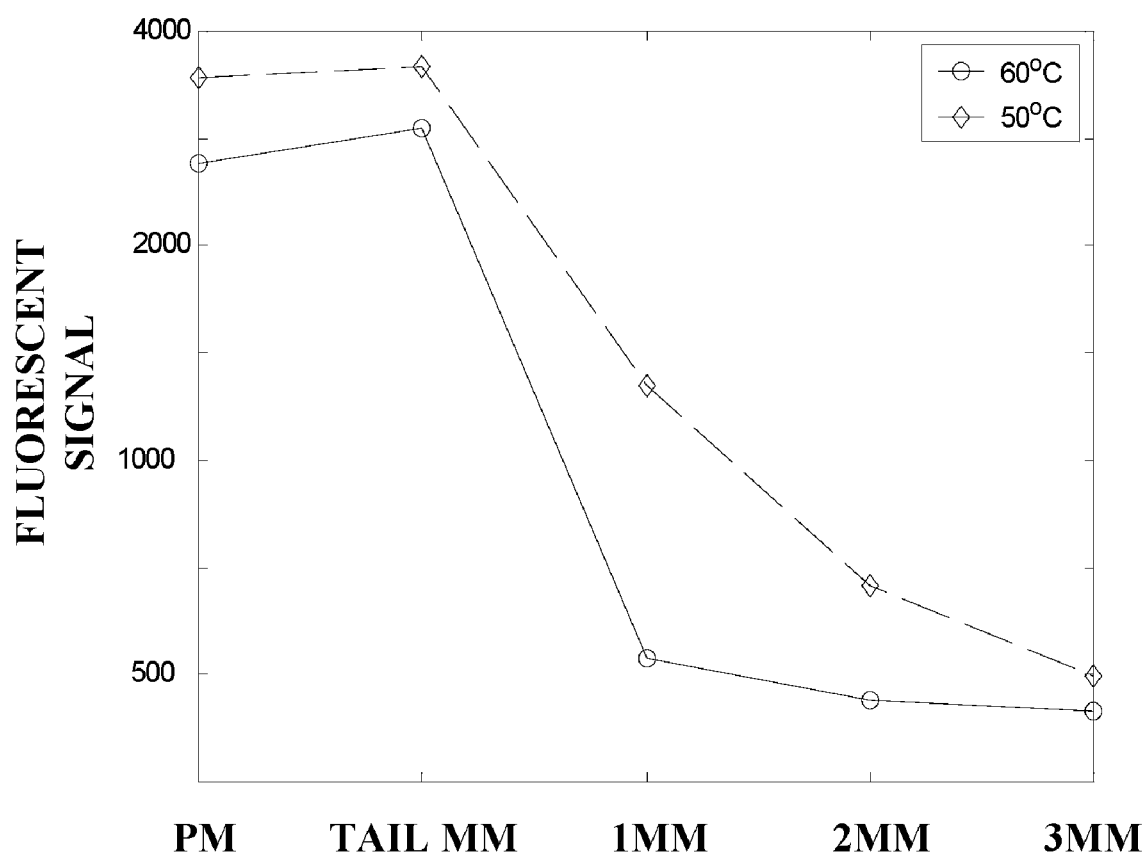
FIG. 18B is a line graph showing specificity of hybridization of a microarray constructed and operative in accordance with a preferred embodiment of the present invention.

Reference is now made to FIG. 18B, which is a line graph showing specificity of hybridization of a microarray constructed and operative in accordance with a preferred embodiment of the present invention and described hereinabove with reference to FIGS. 17A-17C.

The average signal of known miRNA oligonucleotides in Library A2 is presented on a logarithmic scale as a function of the following probe types under two different hybridization conditions: 50 C and 60 C: perfect match (PM), six mismatches on the tail (TAIL MM), one mismatch on the miRNA oligonucleotide (1MM), two separate mismatches on the miRNA oligonucleotide (2MM), three separate mismatches on the miRNA oligonucleotide (3MM). The relative equality of perfect match probes and probes with the same miRNA oligonucleotide but many mismatches over the tail attest to the independence between the tail and the probe signal. At a hybridization temperature of 60 C, one mismatch in the middle of the miRNA oligonucleotide is enough to dramatically reduce the probe signal. Conducting chip hybridization at 60 C ensures that a probe has a very high specificity.

It is appreciated that these results demonstrate the specificity of the microarray of the present invention in detecting expression of miRNA oligonucleotides.

Reference is now made to FIG. 18C, which is a summary table demonstrating detection of known miRNA oligonucleotides using a microarray constructed and operative in accordance with a preferred embodiment of the present invention and described hereinabove with reference to FIGS. 17A-17C.

Labeled cRNA from HeLa cells and Human Liver, Brain, Thymus, Placenta, and Testes was used for 6 different hybridizations. The table contains the quantitative values obtained for each miRNA oligonucleotide probe. For each miRNA oligonucleotide, the highest value (or values) is given in bolded font while lower values are given in regular font size. Results for MIR-124A, MIR-9 and MIR-122A are exactly as expected from previous studies. The "References" column contains the relevant references in the published literature for each case. In addition to these miRNA oligonucleotides, the table shows other known miRNA oligonucleotides that are expressed in a tissue-specific manner. The results indicate that MIR-128A, MIR-129 and MIR-128B are highly enriched in Brain; MIR-194, MIR-148 and MIR-192 are highly enriched in Liver; MIR-96, MIR-150, MIR-205, MIR-182 and MIR-183 are highly enriched in Thymus; MIR-204, MIR-10B, MIR-154 and MIR134 are highly enriched in Testes; and MIR-122, MIR-210, MIR-221, MIR-141, MIR-23A, MIR-200C and MIR-136 are highly enriched in Placenta. In most cases, low but significant levels are observed in the other tissues. However, in some cases, miRNA oligonucleotides are also expressed at relative high levels in an additional tissue.

It is appreciated that these results reproduce previously published studies of expression of known miRNA oligonucleotides. These results demonstrate the reliability of the microarray of the present invention in detecting expression of published miRNA oligonucleotides, and of novel GAM oligonucleotides of the present invention.

Reference is now made to FIG. 19, which presents pictures of laboratory results that demonstrate laboratory confirmation of excision ("dicing") of four bioinformatically-detected novel HIV1 miRNA-like oligonucleotides from their predicted precursors by incubation in HeLa S-100 lysate as described in FIG. 15.

FIG. 19A presents the entire 5'UTR of HIV1 (U5R) containing two predicted GAM precursors in bold. The bioinformatically-predicted mature GAM RNAs are underlined, one closer to the 5' end (FIG. 19B) and the second closer to the 3' end (FIG. 19C). The 5'-most GAM RNA matches the known HIV1 RNA structure named TAR to which the TAT protein binds (Nature 1987. 330:489-93).

FIGS. 19B and 19C depict Northern blot analysis of GAM RNA oligonucleotides that are present in U5R, hybridized with predicted mature GAM RNA probes. The upper arrow indicates the molecular size of the entire 355 nt U5R transcript. The predicted molecular sizes of the two GAM RNAs are 22 nt and 17 nt, respectively. The lower arrow indicates the 22 nt molecular marker. Lanes: 1—Hela lysate; 2—U5R transcript in HeLa Lysate without incubation; and 3—U5R transcript incubated for 24 hours with Hela lysate.

Figures 19D, 19E:
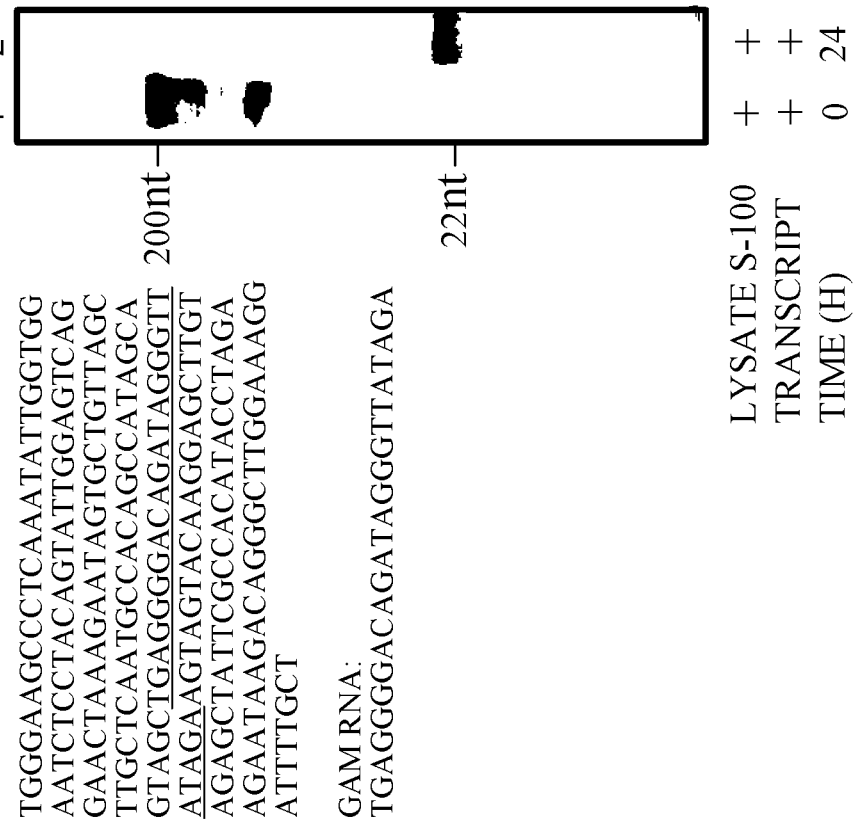
FIG. 19E shows an HIV TRANSCRIPT SEQUENCE (SEQ ID NO: 4205091). Annotated in SEQ ID NO: 4205091 is the underlined sequence of nucleotides 102-125 (SEQ ID NO: 4205092). Also shown in FIG. 19E is a sequence named "GAM RNA" (SEQ ID NO: 4205093).

FIGS. 19D and 19E present partial transcripts of HIV1 RNA reacted with predicted mature HIV1-GAM RNA probes. In each figure, the experimental transcript sequence is shown, and the predicted mature GAM RNA is underlined. Northern blot analyses of GAM precursors are presented. It is demonstrated that one GAM precursor transcript is 163 nt and the other GAM precursor transcript is 200 nt. The predicted molecular sizes of mature GAM RNA are both 24 nt. The 22 nt molecular marker is indicated. Lanes: 1—Transcript in HeLa Lysate without incubation and 2—Transcript incubated for 24 hours with HeLa lysate.

It is appreciated that the sequences of the expected sizes that hybridize with the probe comprise sequences of novel GAM oligonucleotides, detected by the bioinformatic oligonucleotide detection engine 100 of the present invention, described hereinabove with reference to FIG. 2.

Figure 20C:
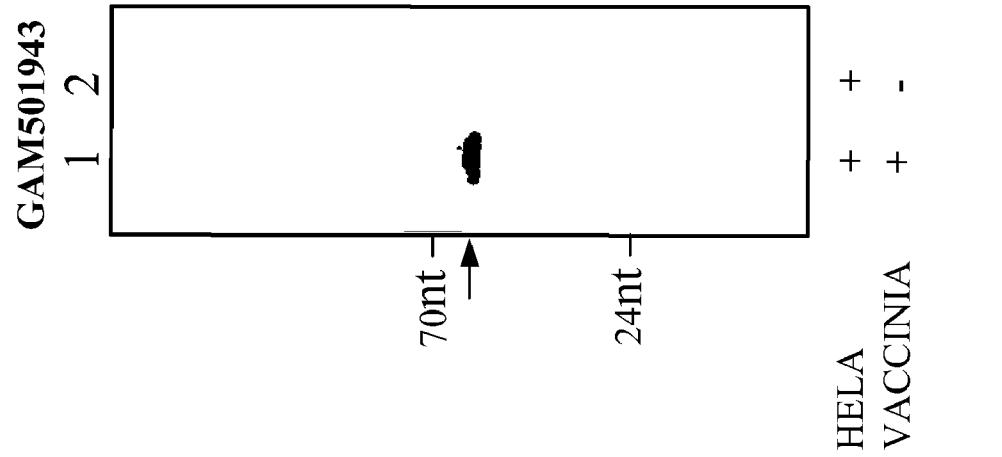
FIG. 20 presents pictures of laboratory results demonstrating laboratory confirmation of expression of two novel bioinformatically-detected Vaccinia GAM precursors, herein designated GAM501943 PRECURSORS and GAM501981 PRECURSORS.
Figure 20B:
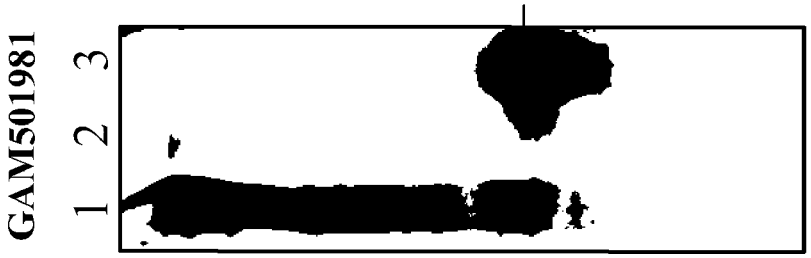
Figure 20A:
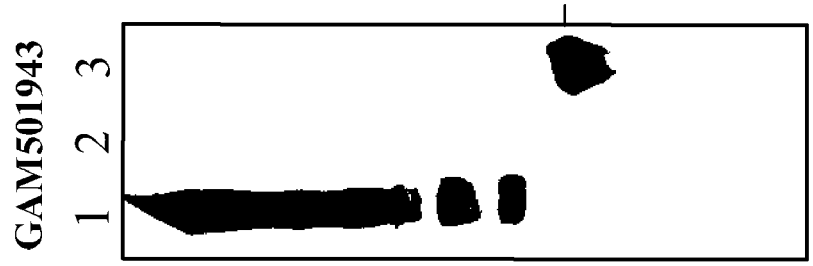

Reference is now made to FIG. 20, which presents pictures of laboratory results that confirm expression of the bioinformatically-detected novel Vaccinia GAM oligonucleotides GAM501943 (FIGS. 20A and 20C) and GAM501981 (FIG. 19B). HeLa cells were infected with 50 PFU Vaccinia Virus and total RNA was harvested after 3 days. Northern blot analysis was performed with a 53 nt DIG-labeled RNA probe for GAM501943 predicted precursor (FIG. 19A), a 73 nt DIG-labeled RNA probe for GAM501981 predicted precursor (FIG. 19B) or a 22 nt 32P-ATP-labeled DNA oligonucleotide probe for predicted mature GAM501943.2 (FIG. 19C). Lanes: 1—GAM precursors in total RNA extracted from HeLa cells infected with Vaccinia Virus; 2—GAM precursors in total RNA extracted from HeLa cells that were not infected with Vaccinia Virus; and 3—a transcript of predicted sequence and size was run alongside the other lanes to serve as a size marker and a hybridization control (FIGS. 19A and 19B). The arrow in FIG. 19C marks a band 53 nt, which is the predicted precursor size, that reacts with mature 22 nt GAM501943.2 probe.

It is appreciated that the sequences that hybridized with the probe appear only in infected cells in vivo and comprise sequences of novel GAM gene precursors, referred to here as GAM501943 and GAM501981, detected by the bioinformatic gene detection engine 100 of the present invention, as described hereinabove with reference to FIG. 2.

Figure 21A:
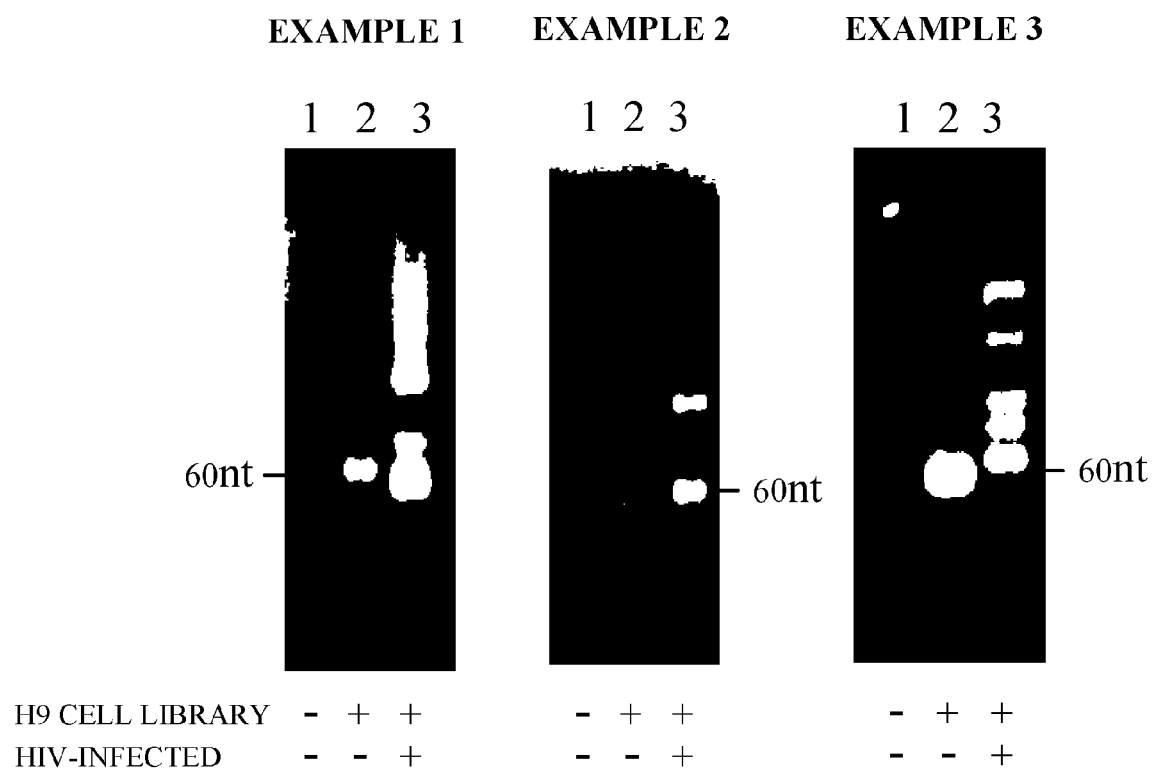
FIG. 21A is a picture of laboratory results demonstrating bands demarcating the presence of small, approximately 60 nt-long oligonucleotides (representing 22 nt-long GAM RNA ligated to adaptors) in control H9 cells and H9 cells infected with the HIV virus, thereby validating that HIV infection can alter the levels of efficacy of small, 22 nt-long oligonucleotides of the present invention.

Reference is now made to FIG. 21A, which is a picture of an agarose gel demonstrating the effect of HIV infection on GAM RNA levels in H9 cells. DNA libraries were created from H9 cells and from HIV-infected H9 cells as described in FIG. 17C. Briefly, adaptor sequences were ligated to YM100 RNA, reverse transcribed to cDNA and amplified to libraries using PCR with hemispecific primers. The PCR product was run on an agarose gel and stained with ethidium bromide. Some representative gels are presented in FIG. 21A. Lane 1 shows PCR product from a reaction run with all of the reaction components except for the library and serves as a control; Lane 2 shows PCR product levels from an H9 cell library that has not been infected with HIV; and Lane 3 shows PCR product levels from an H9 cell library that was infected with HIV.

It is appreciated that HIV infection of H9 cells increases the expression of small, approximately 22 nt-long oligonucleotides in certain predicted GAM RNAs (Examples 1 and 2), while decreasing them in other predicted GAM RNAs (Example 3). Lanes that did not contain any libraries did not show any bands, demonstrating a lack of contaminated DNA in the procedure. The 60 nt bands representing 22 nt-long GAM RNA ligated to adaptors were then excised, cloned and sequenced, with reference to FIG. 21B hereinbelow.

Reference is now made to FIG. 21B, which is a table of laboratory results validating expression of novel human oligonucleotides in human cells infected with HIV, that are detected by a bioinformatic oligonucleotide detection engine 100 (FIG. 2), constructed and operative in accordance with a preferred embodiment of the present invention. It is appreciated that the bioinformatic predictions presented here serve only as examples of a large quantity of results from the bioinformatic oligonucleotide detection engine 100. The bands from the gels depicted in FIG. 21A were cloned and sequenced as described hereinabove. In brief, a primer was designed such that its first half, the 5' region, is complementary to the adaptor sequence and its second half, the 3' region, anneals to the 5' terminus of GAM RNA sequence, yielding a hemispecific primer (as elaborated herein above with reference to FIG. 13). Predicted GAM RNA sequences were examined by PCR using hemispecific primers and a primer specific to the 3' adaptor. PCR products were cloned into plasmid vectors and then sequenced. (The predicted GAM RNA were verified by cloning and sequencing using a primer that was originally designed for a slightly different prediction.)

The results are presented in a table that includes the following fields: "Primer Sequence" contains the "specific" part of the hemispecific primer; "Sequenced sequence" represents the nucleotide sequence detected by cloning (excluding the hemispecific primer sequence); "Predicted GAM RNA" contains the GAM RNA sequence that is predicted by the bioinformatic oligonucleotide detection engine 100; "GAM precursor sequence" contains the sequence of the GAM precursor RNA that is predicted by the bioinformatic oligonucleotide detection engine 100; "Chr" depicts the human chromosome on which the GAM precursor lies; "Strand" indicates whether the predicted GAM precursor lies on the "+" or "−" strand of the chromosome; and "Start Offset" contains the nucleotide number of the specified chromosome at which the predicted GAM precursor sequence begins.

It is appreciated that the "sequenced sequence" from Row 1 of the table in FIG. 21B was sequenced from the 60 nt band in Lane 3 of Example 1 of 21A. It is further appreciated that the "sequenced sequence" from Rows 2 and 3 were sequenced from the 60 nt band in Lane 3 of Example 2 of 21A. Row 3 was cloned from five independent clones showing robustness of that GAM RNA. It is further appreciated that the "sequenced sequence" from Row 4 was sequenced from the 60 nt band in Lane 2 of Example 3 of 21A. It is still further appreciated that the "sequenced sequence" from Rows 5 and 6 were sequenced from the 60 nt band in Lane 3 of Example 3 of 21A. Thus, it may be speculated that HIV infection of H9 cells down-regulates the GAM RNA presented in Row 4 of the Table and simultaneously upregulates the GAM RNAs presented in Rows 5 and 6 of the Table, with an overall downregulation of band signal intensity.

DETAILED DESCRIPTION OF TABLES

Table 1 comprises data relating the SEQ ID NO of oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; GAM POS: Dicer-cut location (see below); and Table 2 comprises detailed textual description according to the description of FIG. 1 of each of a plurality of novel GAM oligonucleotides of the present invention, and contains the following fields: GAM NAME: Rosetta Genomics Ltd. nomenclature (see below); GAM ORGANISM: identity of the organism encoding the GAM oligonucleotide; PRECUR SEQ-ID: GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 1; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; GAM ORGANISM: identity of the organism encodes the GAM oligonucleotide; SOURCE: For human GAM—chromosome encoding the human GAM oligonucleotide, otherwise—accession ID (GenBank, NCBI); STRAND: Orientation of the strand, "+" for the plus strand, "−" for the minus strand; SRC-START OFFSET: Start offset of GAM precursor sequence relative to the SOURCE; SRC-END OFFSET: End offset of GAM precursor sequence relative to the SOURCE; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; GAM ORGANISM: identity of the organism encoding the GAM oligonucleotide; PRECURSOR-SEQUENCE: GAM precursor nucleotide sequence (5' to 3'); GAM FOLDED PRECURSOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; PRECUR SEQ-ID: GAM precursor Seq-ID, as in the Sequence Listing; GAM POS: Dicer-cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET ORGANISM: identity of organism encode the TARGET gene; TARGET: GAM target gene name; TARGET BINDING SITE SEQUENCE: Nucleotide sequence (5' to 3') of the target binding site; and Table 7 comprises data relating to target-genes and binding sites of GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; TARGET: GAM target gene name; TARGET REF-ID: For human target genes—Target accession number (RefSeq, GenBank); Otherwise—the location of the target gene on the genome annotation. TARGET ORGANISM: identity of organism encode the TARGET gene; UTR: Untranslated region of binding site/s (3' or 5'); TARGET BS-SEQ: Nucleotide sequence (5' to 3') of the target binding site; BINDING SITE-DRAW: Schematic representation of the binding site, upper row represent 5' to 3' sequence of the TARGET, Lower row represent 3' to 5' Sequence of the GAM RNA; GAM POS: Dicer-cut location (see below); and Table 8 comprises data relating to functions and utilities of novel GAM oligonucleotides of the present invention, and contains the following fields: GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; TARGET: GAM target gene name; TARGET ORGANISM: identity of organism encode the TARGET gene; GAM FUNCTION: Description of the GAM functions and utilities; GAM POS: Dicer-cut location (see below); and Table 9 comprises references of GAMs target genes and contains the following fields: TARGET: Target gene name; TARGET ORGANISM: identity of organism encode the TARGET gene; REFERENCES: reference relating to the target gene; and Table 10 comprises data relating to novel GR (Genomic Record) polynucleotides of the present invention, and contains the following fields: GR NAME: Rosetta Genomics Ltd. nomenclature (see below); GR ORGANISM: identity of the organism encoding the GR polynucleotide; GR DESCRIPTION: Detailed description of a GR polynucleotide, with reference to FIG. 9; and Table 11 comprises data of all sequences printed on the microarray of the microarray experiment, as described herein above with reference to FIG. 17 and include the following fields: PROBE SEQUENCE: the sequence that was printed on the chip PROBE TYPE: as described in detail in FIG. 17 in chip design section and summarized as follows: Known: published miRNA sequence; Known_mis1: similar to published miRNA sequence, but with 1 mismatch mutation on the miRNA sequence; Known_mis2: similar to published miRNA sequence, but with 2 mismatch mutations on the miRNA sequence; Known_mis3: similar to published miRNA sequence, but with 3 mismatch mutations on the miRNA sequence; Known_mis4: similar to published miRNA sequence, but with 6 mismatch mutations on regions other than the miRNA sequence; Predicted: predicted GAM RNA sequences; Mismatch: sequences that are similar to predicted GAM RNA sequences but with 2 mismatches; Edges1: left half of GAM RNA sequences; Edges2: right half of GAM RNA sequences extended with its hairpin precursor (palindrome); Control1: negative control; Control2: random sequences; Control3: tRNA; Control4: snoRNA; Control5: mRNA; Control6: other; GAM RNA SEQ ID/MIR NAME: GAM oligonucleotide using Rosetta Genomics Ltd. Nomenclature (see below) or published miRNA oligonucleotide terminology; GAM RNA SEQUENCE: Sequence (5' to 3') of the mature, "diced" GAM RNA; LIBRARY: the library name as defined in FIG. 17C; SIGNAL: Raw signal data for library; BACKGROUND Z-SCORE: Z-score of probe signal with respect to background, negative control signals; MISMATCH Z-SCORE: Z-score of probe signal with respect to its mismatch probe signal; and Table 12 lists the GAM oligonucleotide sequences included in the present invention that were validated by laboratory means. For validated sequences of the present invention with more than one SEQ ID, the SEQ ID listed in the table may be arbitrarily chosen. The table includes the following fields: SEQUENCED: GAM oligonucleotides that were sequenced, as described hereinabove with reference to FIG. 13, are denoted by "1"; CHIP EXPRESSION: GAM oligonucleotide sequences that were validated by microarray experiments, as described hereinabove with reference to FIGS. 17A-C and 18A-C, are denoted by either "1" or "2". A "chip expression" value of 2 refers to GAM oligonucleotide sequences whose intensity is more than 6 standard deviations above the background intensity and 2 standard deviations above the intensity of the mismatch probe. A "chip expression" value of 1 refers to miRNA oligonucleotide sequences, whose intensity was more than 4 standard deviations above the background intensity. Note that some miRNA oligonucleotide sequences were validated by both microarray experiments and sequencing; SIGNAL: a raw signal data; BACKGROUND Z-SCORE: a Z-score of probe signal with respect to background, negative control signals; MISMATCH Z-SCORE: a Z-score of probe signal with respect to its mismatch probe signal; and Table 13 comprises sequence data of GAMs associated with different viral infections. Each row refers to a specific viral infections, and lists the SEQ ID NOs of GAMs that target genes associated with that viral infection. The table contains the following fields: ROW#: index of the row number; INFECTION NAME: name of the infecting organism; and SEQ ID NOs OF GAMS ASSOCIATED WITH INFECTION: list of sequence listing IDs of GAMs targeting genes that are associated with the specified infection.

Table 14 lists HIV-1 GAM oligonucleotides detected by the bioinformatics detection engine 100 of the present invention and include the following fields: GAM PRECURSOR SEQUENCE: Nucleotide sequence of the GAM precursor; GAM RNA SEQ: Nucleotide sequence of the GAM RNA; SOURCE: Source accession number encoding the GAM oligonucleotide; SRC-START OFFSET: Start offset of GAM precursor sequence relative to the SOURCE; STR: Orientation of the strand, "+" for the plus strand, "−" for the minus strand; TARGET: Target gene name; TARGET ORGANISM: organism encoding the target; TAR-REF ID: For human target genes-Target accession number (RefSeq, GenBank), otherwise, the location of the target gene on the genome annotation; BINDING SITE SEQUENCE: Nucleotide sequence of the target binding site;

The following conventions and abbreviations are used in the tables: The nucleotide "U" is represented as "T" in the tables, and;

GAM NAME or GR NAME are names for nucleotide sequences of the present invention given by Rosetta Genomics Ltd. nomenclature method. All GAMs/GRs are designated by GAMx/GRx where x is a unique ID.

GAM POS is a position of the GAM RNA on the GAM PRECURSOR RNA sequence. This position is the Dicer-cut location: A indicates a probable Dicer-cut location; B indicates an alternative Dicer-cut location.

All human nucleotide sequences of the present invention as well as their chromosomal location and strand orientation are derived from sequence records of UCSC-hg16 version, which is based on NCBI, Build34 database (April, 2003).

All viral sequences of the present invention as well as their genomic location are derived from NCBI, RefSeq database.

| GAM RNA SEQ | GAM SEQ-ID | SEQUENCED | CHIP_EXPRESSION | CHIP_SIGNAL | CHIP_BG_Z_SCORE | CHIP_MM_Z_SCORE |
|---|---|---|---|---|---|---|
| TTTGCTGCCTCTCCCAGCTCCC | 1 | 0 | 2 | 4807 | 7.1600103 | 7.8129125 |
| CACTAGTAGTCTCTGGC | 2 | 0 | 1 | 4435 | 7.298171 | −1.4740227 |
| GCTAGTGCAGGGAAATCTTTGG | 3 | 0 | 1 | 2688 | 13.465069 | −4.7450089 |
| CGCTGCTCCGCCTTGTCCATAT | 4 | 0 | 1 | 3421.5 | 5.0435877 | 7.0959082 |
| CCCCACTGTCCCCGGAGCTGGC | 5 | 0 | 2 | 65518 | 22.799175 | 24.102064 |
| TGCCCTGGCTCTTCTTGTTCCA | 6 | 0 | 2 | 9983 | 8.4301682 | 12.997806 |
| ACATTCTCTGATTGGTGCCTCC | 7 | 0 | 2 | 6695 | 12.723179 | 6.4453721 |
| AATATTTCTTCTAAAGCCCTTT | 8 | 0 | 1 | 1018.5 | 4.8226123 | 2.7607162 |
| GTTGAGGTGATGCCAGCCCTGC | 9 | 0 | 2 | 3770.5 | 12.133699 | 8.0446234 |
| TCATGGGGCCACAGCTGCCAGC | 10 | 0 | 1 | 1294.5 | 5.4938359 | −3.9189341 |
| TGGGGGACACCAGTCTCTCTCT | 11 | 0 | 1 | 3739 | 4.4848466 | −2.4173083 |
| TGGTCCCCATCCTTGCGATT | 12 | 0 | 1 | 4035.5 | 4.9446163 | 6.7577944 |
| TCCTGGGAGGCGGAGGTTGCAG | 13 | 0 | 2 | 2269 | 6.121397 | 7.7621231 |
| AGCAAGACCAGGGTTTTGTGTT | 14 | 1 | 0 | | | |
| CCCAGGCTGGAGTGTAATGGTG | 15 | 0 | 2 | 3009 | 7.0731392 | 13.781642 |
| AGCCCCTTGGTACTGTCCT | 16 | 0 | 1 | 9378 | 18.433018 | 1.0831363 |

-continued

| | | | | | |
|---|---|---|---|---|---|
| CTCTGTTTGCCTGCTGCCATC | 17 | 0 2 | 15154 | 17.421993 | 10.804789 |
| GTCTCCCAGCCTACATCTTTCT | 18 | 0 1 | 7497 | 5.4792051 | -2.7626641 |
| CCCGGGTGGAGCCTGGGCTGTG | 19 | 1 0 | | | |
| TCACTGCAAGCTCCACCCTCCG | 20 | 0 2 | 3370 | 12.960393 | 9.7885542 |
| AACCCAGGAGGTGGAGGTTGTG | 21 | 0 1 | 2482.5 | 5.7054992 | 11.887776 |
| ACCTTGTGATCCACCTGCTTTG | 22 | 0 2 | 9350 | 10.149202 | 4.1434402 |
| CCGGCTACTCGGGAGGCTGACG | 23 | 0 1 | 3014 | 4.2986312 | 12.683091 |
| CTGCCCTGGGGGCCTCCTTGC | 24 | 0 2 | 4817 | 12.989676 | 3.0056505 |
| GACCTCATGATCCACCTGCCTT | 25 | 0 2 | 5103 | 8.7762318 | 12.394208 |
| TTCTCTGTGCTGGGTCCTGAGG | 26 | 0 2 | 5272.5 | 8.1261625 | 9.2259359 |
| TGGGTAGTTTCCCCTGCCCTGC | 27 | 0 1 | 2944.5 | 4.1729741 | 10.251331 |
| AAAACAGCTTCCTCCAGTGGCTC | 28 | 0 1 | 2883 | 4.3991041 | 8.6778612 |
| TCACTGCACTCCAGCCTGGGTG | 29 | 0 2 | 65518 | 25.576307 | 20.417265 |
| CACCAGGAGGACAGGCCCCTAC | 30 | 0 1 | 1419 | 6.8781896 | -4.1960559 |
| ACGCCTGTAATCCCAGCACTTT | 31 | 0 2 | 6898 | 10.893064 | 18.948416 |
| TGACCTCCTTTCTCGACTAATT | 32 | 0 2 | 43651 | 10.281033 | 24.914602 |
| CCTGGCTCTGCCACTTACTGCC | 33 | 0 1 | 7371 | 5.4429383 | 8.8807936 |
| CTGCTCCCCAGCCTGCGCCTTT | 34 | 0 2 | 15059 | 11.630778 | 16.378119 |
| CATTGCACTCCAGCCTCCCATA | 35 | 0 2 | 10435 | 16.077471 | 9.6274853 |
| TTCTGATGGTTAAGTTCTGTCA | 36 | 1 0 | | | |
| CTGCAGTATGAGCTACCCAGGT | 37 | 0 1 | 671 | 4.2650108 | 3.2315347 |
| TACCATCCAAGCTGGTTTG | 38 | 0 1 | 1295 | 5.434535 | 7.9920983 |
| TGGTTTCCCTTTTGGCCTCTCC | 39 | 0 2 | 10935 | 11.08107 | 6.0971227 |
| ACTCTTTCTGCCCACAGG | 40 | 0 1 | 2806 | 5.5159893 | 5.3098421 |
| GGCTCACTGCAAACTGTGCCTC | 41 | 0 2 | 6270 | 10.347923 | 7.3339972 |
| ACCATTGCCCCCTAGTGTCTGT | 42 | 0 2 | 6005.5 | 16.011629 | 9.1782494 |
| CATTGCACTCCAGCCTGGGTGA | 43 | 0 2 | 65518 | 29.090452 | 30.6901 |
| TTCCTGGTCACTGCTGTTCCCT | 44 | 0 1 | 6518.5 | 5.1799512 | 10.527549 |
| GTCATGGTGCTAGCGGGAATGT | 45 | 0 2 | 23180 | 29.411751 | 28.092485 |
| GCGCCTGTGCCTCCTAA | 46 | 0 2 | 17094 | 12.760594 | 23.842529 |
| GCCTCCTGGCAGGCAGTGATG | 47 | 0 1 | 3239.5 | 4.4799371 | 8.1225739 |
| CTGTAATCCCAGCTACCTGGGA | 48 | 0 1 | 902 | 4.8697472 | 5.3667827 |
| CAAGGGTTTGCATTGGCTTT | 49 | 0 1 | 2817.5 | 4.1292181 | 6.8459005 |
| GTTTCTCTGGGCTTGGCAT | 50 | 0 2 | 8298 | 10.689093 | 5.6611276 |
| CCTGGGAGGCTGAGGCTGCAGT | 51 | 0 1 | 2965.5 | 4.9182892 | 9.9978838 |
| CACTGCAAGCTCCACCTCCCGG | 52 | 0 2 | 7048 | 12.263177 | 14.099768 |
| CACTGCAGCCTCGACTTCCCTG | 53 | 0 1 | 8874 | 6.8341184 | 1.4886127E-2 |
| CCCGGGTTGTCCGCGCGTCCGG | 54 | 0 2 | 7828 | 9.6190052 | 4.963129 |
| TAGCACAGGGCTCCTCAACCCA | 55 | 0 2 | 1806 | 7.8335514 | 5.4125681 |
| TCCTCCCCAAAGCCCAGCCTGG | 56 | 0 1 | 3388 | 4.4911599 | 5.001718 |

-continued

| | | | | | |
|---|---|---|---|---|---|
| ACAAAGTGCCTCCTTTTAGAGT | 57 | 0 2 | 65518 | 13.412503 | 32.421429 |
| CCCGGGAGGTGGAGCTTGCAGT | 58 | 0 1 | 2094 | 5.0106125 | 8.1183786 |
| CACTGCACTCCAGCCTGGCGAC | 59 | 0 2 | 65518 | 21.073904 | 27.87985 |
| CTGGGCTCAAGTGATCCACCCA | 60 | 0 1 | 2046 | 4.3300858 | 5.4814286 |
| TCTTTGCTATTGTGAATAGTGC | 61 | 0 2 | 9707 | 23.491186 | 2.1807733 |
| GTATGTGCTGAGCTTTCCCCGC | 62 | 0 2 | 2572.5 | 6.3526735 | 4.20855 |
| ACAGATTCACTGCACTGGCCAT | 63 | 0 2 | 15207 | 9.5306025 | 12.396938 |
| CACCTGTAATCCCAGCACTTCA | 64 | 0 1 | 2591 | 5.442101 | 10.425298 |
| CCCCTACACACCCCTCTTGGCA | 65 | 0 2 | 13065.5 | 7.4358983 | 7.0756011 |
| TCCTTCCTCTGTCAGGCAGGCC | 66 | 0 2 | 10471 | 20.063852 | 2.295146 |
| CAGGCTGAAGTGCAGTGGTGTG | 67 | 0 2 | 2136 | 8.2628632 | 9.4549208 |
| CGGAGTCTTGCTATGTTGCCCA | 68 | 0 1 | 1781 | 5.2067318 | 5.238801 |
| GCCATCCTGATGACAGGCCACT | 69 | 0 1 | 3787 | 14.638888 | −0.88807422 |
| GCTCACTGCAACCTCCGCCTTC | 70 | 0 2 | 42294 | 20.673286 | 23.478565 |
| TCAAGCCATTCTCCTGCC | 71 | 0 2 | 7209.5 | 8.1129141 | 18.200718 |
| TATTCCAGCCGCTTGAGCTCGC | 72 | 0 2 | 4174 | 10.310376 | 2.8741286 |
| GCAGCCTGGGCAACAGAGTGAG | 73 | 0 1 | 2157 | 4.5432754 | 10.740927 |
| TCACCAGGCTGGAGTGCAGTGG | 74 | 0 2 | 4254.5 | 12.14083 | 15.720531 |
| TGTGACACTGGCCATCTGGGTT | 75 | 0 2 | 2784.5 | 11.518049 | 11.150477 |
| TGCAATCCCCGCCTCAACAGGA | 76 | 0 2 | 7725 | 6.5569119 | 20.462164 |
| TGCCTGTTGCCCACCTGATAAA | 77 | 0 2 | 5059 | 6.2758183 | 2.6550572 |
| TCACTGCAACCTCCACCTTCAG | 78 | 1 0 | | | |
| TGCGCGCCAGCTCCCAGGTTCG | 79 | 0 1 | 2256 | 5.0988479 | 6.3105674 |
| GCGGGGTTCCGTGCCCCAGAGT | 80 | 0 2 | 4053 | 7.8508492 | 13.874727 |
| TTGCCCAGGCTGGAGTGCAGTG | 81 | 0 2 | 30880.5 | 19.972326 | 29.117062 |
| ACCATTGCACTCTAGCCTGGGC | 82 | 0 2 | 24856 | 14.974783 | 26.093969 |
| CTAGAGTGCAGGTGTATGGTTA | 83 | 0 2 | 1669 | 7.7501578 | 4.8546963 |
| TGTGCTGGCCTTTGGTGACTTC | 84 | 0 2 | 65518 | 44.612064 | 26.016636 |
| GCCCTTTGTGTCTGGCTGGGGT | 85 | 0 2 | 5320 | 11.978069 | 10.261797 |
| GGAGGCGGAGGCTGCAGTGAGC | 86 | 0 2 | 2820.5 | 9.8273449 | 10.098513 |
| AGCTCATTGCAACCTCCGCCTC | 87 | 0 2 | 30089 | 17.692238 | 12.997955 |
| ACTGCACTCCTGCCTGGGTAAC | 88 | 0 2 | 46280 | 12.181033 | 26.546303 |
| TCGCGGGTTGCACATGGCCATC | 89 | 0 1 | 3200 | 5.0210557 | 12.488149 |
| ATTGCACTCCAGCCTGGGCGAC | 90 | 0 2 | 65518 | 24.324524 | 35.482765 |
| GTGGCCCCAGGGCCCTGTCTGG | 91 | 0 1 | 2103 | 4.3064132 | 5.4394917 |
| GGGCAGATCACCTGAGGTCAGG | 92 | 0 2 | 3840 | 11.253606 | 14.604554 |
| GTCCCGCCGTCGCTCAGGCTG | 93 | 0 1 | 5861 | 5.2278342 | 1.3164479 |
| GGCCCCCGGAACGCTCTGTGACC | 94 | 0 1 | 8124 | 16.673124 | −2.3175049 |
| CGGTGCAAGGGTAGCGGCAGGC | 95 | 0 1 | 3417.5 | 4.6143517 | 0.71493685 |
| GCTCAAGCCTTCTGCCCACCTC | 96 | 0 1 | 1983.5 | 4.2462573 | 7.6688213 |

-continued

| | | | | | |
|---|---|---|---|---|---|
| GAGCCCAGGAGTTTGATGCTGC | 97 | 0 1 | 2802 | 4.1153555 | 12.440318 |
| TGAGTCAGCCTTGGCAGCCCCT | 98 | 0 1 | 4321 | 9.5403223 | -0.46607512 |
| TTTCACCATCTTGGCCAGGCTG | 99 | 0 1 | 1450.5 | 5.8872299 | 6.5283771 |
| GGACACGTGGCTGAAGGCGGCC | 100 | 0 2 | 3613 | 11.24597 | 5.512249 |
| CGGGGTTCATCCATGCTGTGGC | 101 | 0 1 | 3762 | 4.0037775 | 5.9347458 |
| AGTCCTGGCCTGGGGGACC | 102 | 0 1 | 4747 | 5.1204491 | 11.736219 |
| GCTGCACCCCAGCCTGGGTAAC | 103 | 0 2 | 7858 | 6.2366548 | 20.271864 |
| ATGCAGCCCCTGGTGCCCGGG | 104 | 0 2 | 14258.5 | 14.995996 | 10.545995 |
| TTAGGGTTACACCAGCCTCCTG | 105 | 0 2 | 12631 | 6.595377 | 2.2383578 |
| GTGGCTCACGCCTGTAATCCCA | 106 | 0 2 | 20268 | 15.527308 | 18.321419 |
| CCATTGCACTCCATCCTGGGCA | 107 | 0 2 | 37862.5 | 18.121622 | 18.236954 |
| GACCTTGTGATCTGCCTGCCTT | 108 | 0 2 | 7752 | 23.901592 | 13.466584 |
| TGTCCCCACCCAAATCTCATCT | 109 | 0 1 | 2845.5 | 5.6470904 | 0.60507727 |
| ACCTGTCTGCCTCCCACCATCAA | 110 | 0 2 | 6789 | 17.796188 | 8.0814438 |
| GTTGGCCAGGCTGGTCTCAAAC | 111 | 0 2 | 1993.5 | 6.2810149 | 2.2314062 |
| CAGCTGTTCATTGTTGCCACCC | 112 | 0 1 | 3205.5 | 5.7638865 | -1.2926182 |
| ATAGCAGCGCTGGCCCTCTGCC | 113 | 0 2 | 11135.5 | 8.3489428 | 16.26886 |
| AGTGGCCTGGAGCCCCGCCTGG | 114 | 0 2 | 64840 | 12.445142 | 20.585953 |
| GGCCGTCAGCCCCGATTTGCCA | 115 | 0 1 | 3015.5 | 4.7711444 | 4.6092601 |
| GCTGACCCCTACAGGTTGTGTT | 116 | 0 2 | 7867 | 6.2393546 | 19.308796 |
| CCTGGCTCCTACGGGTATTTTG | 117 | 0 1 | 3308 | 4.5325184 | 0.97975397 |
| CTCAGCTTGGCCTGGACGTAGC | 118 | 0 1 | 4410 | 4.8741584 | 14.490013 |
| CTCCTTGCCATTTCTTTTC | 119 | 0 2 | 5430.5 | 13.120463 | 6.2777233 |
| CCCAGGAGGCGGAGGTTGCAGT | 120 | 0 2 | 2787.5 | 6.7205362 | 12.188313 |
| CCCAGCAGTAGAGCTCATATGG | 121 | 0 1 | 4022 | 20.382507 | -2.8780954 |
| TCTCGATCTCCTGACCTTGTGA | 122 | 0 2 | 7138 | 10.617272 | 15.065091 |
| CACCATGCCCGGCTAATTTTGG | 123 | 0 2 | 5040 | 7.316802 | 9.882267 |
| TAGCCCTTCTCCACCTCGCCC | 124 | 0 2 | 8140 | 13.744523 | 2.9828069 |
| CCTGTGCTTGGCCAGAGAGGTT | 125 | 0 1 | 3994 | 4.3371038 | 14.052099 |
| CATGCCTGTAATCCCAGCACTT | 126 | 0 2 | 10382 | 14.765577 | 17.657774 |
| CCTGGGCCTCTCAAAGTGCTGG | 127 | 0 2 | 7478 | 6.5816064 | 16.968868 |
| GTCCCCGACGTTTGGCTTGATG | 128 | 0 1 | 3207 | 4.4545999 | 5.6476693 |
| CTGCACTGACTTCCCCGGCTGC | 129 | 0 1 | 2702 | 4.0437126 | 7.0977674 |
| TCCTGGGATCAAGTGATCCTCC | 130 | 0 1 | 2812 | 4.0140038 | -0.25205359 |
| TTGCTAGTGTTTGGTTGATGGT | 131 | 0 2 | 13321 | 29.278065 | 21.353354 |
| ATCATTATCCTCCTATTTGCCT | 132 | 0 2 | 2916 | 8.0566654 | 5.4937286 |
| TGCTCTGATTTTTGCCCCAGCT | 133 | 0 2 | 10768.5 | 14.230415 | 7.0602937 |
| TCTGTGTCTCCACCCAAATCTCA | 134 | 0 1 | 3991.5 | 4.6330791 | -6.5020531E-2 |
| TACTATGGTTATTATCCCTCTCC | 135 | 0 1 | 1264 | 4.0216489 | 1.9981372 |
| GGAGTGCAGTGGCGTGATCTCG | 136 | 0 2 | 3942.5 | 10.745003 | 10.263955 |

-continued

| | | | | | |
|---|---|---|---|---|---|
| TCGAAGGCCTCTTGCTCCTCGA | 137 | 0 1 | 1306 | 4.9944282 | 4.6041131 |
| GTATTTGGAAACCACCAGTGCC | 138 | 0 2 | 1363 | 7.8097911 | 4.1715727 |
| TTGCCCAGGCTGGAGTGCAGTA | 139 | 0 2 | 11492 | 11.738238 | 20.495441 |
| CTGTCCCTGAGCAACTCCTGTT | 140 | 0 2 | 2516 | 6.2773986 | 8.6073799 |
| AGCGTGTTGGGAGGAGCTGCAG | 141 | 0 2 | 1410 | 9.0065594 | 8.8227701 |
| CCGGGCTGGAGTGCAATGGCTC | 142 | 0 2 | 3585.5 | 7.393702 | 15.612262 |
| GGGCGTGGAGCTGGAATGATGT | 143 | 1 0 | | | |
| GCTGAACGAGCTGGCCAAGTTC | 144 | 0 2 | 9451 | 6.6551905 | 19.321331 |
| CCACTGCACTCCAGCCTGCCAA | 145 | 0 2 | 65518 | 20.333113 | 17.882483 |
| TCTCTAGTCCTGCCTCCCC | 146 | 0 2 | 12753 | 19.169752 | 7.0407801 |
| CACTGCACTGCAGCCTGGAGAC | 147 | 0 1 | 6050 | 5.6199274 | 17.140821 |
| ATGGGGTGAGTGACGCCCTC | 148 | 0 1 | 1899 | 5.3449593 | 1.7462343 |
| AGCACGGTGGGTTTGGCTGGCA | 149 | 0 2 | 8532 | 8.91047 | 7.0811062 |
| ATGCCACTGCACTTCAGCTTGG | 150 | 0 2 | 7484.5 | 6.5842552 | 19.414671 |
| ACATCCTCCCGATCTACTGGCT | 151 | 0 1 | 3651 | 4.4286699 | 1.3539879 |
| ACTGTCCGGACAGGCCCATCC | 152 | 0 2 | 1271 | 9.39785 | 2.6795073 |
| TGACAATGAGGCCCTCCACAAA | 153 | 0 1 | 1679 | 5.1023388 | 2.1864455 |
| AAGTGCTAGTGAGTCTATTGTA | 154 | 0 2 | 15263 | 30.581371 | 17.914198 |
| GACCTCGTGATCCGCCTGCTTT | 155 | 0 2 | 4080.5 | 7.6009617 | 13.947659 |
| TGACCTCCTGGGCTCAAGCC | 156 | 0 1 | 1564.5 | 4.9039502 | -9.6304779 |
| CTCGACTTCCCTGGCTTGCGTGA | 157 | 0 2 | 6890 | 6.5380254 | 11.584653 |
| AGAGATGGGGTTTCACCACGTT | 158 | 0 2 | 2101.5 | 7.7702832 | 10.676204 |
| GGTGGCAGTAGCACTGGGCCTG | 159 | 0 2 | 1077 | 6.041307 | 2.6370835 |
| GTGACCTGGCCGCCTAAACCCA | 160 | 0 1 | 5941.5 | 5.6531525 | 18.527802 |
| AATTGCACGGTATCCATCTGTA | 161 | 0 2 | 18407 | 8.3120737 | 26.950815 |
| CTGTCCTGTGCTTTTTACTGTC | 162 | 0 1 | 5185 | 5.3258371 | 1.2787153 |
| CCTGCCTACTGAGTTTTATATT | 163 | 0 1 | 3745 | 12.145576 | 4.7314309E-2 |
| GCGGCGGCGGTAGCAAAAATGA | 164 | 0 2 | 65518 | 27.5298 | 22.089998 |
| CTGGCCACTGCACCTCTTCCT | 165 | 0 1 | 3912 | 5.3084121 | 3.5621116 |
| TCAGCCTCCTCCACCCCAGAGT | 166 | 0 2 | 6996.5 | 14.03341 | 7.0927162 |
| AGCAGCAGTATCCTTCCCCGGC | 167 | 0 1 | 3825 | 4.4749479 | 9.2136803 |
| CCAGGAGGTGGAGGTTGCGGTG | 168 | 0 2 | 2398 | 6.4942522 | 7.9789319 |
| GGCTGGCCCCATCCAGGCTGGCA | 169 | 0 2 | 65518 | 10.117671 | 10.864906 |
| TGCAGGTTGCTGGTCTGATCTC | 170 | 0 2 | 8079 | 24.743416 | 17.869699 |
| TGGTGCAGCGTGTGGTGGCTCT | 171 | 0 2 | 4082.5 | 9.6208868 | 12.887189 |
| TTGCCTTCCTGCCCAGCTTCTG | 172 | 0 2 | 5405 | 6.7744174 | 12.840696 |
| CTCTTTGGTTGGTTCCTGATGC | 173 | 0 2 | 9661 | 15.128378 | 18.743273 |
| TCACCGAGGCTGGAGTGCAGTG | 174 | 0 2 | 3619 | 11.230327 | 15.315854 |
| GCGTCCGGCCTCTCTCGCTCCCG | 175 | 0 1 | 3319 | 5.4790416 | 5.205163 |
| CGGTGCCTCCTCCAGTGTTGCT | 176 | 0 2 | 8559 | 10.886886 | 9.833169 |

-continued

| | | | | | |
|---|---|---|---|---|---|
| CAGGCTGGAGTGCAGTGGCGCT | 177 | 0 2 | 7523 | 15.30444 | 19.097713 |
| AGGCACCACATCTCCCTCCCC | 178 | 0 1 | 2510.5 | 5.2200365 | 3.5559428 |
| GATATGGAAGGCCATGCC | 179 | 0 1 | 1268 | 6.3048329 | 0.48396423 |
| TAGAACTATGGCTATGTGCCA | 180 | 0 2 | 2523.5 | 18.843672 | 7.4688845 |
| GTTGCCTAGGCTGGTCTTGAAC | 181 | 0 2 | 4155 | 10.291553 | 9.7640581 |
| AGCACCTCCAGAGCTTGAAGCT | 182 | 0 2 | 7872 | 6.2408533 | 20.331314 |
| GGGTTGGCATCAGGGTTCTGTG | 183 | 0 1 | 4777 | 4.5148683 | 8.4523115 |
| ACTGCACTGCAGCCTGGCCAAC | 184 | 0 2 | 10584 | 7.3915148 | 12.856659 |
| TTCACTGCAACCTCCGCCTCCC | 185 | 0 2 | 32044.5 | 19.90851 | 19.617628 |
| CTCACTGCAACCTCCGTCTCCC | 186 | 0 2 | 36527.5 | 21.028955 | 23.176895 |
| ATATGCAGTCTCTTGCCCTTCT | 187 | 0 2 | 18270 | 7.3851495 | 16.705791 |
| GGCCTGTAATCCCAGCTACTCA | 188 | 0 1 | 3140.5 | 5.8857031 | 12.328485 |
| AGCAGAGTGCCCATCCCGGA | 189 | 0 1 | 1287 | 5.9567142 | 7.4900131 |
| CTCACTGCAAGCTCTGCCTCCA | 190 | 0 2 | 18388.5 | 17.632027 | 21.920879 |
| GTGGTAGCTCCAGGCTGTCTGA | 191 | 0 2 | 10711 | 30.533655 | 22.150589 |
| TGGCGGCGTGTGGACTGAGGAC | 192 | 0 2 | 15121 | 9.9330997 | 18.565649 |
| CCCCTCAGTTTGCTAGTATTTT | 193 | 0 1 | 11735 | 24.905746 | 1.1986766 |
| ACTGCCCTCCAGCCTGGGTGAC | 194 | 0 2 | 21572 | 13.925464 | 26.790289 |
| GTTGGTCTTCATTAAATGCTTT | 195 | 0 2 | 3499.5 | 17.153486 | 5.8892236 |
| AGCTTTGGTTGCCATGATCTGA | 196 | 0 1 | 1665 | 5.5821729 | 10.27639 |
| CATAATTTCTACCAGGGCCATA | 197 | 0 1 | 886 | 5.792675 | 1.0480881 |
| TCCTTGTGCTGAGGGTGTTGCT | 198 | 0 1 | 2546 | 5.148253 | 3.1969757 |
| TCTGGCTTCCCTCTGTTCTGGG | 199 | 0 1 | 6739 | 9.2949047 | 0.96471214 |
| TCCCCCAGGCTGGAGTGCAGTG | 200 | 0 2 | 7443 | 15.029393 | 17.058321 |
| CTTCATCAGCTGGCTTACTGTT | 201 | 0 1 | 2296.5 | 4.4541421 | -4.1260543 |
| TGCGTTCCAGTTGCTGCCAGGC | 202 | 0 2 | 5079 | 11.194171 | 5.7294831 |
| CCTGGAGGCGGAGGTTGCAGTG | 203 | 0 2 | 3559.5 | 8.169879 | 12.004289 |
| CCTCTGCACCAACCTGTCAAGA | 204 | 0 2 | 2057.5 | 11.429537 | 3.11975 |
| CACTGCAGCCTCCATCTCTGGG | 205 | 0 2 | 4050 | 6.9180322 | 10.574921 |
| GGTGCCCCATCGCGGGTGGCTG | 206 | 0 2 | 27077 | 14.316696 | 22.61035 |
| GCAGGGAACTGGCTGGGCTTT | 207 | 0 2 | 16084 | 7.1124773 | 22.951672 |
| CCGTCCCCGGTGCTGCCTGCGC | 208 | 0 2 | 48514 | 9.4747534 | 7.9190497 |
| ATTAGGAGAGTGGGTGCTAAGT | 209 | 1 0 | | | |
| ACCCAGGCTGGAGTGCAGTGAT | 210 | 0 2 | 1941.5 | 7.7255301 | 11.090164 |
| CACTGCACTCCAGCTTGGGCAA | 211 | 0 2 | 65518 | 28.324137 | 30.232615 |
| CAGAGCTGGCTTCATGGGTGTGC | 212 | 0 2 | 5653 | 6.236114 | 16.840534 |
| TCTTCCTGTCAATGAGAATTAA | 213 | 0 1 | 3699 | 5.0892124 | 3.8346827 |
| GCAGGCGGAGGTTGCAGTGAGC | 214 | 0 1 | 1579 | 4.3141651 | 8.2424784 |
| GTCTTTTGCTAGCCAGAGAGCT | 215 | 0 2 | 2153 | 8.0217466 | 10.245297 |
| CACTGCACTCCAGCCTGGGCAA | 216 | 0 2 | 65518 | 31.916103 | 33.140068 |

-continued

| Sequence | ID | | | | | |
|---|---|---|---|---|---|---|
| GCCCCCGTAGTAGATGAGGCGC | 217 | 0 | 2 | 16235 | 27.099997 | 7.9834018 |
| GGTCGCTGTGTAGGTTCAGCTA | 218 | 0 | 1 | 3938.5 | 5.7133183 | 2.4790351 |
| TCTGGCTCTGGAGTCCACCTGC | 219 | 0 | 2 | 3242.5 | 6.90412 | 4.9786406 |
| GACAGCTCCAGCTCCTCCAGGC | 220 | 0 | 1 | 1845 | 4.1900787 | 8.3998461 |
| TCACTACAACCTCCGCCTCCTG | 221 | 0 | 2 | 28515 | 18.559631 | 13.999067 |
| ACCCAGGCTGGCGTGCAGTGGC | 222 | 0 | 1 | 1413.5 | 5.045722 | 6.4478707 |
| CCTGTGGTCCCTGTCTGTGCCT | 223 | 0 | 2 | 17748 | 13.149311 | 10.342139 |
| ATTGCACTCCAGCCTGGGCAAC | 224 | 0 | 2 | 65518 | 33.306091 | 35.513947 |
| TCAAGCAATTCTCCTGCCTCGGC | 225 | 0 | 2 | 10092.5 | 16.702658 | 19.82888 |
| AATGCTGAGTCCTGTGAGTCTT | 226 | 0 | 1 | 923 | 4.3064132 | 5.5901709 |
| AGTCGCTGTTGGTCGTGGCACT | 227 | 0 | 2 | 2426.5 | 6.5083675 | 3.8499751 |
| CTGCAAGCTACCCCTAGCATCA | 228 | 0 | 1 | 1187 | 5.359941 | 7.49787 |
| AGGACCTGTCCCCTGGCCCACT | 229 | 0 | 2 | 65518 | 15.796532 | 15.770715 |
| GCAGGCATTAGCCCCCATGGCT | 230 | 0 | 1 | 2898 | 5.201571 | 11.64039 |
| AGGCCAAGAAGGAAGCAGAGG | 231 | 1 | 0 | | | |
| CTTCCTGCCTCTCGCCGCCCGC | 232 | 0 | 2 | 7982 | 10.846725 | 2.7860351 |
| ATTGTTGCCCATGTTTTTATTT | 233 | 1 | 0 | | | |
| CTGGCAGGTTATAGAGCTGCCC | 234 | 0 | 2 | 1302 | 7.096612 | 5.6983724 |
| TCTCCACAGCTGGCCCCCAAGA | 235 | 0 | 2 | 19483.5 | 23.591568 | 26.742323 |
| GGGTTGGATCCTGGTGGCTGCC | 236 | 0 | 1 | 2919 | 4.99542 | -1.0961211 |
| CCTTTTGTCCTGCTTGGTTTCG | 237 | 0 | 1 | 5359.5 | 5.4283695 | 7.2327213 |
| TGGTGCTTGTGGAGCTGGTGCT | 238 | 0 | 1 | 6931 | 22.109066 | -15.237776 |
| CAGCCTGCATCATCTGCAGC | 239 | 0 | 1 | 1052.5 | 6.097331 | -9.9813395 |
| TCACTGCAATCTCAGCCTCCTG | 240 | 0 | 2 | 13609 | 16.304766 | 12.973942 |
| TGGGTGGAGCAGGCTGGTGCTT | 241 | 0 | 1 | 1915.5 | 4.7277126 | 2.129667 |
| CTGAGATAGGACTCTGCTGGCT | 242 | 0 | 1 | 3797.5 | 4.0238738 | -0.4093681 |
| GCCTATCTGTCAAATTTCTCTG | 243 | 0 | 1 | 2514 | 5.7133183 | -1.7767694 |
| TTCTTCTGCCCCTTGCCTGACA | 244 | 0 | 2 | 10593.5 | 16.647232 | 9.2061243 |
| ACTGCACTCCAGCCTGGGCAAC | 245 | 0 | 2 | 65518 | 37.057747 | 34.517231 |
| TGCCTAGGCTGGAGTGCAATGG | 246 | 0 | 1 | 1842 | 4.9093466 | 7.6070156 |
| CTGGCCTGGCGCAGTGGCTCAC | 247 | 0 | 1 | 3273.5 | 4.5061736 | -1.0821109 |
| CTCCTTCTGGGCCTGGCAGTGG | 248 | 0 | 2 | 17180 | 8.0816298 | 15.63814 |
| CAAGGTGCCATGCTGGGCGGGG | 249 | 0 | 2 | 2339 | 11.124713 | 9.2460661 |
| AGTGGGCCGGACAGCCCAGGCC | 250 | 0 | 1 | 3009 | 10.806414 | -0.20481651 |
| TGCTTATATTTCATTGGCCCAA | 251 | 0 | 1 | 1737 | 5.1939707 | 0.85535181 |
| CCAAAGTGCTAGGATTACAGGC | 252 | 0 | 2 | 1345 | 8.5948114 | 8.4856577 |
| CGGCACTGTAGTCTGGCTGGGA | 253 | 0 | 2 | 3297 | 6.7212648 | 9.1534166 |
| TGCCGCAAGTACTGCTGCCTGT | 254 | 0 | 1 | 1966.5 | 5.8571658 | 3.7118392 |
| GATGTCGTGATCCACCCGCCTT | 255 | 0 | 2 | 3425 | 7.313684 | 10.200798 |
| CGTGCCACTGCACTCTAGCCTG | 256 | 0 | 2 | 27042.5 | 12.034669 | 26.515484 |

-continued

| | | | | | |
|---|---|---|---|---|---|
| CATGGCAGCTCCTCCAGTGTGA | 257 | 0 2 | 2256.5 | 6.8781896 | 5.7773385 |
| GGAATCCTGCCAGCTCTGCCCC | 258 | 0 1 | 13916 | 12.002161 | 2.1075698E-2 |
| CCAGTACGTTGCTCAGCTCCTC | 259 | 0 2 | 10610.5 | 11.484417 | 2.7025924 |
| TGTCTCCCCACTGGTCTTCCAG | 260 | 0 1 | 7039 | 5.6089306 | 15.167439 |
| CTGGCCTAAAAATACAGAACAA | 261 | 0 1 | 8784.5 | 6.609952 | -0.46130967 |
| CAGGCTCTTCCCTCTGGCCAAG | 262 | 0 2 | 25089 | 10.865691 | 11.601097 |
| ACTCTGGCCATCTTGGACCTTG | 263 | 0 1 | 4235 | 5.8999434 | 14.697995 |
| CGGCGAGCGGGACCTGCGCCTG | 264 | 0 2 | 13179 | 8.0060148 | 5.5586901 |
| TGTGCCTGTTCCCACTTTGCCT | 265 | 0 1 | 2611 | 5.0901771 | 2.5660698 |
| CTCACTGCAACCTCCGCCTCCT | 266 | 0 2 | 62403 | 22.993574 | 18.170233 |
| AGGCTCCCTGAATCGCCCGTTC | 267 | 0 1 | 3782.5 | 5.0892124 | -3.9663608 |
| CTCTGCCTCCCAGGTTCAAGCG | 268 | 0 2 | 20999.5 | 17.079414 | 18.674911 |
| GCTAGTGTTTGCCAGCGTAGCC | 269 | 0 1 | 825 | 4.6319594 | 4.9597144 |
| GGAGTTCCAGACCAGACTGGCC | 270 | 0 1 | 2430 | 4.3969355 | 2.4696999 |
| CTCAGCTCATCCACTAAATCCC | 271 | 1 0 | | | |
| ATTGCACTCCGGCCTGGGTGAC | 272 | 0 2 | 15397 | 13.126676 | 25.123175 |
| CAACATGGTGAAACCCCGTCTC | 273 | 0 2 | 8706 | 11.270616 | 12.27146 |
| GTGCCGACGCTCCAGCACCATCC | 274 | 0 1 | 1384 | 5.1635141 | 3.8417749 |
| ACTGTACTCCAGCCTGGTGGCA | 275 | 0 2 | 9608.5 | 7.5143518 | 22.582787 |
| GTGACAGTGAATCTAGACAGAC | 276 | 1 0 | | | |
| TCACTGCAACCTCCGCCTGCTG | 277 | 0 2 | 39092.5 | 19.973478 | 20.767599 |
| TCTGCGGTCCCCTTCTCGCCCT | 278 | 0 2 | 10190 | 10.797435 | 8.6208448 |
| CAGGCTGGAGTGCAGTGGTGCC | 279 | 0 2 | 8766 | 16.20937 | 18.915073 |
| CCTCTTTCACCGTGCCTGTCCC | 280 | 0 2 | 8800 | 16.616077 | 5.438931 |
| CTGAGCTCACGCCATTCTCCTT | 281 | 0 2 | 10524 | 16.186312 | 18.177279 |
| GGTGATCCACCAGCCTCGGCCT | 282 | 0 2 | 5029 | 8.9257526 | 7.78508 |
| TGACCCCTATATCCTGTTTCTT | 283 | 0 2 | 6691 | 6.3185239 | 5.4931335 |
| ACTTCCCACCCCTCCAG | 284 | 0 1 | 3259.5 | 4.1611338 | 12.380153 |
| CTTTATGAAAACCTGAATTATG | 285 | 0 2 | 3768 | 23.111034 | 14.960108 |
| CGGCTCACTGCAGCTCCGCCTC | 286 | 0 2 | 14047 | 17.9716 | 6.964889 |
| GGCCTGTGGTGCGCTATTTCAG | 287 | 0 1 | 3159 | 4.7927871 | 10.763789 |
| CTTGCTTTCAGTCTCGGCCTCA | 288 | 0 1 | 1763 | 4.0555487 | 1.144424 |
| ATCACTTTGAGTCCAGGAGTTT | 289 | 0 2 | 7335 | 6.5335536 | 19.718058 |
| GAGGCAGAGGTTGCAGTGAGCT | 290 | 0 2 | 2657 | 8.4238987 | 11.530189 |
| CTGGCCAAGATGGTGAAACCCC | 291 | 0 1 | 29538 | 10.824452 | 1.9062781 |
| GCCTGGGTCCACCGCTCGCGCT | 292 | 0 2 | 7299 | 6.5360622 | 9.6849566 |
| GAGGCCACTGTCCCTGCCTTCC | 293 | 0 1 | 3343.5 | 4.653738 | 9.7698135 |
| ACCCGCCGCACGTCCAGGCTGA | 294 | 0 1 | 5018 | 5.1787949 | -1.1583936 |
| TGGCTTCCCCGGAGTGACATGT | 295 | 0 2 | 13507.5 | 16.857716 | 15.057426 |
| GGAGGAGCATGAGAGGGTAGTG | 296 | 0 1 | 1193 | 4.0301342 | -18.279354 |

-continued

| | | | | | |
|---|---|---|---|---|---|
| GCTGTCCAGCCCTTGTTCACCT | 297 | 0 1 | 2068 | 6.8781896 | -1.7931671 |
| GCCTCCAGGTCGGTCTTTCTCT | 298 | 0 2 | 7529 | 13.077046 | 6.7496343 |
| AGGGAAATCTCAGCTCTAAAAT | 299 | 0 2 | 8991 | 16.352005 | 20.399546 |
| CTCAGTGCAACCTCCGCCTACT | 300 | 0 2 | 4516 | 8.8905106 | 13.512998 |
| CCGGTCTGTGTACTTGCTGGCC | 301 | 0 1 | 10835 | 16.283325 | 0.65039492 |
| CACTGTCTTCCTTTGGCTCCTC | 302 | 0 2 | 8497 | 10.860129 | 11.864268 |
| CACTGCACTCCAGCCTGGGAGA | 303 | 0 2 | 65518 | 22.925808 | 34.725494 |
| TACTGTGTGCCCAGCCGAGCTG | 304 | 0 1 | 1632 | 5.7854853 | 4.7016063 |
| GCCCAGATCTCCTGACCCTCAG | 305 | 0 1 | 4383 | 4.3306851 | 5.3791971 |
| TCACTTCCCAGACGGGGTGGCA | 306 | 0 1 | 1907 | 4.2122374 | 7.5382385 |
| TGCTGCCCTAAGACCACCTT | 307 | 0 2 | 4950 | 11.124713 | 13.249466 |
| ACACTGATGTTGGCCCTGGTCA | 308 | 0 2 | 6128 | 7.7381911 | 9.9548664 |
| ATGGCTGCCTGGGCGCTGGCCG | 309 | 0 2 | 65518 | 12.023874 | 4.5536995 |
| TTTCTCCTCATGACTGGTTGTG | 310 | 0 1 | 2943 | 4.1956687 | 3.8969367 |
| AAAGCGCTTCCCTTTGGAGCGT | 311 | 0 1 | 6099 | 5.6389537 | 17.599831 |
| AACGCCCAGCCTTGATCAAATG | 312 | 0 1 | 983 | 5.3299565 | 0.62059402 |
| TGAGCACATGCCAGCCCTTCTC | 313 | 0 2 | 7638 | 17.835676 | 6.0798554 |
| GACCTCGTGATCTGCCGGCCTT | 314 | 0 2 | 2588 | 16.253777 | 11.608788 |
| TGGCTAACAAGGTGAAACCCCG | 315 | 0 2 | 22025 | 9.0206518 | 5.915132 |
| TGTGCTCTGACTTTCTCCTGGT | 316 | 0 2 | 6627 | 6.2784839 | 12.047 |
| TCTAGGTAGGCTGTGTGTGGAA | 317 | 0 1 | 20581 | 30.987326 | -4.863667 |
| GAAGTGTAGTCTTGAGCCCCCA | 318 | 0 1 | 2564 | 9.2326555 | -0.1792703 |
| CCTGCCTCCCCATCAGTTATACA | 319 | 0 1 | 7820.5 | 15.964743 | 1.1131122 |
| ACCACTGCACTCCAGTCTGGGC | 320 | 0 2 | 65518 | 19.886633 | 30.113441 |
| CTGCTCTGGTTTCCTCTGTC | 321 | 0 2 | 7506.5 | 7.7015729 | 15.622507 |
| GGGGCATTGTGTCTGGGTTCCT | 322 | 0 1 | 2912 | 5.6041431 | 2.0277293 |
| GCTGGCAGACTTCCTCTGGAAC | 323 | 0 2 | 1985 | 9.0118723 | 2.4699371 |
| CCTCAACCATAGGTCCAGGGG | 324 | 0 1 | 1203.5 | 6.5887036 | -0.78580427 |
| TCTCCTGGAGCCCAGATGCTGG | 325 | 0 1 | 2100.5 | 4.8226123 | 5.4119086 |
| CTCCTTGCTGGTCTGGTGTAAT | 326 | 0 2 | 12887 | 13.768332 | 6.9087734 |
| AAAGTGCTGGTATTACAGGTGT | 327 | 0 2 | 1430 | 8.6389112 | 8.4515057 |
| CTCCAGTTGGCCCCAGTTGGTT | 328 | 0 2 | 10654 | 12.255802 | 17.910707 |
| CCTCACTCAGGTTTGGACCCTG | 329 | 0 2 | 7301 | 15.895414 | 5.3846102 |
| ACTGCACTCCAGCCTTCCAG | 330 | 0 2 | 65518 | 16.869547 | 28.85684 |
| TGCCTAGCCAAGTCCAGTATTT | 331 | 0 2 | 5823 | 17.976177 | 16.478537 |
| CGCATGAGACCTGCCGGCCATC | 332 | 0 1 | 2073 | 9.8048887 | -3.4777019 |
| ATGCCCCTGGCCTGGGGAACAT | 333 | 0 1 | 5475 | 5.3843775 | 17.659876 |
| TCTCGCTCTGTCGCCCAGGCTG | 334 | 0 2 | 8558 | 11.966861 | 10.057902 |
| TAGTGCCCTCCCCTTTGGGATA | 335 | 0 2 | 3843 | 11.037247 | 12.832376 |
| GGCTCCTGGGGGTGCTCCTGCC | 336 | 0 2 | 9895 | 9.94205 | 8.883275 |

-continued

| | | | | | |
|---|---|---|---|---|---|
| AATGGGGTAGTGGGCAGCCTGG | 337 | 0 2 | 7138 | 14.468472 | 13.397085 |
| AACCCAGGAGGCGGAGGTTGTG | 338 | 0 2 | 3802 | 7.9819422 | 12.273234 |
| GGCTCACTGCAACTTCCGCCTC | 339 | 0 2 | 31704 | 19.028578 | 16.190495 |
| CCCGGAGGCAGAGGTTGCAGTG | 340 | 0 1 | 1643.5 | 5.8650842 | 6.6221547 |
| CGCCTGGCCCCCAGTACTTTGT | 341 | 0 2 | 65518 | 14.386203 | 22.674049 |
| TGGCTGTACATTGGAATTATCT | 342 | 0 1 | 4116 | 4.8355722 | 0.55707508 |
| CGTGCGCCTCAGCCTCGTGCGC | 343 | 0 1 | 3284 | 4.5142207 | 12.660418 |
| TCAGAATATGGCTAGGAGTGCT | 344 | 0 2 | 1830 | 9.6709318 | 10.3449 |
| CAGGCTGGAGTGCAGTGGGGCG | 345 | 0 2 | 4013 | 11.398844 | 15.757032 |
| TACGCCTGTAATCCCAGCACTT | 346 | 0 2 | 5888.5 | 12.35752 | 15.497684 |
| TGTCCCTGCAAATAACAT | 347 | 0 1 | 1509.5 | 5.3898416 | 8.1098919 |
| CTTCCCCAGGCTGGTCTGTAT | 348 | 0 1 | 3686 | 4.3019638 | -0.81996107 |
| CATGTTGGTGTGCTGCACCCGT | 349 | 0 2 | 3866 | 8.1607409 | 11.896873 |
| AGGCTGTAGTGCATGTGCTATG | 350 | 0 2 | 17379.5 | 8.1088619 | 26.406704 |
| ACTGCGCTCCAGCCTGGGTGAC | 351 | 0 2 | 46098 | 18.273163 | 32.816708 |
| AGTCCCCCTCTGAGCCCAGGGA | 352 | 0 1 | 5483 | 5.3878217 | -0.95005888 |
| TAGGTATAGGATTCTAGGTTGG | 353 | 0 2 | 1295 | 6.1877456 | 2.5713561 |
| CAATTCCCAGCTGCCGGGCTGC | 354 | 0 2 | 7442 | 8.735631 | 7.0616617 |
| CCATCCCTTGGAAGCTGGTTTTA | 355 | 0 2 | 4197 | 11.864914 | 11.215641 |
| GTGCTCCCTCCTTCCTCAAGGA | 356 | 0 2 | 3789 | 7.298171 | 9.6469736 |
| CCAAAGTGCTAGGATTACAGGT | 357 | 0 1 | 1054 | 4.3064132 | 4.0962029 |
| TGGATTCACACCATTCTCCTGC | 358 | 0 2 | 7131.5 | 8.6853085 | 6.5294394 |
| AAGTGCTGGGATTACAGGCATG | 359 | 0 2 | 1812 | 7.3370275 | 10.102645 |
| TGAGATGGAGTCTCGCTCTGTT | 360 | 0 1 | 1785 | 5.1520457 | 7.9560995 |
| TTGCTGCTCTGCCGGTACAGCT | 361 | 0 2 | 9885 | 6.0708628 | 22.70689 |
| GCCTGTCCCGCACCGGAGCCCG | 362 | 0 2 | 2397 | 7.096612 | 10.159995 |
| GTCTCCCCAGGGCCCTCTTCAT | 363 | 0 1 | 4158 | 6.0783563 | 1.3304862 |
| TGGATGGCTGTGGTCTTTGCCC | 364 | 0 1 | 4573 | 7.9280648 | -2.8086965 |
| CTTCCTTCTCACTAGCAGCGCC | 365 | 0 1 | 2665 | 5.1787534 | 2.627044 |
| TCCTTTGCTTCTGTCATTCTCC | 366 | 0 1 | 2483 | 4.0944448 | 6.7577206E-2 |
| GAGGCTGAGGTTGCAGTGAGCT | 367 | 0 2 | 1999 | 6.8439331 | 8.8330622 |
| GTAATATGTGCTGAGTCCT | 368 | 0 1 | 1202 | 4.4296627 | 8.1321344 |
| CTGGTTATCTCGGCCACAGAGA | 369 | 0 1 | 3187.5 | 5.22434 | -0.64146328 |
| GGCCACTGCTCTCCAGCCTGGG | 370 | 0 2 | 40431 | 15.478172 | 22.089659 |
| CCTGGCTCTGGCTTCCTGTTGT | 371 | 0 2 | 34525 | 11.373339 | 6.4300051 |
| AGCCCCAAACACCAGGATTACT | 372 | 0 1 | 4319 | 8.0879526 | 1.9557818 |
| CCGCCGCTGATAGCTCTGGGC | 373 | 0 2 | 7166 | 6.0192232 | 10.085858 |
| AGGGGCTCCTTTGTGCTGCGTC | 374 | 0 2 | 1911.5 | 7.5021071 | 5.5356297 |
| TCTTCACGCCAAGTGCCCCTCA | 375 | 0 1 | 4150 | 9.149087 | -6.0181384 |
| GGCCTCAGTGATGATGGGTTAAA | 376 | 0 2 | 6124 | 6.4003 | 5.4322863 |

| | | | | | |
|---|---|---|---|---|---|
| AAGGCTCGGCAATGTGCGGCTC | 377 | 0 2 | 1617 | 6.3867145 | 5.1396852 |
| TTTCCCTTTAGCCTGAGAATCC | 378 | 0 1 | 2392 | 5.359941 | 11.933125 |
| CAAAGTGCTAGGATTATAGGTG | 379 | 0 2 | 1570.5 | 9.1333447 | 8.6484661 |
| GAGGCAGGAGGATTGCTTGAGC | 380 | 0 2 | 11218 | 8.9163761 | 23.396725 |
| TCCGGGTGCCCACGTGCCCCTA | 381 | 0 2 | 13959 | 8.1505041 | 9.7457113 |
| GAGGCTGAGGCGGATGGATCAC | 382 | 0 2 | 37381 | 14.008185 | 28.093838 |
| ACCACCCAGCCAGCTTCTCCCT | 383 | 0 1 | 6121 | 8.7047195 | -0.78491044 |
| TGTCCAGCCGGCCCACGCCCAT | 384 | 0 1 | 2478 | 9.9760656 | -5.2396908 |
| GGCTCTTCCGCCACCAGCCACA | 385 | 0 1 | 1624 | 4.4541421 | 1.0276202 |
| TGCAGCATTGCACTCCAGCCTG | 386 | 0 2 | 11232 | 11.505449 | 21.076042 |
| TGGGTCTCTGGCCACCCCAGCC | 387 | 0 2 | 12948.5 | 8.0436459 | 19.699574 |
| TCTCTAGTCTCCTTTAACCTGA | 388 | 0 1 | 1148 | 5.2546234 | 2.501446 |
| TAGGTTGTCCATCTCTAGAAGC | 389 | 0 2 | 1004.5 | 8.2524061 | 4.2505751 |
| ACTGCAGTCTTGATCTCCTGGGC | 390 | 0 1 | 4871 | 4.5565634 | 1.9227443 |
| ACATCTAGACTCTTGCCCTCTT | 391 | 0 2 | 6310 | 10.886886 | 15.850095 |
| CTGGTCTGCCACCCACACCCCT | 392 | 0 1 | 5580 | 7.5570545 | -1.1313673 |
| GTGCCAGGCACAGGAAGCAGCC | 393 | 0 1 | 1855 | 4.0386124 | 0.18331024 |
| TCCTCCCTCACCTCAGTCTGGG | 394 | 0 2 | 8976.5 | 11.361602 | 9.0995693 |
| GTCCTCACTGGCCGCACGCTGA | 395 | 0 2 | 8536 | 7.1346483 | 19.281561 |
| CTGGCCTCGGCAGCAGGAACAG | 396 | 0 1 | 3757 | 4.0009317 | 4.5684352 |
| GAGTGCAGTGGCGTGATCTCTG | 397 | 0 2 | 1660.5 | 6.5337977 | 5.7436481 |
| GTGTTCCTGTGCTGGATGGTCA | 398 | 0 2 | 2131 | 11.864914 | 6.3784571 |
| CCAGGCTGGAGTATAGTGGCGC | 399 | 0 1 | 1270 | 4.4945917 | 7.4746661 |
| CCAGACCCTCCATTCAAGCTCC | 400 | 0 2 | 8423 | 9.3362026 | 7.7677507 |
| CACTAGGCTGGAGTGCAGTGGC | 401 | 0 2 | 4301 | 12.202009 | 16.549067 |
| TCACTGCGCTTCAGCCTGGGTG | 402 | 0 1 | 1929.5 | 5.0829325 | 1.1913716 |
| TCTTTGCTATTGTGAGTAGTGC | 403 | 0 1 | 3427 | 15.098435 | -1.562425 |
| TTGTATAGCCCAGAGAGTGAGA | 404 | 0 2 | 1038.5 | 6.9170618 | 6.1502376 |
| CATTGCACTCCAGCCTGGGCCA | 405 | 0 2 | 65518 | 29.033922 | 21.707558 |
| CTGCCCGCACCATCCCCGGGCT | 406 | 0 1 | 1967 | 5.5675011 | 7.4003267 |
| CGGCATGGGCGTCCCCCTCACT | 407 | 0 1 | 6042 | 5.6168065 | 9.6102333 |
| TTGCATTTGGTTCTGCCTGGTA | 408 | 0 2 | 7111 | 6.8737931 | 11.158542 |
| GAGCCCCACCCTAGACATTCTG | 409 | 0 1 | 2592 | 5.6915727 | -3.6630919 |
| GGATGGACGTGATGCCTTAGCCA | 410 | 0 1 | 5225 | 18.121622 | -2.3604157 |
| TGCCTGCTGTATTCCAGAG | 411 | 0 1 | 1491 | 5.1635141 | 7.662797 |
| CCTGGTCGGCGTGGTGACGGCG | 412 | 0 2 | 6434.5 | 6.2044091 | 6.2762375 |
| TCACTGCAGCCTCTGCCTCCCG | 413 | 0 2 | 17181 | 17.958405 | 9.3027229 |
| ACTGTACTCCAGCCTTGGCGAC | 414 | 0 1 | 3187 | 4.4324884 | 14.526779 |
| CTCCAGTCTTCTCATGTATCCC | 415 | 0 1 | 2943.5 | 5.1170878 | 6.0549593 |
| TAGCAGTGTCTAGGTAGGCCAT | 416 | 0 1 | 7447 | 24.057808 | 1.1526781 |

-continued

| | | | | | |
|---|---|---|---|---|---|
| GCCCTTGGCCTCTTTGGCCCGG | 417 | 0 1 | 6460 | 6.3274021 | -0.69839072 |
| CATTCTGCGATCCTCAAGCACA | 418 | 0 1 | 1481 | 4.0957041 | 9.367939 |
| AGCAGCTTTCACCTCCCCGCCT | 419 | 0 1 | 65518 | 12.03591 | 0 |
| TGGAGCCAGCGGCCTGCTGAGG | 420 | 0 1 | 744 | 4.4214902 | 3.8499751 |
| AGCTGGGGCTGTGGTTGTGATT | 421 | 0 1 | 3007 | 5.3449593 | 10.225232 |
| TAGCTGAGCCGCCTGGCTGGGG | 422 | 0 2 | 9026 | 6.8317003 | 8.4015751 |
| CCATCACCCTAACTAGTG | 423 | 0 1 | 2735.5 | 11.982088 | -3.3107362 |
| GCCTGGCCTAATTCCAGCATTT | 424 | 0 2 | 62842.5 | 13.758234 | 31.293688 |
| CACAGCCTCCTCTGGCTCACGG | 425 | 0 2 | 14804 | 7.7305474 | 23.87908 |
| CCGAGGTCCTGGACTTGGCCCT | 426 | 0 1 | 6198 | 7.1988444 | -1.3169746 |
| GCAGAGTGCTGTCGTACGCCCC | 427 | 0 1 | 1421 | 4.527245 | 1.0200601 |
| CTGTAACTGTCCCTTTTGCC | 428 | 0 1 | 3318 | 4.9795561 | 11.643893 |
| TCACTGCAACCTCCACCTCCTG | 429 | 1 2 | 45662 | 20.504339 | 18.911047 |
| TTGCTTTGCAGTGCCTATAGGA | 430 | 0 2 | 1273 | 6.826138 | 5.0606236 |
| TGGAGGCTGGAGTGCAGTGGCG | 431 | 0 2 | 2034.5 | 7.5323806 | 10.788618 |
| AAGGTGGAGGTTGCAGTGAGCT | 432 | 0 2 | 4275.5 | 9.1417122 | 11.853789 |
| GCAGGCTGTCTAAAGTTAGAGT | 433 | 0 1 | 960 | 5.3449593 | 4.6880941 |
| GCGCCCCATCTACAGTACTTTT | 434 | 0 1 | 3901 | 7.4468746 | 1.8634913 |
| TCTGCCTTCTATCTTTTGTCTG | 435 | 0 1 | 2195 | 4.2943249 | 5.856668 |
| CCTTCCCATGCAGCCTGTCTGA | 436 | 0 1 | 4066 | 5.3572183 | 6.7426419 |
| GCCTGGCCTAAATTAGTAATTT | 437 | 0 2 | 65518 | 14.47023 | 33.939186 |
| TTCTGGCTTCTCCCAGGCGGCC | 438 | 0 2 | 5582 | 8.2352791 | 10.879703 |
| GGCGCCCCCTTCAAACAGAGCA | 439 | 0 1 | 1745 | 4.7277126 | 8.7167349 |
| TCCCAATAGCCTAAGAGCCTGG | 440 | 0 1 | 2742.5 | 4.4703951 | 1.2259418 |
| GCCTGGCCAACGTGGTGAAACC | 441 | 0 1 | 18181.5 | 9.7641363 | -0.38965413 |
| TGTCTGGCTTTCTTCAGTTAGC | 442 | 0 2 | 6191 | 9.9906111 | 15.989508 |
| TGGGTTTTGTTTGTACAGTGTA | 443 | 1 0 | | | |
| CTGTGGTGAGGCCCTAGAATCTG | 444 | 0 2 | 3222 | 11.085442 | 6.6749387 |
| TTGCTCAGGCTGGCGTGCAATG | 445 | 0 2 | 9724 | 11.115126 | 19.742767 |
| GGAGGTGGAGGTTGCAGTGAGC | 446 | 0 2 | 4936 | 10.584228 | 13.28014 |
| GGAGGCGGAGGTTGCAGTGAGT | 447 | 0 2 | 2351 | 7.6334682 | 8.3588333 |
| CTGAGCCTCCTGCTTCTATTTC | 448 | 0 1 | 1864 | 5.9849868 | 3.7265418 |
| ACTGTACTCCAGCCTGGGAAAC | 449 | 0 1 | 4692 | 5.6260824 | 17.568949 |
| TCACATTTTCAAAAGCTGGTGC | 450 | 0 1 | 764.5 | 4.7752681 | -3.7142565 |
| CGCACCCCACTGTCCCTCAACC | 451 | 0 2 | 4601.5 | 6.5281987 | 4.8853817 |
| ACACTTTGCCCCTGGCCGCCTT | 452 | 0 2 | 42189 | 12.009233 | 22.436626 |
| GCAACTGAACATGTGTGTGGCC | 453 | 0 1 | 2167 | 6.7475801 | 0.27415401 |
| CCCAGGAGTTGGAGGCTGCAGT | 454 | 0 2 | 4273.5 | 6.2922449 | 14.155445 |
| GTCTGTTTTCTCTTCTGTGGGA | 455 | 0 1 | 3260 | 4.4957891 | 12.91537 |
| ATGGTACTCCAGCCTGGGTGAC | 456 | 0 2 | 4173 | 7.3957338 | 16.409479 |

-continued

| | | | | | |
|---|---|---|---|---|---|
| AGAATCCCAGGCCCCACTG | 457 | 0 2 | 3122 | 8.3376312 | 13.851473 |
| ACTGCACTCCAGCCTGGGTGAC | 458 | 0 2 | 65518 | 27.343826 | 34.911034 |
| TGGTAGGTTGGGCAGTTC | 459 | 0 2 | 8731.5 | 31.377066 | 20.530041 |
| CAGCCCTCCTACCCTGCCAGGC | 460 | 0 2 | 7825 | 9.6958656 | 6.1267514 |
| AGTGAGCAAGTTGATAATGGCC | 461 | 0 1 | 2206 | 12.457526 | 1.2831149 |
| CCCTGCCTGTCCTGGTCCCGTT | 462 | 0 2 | 18466 | 9.747386 | 21.814604 |
| CACTGCTACCTCTGCCTCCCGG | 463 | 0 2 | 19159 | 17.182699 | 10.042536 |
| GCTGTGGAAGTCTTTATA | 464 | 0 1 | 1228 | 5.2394924 | 0.15779255 |
| TCTGAGCCAGGGTCTCCTCCCT | 465 | 0 2 | 2987 | 6.3731112 | 9.5772123 |
| AGGAAAAAATTAATGTGAGTC | 466 | 1 0 | | | |
| ATTGCACTCCAGCCTGGGTGAC | 467 | 0 2 | 60365.5 | 24.984217 | 35.201714 |
| GCCTGTGTCTGGGTGGCCAGAG | 468 | 0 1 | 3356 | 4.7288775 | 1.1448419 |
| TGTCCTCGTCCGCCTCGAACTC | 469 | 0 1 | 2812.5 | 4.2049069 | -1.0601429 |
| CACTGCACTCCAGCACTCCAGC | 470 | 0 2 | 6054.5 | 6.051445 | 10.920486 |
| GGTCTTTTCTGCTGCAGGTTGT | 471 | 0 1 | 3605 | 4.629807 | 6.2433772 |
| GGAGCCGCCGCCCTTCATT | 472 | 0 2 | 4182 | 6.2263575 | 9.809968 |
| TTTGGTGTTCCGGTCATTGCTG | 473 | 0 1 | 1967 | 4.1357851 | 5.2781134 |
| GAACTTGTGATCCGCCCACCTT | 474 | 0 1 | 2483 | 4.4610376 | 7.0900927 |
| CTTCTGGCTGGTCAAGGACT | 475 | 0 2 | 4005 | 8.6937799 | 9.6446276 |
| GTCAGTCATTGAATGCTGGCCT | 476 | 0 2 | 8592.5 | 23.067156 | 11.230301 |
| GGAGTTTGCCTATTGCTTTTGG | 477 | 0 2 | 3720 | 6.173347 | 6.482801 |
| CAGGCTGGAGTGCAATGACGCC | 478 | 0 2 | 2761 | 6.4190331 | 12.467172 |
| CTCTGATGTCTGCCCCTCACCT | 479 | 0 2 | 12084 | 23.231821 | 2.7038672 |
| AAGCCCTGGACGGCCCTTCCCC | 480 | 0 1 | 4492 | 7.5995965 | -3.6259129 |
| GACCCTCTAGATGGAAGCACTG | 481 | 0 1 | 3638 | 4.4202566 | 13.507792 |
| CTGGCCAGATGTTACGTCCAAT | 482 | 0 1 | 2339.5 | 9.680912 | -11.645831 |
| AGCTGGTTTAATATGCTGTCTG | 483 | 0 2 | 11390 | 14.25641 | 8.7015753 |
| TCCTGCCTGGGGCCGCCTG | 484 | 0 1 | 2616 | 4.7310023 | 10.146957 |
| GAGCTGGGCCTGCGAGTGCTGC | 485 | 0 1 | 2060.5 | 5.0099111 | 1.7965864 |
| ACGCCCAGACTCCCATACTTTG | 486 | 0 1 | 2459 | 4.50102 | 4.1521502 |
| TTAAAGCCTCCCTCATAAGGA | 487 | 0 2 | 3650 | 8.3206406 | 14.328845 |
| CCCAGGGGTTCAAGGCTGCAGT | 488 | 0 1 | 1033 | 4.0216489 | 6.0328941 |
| TTCCAGTTCTGGGCTGGCTGCT | 489 | 0 1 | 3769.5 | 4.0091105 | 3.8919213 |
| TCTCTTCCTCCGCGCCGCCGC | 490 | 0 2 | 7111 | 6.0010505 | 12.012436 |
| CGTGACTGGGTCCGTCTGGCT | 491 | 0 1 | 4430 | 5.1234531 | 8.6597939 |
| AACCCGGGAGGCGGAGGTTGTG | 492 | 0 1 | 1833 | 5.103756 | 10.290462 |
| GGCCCCGCAGACCCAGCACGT | 493 | 0 2 | 1905.5 | 6.5486112 | 6.9167981 |
| ACTGTACTCCAACCTGGGCAAC | 494 | 0 1 | 6841 | 5.909749 | 20.226805 |
| CGCCCGCTGGCCCTGCGATCTC | 495 | 0 2 | 65518 | 15.196337 | 33.776985 |
| CTCACCTCCAGGAGCTGCTGGC | 496 | 0 1 | 8262.5 | 9.149087 | -4.4073544 |

-continued

| | | | | | |
|---|---|---|---|---|---|
| ATGGCCCTAATGAGTTGGTGTT | 497 | 0 2 | 5385.5 | 19.2614 | 5.6697388 |
| GGTAGTCGGCCTTGCCCTGGGC | 498 | 0 1 | 1782 | 5.1635141 | 8.7292385 |
| CTCGCCCCTCTCAGCCCTGCAA | 499 | 0 1 | 14248.5 | 19.352268 | 1.4588933 |
| GCCCCAGCTCACCGGCTCACTG | 500 | 0 2 | 15345 | 20.667051 | 7.4258513 |
| AAGTGCTCATAGTGCAGGTAGT | 501 | 0 2 | 27166.5 | 9.1624584 | 28.31859 |
| CAACTCACTGCGGCCTCAACCT | 502 | 0 1 | 3783 | 5.4047599 | 5.8278494 |
| CCTCTTCAGGCACTCGAAGGCC | 503 | 0 1 | 2775.5 | 11.314644 | -1.779775 |
| CTGCCATGCCACTGTGACTGCA | 504 | 0 1 | 2352.5 | 10.038951 | -0.80460918 |
| CCCAGGCCCTGGCAGAGCTTGT | 505 | 0 1 | 3205 | 4.2292862 | 11.181579 |
| TGCAGAAACAAGCCATCATTCA | 506 | 0 2 | 1094 | 6.8781896 | 4.4873405 |
| GGCTCAATGCAACTTCTGCCTC | 507 | 0 2 | 6445 | 11.169347 | 10.793466 |
| ATTGTACTCCAGCCTGGGTGAC | 508 | 0 2 | 13270 | 12.799824 | 24.968328 |
| CTGGGAGGCAGAGGTTGCAGTG | 509 | 0 2 | 1910 | 6.9613633 | 10.357609 |
| GCAGCTGACATCTGGCTGGGCC | 510 | 0 2 | 2573 | 8.120388 | 3.4149001 |
| GTCCAGTTGTATGTCCAGTGTC | 511 | 0 2 | 2058 | 8.4334011 | 5.2194672 |
| TGACTACAACCTCCACCTCCCG | 512 | 0 2 | 4496 | 8.9163761 | 9.9170055 |
| AGGCTGGAGTGCAGTTGCATGA | 513 | 0 1 | 1154 | 4.7976661 | 6.3405333 |
| CACCTGGCTGGCAATTTATAAT | 514 | 0 2 | 9852 | 8.0965796 | 17.484594 |
| GCTCCCTGGTAGCCATGCTCTC | 515 | 0 2 | 12312 | 6.6286459 | 3.9085872 |
| CTAGACTGAAGCTCCTTGAGGA | 516 | 1 0 | | | |
| GAGAAATATGGCTCAGTTCCAC | 517 | 0 1 | 1451.5 | 5.3449593 | 6.0128675 |
| CTCACTGCAAGCTCCACCTCTT | 518 | 0 2 | 4183.5 | 15.744108 | 13.408605 |
| TCACCTTGTGATCCGCCCACCT | 519 | 0 1 | 2944 | 5.0713305 | 4.4200244 |
| ACTGCACTCCAGCCTGGGTAAC | 520 | 0 2 | 65518 | 29.763027 | 35.404873 |
| ACTGCACTCCAACCTGGGTGAC | 521 | 0 2 | 5289.5 | 9.2819481 | 17.745958 |
| TTCCTGGTCTATTTAGAATTGC | 522 | 0 1 | 3974 | 4.2977972 | 7.7437348 |
| CTCGTGATCCGCCCACCTCAGC | 523 | 0 2 | 9254 | 12.490854 | 15.083214 |
| CACTGCACTCCAGCCTGCGCAA | 524 | 0 2 | 65518 | 26.453463 | 34.462708 |
| ACAATGCTCCCTGTAGTCAGGA | 525 | 0 1 | 1874 | 4.6958904 | 7.40031 |
| AGGAGGCCCTGGCGTTT | 526 | 0 2 | 7670 | 9.8578186 | 18.796598 |
| ACTGCACTCCAGCCTGGGT | 527 | 0 2 | 65518 | 27.764378 | 33.832714 |
| CTCACAGTCTGCCTTTCCCTTG | 528 | 0 2 | 4450.5 | 6.7386289 | 12.351869 |
| TCTCTCTTTTTTGAACCCGCTC | 529 | 0 1 | 2311.5 | 4.0555487 | 1.0858992 |
| AAATGTGGGGCTGGAGGCAGGA | 530 | 0 1 | 4164 | 4.2210102 | 16.645317 |
| CAAGCCATTCTCCTGCCTCAGC | 531 | 0 2 | 18892 | 18.51676 | 21.383736 |
| CCTGCCCTGCTCACTGTCGGTA | 532 | 0 1 | 4583 | 4.9649172 | 0.75725234 |
| TGCACCACTGCACTCCAGCCTG | 533 | 0 2 | 65518 | 25.040926 | 34.867786 |
| GGCCCTGGTCCTAGGGGTGGAA | 534 | 0 1 | 3918 | 5.2506523 | -11.347021 |
| CACGCCTGTAATCCCAGCACTT | 535 | 0 2 | 13062 | 15.57386 | 18.50495 |
| ACTTGGAACTGGCCCCTTTCAT | 536 | 0 2 | 17782 | 14.512917 | 23.881441 |

-continued

| | | | | | |
|---|---|---|---|---|---|
| CAGGAAAAGGCGGCTCGGGGCT | 537 | 0 2 | 27684.5 | 9.7338009 | 6.1309323 |
| TCGCCCAGGCTGGAGTGCAGTG | 538 | 0 2 | 16241 | 17.047142 | 24.279329 |
| GTGGCCCATCACGTTTCGCCTT | 539 | 0 2 | 65518 | 14.54515 | 20.760025 |
| CAAGTGATCCTCCCATCTTGGC | 540 | 0 1 | 2388 | 5.3808784 | 7.4311776 |
| GAGAGGTGGAGGTTGCAGTGAG | 541 | 0 2 | 2534.5 | 6.4362307 | 12.629781 |
| TTTCCCAGCCTCAGCTCAGCAG | 542 | 0 1 | 4894.5 | 7.2876582 | -0.72574896 |
| GTGCGGCCTGGCCTTCAAGTGG | 543 | 0 2 | 15350 | 9.6908836 | 19.487803 |
| CACTGCACTCCAGCCTGGGTCA | 544 | 0 2 | 65518 | 26.882214 | 33.427895 |
| ACCTCCTGGCCTCAAGCAATCC | 545 | 0 2 | 58457 | 12.381654 | 19.294073 |
| TGGGAGGCCAAGGCAGGCGGAT | 546 | 0 1 | 1193 | 4.9847255 | 7.2392049 |
| TGTCCTTCTTGTCTTGCCCAAA | 547 | 0 1 | 3592.5 | 5.1910453 | 1.0036907 |
| CCCGGGAGGTGGAGGTTGCAGT | 548 | 0 2 | 2962 | 7.343236 | 13.058587 |
| GCCACTGAGCCCGGCCATTGTT | 549 | 0 2 | 2514 | 7.7381911 | 2.2476037 |
| GTCTCGGACTCCTGATCTCAGG | 550 | 0 1 | 1380 | 4.1414785 | 3.9894354 |
| CAGGAGGATTGCTTGAGGCCAG | 551 | 0 2 | 9887.5 | 8.4761457 | 19.047802 |
| AACCCGTGATCCTGACTCCCCT | 552 | 0 1 | 7080 | 5.843668 | 7.8386455 |
| GCTCCTGGCCGGGCTGCTCCTG | 553 | 0 2 | 27106 | 14.495318 | 9.280777 |
| AAGGGAATGTTGTGGCTGGTTT | 554 | 0 2 | 3896 | 10.519875 | 13.251223 |
| ACCATCTCCTGTGCCTCCAGCT | 555 | 0 2 | 16520 | 12.522655 | 19.197701 |
| TCTGCCTAGAAACAGTGTTTGC | 556 | 0 2 | 5275 | 7.7571926 | 3.0926366 |
| TTGGTCCCCTTCAACCAGCTAC | 557 | 0 2 | 20228 | 9.5504265 | 23.87529 |
| GCCTGCTCCCAGTTGGCGCCTC | 558 | 0 1 | 3775 | 7.6600766 | -1.6529437 |
| CGGGCAAGGCGAGACTAGGCCC | 559 | 0 1 | 1455.5 | 5.7638865 | -0.9456889 |
| GGGGGGCGCCATGGTCTCTTGG | 560 | 0 1 | 3867.5 | 4.3061237 | -0.1289482 |
| ATGCCACTGCACTCCAGCCTAG | 561 | 0 2 | 49924.5 | 14.368088 | 30.30353 |
| GGTCTGTCTTCCCAATCGTGGC | 562 | 0 1 | 4046.5 | 4.2799697 | 6.4598308 |
| GGCTGTGGAGCTGCAGAGTTGG | 563 | 0 2 | 5971 | 7.1055961 | 2.2149129 |
| CAGGCTGGAGTGCAGTGGCGCC | 564 | 0 2 | 4637 | 11.871922 | 16.185398 |
| GGCCCCTCTGAGCTTACTCTGT | 565 | 0 2 | 6262.5 | 11.684633 | 9.8594589 |
| GCGCCTCCTCGGCCTC | 566 | 0 2 | 12734 | 7.9515629 | 6.2195482 |
| CACCAGGCTGGAGTGCAGTGGC | 567 | 0 2 | 5291 | 13.367915 | 17.112989 |
| TGGCTAGGCTGGTGTCAAGCTC | 568 | 0 2 | 2082 | 6.3935094 | 7.687212 |
| GCCCAGCCACAGTCACTTTCAT | 569 | 0 1 | 2139 | 4.7320642 | 8.6496077 |
| CTTCCCACCATCTCCTG | 570 | 0 1 | 2625 | 4.8619056 | 7.170155 |
| GACCTCAGGTGATCTGC | 571 | 0 2 | 5069 | 10.007993 | 16.466791 |
| TTCCCTGGGACTGGCCTGCACC | 572 | 0 2 | 17948.5 | 9.3010607 | 15.061718 |
| ATGTTCATATCCCCATTCTGAT | 573 | 0 2 | 1760 | 8.5004892 | 7.7344885 |
| CATTGCACTCTAGCCT | 574 | 0 1 | 875 | 4.0046587 | 2.2476213 |
| TCACTGCAACCTCCACCTCCCA | 575 | 1 0 | | | |
| GCCATTTCACACAGACATTTG | 576 | 0 2 | 1978.5 | 6.6882792 | 9.8837452 |

-continued

| | | | | | |
|---|---|---|---|---|---|
| GTAGTCCCAGCTACCCCGGAGG | 577 | 0 2 | 3868.5 | 12.13766 | 12.272501 |
| CCTGTCATATACATACCTCCTC | 578 | 0 1 | 1712 | 4.1733551 | 4.783987 |
| TCTCTCAGGCTGGAGTGCAGTG | 579 | 0 2 | 2711 | 9.6044931 | 12.843214 |
| TAGCTACCATTATTGAGCACCT | 580 | 0 1 | 757 | 4.2067757 | 2.5492058 |
| GTTTACTTGTGCCTTGGCTTAA | 581 | 0 1 | 1948.5 | 4.0322022 | -15.512288 |
| AGCGCCGCCCCTGCTGGTGTTG | 582 | 0 1 | 4465 | 4.3703461 | 6.2275581 |
| TCCAGGGCCATCTCCATGAGGC | 583 | 0 1 | 1948 | 5.4790416 | 9.0826721 |
| TCAGTCTTGAACAGCCCCCTGT | 584 | 0 2 | 6402 | 12.333841 | 7.9963231 |
| ACTGCAACCTCCACCTCCTGGG | 585 | 0 2 | 26924 | 17.396763 | 10.658098 |
| TGGTGGAGGCGCTGCTGGCCAG | 586 | 0 2 | 11424 | 10.211181 | 12.62489 |
| CTGCAGCCTTTGCCTCCTGGGTT | 587 | 0 2 | 8429 | 12.857187 | 13.758839 |
| GGCTCACTGCAACCTCTGCCTC | 588 | 0 2 | 62440 | 23.696358 | 18.67169 |
| TGCCGAGGCTGGAGTGCAGTGG | 589 | 0 2 | 2467.5 | 8.8668938 | 8.8795528 |
| CCGGGTTGAGGTTCCCATAGAT | 590 | 0 2 | 6920 | 8.8808632 | 18.126587 |
| CTGCTGCGCTGGCCGTCACGGT | 591 | 0 2 | 45168 | 18.758972 | 18.507338 |
| TCCTGGTCTTCAGGTTGCAAAA | 592 | 0 1 | 7121 | 5.3691082 | 9.0031843 |
| CACCCTCCAGCTCCCGGGGGCT | 593 | 0 2 | 5651.5 | 10.5429 | 4.3305707 |
| CATTGCACTCCAGCCTGGGCAA | 594 | 0 2 | 65518 | 32.881447 | 28.077059 |
| TCAGGGGTTGGCTTGTTGTGTT | 595 | 0 2 | 20519.5 | 8.8405285 | 21.048086 |
| AGCCTCTGGTCCTTTTTTCCCT | 596 | 0 2 | 11308.5 | 12.165344 | 5.3993454 |
| ACTGCACTCCAGCCTCGGGGTC | 597 | 0 2 | 49031.5 | 14.262467 | 31.189104 |
| GCCAGCCTCCATCCTCCCTTG | 598 | 0 2 | 10191 | 21.391727 | 11.342846 |
| GCTCCGCCACGCCCACTCCTAC | 599 | 0 2 | 4705 | 6.8716969 | 9.635397 |
| CCGCGGGGTCATGGCTGGGCCG | 600 | 0 2 | 7300.5 | 6.5837302 | 5.0417223 |
| ATGGCCCTCTTATCACAGCTCC | 601 | 0 2 | 5586.5 | 21.480997 | 6.3762493 |
| AACCTTGTGATCCACCCACCTT | 602 | 0 2 | 3034 | 7.7903786 | 12.639959 |
| CAAAGGGAAAAGCCATGTGGGC | 603 | 0 1 | 1205.5 | 6.3321967 | -1.1940883 |
| TCCTGGCTTGTCACATCTACGT | 604 | 0 1 | 4198 | 4.4526401 | 3.8407443 |
| CATTGCACTCCTGCCTGGGCAA | 605 | 0 2 | 65518 | 27.010284 | 16.583426 |
| GGCCTCTTATCTGGCTCCTGCA | 606 | 0 2 | 5318 | 6.4274201 | 6.5868769 |
| AGTGGCGTGATCTCGGCTCGGT | 607 | 0 2 | 3395 | 8.8775339 | 14.742507 |
| TGGCTATTCCTTGGACACA | 608 | 0 1 | 2806 | 18.035503 | -3.2833591E-2 |
| GCTCCCAAAAGCTCCAGGAAA | 609 | 0 1 | 2161 | 5.5307322 | 0.0302024 |
| CCAGGAGGTTGAGGCTGCAGTG | 610 | 0 2 | 5379 | 11.585869 | 13.504684 |
| ACAGCCTCCATCTCCTGGGCT | 611 | 0 2 | 5043 | 8.2979441 | 10.987616 |
| CCAGGAGGCGGAGGTTGCAGCG | 612 | 0 1 | 1831 | 4.9563489 | 9.9608593 |
| TGCCCGGATACCCCTGGCCTC | 613 | 0 2 | 46111 | 13.316625 | 10.030684 |
| TGCGACCCTAGCCCCCTCACTT | 614 | 0 2 | 5417 | 11.129067 | 4.3243365 |
| CTGTCCTGGGGAAAGCCAGCCC | 615 | 0 2 | 1892 | 8.5004892 | 5.7830157 |
| GCAGCTCCTGGAGGTGAGAGGCG | 616 | 0 2 | 5368 | 7.8018293 | 15.956004 |

-continued

| | | | | | |
|---|---|---|---|---|---|
| CACCCAGGCTGGAGTGCAGTGG | 617 | 0 2 | 4215 | 12.088334 | 14.940107 |
| AGCCCTCGTTTCTGCATCCTGT | 618 | 0 1 | 4923 | 15.10443 | 0.58649576 |
| ATTGCACTTCAGCCTGGGTGAC | 619 | 0 2 | 11488.5 | 11.742085 | 23.617636 |
| TCTTCTATCCTCAGCCCCTGCC | 620 | 0 1 | 5352.5 | 9.7554712 | 1.239718 |
| GTGGCTCACACCTGTAATCCCA | 621 | 0 2 | 15446 | 13.370042 | 20.396935 |
| CACTGCAAGCTCCGCCTCCTGG | 622 | 0 2 | 16781 | 17.735508 | 9.1570225 |
| GTGGCAGACCTTCCCTTCTCCT | 623 | 0 2 | 4139 | 6.9686718 | 8.4107714 |
| GCTCACTGCAACCTCCACCTCC | 624 | 0 2 | 33649 | 18.60092 | 20.711613 |
| TCTAAGAGAAAGGAAGTTCAGA | 625 | 1 0 | | | |
| TTGTTCTTGTCTTTGCCTTCAC | 626 | 0 1 | 4146 | 5.8114853 | 5.746397 |
| CCAGGCTGGAGTGCAGTGGCAC | 627 | 0 2 | 14590 | 15.059402 | 24.507948 |
| AAAGTGCTTCCTTTTTGAGGGT | 628 | 0 1 | 4403.5 | 4.8706794 | 7.6543956 |
| TCCAAATGAGCTCTGCCTTCCA | 629 | 0 1 | 8231 | 5.6790619 | 11.278896 |
| GCCTGTAATCCCAGCACTTTGT | 630 | 0 2 | 6291 | 12.232025 | 12.874677 |
| AATGTGTTGAATAAATTGTGCC | 631 | 0 2 | 1493 | 7.7202153 | 3.8070927 |
| CCAGCCCGAATCCCTGGCCAGG | 632 | 0 1 | 3382 | 13.906728 | 1.8086184 |
| CTAGATAACTTATTTTCAAGGA | 633 | 0 1 | 693.5 | 4.0893412 | 1.9033302 |
| GCTGCTGGGCCATTTGTTGG | 634 | 0 1 | 4101 | 7.4591732 | 1.3319389 |
| CTCATTGCCCAGATCCCCACAG | 635 | 0 1 | 2016 | 4.838347 | 8.3423147 |
| CTGTGGTACAGCTGGGACGGA | 636 | 0 1 | 664 | 4.6319594 | 3.5137784 |
| GTGTTGTCGCTGGGTTTTGAGGG | 637 | 0 1 | 3030 | 4.5279474 | 3.9595523 |
| TGGAGTTGGCTGCAGATGAGTC | 638 | 0 2 | 9954 | 13.087917 | 15.585505 |
| CAGTCACAAGCGTACCTAATTT | 639 | 0 2 | 2097.5 | 9.4896584 | 6.2945709 |
| ACTGCAAAGGGAAGCCCTTTCT | 640 | 0 2 | 14213 | 7.6344547 | 19.22015 |
| AGCGCCACTGCACTCCAGCCTG | 641 | 0 2 | 65518 | 21.477427 | 32.126575 |
| CACTGCACTCCAGCCTCGGTGA | 642 | 0 2 | 65518 | 19.946772 | 34.137524 |
| GGGCTAGCCTCTTCCCTGCTCC | 643 | 0 1 | 2982 | 4.0539145 | 1.5543098 |
| TGCGCCATGTGCTCTCGGCCCT | 644 | 0 1 | 3290 | 5.4790416 | 8.9091539 |
| TTTTGGCCACATCCTTTTGAGT | 645 | 0 1 | 932 | 4.3311777 | 5.6849165 |
| CGGCATCCCCACTTCCTCCTGC | 646 | 0 2 | 5467 | 7.7441764 | 4.2301731 |
| CTGGCTCTCAGGCTGGTCCCCA | 647 | 0 2 | 11103 | 17.197889 | 7.7209744 |
| TGCACCACTGCACCCCAGTCTG | 648 | 0 2 | 5009 | 7.3463378 | 16.848854 |
| TGCCAGTATCCTTCTGAGACCC | 649 | 0 2 | 9374.5 | 18.697142 | 19.309006 |
| GCAAGTGTCTGTCCCCTT | 650 | 0 1 | 2829.5 | 5.2069716 | 4.7231493 |
| TGACATTTCCTAGTGCTTTGTG | 651 | 0 2 | 1338.5 | 7.1093221 | 8.5563574 |
| TCACTGCACTCCAGCCTGGGCA | 652 | 0 2 | 65518 | 34.101166 | 18.829176 |
| AAGACCAGCCTATGTTTTCCAT | 653 | 0 2 | 1307 | 6.3594904 | 4.4498701 |
| CTTAGAGATGGGTTTTACTTAG | 654 | 0 1 | 886 | 7.7022095 | 1.8901725 |
| AAAGTGCTGGGATTACAGGCAT | 655 | 0 1 | 1350 | 5.680541 | 7.7369747 |
| CTGGCCCCTTTCATTCTGGAAG | 656 | 0 2 | 11008.5 | 19.356289 | 14.29258 |

-continued

| | | | | | |
|---|---|---|---|---|---|
| GCCTCATTTCCACCTCCCC | 657 | 0 1 | 7161.5 | 19.507957 | 0.16928124 |
| TTCCCTGCCATACCTGAAGGCA | 658 | 0 2 | 3785 | 7.4591732 | 4.4417677 |
| GGTTTTATCCTACCCACACAGC | 659 | 0 1 | 2980.5 | 5.771091 | 0.75884527 |
| TGCGCCTGGGGCCCTGGCTGTC | 660 | 0 1 | 4313 | 4.8216996 | 7.0607853 |
| CACTGCACTCCATCCTGGGAAA | 661 | 0 2 | 6397.5 | 6.6049953 | 18.619169 |
| CAGTTCCCTCCGCCAGCACTTC | 662 | 0 2 | 6955 | 6.4068542 | 9.6022158 |
| CCAGACCATTTTGCCTTACC | 663 | 0 2 | 38076 | 30.955603 | 11.095823 |
| TACAACCTCTGCCTCCCAAGTT | 664 | 0 2 | 6090 | 14.013508 | 12.263943 |
| CGCCATGTCCAGCGTCTTCGGG | 665 | 0 2 | 8765 | 20.334946 | 20.485155 |
| TGCCTCCAACAGCCCATCCTAG | 666 | 0 2 | 5709 | 13.713832 | 8.2213135 |
| TCACCAGGCTAGAGTGCAGTGG | 667 | 0 1 | 1159.5 | 4.8244257 | 6.5572648 |
| CCCACTGCTGCGCCGGGCGCCG | 668 | 0 2 | 17950 | 21.138054 | 12.695562 |
| GCAGGCTCTGGCTTATTCTGGG | 669 | 0 1 | 4399 | 4.4706116 | 13.904231 |
| GCGCCGCCATCCGCATCCTCGT | 670 | 0 2 | 4801 | 16.34218 | 9.281786 |
| TCACATCTAATTCCATTTCTGC | 671 | 0 2 | 8429 | 13.263923 | 4.5787411 |
| GTGACACCCGCATGCCACTGTG | 672 | 0 1 | 4433 | 5.2274818 | 8.4032717 |
| TGCAGCCTCTTGTTTCAGCCCC | 673 | 0 2 | 11243 | 15.895414 | 2.5227482 |
| GGCCCAGTGCAAGCTCTTTCTG | 674 | 0 2 | 2960 | 7.6298795 | 6.4523926 |
| AGGCTGGAGTGCAGTGGTGTGA | 675 | 0 2 | 7407.5 | 15.261675 | 13.995954 |
| GCTCACTGCAAGCTCTGCCTCC | 676 | 0 2 | 20572.5 | 19.847269 | 12.887133 |
| CAAATTCCATTCATGCTCCCTT | 677 | 0 2 | 3158.5 | 7.6177769 | 5.7730742 |
| GCCATCCCAAGCATTTTGG | 678 | 0 2 | 3676 | 17.232298 | 13.983404 |
| GACAAGCTCCCGGTGGCCCTCC | 679 | 0 1 | 12851 | 9.4387512 | -5.8295474 |
| AGCTACCTGATCCTTCTTCTGA | 680 | 0 1 | 3226 | 4.1367669 | 12.153009 |
| GGGTAAATCTCTTTTCATGGCT | 681 | 0 1 | 3221 | 4.827455 | 8.7138081 |
| CTGTCCTTCCAGCCGAAATCTA | 682 | 0 1 | 2360 | 4.3559012 | 11.170581 |
| GCATGGCTTCGGGGTGCTGCCT | 683 | 0 1 | 3747 | 5.1863647 | 12.211168 |
| TAGGACCCTGGTGGCCCCC | 684 | 0 2 | 5109 | 8.5892859 | 8.0437737 |
| AAAAGGGACGACAACAGGCCAC | 685 | 0 1 | 1681 | 4.7831736 | -0.22445607 |
| CCCAGCTCTTCAAGTCACCCCC | 686 | 0 1 | 2752.5 | 5.4642267 | 3.5884585 |
| ACTGCACTCCAGCCTGGGACAC | 687 | 0 2 | 65518 | 25.933289 | 35.343163 |
| AGCTGGCTTACTTGAGATGCAT | 688 | 0 2 | 3049 | 8.8567095 | 7.4132333 |
| GACCTTGTGATCCCCCTGCCTT | 689 | 0 2 | 6915 | 8.0644264 | 17.640575 |
| CCGCCTGGCCCATTGCAGGGCA | 690 | 0 2 | 65518 | 18.506096 | 29.045151 |
| TGAACTCCTGACCTCATGATCC | 691 | 0 2 | 6999.5 | 26.17539 | 18.849899 |
| GACCATCCTGGCCAACGTGGTA | 692 | 0 1 | 3690 | 4.9752827 | 15.844102 |
| CCCAGGCTTTTCTCTTGCCCCA | 693 | 0 2 | 5771 | 12.212635 | 10.303027 |
| TTCTTCAGCCTACCTTGACCTC | 694 | 0 1 | 1982 | 4.5595746 | 0.49319306 |
| CTGCGGGGCCTGGACAGGGAGG | 695 | 0 2 | 11797 | 7.1950088 | 21.891239 |
| GGCTGTGTGGCCGTGGGCTCTA | 696 | 0 1 | 1700 | 4.3887382 | 4.3097105 |

-continued

| | | | | | |
|---|---|---|---|---|---|
| GGGCCACCCCACTGCCCACGCT | 697 | 0 1 | 3459 | 4.6319594 | 4.3550696 |
| CCCCACTGTTTTCTTCATCCTA | 698 | 0 2 | 50957 | 31.882698 | 4.8442335 |
| GGAGTGCAGTGGCGTGAGCTCG | 699 | 0 1 | 1283.5 | 4.7879038 | 3.6301775 |
| TAGGAGGATTGCTTGTGGCCAG | 700 | 0 1 | 3154.5 | 4.6519237 | 4.9273152 |
| CTGAGGGCAGGTGGTGCTGCCA | 701 | 0 2 | 1847.5 | 8.3489428 | 5.0725312 |
| GCACCACCACCATCGGCACCTC | 702 | 0 2 | 3012 | 6.4477148 | 2.4866204 |
| CTTGTTTATCTCTGTAGCCCTG | 703 | 0 1 | 3684 | 5.9854388 | 8.3862486 |
| GTGGGTTCGTGGTCTCGCTGGC | 704 | 0 2 | 65518 | 26.617212 | 17.195196 |
| AAAGCCCTGGCCAGACACCAGT | 705 | 0 2 | 5732.5 | 6.8473902 | 6.6282077 |
| ATCGGCAAGCCCCACACCGTCC | 706 | 0 1 | 1713 | 4.0142264 | 9.0132332 |
| AGCCTCAGGTTGTTGGTTCTT | 707 | 0 1 | 1042.5 | 4.1900787 | 4.8052392 |
| CGGTGGGTGCTTCAGGCGGTGG | 708 | 0 1 | 3999 | 5.0099111 | 5.715847 |
| AATGGTCTTCCTCCACCCCTCTG | 709 | 0 1 | 4451 | 4.8959856 | 5.1994057 |
| TCACTGCAAGCTCTGCCTTCCG | 710 | 0 2 | 9055 | 7.7008362 | 11.763208 |
| TGGTCTTTGTCCCTCCTTGATC | 711 | 0 1 | 3743 | 4.256711 | 2.9960811 |
| AGTGCAATGGCGTGATCTTGGC | 712 | 0 2 | 5951 | 8.6127348 | 17.549313 |
| ATGCCACTGCGCTCCAGCCTGG | 713 | 0 2 | 44255 | 14.692498 | 32.195774 |
| TTTCTTCCTGCTTTGTCCCATG | 714 | 0 1 | 4054 | 5.4825935 | 11.238956 |
| CTCTCGCCAGCGGGGCTGCGCT | 715 | 0 2 | 13140 | 7.6419506 | 17.506365 |
| TATGTTTGGCCTGGCAATTTCA | 716 | 0 1 | 2780 | 4.5881057 | 9.7094517 |
| CCACCAGCTGCATATGCACGTA | 717 | 0 1 | 1730 | 4.4214902 | 1.1879559 |
| GTGTCCCCACCCAAATCTCATC | 718 | 0 1 | 2826 | 5.9052849 | 6.1014419 |
| GGAAAGGCCTGGGTGTCCTGGG | 719 | 0 1 | 5274 | 6.3618565 | -1.7002298 |
| GGGCGGATCATTTGAGGTCAGG | 720 | 0 2 | 1943.5 | 6.9547186 | 9.5280085 |
| ACTGTACTCCAGCCTCGGTGAC | 721 | 0 1 | 3141 | 5.0527177 | 14.756032 |
| GATAATCCACTCTGCTGACTTT | 722 | 0 1 | 3054 | 4.3317614 | 6.3779197 |
| GCCTGTAATCCCAGCACTTTGG | 723 | 0 2 | 8675.5 | 12.842025 | 14.392535 |
| TTTAAATCACAACTCTGCCCCT | 724 | 0 2 | 15129 | 15.825633 | 8.2785378 |
| GATGAGTTTGCCTGGCCTGCAG | 725 | 0 2 | 25445.5 | 12.297516 | 17.035336 |
| TGCCACCCCGGACCCCGAAGTG | 726 | 0 1 | 2106 | 4.6232533 | 7.5721364 |
| CACTGCAACCTCCGCCTCCTGG | 727 | 0 2 | 55476 | 22.094246 | 10.714499 |
| CACTGCAAGCAAGCTCCGCCTC | 728 | 0 1 | 7633 | 15.721508 | 0.38197863 |
| GGCTCATATCCCGGCCATCATT | 729 | 0 2 | 2692.5 | 14.02678 | 7.6887875 |
| ATTCTGTGCTAACTGCAGGCCA | 730 | 0 2 | 4140 | 19.305922 | 11.530575 |
| CAGGCTGGAGTTCAGTGGTGTG | 731 | 0 1 | 1648.5 | 4.3088479 | 8.9180403 |
| CATTCCTGGCCCGGCGCCGTC | 732 | 0 1 | 2736 | 4.0554576 | 10.724096 |
| CAGGTTCAAGCGATTCTCCTGC | 733 | 0 2 | 9179 | 16.397514 | 14.266402 |
| GCCTGGCCGGGTCTTGGATTTT | 734 | 0 1 | 5031.5 | 5.5863533 | 7.3384004 |
| GGTTCTCAGCCTGAGCCGCCCC | 735 | 0 1 | 18192 | 21.105703 | 1.4826102 |
| CGCGAGGTGGAGGTTGCAGTGA | 736 | 0 2 | 2801 | 7.2209163 | 4.0311246 |

-continued

| | | | | | |
|---|---|---|---|---|---|
| TCACTGCACTTCAGCTTGGGCA | 737 | 0 2 | 31458 | 10.144489 | 22.4685 |
| AAGTGCTGGGATTACAGGCGTG | 738 | 0 2 | 3421 | 6.6648126 | 13.608858 |
| ATGTGAGTGCTATGATAGACAG | 739 | 0 2 | 1139 | 8.0798817 | 5.4914975 |
| ATCACCCAGGCTGGAGTGCAGT | 740 | 0 2 | 4395.5 | 12.324327 | 14.314183 |
| TATCGAGCTGGACGGGCTGGTC | 741 | 0 1 | 6607 | 5.2088056 | 6.9531446 |
| GCTGTTTTCCCATAGCTGGTCA | 742 | 0 2 | 7061 | 19.803032 | 6.222959 |
| GGAGTGCAATGGCTTGATCTTG | 743 | 0 1 | 5693 | 6.7378373 | 1.033795 |
| AGGATCTTGCTATGTTGGCCAG | 744 | 0 2 | 2784 | 10.949057 | 7.9714575 |
| CTTTTCCCCTTTGGACTC | 745 | 0 1 | 4238.5 | 5.1553736 | 7.0349116 |
| CTGAGGCTGGAGTGCAGTGGTG | 746 | 0 2 | 4514 | 12.474048 | 16.694977 |
| GCCATGACTCTCCATACCAAAG | 747 | 0 2 | 1592 | 6.0272546 | 8.5714464 |
| CCTGCTGGCTCTGTTGCTCGGC | 748 | 0 1 | 13366.5 | 10.797435 | -3.9057117 |
| CCCTGCCTTGTCTGGGCTAGGT | 749 | 0 1 | 200 | 24.0046587 | 9.0806446 |
| GGCCCAGGTTGGAGTGCAGTGA | 750 | 0 2 | 2994 | 8.0930119 | 10.374014 |
| TGCTCTGTTGGCTTCTTTTGTC | 751 | 0 2 | 8407 | 17.417171 | 17.734081 |
| AGTGATTCTCCTGCCTCAGCCT | 752 | 0 2 | 35041 | 21.798445 | 19.430222 |
| AGTTGGCACTGAGCTGTGATTG | 753 | 0 1 | 3303 | 4.4303179 | -1.0004215 |
| AAGGTGGGTGGATCACGAGGTC | 754 | 0 2 | 1791 | 6.7066569 | 9.7404299 |
| GAATCCCTTGCATTATCCCTTT | 755 | 0 2 | 2882 | 6.153091 | 4.2042389 |
| TCCCCAAGCAGGCAATCTCCCG | 756 | 0 1 | 3149 | 4.4257097 | 6.5767608 |
| TGCCCACTGCTGGCCACCACCC | 757 | 0 2 | 32112 | 15.630626 | 16.785101 |
| GCCCTGCCCTCTCGGCACTCGC | 758 | 0 1 | 2717 | 5.5086098 | 11.520112 |
| AAAGTGCTAGGATTACAGGTGT | 759 | 0 1 | 820 | 4.1482205 | 4.6776071 |
| GGGCGGATCACCTGAGGTCAGG | 760 | 0 2 | 7018 | 13.621652 | 16.918211 |
| CTGTGCTCTTTCCACGGCCCCA | 761 | 0 2 | 6477.5 | 13.662484 | 9.3280506 |
| CTCCCCAGCCCTGGTATTCTGA | 762 | 0 1 | 5384.5 | 5.0192461 | 5.6187172 |
| CATTGCACTCCAGCCTGGGTAA | 763 | 0 2 | 65518 | 31.334749 | 27.271093 |
| GCGCTGCGCCTCCTCTTCCGCA | 764 | 0 1 | 2221 | 4.0475416 | 8.1211281 |
| AGTGCTGGGCTATCTACTGCTA | 765 | 0 2 | 18896.5 | 8.3062468 | 21.32906 |
| TGTGACTGGTTGTCCCGCTTTC | 766 | 0 1 | 2849 | 5.792357 | 8.2097464 |
| CTCATTGCAACCTCCGCCTCCC | 767 | 0 2 | 33077 | 19.544933 | 20.350861 |
| GCCATTGCACTCCAGCCTAGGC | 768 | 0 2 | 5526 | 10.291553 | 17.393818 |
| TTCCACATGTTAGCTGGTTAAA | 769 | 0 2 | 2748 | 17.300783 | 11.944987 |
| GACTGTGGGAAGCAGATGCCA | 770 | 0 1 | 1511 | 4.0386124 | -0.97461921 |
| TGTCCGTGGCCTTCTGGAT | 771 | 0 1 | 4401 | 5.2269702 | 12.950581 |
| ACTGCATTCCAGCCTGGGCAAC | 772 | 0 2 | 65518 | 24.732506 | 33.288292 |
| TCCATTGGCCTTTTATCCTAGA | 773 | 0 2 | 5760 | 15.329782 | 8.1126537 |
| CACTGCAAGCTCCGCCTCTGGG | 774 | 0 2 | 7054.5 | 14.676391 | 11.85893 |
| CTTGGGAGGCAGAGGTTGCAGT | 775 | 0 1 | 1287.5 | 5.3808784 | 8.0099583 |
| TCCACAAGGCAGCTCCTCCAGG | 776 | 0 1 | 2706 | 5.4716368 | 1.7482823 |

-continued

| | | | | | |
|---|---|---|---|---|---|
| GCTCCCACCGCCGCTATGGGTA | 777 | 0 1 | 3502 | 4.3559012 | 3.5113876 |
| CTCGCATGCCCTGCCTCATCCA | 778 | 0 1 | 2410.5 | 5.5748396 | 0.29925746 |
| GGCCGGGGCCTGCTCGCCTGTG | 779 | 0 1 | 3488 | 5.4115729 | -8.3415947 |
| GGTCAGGAGCCCTTGGCCCCCT | 780 | 0 2 | 5270 | 7.1600103 | 6.9067311 |
| TGGTCTGGCCCACATGGTC | 781 | 0 2 | 8349 | 13.022524 | 4.8629713 |
| GGTTCAGAGCCTGCCCAGTATA | 782 | 0 1 | 1813 | 6.9879608 | -2.6342282 |
| CATTGGCCTTTTATCCTAGAGG | 783 | 0 2 | 4983.5 | 15.452302 | 15.902376 |
| TCCTCAGCTTGGCCACGGAGTT | 784 | 0 1 | 6478.5 | 5.8972673 | 17.989834 |
| ATGTTGGCCAGGCTGGTCTTGA | 785 | 0 2 | 2519 | 7.2414885 | 7.5854573 |
| GTCCACAGCTCTGAGGTCTCCC | 786 | 0 1 | 6493 | 5.3572183 | 1.3877324 |
| GCCTAGTGGATTTGAAGGGCC | 787 | 0 2 | 2352 | 11.945862 | 8.8114462 |
| TCAGCTCCTACCCCGGCCCCAG | 788 | 0 2 | 8279.5 | 11.228731 | 17.399603 |
| AGAGTCTCCCTGTGTTGCCCTG | 789 | 0 2 | 10467 | 7.4270558 | 12.602409 |
| GTGTAAGAACCTTCTAGAGCCC | 790 | 0 2 | 3204 | 7.0456204 | 2.6366203 |
| ACTGTAACCTCAAACTCCTGGG | 791 | 0 1 | 6067.5 | 5.62674 | 11.00416 |
| GTGGCCAACCTGGCCCTGAACT | 792 | 0 1 | 4379 | 4.9676137 | -1.203916 |
| TATTTGTCTGGTCTAAGGAGGG | 793 | 0 1 | 3219.5 | 4.6818242 | 11.217502 |
| GGAGTGCAGTGGCGTGATCTCA | 794 | 0 2 | 2509 | 9.1686945 | 10.351524 |
| TCCTCCAGAGCTTCATCCTGCC | 795 | 0 2 | 16927 | 19.618345 | 5.2284846 |
| TGAGGCCCACCTTGGCCCCGGC | 796 | 0 1 | 4794 | 5.7001333 | 14.264636 |
| ATGATGGCTAGGCTGGTTTTGA | 797 | 0 1 | 1068 | 4.3558846 | 3.1461418 |
| CGCCCCGGACGTCTGACCAAAC | 798 | 0 2 | 7410 | 6.9984522 | 2.8285146 |
| GGCCGCCCTTTCCACGGTTTCT | 799 | 0 2 | 2520 | 9.4387512 | 10.455907 |
| AGGCTTACAGCAGCAGGC | 800 | 0 1 | 1484 | 4.7118134 | -0.64998931 |
| GGCTTCCTGCCTCGGGCTGGCC | 801 | 0 2 | 58372 | 11.079018 | 4.4936109 |
| GATGGGTTTGTTGGAGAGGTC | 802 | 0 1 | 5425.5 | 4.8749881 | 17.533426 |
| TCACTGCAACCTCCACCTCCCG | 803 | 1 2 | 31810 | 20.186802 | 16.772465 |
| GAATGTGTACTGAGTGCCCCTT | 804 | 0 1 | 5542 | 12.220497 | -4.4586358 |
| TCCACTGTCCCTGGCACTTTT | 805 | 0 2 | 9134 | 6.4327211 | 12.8872 |
| GCACCACTACACTCCAGCCTGG | 806 | 0 2 | 3563 | 6.3702331 | 11.491977 |
| ATGGTAGCTGTCCACATCAGGA | 807 | 0 2 | 8208 | 25.85717 | 21.352978 |
| CTGAGGCAGGCAGATCACTTGA | 808 | 0 1 | 1210 | 4.8558879 | 3.7993965 |
| GTGGCCCAGGTTGGAGTGCAGT | 809 | 0 2 | 4915 | 12.333922 | 6.7368903 |
| GACCTTGTGATCTGCCCACCTT | 810 | 0 2 | 8467 | 31.729177 | 18.925035 |
| GTGATCTGCCAGCCTCAGCCTC | 811 | 0 2 | 7194 | 15.083432 | 9.3042612 |
| AGACAGGGTGATCGCTTGAGCC | 812 | 0 1 | 3466 | 4.6497626 | 7.744925 |
| CCCAGGAGGTCAAGGCTGCAGT | 813 | 0 2 | 2036.5 | 6.6226544 | 11.643046 |
| CGGTCTCCCGTGTGTGTGCGCT | 814 | 0 1 | 4407 | 5.3256574 | 16.37768 |
| AGCGGGGTGTTTTGGGTGGCCT | 815 | 0 1 | 4033.5 | 8.2409916 | 0.52406603 |
| GTCTCCTCCCTTTCATTCACCT | 816 | 0 2 | 4807 | 8.0566654 | 3.426122 |

-continued

| | | | | | |
|---|---|---|---|---|---|
| CCTGCTCTCTGTTCTTAAGCTT | 817 | 0 2 | 5021 | 9.0648565 | 7.4354005 |
| CAAGTGGAATGCTCTTCCTCCC | 818 | 0 1 | 3123.5 | 4.0142264 | 6.7150235 |
| AAGGCCGCCCCTTCATGCTCCT | 819 | 0 2 | 6358.5 | 9.1175785 | 8.5895061 |
| TGTCCTCATCCTCCAGTCTGTC | 820 | 0 1 | 3129 | 5.6114564 | 1.2281151 |
| TGGCGATGGTCATTTTTC | 821 | 0 2 | 2609 | 7.1536875 | 3.1643765 |
| TTGGGGGAGGCCTGCTGCCCAT | 822 | 0 2 | 3549 | 9.3567915 | 8.3044834 |
| GCGGGGCCCGGACCCAGCCTCT | 823 | 0 1 | 4254 | 4.2667646 | 3.5057929 |
| TGGGGTATCCGTTAGTAAGATG | 824 | 0 1 | 3380.5 | 4.0906634 | 13.235014 |
| TGGAGTTGGCCGCCCGGACCGA | 825 | 0 2 | 8187 | 7.0123053 | 19.997877 |
| AGTGTGTTGTAGGCTCAAATGG | 826 | 0 1 | 1296.5 | 5.0562248 | 4.8389935 |
| CGCTTCCAGAGTAAGGCGCTGC | 827 | 0 1 | 2448 | 4.256711 | -0.95797318 |
| GATATCATTGAGCCCAGGAGTT | 828 | 0 1 | 3794 | 4.876976 | 13.768772 |
| CACTGCACTCCAGCTTGGGTGA | 829 | 0 2 | 65518 | 18.826578 | 34.620605 |
| CTGAAGCCCAGCTTCC | 830 | 0 1 | 10934 | 14.751002 | -0.56149203 |
| CATCTCTGGCTTGGATTATGGT | 831 | 0 1 | 2875.5 | 4.1804218 | 9.7742558 |
| TTTACCTTTGTGGGTCTCCCTC | 832 | 0 1 | 3593 | 4.5381126 | 8.0754824 |
| CTAGCCCCTACTCCAAGTTGA | 833 | 0 2 | 6032.5 | 13.43356 | 13.731526 |
| GCTGGCAAGGTGCTGGAGGGCC | 834 | 0 2 | 3498.5 | 14.638888 | 3.7599447 |
| TTCCAAAGGCTGCACCTTGCCC | 835 | 0 1 | 6400 | 14.44299 | -2.3250175 |
| GAAGGGGAAGAGAGCTGGCCG | 836 | 0 2 | 63993 | 20.677708 | 18.040138 |
| TTGTTCCTATCTGCCTCCTGC | 837 | 0 2 | 4838.5 | 9.8048887 | 4.8166785 |
| TGGAGCTGGGTCTGGGGCA | 838 | 0 2 | 6426 | 15.46969 | 17.843594 |
| CACTGCACTCCAGCCTGGGTGA | 839 | 0 2 | 65518 | 28.667358 | 32.660065 |
| CATTGCACTCTAGCCTGGGTGA | 840 | 0 2 | 20339 | 14.318895 | 21.095203 |
| AGCCTGTCCCTTCTCCTG | 841 | 0 2 | 4545 | 14.269382 | 3.7745585 |
| TCACCCAGGCTGGAGTGTAGTG | 842 | 0 2 | 4518.5 | 12.479655 | 15.868072 |
| CTGCTGCCGGAGACTCGTC | 843 | 0 1 | 1437 | 4.8540587 | 2.4149714 |
| AAAACCTAAGCCAGTAGCTCCC | 844 | 0 1 | 2386.5 | 4.5235443 | 0.87618637 |
| GGCTCACTGCAACCTCCACCTC | 845 | 0 2 | 38975.5 | 20.41017 | 17.418346 |
| CTGTAATCCCAGCTACTCGGGA | 846 | 0 1 | 2806 | 5.0527177 | 13.475494 |
| GCCATCATATCCCTGTGACCT | 847 | 0 2 | 5493 | 17.421993 | 9.6620798 |
| CCAGGTTGGAGTTCAGTGGCGC | 848 | 0 1 | 1854.5 | 4.1551623 | 4.9337268 |
| TGGTTAACTTCTGAGCAGGCTG | 849 | 0 1 | 1338 | 4.0301342 | 2.5747242 |
| GCTGGCTGACAGATTTGGGGTG | 850 | 0 1 | 3232 | 5.4790416 | -2.1113901 |
| CATCCCTGTCGTCAAGTCTCTG | 851 | 0 1 | 6284 | 5.1015582 | -0.33885518 |
| AAAGTGCTGCGACATTTGAGCG | 852 | 0 2 | 20430.5 | 8.490345 | 28.331139 |
| ATGTCATGAGGCTAGCCCCCAA | 853 | 0 1 | 1710 | 6.4409542 | -1.0215437 |
| AATCACTTGAACCCAAGAAGTG | 854 | 1 0 | | | |
| TGAGGCAGGCGGATCACGAGGTC | 855 | 0 2 | 1475 | 6.1789246 | 8.965416 |
| AAGAGGTAGCAGTCACAAAAGA | 856 | 0 1 | 682 | 4.1900787 | 3.1956244 |

-continued

| | | | | | |
|---|---|---|---|---|---|
| CCGTGGTCACCTGAGCTCCTTG | 857 | 0 1 | 2997 | 4.0277519 | -1.3587624 |
| CAGTTTCTTCCTCCCCCAGAGA | 858 | 0 1 | 2348 | 4.165566 | 0.71364939 |
| ATCTTTTATCACTCCCACTGCT | 859 | 0 1 | 5396 | 5.4679914 | 11.567021 |
| TCACCCAGGCTGGAGTGCAGTG | 860 | 0 2 | 6851 | 14.545588 | 17.889225 |
| TCTCCCAGGCAGGAGTGCAGTG | 861 | 0 2 | 2795 | 6.2941146 | 8.1798553 |
| GGGGCTGGTCTTTCCACTTACT | 862 | 0 2 | 65518 | 11.24554 | 19.391401 |
| TGTAATCCCAGCTACTCGGGAG | 863 | 0 2 | 4677 | 11.408354 | 16.218851 |
| CTGATCTCAAGTGATCCACCCA | 864 | 0 2 | 2249 | 7.9458203 | 9.493042 |
| TAGGTTACAGCCAGCCAG | 865 | 0 2 | 1963 | 10.949057 | 11.221157 |
| CCTCTGTGTCTCCAAGAGGCCT | 866 | 0 1 | 3752 | 9.7851496 | 0.61701149 |
| CTGCCTGCCTGGCCCAGGAACC | 867 | 0 2 | 65518 | 14.752467 | 36.164337 |
| ACAAAGTGCCTCCCTTTAGAGT | 868 | 0 2 | 65518 | 22.461653 | 34.028076 |
| GGGGAAAGCCAGCCCTGCTTCC | 869 | 0 2 | 1892.5 | 6.826138 | 6.2401505 |
| GGAGTGCAGTGGTGGGATCTCA | 870 | 0 1 | 1541 | 5.5753407 | 8.2118359 |
| ATCGATCCCGCGTAAGGCCCCG | 871 | 0 1 | 1231 | 4.8226123 | 1.2662603 |
| TCTGTGCTAGGCAGCCTGGCCC | 872 | 0 2 | 11107 | 23.362293 | 13.677877 |
| CTGTCCCCACCCAAATCTCATC | 873 | 0 2 | 2917 | 10.575051 | 6.3207545 |
| GAGCCGCCCTCCACGATGTCCC | 874 | 0 2 | 7252 | 8.6663809 | 14.735928 |
| GGTGGTGGAGCGGGCCCAGGCC | 875 | 0 2 | 4320.5 | 7.4591732 | 12.328825 |
| TCACTGCAACCTCCACCAGCCT | 876 | 1 0 | | | |
| CTGTCCTGCCAGTCCTGGACTC | 877 | 0 1 | 3377 | 5.8142152 | 7.2265315 |
| GGCGGGCAGCGTCTTGCTGGCC | 878 | 0 1 | 4755 | 7.4653172 | -11.274526 |
| TCCTGGGCTTGTCGCTGGCCA | 879 | 0 2 | 28926 | 9.8624611 | 7.4913173 |
| CAGCTGGTGCTTGCCTGGCTAA | 880 | 0 2 | 7373 | 13.676201 | 7.9258513 |
| CAGGCTGGCTCCCTGAAGGTTC | 881 | 0 2 | 8459.5 | 6.1472831 | 17.683357 |
| AGGTGGCCACAAGGTGGCTGGC | 882 | 0 2 | 13621 | 20.378857 | 17.680929 |
| TGGAGACACAGGACCAGACTGC | 883 | 0 2 | 2004 | 6.981535 | 2.3005965 |
| GGCTCTGGCTTTGGAGGAGCAG | 884 | 0 2 | 4483.5 | 6.8781896 | 14.473881 |
| CTGGCTAAGATCCAAGAAAGGC | 885 | 0 2 | 5036 | 14.178236 | 6.6532001 |
| GCTGTAGTGAATGGCCGCGTTC | 886 | 0 2 | 15429 | 7.8280811 | 7.1725068 |
| TGTTTGTGTGGGCCTTGGC | 887 | 0 2 | 7702 | 6.3522415 | 7.8300943 |
| ATCAAGAGCACAGTGCTGGCAT | 888 | 0 1 | 1172 | 4.3064132 | 2.099376 |
| CTGGGAGGCGGAGGTTGCAGTG | 889 | 0 2 | 4850 | 10.57113 | 16.432323 |
| TCACTGCAACCTCCGCCTCCCG | 890 | 0 2 | 42376 | 20.906567 | 16.209127 |
| TCTCTATTTGCCTAGGCTTGTG | 891 | 0 1 | 1775 | 4.0386124 | 5.2510257 |
| GTGGCGTGATCTCGGCTCACTG | 892 | 0 2 | 5379.5 | 9.6190071 | 14.266473 |
| TCGTTACCATAGCCTTGTCCCT | 893 | 0 2 | 2169 | 6.6286459 | 10.14022 |
| CCCAGGAGGCCTGCCTGGCCGG | 894 | 0 1 | 4711 | 5.0298901 | 9.8042231 |
| CAGCTCGGGCCTCCCTCTCCCG | 895 | 0 2 | 5136 | 8.3545942 | 10.162696 |
| ATGAGATGAGGAATGGCCCTCC | 896 | 0 2 | 2753 | 10.024472 | 4.1300974 |

-continued

| | | | | | |
|---|---|---|---|---|---|
| AGGCCGAGGCGGGCGGATCACC | 897 | 0 1 | 1354 | 5.2067318 | 8.9456701 |
| ACGGTGCAGCCTGTCCCTTCTC | 898 | 0 1 | 3755 | 6.826138 | -1.7736735 |
| GGAGGTACTGTAGCTGGCGTT | 899 | 0 2 | 1877 | 10.634505 | 9.6884193 |
| CTTTGGAACACCCAGCTCTGTG | 900 | 0 1 | 4367 | 4.3228598 | 8.8246651 |
| TGGGCGACAGAGCAAGACTCCG | 901 | 0 2 | 8120.5 | 7.6260972 | 20.824087 |
| TGGGTGACAGAGCAAGACTCTG | 902 | 0 1 | 3917.5 | 4.9988604 | 13.126308 |
| TGGCTTTAGTAATAAGTTTCTC | 903 | 0 2 | 12660 | 16.773508 | 11.141039 |
| TGCTAGCTGCCCGAAGGTCTCA | 904 | 0 2 | 39989 | 47.058292 | 15.67876 |
| GCTTCAGAGAGGGGTGAAGCTG | 905 | 0 2 | 21900 | 17.158428 | 13.963737 |
| GCTGCCTTGCCCTCTTCCCATA | 906 | 0 2 | 8045 | 13.299488 | 9.9672127 |
| GCTGTAAGTCACCTGGCCCGAT | 907 | 0 2 | 26191 | 8.8471966 | 25.053482 |
| TGCTGGCTATCCTGCGCCTTTC | 908 | 0 2 | 7903 | 10.469044 | 13.746831 |
| CCAGGCTGGAGTGCAAGCAGCA | 909 | 0 2 | 8552.5 | 10.636292 | 19.600433 |
| GCTAGGTTGGGAAGTTCTCCT | 910 | 0 2 | 2180 | 6.2453051 | 9.2986526 |
| CCAAAGTGCTGGGATTACAGGC | 911 | 0 1 | 2212.5 | 5.0945106 | 7.6044312 |
| GCCTGGACTGTTCTACCATTTT | 912 | 0 1 | 2709.5 | 4.8429475 | 1.7205493 |
| GCCGGGCCCGGGTTGGCCG | 913 | 0 2 | 11714 | 7.709898 | 8.2685728 |
| CAGCCTCTATGCCCCCGTCACC | 914 | 0 2 | 9484 | 16.652414 | 11.957335 |
| CTGGCTAGATGTGTGGCCATGA | 915 | 0 2 | 3221 | 21.032122 | 14.058989 |
| ACTGCACTCCATCCTGGGCAAC | 916 | 0 2 | 46281.5 | 15.235478 | 33.271416 |
| CCTTCTCAGCCCCAGCTCCCGC | 917 | 0 1 | 3674 | 6.026938 | 0.30380982 |
| GTCTCCCAAACTCTGATGGTCC | 918 | 0 1 | 5069 | 6.4115953 | -0.19100553 |
| GGTCCCCCCATGGTGAGCACTG | 919 | 0 1 | 2640 | 6.9299874 | -3.5790675 |
| CGGGTTCACGCCATTCTCCTGC | 920 | 0 2 | 25205.5 | 15.182484 | 6.2870688 |
| AGCGACACCGCCTGCAGGCCAT | 921 | 0 1 | 3210 | 17.247011 | 1.8362232 |
| GAACTTGGCCTGTCTGTCTGGC | 922 | 0 1 | 3174 | 4.165082 | -0.96377498 |
| TGGGTCAGAGGGAAAGTGTAT | 923 | 0 1 | 1240 | 5.4864416 | 4.4304075 |
| TGTTGCCCAGGTTCTCTCCTGC | 924 | 0 1 | 2527 | 4.6479778 | 4.8975463 |
| CATTGCACTCCAGTCTGGGCCA | 925 | 0 2 | 20401.5 | 20.588572 | 15.621833 |
| TGGTTCTTCGCTGGGCGGCTGC | 926 | 0 2 | 18451 | 17.683105 | 11.562138 |
| CAAAGTGCTAGGATTACAGGCG | 927 | 0 2 | 1593 | 7.9515629 | 8.8260517 |
| TGGTAGGTACTGGCTTCAGGC | 928 | 0 1 | 1959 | 5.7638865 | 10.948694 |
| CACTGCACTCCAGCTCTGGGT | 929 | 0 2 | 65518 | 20.15584 | 31.571056 |
| GTCTTGTCCCAGCTCTGCCACT | 930 | 0 1 | 5667 | 5.9998269 | 10.289277 |
| GCCTGGGAGTTGCGATCTGCCCG | 931 | 0 2 | 65518 | 31.678772 | 9.6128397 |
| GCAGCATCCCGGCCTCCACTGT | 932 | 0 2 | 5995 | 7.2606683 | 11.881517 |
| TCTGCCCCAGCCGCACTG | 933 | 0 1 | 3479 | 5.2319188 | 7.0148258 |
| ACCCATCCAGTGTCCCTGCTAG | 934 | 0 2 | 3030 | 8.7047195 | 5.2593546 |
| GCCTGGCCAACATAGTGGGACC | 935 | 0 2 | 16749 | 8.6138811 | 20.486101 |
| CATTGCACTCTAGTCTGGGTGA | 936 | 0 1 | 2023 | 4.2580843 | 8.942131 |

-continued

| | | | | | |
|---|---|---|---|---|---|
| AAGACACCAGTGGCAGCCCC | 937 | 0 2 | 3888.5 | 10.940197 | 2.9559026 |
| TCCTGGGCTTTGGCTTGTTGGG | 938 | 0 2 | 10813.5 | 7.7058806 | 7.1675959 |
| TGGTAGTCGGCCTCGGTGGCTC | 939 | 0 2 | 38277.5 | 43.447659 | 21.633255 |
| TACTGCGCCTTCACCAAGCGGC | 940 | 0 2 | 2073 | 6.069356 | 2.6888943 |
| TCACTGCAAGCTCCGCCTTCCG | 941 | 0 2 | 11075 | 17.517977 | 5.425684 |
| AGTGCCTTCAGATTTGCCCCAG | 942 | 0 1 | 5977 | 9.7207422 | 0.54957581 |
| ACCCTCTTGAGGGAAGCACTTT | 943 | 0 2 | 7337 | 6.0748458 | 18.790304 |
| GCCCCAAGTCCCTATGTTTCCA | 944 | 0 1 | 8950 | 12.678107 | 1.0439761 |
| ATCCCCCTGTATCTGGAAGAAT | 945 | 0 1 | 2318 | 5.7854853 | 3.7798862 |
| GTGCTTTGCTGGAATCGAGGAA | 946 | 0 2 | 1710 | 10.403996 | 8.5636625 |
| GAGGCTGAGGTTGCAGTGAGCC | 947 | 0 1 | 1366.5 | 5.0199966 | 6.459177 |
| TGGTCGGGCTGCATCTTCCGGC | 948 | 0 2 | 4093 | 7.5570545 | 2.1106353 |
| ACCACTGCCTCCAAGGTTCAG | 949 | 0 2 | 3247.5 | 10.014809 | 6.09551 |
| TTTGGTCCCCTTCAACCAGCTA | 950 | 0 2 | 13310 | 7.6353297 | 18.880299 |
| GGTATGCTGAAGCCAGCTCGCA | 951 | 0 2 | 792 | 6.1946688 | 4.135592 |
| TTGCTTGGGCTGGAGTGCAATG | 952 | 0 1 | 2486 | 4.9725943 | -2.7821193 |
| TATCTATGTGCTCTGACCTCTC | 953 | 0 2 | 6670 | 9.7406015 | 7.9747272 |
| AGGAGAAGCCAAGTTGTGAGCA | 954 | 0 2 | 6905.5 | 29.559206 | 20.101482 |
| ACCCATGGTCTGGTGGGCCCT | 955 | 0 1 | 4897 | 5.121223 | 1.2881944 |
| ACCCCGCTCCTTGCAGCCTCTG | 956 | 0 2 | 9609 | 6.7912097 | 4.80404 |
| CACTGCAAGCTCCGCCTCCCGG | 957 | 0 2 | 13890 | 17.77289 | 14.108605 |
| ATTCTTGGATTTGGCTCTAGTG | 958 | 0 1 | 2081 | 5.359941 | 9.4660416 |
| ACTGCACTCCATCCAGCCTGGC | 959 | 0 2 | 5668 | 7.6480083 | 10.938603 |
| GCCCAGGCTGGAGTGCAGTGGT | 960 | 0 2 | 12883 | 15.701074 | 24.210485 |
| CTGCGTTCTGCCTGGCGGCCTA | 961 | 0 2 | 5047 | 6.173347 | 11.160098 |
| TCACTGCAAGCTCCACCTCCCG | 962 | 0 2 | 9843 | 15.895414 | 13.694772 |
| CACTGCCTTGGCCACCTATCCT | 963 | 0 2 | 10671 | 9.1234684 | 14.108407 |
| TCCTTTAAACAACCAGCTCTCA | 964 | 0 1 | 2428 | 5.5528088 | 7.3969135 |
| GGCCTCTCTTGGGACAGCTGTC | 965 | 0 2 | 2816.5 | 11.840509 | 11.64073 |
| GAAGAGTGGTTATCCCTGCTGT | 966 | 0 1 | 2580 | 4.6407037 | 10.335828 |
| CCCTGATAGCCCCTATCATCAG | 967 | 0 2 | 3127 | 14.184772 | 3.5698271 |
| CACTGCAACCTCTGCCTCCTGG | 968 | 0 2 | 53207 | 22.508492 | 13.233194 |
| TCATTGCAACCTCCTCCTGGGT | 969 | 0 2 | 5648 | 10.772061 | 9.7537737 |
| CTGCAGTCTACCTGGATTTTTA | 970 | 0 1 | 4922 | 4.5788498 | 17.83988 |
| GGACCCTAGAGAGAGCCAGCCT | 971 | 0 1 | 1774.5 | 10.895789 | 0.5640983 |
| ACCCGATGTTGGTGCTCTAGTA | 972 | 0 1 | 2346 | 5.8714437 | -2.1286945 |
| CGGAGGTTGAGGCTGCAGTGAG | 973 | 0 1 | 1322.5 | 4.7339053 | 5.850657 |
| TTGCATCTTCTGGTTGAGCCCC | 974 | 0 1 | 3115.5 | 4.8583755 | 5.3206172 |
| GAGAGAGCTCTGTGCCTGGGAT | 975 | 0 1 | 1460 | 4.1398292 | 2.7307003 |
| GGCCCGGTGACGTCACT | 976 | 0 1 | 2095 | 4.7288775 | -1.6421453 |

-continued

| | | | | |
|---|---|---|---|---|
| TCTAGCTCTGCTTATCATGGCT | 977 0 1 | 4019.5 | 11.909512 | 1.1704206 |
| CTGGCTGGAGTGCAGGTGAGTG | 978 0 2 | 4570 | 6.2398477 | 8.3825598 |
| GATGGCCTCATGGCTGCAGGCC | 979 0 1 | 902 | 4.7118134 | 1.0811797 |
| GAGGCCAAGGTGGGCAGATCAC | 980 0 2 | 2720.5 | 8.2338047 | 10.671504 |
| GTCCTTCCACATGGCCAACTTC | 981 0 1 | 3716 | 4.1157985 | 8.4863319 |
| CAGGAGTTTTAAATCTAGCATG | 982 0 1 | 1165.5 | 10.034127 | -3.4165139 |
| GGAGGGGCTCAGTCTTTCTTGG | 983 0 2 | 2551 | 7.60566 | 8.0373402 |
| AAGGCAAGGCTTCCAGCTCCCC | 984 0 2 | 2465.5 | 6.0202217 | 6.2276101 |
| TCACTGCAACCTCCACCACGTG | 985 1 0 | | | |
| CACCGAGGCTGGAGTGCAGTGG | 986 0 2 | 3565 | 11.145717 | 13.107421 |
| CCACAGTCCTGGCTTCTGTCTG | 987 0 1 | 4568 | 4.546155 | 15.062599 |
| GCCCGCTGGCTGGGCTCCAGCT | 988 0 1 | 3048 | 4.0028958 | -8.7108431 |
| ACTGCACTTCAGCCTGGGTGAC | 989 0 2 | 21975 | 15.030581 | 28.149118 |
| CTTCCCACCAAAGCCCTTGTTG | 990 0 2 | 3477.5 | 6.069356 | 7.7381773 |
| AAGTGCTGGGATTATAGGCATG | 991 0 1 | 1598 | 4.0027814 | 6.5471692 |
| TCGTGATCTGTCCACCTCGGCC | 992 0 2 | 5621.5 | 23.653496 | 15.646881 |
| GCGGCAGGAGTAAAGGAGGAAG | 993 0 2 | 3316.5 | 10.005136 | 13.926331 |
| GGCTCACTGCAAGCTCCGCCTC | 994 0 2 | 20587 | 20.311087 | 3.6339736 |
| GTGCCCAGCAGCAGCGTCCCCG | 995 0 1 | 2773 | 6.90412 | -1.4229031 |
| ACTGTACTCCAGCTCTGGGTGA | 996 0 2 | 8927.5 | 10.2185 | 21.731802 |
| GGAGGCGGAAGTTGCAGTGAGC | 997 0 2 | 2314 | 8.7133474 | 5.029707 |
| TGGTTGTTAGGGAAGATTCATC | 998 0 1 | 1996 | 5.7277908 | -0.53821027 |
| ACCTCCTGGCGGGCATCCTC | 999 0 1 | 3524 | 4.3451629 | 9.1596689 |
| TAGCTGAATTGTGGGAGACCTA | 1000 0 1 | 1518.5 | 7.60566 | -4.9874139 |
| TCCTGCCGTCCTCCGGGGCCTC | 1001 0 2 | 9326 | 11.404112 | 5.8492618 |
| TGGTTGTGCACGGGTTGGT | 1002 0 1 | 4287 | 5.809895 | 12.026738 |
| TGTCCAGGCTGGAGTGCAGTGG | 1003 0 2 | 9691 | 12.871147 | 16.345312 |
| AAAGATGTTGCTGCTCCGCCCT | 1004 0 1 | 10873 | 11.395624 | -1.3708899 |
| TGGGAGGCCGAGGCAGGTGGAT | 1005 0 2 | 1509 | 6.3071833 | 8.9423923 |
| TCACTGCAACCTCCACCTTCCG | 1006 1 0 | | | |
| CTCCTGAATTGTCCCTCACAGC | 1007 0 1 | 3894 | 4.6719613 | -2.2086017 |
| CAAAGTGCTGGGATTACAGGTG | 1008 0 1 | 2224 | 4.9705548 | 11.770996 |
| CATGGTGAAACCCCGTCTC | 1009 0 2 | 3678 | 7.6599259 | 10.599221 |
| CATCCAGGCTGGAGTACAGTGG | 1010 0 1 | 1197.5 | 5.0059147 | 6.9278154 |
| TTGGCCATCTAAGCCCAGCCAC | 1011 0 2 | 2464 | 9.1909533 | 7.750977 |
| GGCCGCCGCCTTGTGCTCTGC | 1012 0 1 | 5552 | 9.3362026 | -7.5507455 |
| CCCTCTGGCCCCTGTGGTGGAT | 1013 0 2 | 65518 | 14.648276 | 19.804953 |
| TAACAGATGTCATTTCGGCGGC | 1014 0 1 | 43807 | 16.818501 | 0.21859378 |
| TCTCTTTGCCTGCTGCCATCCA | 1015 0 2 | 11985 | 23.580763 | 9.5384855 |
| GCTCTAGTAGGAATGTCCCTCT | 1016 0 2 | 6301 | 15.744108 | 2.9028673 |

-continued

| | | | | | |
|---|---|---|---|---|---|
| AGCTCAATGCAACCTCCGCCTC | 1017 | 0 2 | 11240 | 13.15651 | 6.5624309 |
| CCTGGTTCAAGTGATGCCCCT | 1018 | 0 2 | 11617.5 | 9.2222452 | 3.8587017 |
| CACCTGTACAGGGCCGGGCTGG | 1019 | 0 2 | 15471 | 7.5139775 | 10.770471 |
| CTGCAGCCTCCACTTTCTGGGC | 1020 | 0 1 | 2839 | 4.7054248 | 13.918253 |
| GCCCCCGAGGAGGTGATGTCGC | 1021 | 0 1 | 5201 | 12.058164 | -2.6986685 |
| GAGGTTGGGGCTGCAGTGAGCT | 1022 | 0 2 | 2391.5 | 7.2082191 | 11.666763 |
| ACTGCACTCCAGCCTGGGCGGC | 1023 | 0 2 | 65518 | 25.924618 | 35.366241 |
| CTCTGTGGTGGAGTGGGTCACC | 1024 | 0 1 | 2634 | 4.6613207 | 1.0710925 |
| GACCTTGTGATCCGCCCACTTT | 1025 | 0 2 | 3834 | 7.5950313 | 9.0545225 |
| GGGGCTTCTAGGGTGCCAGATC | 1026 | 0 2 | 3012.5 | 13.356146 | 7.901947 |
| TTGCTGACCTTTGCTCTCCGTT | 1027 | 0 1 | 4311 | 5.1390486 | 6.5618801 |
| AAGTGCTGGGATTACAGGTGTG | 1028 | 0 2 | 3352.5 | 6.344357 | 13.838893 |
| CAGCAGAGAAATTACATATTTG | 1029 | 0 1 | 1053.5 | 5.0869894 | 0.55714673 |
| TGGCTTTCTCACAGACCACCTC | 1030 | 0 1 | 8109.5 | 13.15651 | -1.1421698 |
| AATAAACAAAGGACAAGGAGGT | 1031 | 0 1 | 913 | 5.4493914 | -0.35933188 |
| GCTCACAGCCTCCCCCGGCCTG | 1032 | 0 2 | 13198 | 7.8765292 | 3.4258959 |
| GTGGTTCACTTGAGGTCAGGAG | 1033 | 0 2 | 2687 | 7.6964669 | 6.9500546 |
| CCCAAAAGTTCTGAGATGGCT | 1034 | 0 1 | 1275.5 | 7.5570545 | -0.66594625 |
| CTGGAGGAGCTGCCATG | 1035 | 0 2 | 3669 | 12.842446 | 14.933422 |
| TGTCTATTCCCCCACCTCCGTT | 1036 | 0 1 | 2379.5 | 4.5837574 | 3.2563431 |
| GGCCTGGCAGAGCGCGCGGCTG | 1037 | 0 1 | 3187 | 4.2506533 | 0.47298598 |
| CCAGGCTGGAGTGCAATGGCGT | 1038 | 0 2 | 1892 | 6.8911996 | 11.028392 |
| CGCCCAGGCTGGAGTGCAGTGG | 1039 | 0 2 | 12926 | 16.758549 | 16.607355 |
| TGGCTCCTCACGTCCTCAGAGC | 1040 | 0 1 | 1612 | 5.3898416 | 4.4133153 |
| TCCTCCAGTTCCTTGGTTTCAG | 1041 | 0 1 | 4451.5 | 4.743588 | 5.2467165 |
| TGGTGGAATTGTAAAATAGTGT | 1042 | 0 2 | 3325 | 12.173241 | 2.7421064 |
| CGACCTTGTGATCCTCCCGCCT | 1043 | 0 2 | 4594 | 6.1166434 | 4.4487605 |
| TAGCTCCTCCCAGATCTCATCT | 1044 | 0 2 | 3659 | 10.385338 | 3.9473054 |
| CCACGCATCCCTCCACAGAGAG | 1045 | 0 1 | 2981 | 4.6559062 | 10.40073 |
| ACCCAGGCTGGAGTGCAGTGGG | 1046 | 0 2 | 4950 | 12.992976 | 17.386417 |
| GCACCGCCTTGGACCGCCCGCT | 1047 | 0 1 | 3964 | 4.1457386 | 10.605991 |
| CAACATGGTAAAACCCCGTCTC | 1048 | 0 1 | 2540 | 4.2821875 | 2.931881 |
| GGCTGGGCCTCTCCCTCAGCTG | 1049 | 0 1 | 6453 | 5.1583419 | 16.296978 |
| TTTTCTCTTCCCTCTGGACCTG | 1050 | 0 1 | 3826 | 4.9174376 | 7.1403542 |
| AGGCCCCCTCCACCCATTCTGG | 1051 | 0 2 | 2151 | 8.4221792 | 7.0899777 |
| AGTTTGTGTAAGAAAAGC | 1052 | 1 0 | | | |
| TCAGGGCTGCACTGGCTGGTCT | 1053 | 0 2 | 9852 | 10.620815 | 11.96568 |
| CCCTCGTGCATCCATCATTTAG | 1054 | 0 2 | 2096 | 6.675056 | 2.2716882 |
| CACTGCACTCCAGCCTGGCCTG | 1055 | 0 2 | 65518 | 20.659618 | 21.962681 |
| TTCACTGCTCTAGCCCTAATTT | 1056 | 0 2 | 5739 | 15.599205 | 7.8376389 |

| | | | | |
|---|---|---|---|---|
| AAGACACCAGAGACTGGCCTCA | 1057 0 1 | 6306 | 5.8909965 | 5.1631103 |
| CAGAGCTGGTGTGTCCTGGCAT | 1058 0 1 | 4347 | 4.3130379 | 0.72330654 |
| TATTGGCCGGGCGCGGTGGCTC | 1059 0 1 | 3005 | 5.9769301 | 7.7475381 |
| AGGTCTCTTGCTGTCTCTGGGC | 1060 0 1 | 8026.5 | 6.4136252 | 0.43719938 |
| TAGCCCAGGCTGGAGTGCAGGG | 1061 0 2 | 6013 | 9.3222113 | 19.078527 |
| CACTGCACTTCAGCCTGGGTGA | 1062 0 2 | 65518 | 19.494125 | 35.251587 |
| AGTGTTGGCTCGGCTGGCTGCC | 1063 0 2 | 9220.5 | 15.521686 | 7.1320724 |
| CTCTGCTGTGCCGCCAGGGCCT | 1064 0 1 | 5084 | 6.4544711 | 0.20225658 |
| TGCAATCCAGCCTGGGCGACA | 1065 0 1 | 4499 | 4.9212852 | 16.91279 |
| AGTGATCCACCCGCCTCAACCT | 1066 0 2 | 5364 | 8.4659891 | 7.8198662 |
| TGCCGTGGGGCTGAGGCTGGAG | 1067 0 1 | 4521 | 4.5795527 | 15.352057 |
| TTTAGATTGTGACCTCCCCCCA | 1068 0 2 | 5251.5 | 9.5200853 | 6.4590821 |
| GGAGGCTGGCCTTCAGACGGGT | 1069 0 2 | 65518 | 12.034198 | 25.266558 |
| CCTGCCAGAGCAGCTTGTCCTC | 1070 0 2 | 3950 | 6.2292013 | 6.3928571 |
| TGGCCTCGGCATCCAGCAAGAG | 1071 0 1 | 4673 | 4.4677706 | 4.3334913 |
| CCACGGGCAGATGTGGTTGGTT | 1072 0 2 | 2023.5 | 6.754149 | 4.0614367 |
| ACTGTACTCCAGCCTGGGGGAC | 1073 0 1 | 3910 | 5.224843 | 16.213413 |
| CCCTCTTGGCTTCTATCCCACC | 1074 0 2 | 7596 | 7.1978688 | 6.3785648 |
| GCCCACGGCCCTGCTCTGC | 1075 0 1 | 3930 | 4.9654756 | 0.13763157 |
| GGCTGCTGGTTTCTTGTTTTAG | 1076 0 2 | 7926 | 12.94939 | 11.212504 |
| GGAGCCTCTGGCAGGGGCCA | 1077 0 1 | 2402 | 4.6396155 | 6.1019282 |
| TCCTGGCCATCCAGCCTGGGGA | 1078 0 2 | 16778 | 7.2028656 | 18.973217 |
| TCTTGCCACTTCATCCCCTTTC | 1079 0 2 | 5428 | 8.6937799 | 2.063446 |
| GCGTCTCATCCTCCCGCTAATT | 1080 0 1 | 2019 | 4.072968 | 2.8117723 |
| CCTTCCCACATTCCTTACATGC | 1081 0 1 | 4637 | 9.2534456 | 1.1731225 |
| CGCGCTCTCCTTCTGGCACCCA | 1082 0 2 | 8509 | 6.424386 | 19.448072 |
| GAGGCGGGCAGATCACCTGAGG | 1083 0 2 | 1864 | 6.033988 | 5.7446184 |
| GGGAGTTGTGGTTGGCTTCTGG | 1084 0 2 | 4978 | 8.3206406 | 9.2158394 |
| TGGGGCCATCTCACCCACTGTT | 1085 0 2 | 1828 | 9.8785877 | 4.2386732 |
| GCTAGGCTGCTGGCCACTGAGG | 1086 0 2 | 6972.5 | 13.127683 | 19.686853 |
| TGCCGCCCGGCCATCTCGGCTC | 1087 0 2 | 6915.5 | 13.391404 | 5.9536037 |
| AGCTGGAATTACAGGAGCCCAT | 1088 0 1 | 1223 | 9.1280918 | −4.934659 |
| GGGAACAGCTTGGGCTCTGCCA | 1089 0 1 | 4814 | 4.5313773 | 3.7230809 |
| CCCTGGCTCACTTTCTGTTGTG | 1090 0 2 | 20839 | 12.591182 | 5.4283981 |
| TCACTGCAAGCTCCGCCTCCCG | 1091 0 2 | 19903 | 18.896269 | 11.699102 |
| CTGGACTGAGCTCCTTGAGGCC | 1092 1 0 | | | |
| CTGGGTTGGGGTTACATGACTG | 1093 0 2 | 6057.5 | 6.2405562 | 7.4004421 |
| CTGGTGTTGGGTCTTGCTTTTA | 1094 0 2 | 4756 | 6.5764294 | 8.8639517 |
| ACAGGCGATCCACCCGCCTCAG | 1095 0 1 | 2228 | 5.9650521 | 8.9491081 |
| TCAGGCACCTTCCTCTTATCTG | 1096 0 1 | 2858 | 4.891077 | 9.5462265 |

-continued

| | | | | | |
|---|---|---|---|---|---|
| CGGGTTCACGCCATTCTCCTGCC | 1097 | 0 2 | 25616.5 | 15.660168 | 6.7002292 |
| AAAGTGCTTCTCTTTGGTGGGT | 1098 | 0 2 | 65518 | 11.238881 | 30.157898 |
| GGCTCCCTGCAACCTCCGCCTC | 1099 | 0 2 | 39003 | 18.926107 | 13.134951 |
| AGTTGTTCGTGGTGGATTCGCT | 1100 | 0 1 | 3494 | 4.0696526 | 11.844742 |
| GCTCACTGCAACCTCTGCCTCC | 1101 | 0 2 | 52175 | 22.994247 | 20.293594 |
| CTCCTCCACCCGCTGGGGCCCA | 1102 | 0 1 | 4352 | 4.8429317 | -0.27487165 |
| TTATTGCACTCCAGCCTGGGTA | 1103 | 0 2 | 45303 | 21.338472 | 22.149384 |
| ACTGTACTCCAGCCTGGGAGAC | 1104 | 0 2 | 8375 | 6.4653163 | 21.671926 |
| ACAACTCCTTCTTGGGTCCTGG | 1105 | 0 1 | 6494 | 5.7869687 | 2.3521452 |
| CCAGGAGTTGGAGGCTGCAGTG | 1106 | 0 2 | 4602 | 7.9332623 | 12.632589 |
| AAGTCTCTCACATATCTGGTCC | 1107 | 0 1 | 3668 | 4.6719613 | 6.1481905 |
| GAATTTATTACTAGTCAACTG | 1108 | 0 2 | 1889 | 7.8809133 | 3.6355321 |
| GGCTGCTGGTCTTTCATAGTGGG | 1109 | 0 2 | 12604.5 | 21.291653 | 18.561375 |
| CACTGCAATCTCCATCTCCTGG | 1110 | 0 2 | 5091 | 10.483025 | 11.471234 |
| CCGGAGTGTCTGGCCTGCTGGG | 1111 | 0 1 | 3411 | 4.093287 | 9.0740547 |
| TCCCCTGGTGCCACGATCTGCT | 1112 | 0 1 | 5256 | 5.5488677 | -7.7961345 |
| TCTTGGGCAGCTTGCTCGCCCC | 1113 | 0 1 | 1661 | 5.9425497 | -1.1524448 |
| TTTCTTGGGCCGTGTGCTGGT | 1114 | 0 2 | 7386 | 8.0159159 | 10.662634 |
| GGCTCTGCTTGAGGCCAGCCTG | 1115 | 0 2 | 1496 | 8.5616169 | 2.8241165 |
| TGGGTCCTGGCTGAAGATCTCT | 1116 | 0 2 | 13345 | 7.4858232 | 22.909485 |
| GCGGGCGGCTTCATCTTGCCCT | 1117 | 0 1 | 5038 | 5.1213508 | 7.6892729 |
| GCAGCTATTGTCTCCTGGGCCC | 1118 | 0 1 | 3900 | 4.0808616 | 12.07268 |
| GCCTTCCCACCACCCGTCC | 1119 | 0 2 | 6139 | 7.5813851 | 3.1351645 |
| GACCTCGTGATCCGCCCGCTTT | 1120 | 0 2 | 4513 | 8.2720776 | 14.007803 |
| CACTGCACTCCAGCTGGGTGAC | 1121 | 0 2 | 7458.5 | 7.5623012 | 16.072519 |
| CGTCCCGGGTTCACGCCATTCT | 1122 | 0 2 | 4935 | 8.0834999 | 8.5963545 |
| CTCTGGAGTGTCTGGCCAGGGT | 1123 | 0 1 | 3361.5 | 4.2338123 | 13.302693 |
| GCCTGTATTCCCAGCACTTTGG | 1124 | 0 1 | 3873 | 6.2997189 | -0.46441609 |
| GGCGGTCTCAGCACCCTCTTGG | 1125 | 0 1 | 2606 | 4.5257893 | 0.3523702 |
| TGCCCAGGCTGGAGTACAGTGG | 1126 | 0 2 | 8395.5 | 13.998208 | 16.034225 |
| ATCAGAGTAGTTGTTGCCCAGA | 1127 | 0 1 | 1471 | 5.5012255 | 7.6935115 |
| CAGCAGCACACTGTGGTTTGTA | 1128 | 0 2 | 65518 | 16.623587 | 30.172779 |
| GCCTGGCCTCCTACAGTACTTT | 1129 | 0 2 | 35866 | 15.014146 | 23.263319 |
| ACTGCACTTCAGCCTGGGTGTC | 1130 | 0 2 | 30071 | 14.363188 | 30.014778 |
| GACCTCGTGATCCGCCCTCCTT | 1131 | 0 2 | 6551 | 25.696636 | 10.76053 |
| CAGTTTGTCCCCATGGCCATGT | 1132 | 0 2 | 6591.5 | 13.401958 | 5.2375259 |
| GGGCAGAGCCAGCCAGTCCC | 1133 | 0 2 | 3180 | 11.937795 | 10.093319 |
| GCTCATGACTGTAATCCCAGCA | 1134 | 0 1 | 2783.5 | 6.7136006 | 1.7869294 |
| GCTGCTCTCCAAGCCTCCTTGA | 1135 | 0 1 | 3797.5 | 5.4047599 | 5.8530407 |
| ACTGCACTCCAACCTGGGCAAT | 1136 | 0 2 | 21062 | 16.688629 | 27.100132 |

-continued

| | | | | |
|---|---|---|---|---|
| GGCGTGCCCTGGCCCCGAGGCT | 1137 0 2 28813 | 10.987214 | 21.873014 |
| AAATGCAACGGGCTTTCCTTAT | 1138 0 1 3531 | 4.3887382 | 1.0790982 |
| CCCTGGAGGTTGAGGCTGCAGT | 1139 0 1 1366 | 4.2553997 | 5.5404139 |
| GCCCAGGAGGAGAGGCTGCAGT | 1140 0 1 1922 | 4.5738077 | 5.7069306 |
| TCAAGTGATTCTCCTGCC | 1141 0 2 9836 | 15.970009 | 19.168186 |
| GCCCTGTGCAGGTGTGCAGCAG | 1142 0 1 1165 | 6.2430058 | -0.72478187 |
| CTTGCTGCCAGCCACCATACTG | 1143 0 2 1793 | 6.5887036 | 2.1328712 |
| TCTGCCTCCAGGAGCTGGCA | 1144 0 2 12022.5 | 6.4897313 | 19.629604 |
| TGATTTCAAGCCAGGGGCGTT | 1145 0 1 3186 | 4.1073384 | 9.1334038 |
| TGGGGGAGCTCAGTCCAGCCCA | 1146 0 2 3738 | 7.3541789 | 13.35856 |
| AGGCCAGCCTGCCCAAAGCTGC | 1147 0 1 1444 | 6.8652005 | 1.3340253 |
| TTGTCCGTGGTGAGTTCGCATT | 1148 0 1 2678 | 5.3224468 | 5.8358331 |
| ATGGCCGCCTGTCCTTCCCGCC | 1149 0 2 5678.5 | 6.8652005 | 8.8366051 |
| CATTCTAGGCCTGGCTTGGGCC | 1150 0 1 4350 | 4.3145142 | 0 |
| CAGTGCCCGCCGCCGTTCCTGG | 1151 0 1 4235 | 4.8511839 | 14.764318 |
| AGGTGCTGGGGCTTGGCCTGCT | 1152 0 2 54992 | 14.781937 | 19.839622 |
| CAGCAGCTCAGCCTCCTTCCCA | 1153 0 2 6588 | 11.002058 | 9.0820408 |
| CTCATTGTAGCCTCCAGTTCTTG | 1154 0 2 5375 | 10.634505 | 9.6296253 |
| CTCAGTGCTGCTGGCTCCTGTC | 1155 0 2 30057 | 40.88406 | 25.543219 |
| AGCCTGGGCAACAGAGCAAAAC | 1156 0 1 2910 | 4.664422 | -2.435894 |
| ATTTACATACCCAGCAGCCTCC | 1157 0 2 9344 | 14.651403 | 5.7202735 |
| AAAGTGCTGGGATTACAGGCGT | 1158 0 1 2149 | 5.1885619 | 11.850306 |
| GCTCCCACCTTAACCTTCACAT | 1159 0 1 2577 | 8.7701244 | 1.6405232 |
| CTACTGGCCATCTGATCTACAA | 1160 0 2 4485 | 7.3851671 | 14.238548 |
| TGCCTAGTTCTGTATTTACAGT | 1161 0 2 1442 | 7.7322025 | 7.1628423 |
| TACCCAGTGCCACCCTCTGAGG | 1162 0 1 2340.5 | 4.2727714 | 6.8743863 |
| AGCCCAGGAGTTTGAGGCTGTG | 1163 0 1 2967 | 4.5458264 | 13.880125 |
| CACTGCAAGCTCTGCCACCTGG | 1164 0 2 4423 | 9.3773403 | 10.346853 |
| CGCCTCCTCTCTGTCCTGATTT | 1165 0 2 11564 | 15.306285 | 4.1242805 |
| TAGCCCCTGCCTTTGAACCTGG | 1166 0 1 3340 | 5.771091 | 7.2742958 |
| CACTGCACTTCAGCCTGGGCGA | 1167 0 2 65518 | 19.854979 | 32.441864 |
| CCCAGGAGGTGGAGGCTGCAGT | 1168 0 2 1868 | 6.0943484 | 7.1866341 |
| TGAGTGACCAGAAGTCCCCCTC | 1169 0 1 2715 | 5.5675011 | 1.1538888 |
| TTGATCTTTTCTTGCTGCCCCA | 1170 0 2 12258 | 18.854212 | 2.8578236 |
| CATTAGGACGCCCCGCCCATAC | 1171 0 1 3517 | 4.7521834 | 7.6331592 |
| GGTGGTTCACGCCTATAATCCC | 1172 0 1 2909.5 | 4.983528 | 14.240087 |
| GTAGCTCTGTTTAAAGTTCTTT | 1173 0 2 1147 | 7.4468746 | 3.0822921 |
| AGGCGCCTGCGGGATCCTTGCC | 1174 0 2 4344 | 8.3828068 | 9.3085003 |
| GCACTTTGCCCCTCCTTTGGCA | 1175 0 1 3096 | 5.8571658 | 1.1003072 |
| TCGCTCAGGCAGGAGTGCAGTG | 1176 0 1 1902 | 5.7879028 | 8.7315207 |

| | | | | |
|---|---|---|---|---|
| TGCCAGCTGCTTGTCCCCACA | 1177 0 1 | 2506 | 8.8620977 | -2.5429773 |
| AAGTGATACGCCTGCCTCGGCC | 1178 0 2 | 16691 | 9.2873106 | 2.0918362 |
| GGGCTCTCCCACAACGTGCCAG | 1179 0 1 | 2349.5 | 4.1230264 | 5.3486781 |
| ACTGCACTCCAGCCTGGGTGAT | 1180 0 2 | 65518 | 27.70583 | 35.281982 |
| TCATCAGGGATATTGGCCTGAA | 1181 0 2 | 2532.5 | 6.9170618 | 10.842815 |
| GGGAGGCAGTGCTGGAGGCTGG | 1182 0 2 | 9212.5 | 9.3155737 | 13.897033 |
| CCAGTTCCAGTGCTCACATCCA | 1183 0 1 | 2332.5 | 4.5615263 | 1.8066665 |
| TGCCTAGGTCTGGCCTCCTTGG | 1184 0 2 | 10161 | 16.315468 | 2.7759731 |
| CGGGGCCCTGGGGCTGAAGGTC | 1185 0 1 | 4941 | 5.1423211 | 2.6783533 |
| ATTGGTAGTTTTGTATTTCTCT | 1186 0 2 | 2205.5 | 8.1146107 | 5.780735 |
| CTGGCAAGAAATATATATCTTA | 1187 0 1 | 1119 | 5.1329703 | 0.56972069 |
| GCCGACTGCCTTGTGAGCCT | 1188 0 1 | 3002 | 4.0046587 | 4.5328951 |
| GCTCCAGTGACCATCGTTTTAG | 1189 0 1 | 719 | 4.2234468 | 3.1870663 |
| CCCAGGAGGTTGAGGCTGCAGT | 1190 0 2 | 2825 | 8.4417934 | 12.283764 |
| CGCCCAGGCTGGAGTGCAGTGA | 1191 0 2 | 9513 | 14.644378 | 17.344313 |
| CTCCCGGCTGCTCCGGCTCCCG | 1192 0 1 | 3404.5 | 4.0221744 | 10.150807 |
| GTTACTCCTGGTTGAGCTTGGT | 1193 0 1 | 4309.5 | 4.4103327 | 15.300289 |
| GCCTCCAGCCCACGCAGGCCTG | 1194 0 1 | 4519.5 | 9.7356396 | -2.5970438 |
| TATTCATTGCCCATGTTTGTGA | 1195 1 0 | | | |
| CACCCAGGTTGGAGTGCAGTGG | 1196 0 2 | 5832 | 13.915822 | 17.475407 |
| AGAAGGGCTGGCAGGAGTT | 1197 0 2 | 26652 | 14.563484 | 25.132761 |
| GAAGTTTGAAGCCTGTTGTTCA | 1198 1 0 | | | |
| GCTTTATCCGCTTGACCCTTAC | 1199 0 1 | 3616 | 4.4118524 | 13.271925 |
| TCGCCCAGCTCATCTCCCACAA | 1200 0 1 | 2703.5 | 5.3652906 | 1.3689227 |
| GAGGCGGAGGTTGCAGTGAGCT | 1201 0 2 | 4226 | 9.1032648 | 13.02844 |
| GCTTGGCCCATTGATCAGCTGG | 1202 0 1 | 5906.5 | 8.7156487 | -2.7078445 |
| GCCCTGGGCAAGGTTCTGGCCA | 1203 0 1 | 2714 | 4.0351701 | -0.23995513 |
| CTGGGAGGCGGAGCTTGCAGTG | 1204 0 1 | 2035.5 | 5.6867909 | 7.8000135 |
| AAAGCCTCCCAGGTTATGAGTA | 1205 0 1 | 2572 | 5.2848206 | 7.2430992 |
| GCACTGCTGCCTCCTGG | 1206 0 1 | 2627 | 5.5307322 | 7.414557 |
| GACCTTGTGATCCACCTGCCTT | 1207 0 2 | 9694.5 | 12.58271 | 17.013798 |
| CCCGGGAGGCAGAGGTTGCAGT | 1208 0 1 | 1794 | 5.9571199 | 9.9902372 |
| TGGCCTTGGCCGTGCTGGGGTC | 1209 0 1 | 5712 | 4.9820457 | -0.35016832 |
| GAGGCCTGGGCAAGGGGGTCTG | 1210 0 1 | 3266 | 5.8565254 | 9.1992407 |
| CCAGAAAAATCCTCCCTTGTCC | 1211 0 1 | 3211.5 | 5.2451043 | 8.3984203 |
| GCTCCCACTGCTGTCCTGCCAT | 1212 0 1 | 9433 | 17.716768 | 1.6475885 |
| GGCCGGGTGCTCTGGAGGTGCT | 1213 0 2 | 14393 | 11.734104 | 12.172738 |
| GGCTGGTTAGATTTGTGGTCTT | 1214 0 2 | 21258 | 33.569485 | 15.757149 |
| CTGAGGCAGGAGAGTTGCTTGA | 1215 0 1 | 1306.5 | 5.4962068 | -1.4525892 |
| TCCCGTCTTGCTGTTGTCTGCG | 1216 0 2 | 9875 | 9.1909533 | 2.2802107 |

-continued

| | | | | | |
|---|---|---|---|---|---|
| GGTGTCAGACTTTGCATATCCT | 1217 | 0 2 | 1808 | 6.4814534 | 9.6383839 |
| CTCACTGCAAGCTCTGCCTCCC | 1218 | 0 2 | 26494.5 | 19.073179 | 16.964733 |
| CTGCTCTGCTGATCAGTGTCTC | 1219 | 0 1 | 4736 | 4.4964242 | 11.948936 |
| GGAATGGTGGTTGTATGGTTG | 1220 | 1 0 | | | |
| TGATATGTCCCTCGACATCAGG | 1221 | 0 1 | 1273.5 | 4.8226123 | 7.3988724 |
| TTGTCTTTTGTGGGAAATATGG | 1222 | 0 1 | 1686 | 8.4781733 | 1.0731497 |
| CACCATGCCTGGCTAATTTTTT | 1223 | 0 1 | 4149 | 5.579587 | 14.67128 |
| CCGAGGCTGGAGTGCAGTGGCG | 1224 | 0 1 | 1129 | 4.6293564 | 7.4294724 |
| CAGGAGCTCAGATGACATCTCA | 1225 | 0 1 | 1856 | 4.9010544 | 10.314 |
| GACCTCGTGATCTGCCAGCCTT | 1226 | 0 2 | 4406.5 | 24.777288 | 14.546185 |
| CTCTCCTTGGCCACCTCCATGA | 1227 | 0 2 | 23276 | 9.521204 | 7.0737572 |
| CCTGGCCGCTGTGCCCCCT | 1228 | 0 2 | 40002 | 11.873036 | 10.703612 |
| AGGTGCTCTGTGTATGCATAGA | 1229 | 0 2 | 11593 | 19.340197 | 19.182079 |
| AGTCGGAAGCTGTGCGTAAATC | 1230 | 0 1 | 1043 | 4.256711 | 6.0202398 |
| TGTCTGATCATGAGGCAGGGCT | 1231 | 0 1 | 4775.5 | 4.5141959 | -2.3209548 |
| GCCCGCGGCCCGGGGTG | 1232 | 0 2 | 9597 | 6.2839761 | 20.307545 |
| CTCACTGCAAGCTCCGCCTCCC | 1233 | 0 2 | 25071 | 20.895596 | 18.134468 |
| CTTGGAGTAGGTCATTGGGTGG | 1234 | 0 2 | 51071 | 16.39068 | 33.942337 |
| TCAGCCAGCCAGCTACAGGCTT | 1235 | 0 1 | 1054 | 5.2848206 | 1.757583 |
| CATTCTGTGAGCTGCTGGCTTT | 1236 | 0 2 | 6884 | 11.220102 | 9.6062307 |
| TGCCTCCCTGGCAAGTCTCTCC | 1237 | 0 1 | 4529 | 4.4007978 | 9.8346052 |
| CAGCCCGCCCTGAACTTTCGGG | 1238 | 0 1 | 2994 | 5.1533017 | 10.540549 |
| CTTCCTCCTCCATCTCGAAGGC | 1239 | 0 1 | 2834 | 4.6479778 | 8.16576 |
| CTGTGCTCCCTCTGGCGCCCCG | 1240 | 0 2 | 7554.5 | 6.8389502 | 13.825434 |
| ACATGATTGTCTGGCTTGGCCA | 1241 | 0 1 | 4115 | 4.3157549 | -0.68419188 |
| ACTATAGATGCTGGCGAGGCTG | 1242 | 0 2 | 1628 | 7.8868184 | 9.2165308 |
| TGGCTCATTTCTAAACCCAGCT | 1243 | 0 1 | 3232 | 5.0716186 | 3.3175437 |
| GTGCTTAAAGAATGGCTGTCCG | 1244 | 0 2 | 3362 | 12.66304 | 13.195816 |
| GGACAGCCGAGTGGCCTTCTCC | 1245 | 0 1 | 2573 | 4.0717006 | 6.836751 |
| GGAGTGCAATGGCGTGATCTCA | 1246 | 0 1 | 1123 | 4.2392659 | 5.4389768 |
| CCCTGCATCCAAAGGCCTCCTC | 1247 | 0 1 | 4119.5 | 8.5837584 | -4.0344296 |
| CTCAGGTGATCCACCCCTCTTG | 1248 | 0 2 | 8190 | 8.7424583 | 3.9819176 |
| ACTGCAACCTCCGCCTGCCAGG | 1249 | 0 2 | 24273 | 17.594145 | 15.796898 |
| GCTGCACTTCAGCCTGGGTGTC | 1250 | 0 2 | 5310 | 7.5533419 | 15.940791 |
| GCAGGTGGATCACCTGAGGTCA | 1251 | 0 2 | 1573.5 | 6.542747 | 9.5370836 |
| GGCCCTGGCAGCCACGAAAGCC | 1252 | 0 1 | 2349 | 4.256711 | 8.8494081 |
| TCAGTGACTCCTTCTTCCTGCT | 1253 | 0 1 | 2889 | 5.3898416 | -3.7892516 |
| CGAGGCCTCCTCGCCGCCACCG | 1254 | 0 1 | 2917 | 4.3228712 | -0.75868702 |
| TGGTGGCTCACACCTGTAATCC | 1255 | 0 2 | 5307 | 8.9909515 | 17.038876 |
| TGATCTCGTGATCTACCCGCCT | 1256 | 0 1 | 1982 | 5.9927278 | 6.810081 |

-continued

| | | | | | |
|---|---|---|---|---|---|
| GCTCACTGCAAGCTCCGCCTCC | 1257 | 0 2 | 20232.5 | 20.168652 | 18.056574 |
| CACTGCACTCCAGCCCGAGCAA | 1258 | 1 0 | | | |
| CAGTGCACGGGCCAGTCCTGCC | 1259 | 0 2 | 2112 | 9.479496 | 10.392011 |
| ATCCTCCAGCTCCTGCTTCTGC | 1260 | 0 1 | 3174 | 4.2183352 | 2.8458629 |
| ATGCCACTGCACTTCAGCCTGG | 1261 | 0 2 | 37857.5 | 13.168159 | 31.471567 |
| CATTGCACTCCAGCCTAGGCAA | 1262 | 0 2 | 35413 | 18.971554 | 24.194717 |
| CGTTCAGCGGGCTGGCCGTGGA | 1263 | 0 2 | 65518 | 10.117671 | 31.213285 |
| AGCCCTCTTCCAGCCAGCACAG | 1264 | 0 1 | 6035 | 10.519875 | 0.3822628 |
| GTGTGTCTCCCAAGAAGGCCCA | 1265 | 0 1 | 3536 | 4.6024246 | 8.0168934 |
| TCCTTTCTCCCTCATCTT | 1266 | 0 1 | 2966 | 4.4738102 | 11.3113 |
| GGCCCAGGCTGGAGTGCAGTGG | 1267 | 0 2 | 12915 | 16.751265 | 19.536619 |
| TCGCACCATTGCACTCCAGCCA | 1268 | 0 2 | 3636 | 8.0997972 | 12.774747 |
| CCTCAAGTGCCTCCTGCTGCT | 1269 | 0 2 | 5375 | 12.938377 | 9.593914 |
| GGGAAATAATTAATGTGAAGTC | 1270 | 1 0 | | | |
| GAGGTGGGCGGATCACAAGGTC | 1271 | 0 1 | 2041 | 5.9412212 | 9.3532887 |
| TTGACATGCCTCCTACATGATC | 1272 | 0 2 | 5065 | 12.953059 | 10.809283 |
| ATTGCACTCCAGCCTGGGGGAC | 1273 | 0 2 | 27662 | 16.315468 | 27.849897 |
| CTCTGGACCCTCCTGCTGAGAG | 1274 | 0 1 | 3192 | 5.8815751 | 12.393508 |
| TTGGAATGCACACTGAGCCTGC | 1275 | 0 1 | 1641 | 5.4196582 | 4.3278909 |
| CCATGAATTCACTCCATGCTAG | 1276 | 0 1 | 1780.5 | 5.4047599 | 0.20065525 |
| TCCTTCACTCCCTCTGCATCCA | 1277 | 0 1 | 3533.5 | 5.2938275 | 8.4558067 |
| CCACTGAGGTAGCTGGTGACTG | 1278 | 0 2 | 2861 | 16.719574 | 7.8953633 |
| TGTCTCTTTTCAAGCTACCCTT | 1279 | 0 1 | 1480.5 | 8.1952085 | -1.8686998 |
| CGATGGTATCGGCCAGCCCCGG | 1280 | 0 2 | 1767 | 8.5116291 | 3.1429348 |
| CACCTTGTGATCCACCCGCCTT | 1281 | 0 1 | 2139 | 5.5668392 | 4.7121377 |
| CTGAGCTCAAGCGATCCTCCCA | 1282 | 0 1 | 1617 | 4.0809031 | 1.5567338 |
| AGGGTTGTGTGCTGGCCGCTGG | 1283 | 0 2 | 65518 | 29.01285 | 32.102142 |
| AGATTTCCCTTCCTGCTTGCCT | 1284 | 0 2 | 5251 | 6.0291886 | 13.065763 |
| ACACAGAGCCAAACCATATCAC | 1285 | 0 1 | 1680 | 5.9849868 | -1.285585 |
| TCTCAACAGTGCAAGCTGCTCC | 1286 | 0 1 | 4000 | 14.71687 | -15.406388 |
| TCTGGAGGGAAGCACTTTCTGT | 1287 | 0 2 | 10399 | 6.8974981 | 22.211288 |
| TGTCTCCTCGGCTGTCCAGCCA | 1288 | 0 1 | 6736 | 5.2501798 | 5.3288264 |
| CAGAGCCCCTCGTCTCCACCAC | 1289 | 0 1 | 2694 | 5.538096 | 0.54361749 |
| TGCTTGCTGTGGTTGGCTGGTA | 1290 | 0 2 | 6974 | 21.75724 | 11.332961 |
| TCCAGTCGGATAACTAGACGGT | 1291 | 0 2 | 1198 | 8.0100813 | 7.3187399 |
| ACTTGCTGGCTCCTTGCTTCTA | 1292 | 0 2 | 8816 | 12.372648 | 16.758364 |
| ACTGCACTCCAGCCTGGGCTAC | 1293 | 1 0 | | | |
| CTGAGCAGATGACCAGCCCCAG | 1294 | 0 2 | 3552 | 7.8454118 | 5.6452436 |
| GGTATATGGGCCTCACTTG | 1295 | 0 1 | 716 | 4.1230264 | 3.7952623 |
| GGCCGTGGTCGCTGACTCTCGT | 1296 | 0 2 | 4980 | 6.9448657 | 12.094063 |

-continued

| | | | | | |
|---|---|---|---|---|---|
| TCCTTCAGCCTCCCAGCTCAAA | 1297 | 0 2 | 3775 | 7.1473608 | 4.387816 |
| GCCTTGGTGGTTTTGGTAGT | 1298 | 0 2 | 10696 | 15.110422 | 8.3110876 |
| GTTCAAGACCAGCCTGGCCAAC | 1299 | 0 2 | 16360 | 17.522753 | 9.7908163 |
| GGAGGCTGAGGCAGGCGGATCA | 1300 | 0 2 | 3046 | 8.4162111 | 8.6580906 |
| GAGGAGCCCCTCTGCC | 1301 | 0 2 | 2540 | 6.3185239 | 6.9227304 |
| GCAGCCATGTTCCCGTCTCAGCT | 1302 | 0 2 | 2992 | 8.4334011 | 13.142536 |
| CACTTCCCTTCTCTGCTCATGG | 1303 | 0 2 | 7886.5 | 7.3931818 | 7.7415953 |
| CTCTTCCTAGTGTGCAGCGTGG | 1304 | 0 2 | 4232 | 15.394135 | 7.1230512 |
| ACCAGCCTGGCCAACATGGCAA | 1305 | 0 2 | 8606 | 8.2232008 | 18.60726 |
| CCCTCTGCATACAGGCGAGGAG | 1306 | 0 1 | 1363 | 5.7277908 | -3.2187812 |
| GTGAGGCGAAGGTGCTGGCGCC | 1307 | 0 1 | 2222 | 5.5968246 | 2.6594312 |
| ACTGGGGACTCTGGCCTTTTGA | 1308 | 0 2 | 15830 | 9.3586321 | 14.166217 |
| GATTACTGGTATTTGCTGGCTCC | 1309 | 0 2 | 13394 | 25.892035 | 5.407784 |
| AGCTGGTGCTCGGGGAGCTGGC | 1310 | 0 2 | 65518 | 21.547987 | 16.272154 |
| TCTCTATGCCATGCTGGCCT | 1311 | 0 2 | 6926 | 17.665062 | 2.5852687 |
| GCAGGGAACTGGCTGGGCTTTC | 1312 | 0 1 | 9142.5 | 5.9037857 | 16.801399 |
| TTTGGCTTCTCCTACCACCTCT | 1313 | 0 1 | 4981 | 5.5610046 | 7.3423386 |
| GACCTTGTGATCCGCCCGCCTT | 1314 | 0 2 | 7757.5 | 11.425945 | 12.53443 |
| AAACTGCTTCCTTGGCCT | 1315 | 0 1 | 7436 | 5.6282043 | 5.6413546 |
| TGCCTGCCGTTAAATGTTACTT | 1316 | 0 2 | 3936 | 12.749383 | 11.509386 |
| TCAGGTGCCTTGGCTAATTGTT | 1317 | 0 1 | 4158 | 4.3205009 | 12.139079 |
| GGCGCTGGCCTGTGGGATCCCG | 1318 | 0 2 | 65518 | 24.841112 | 31.449797 |
| GGCTCACTACAACCTCCGCCTT | 1319 | 0 2 | 14771.5 | 14.710124 | 15.748096 |
| TCCACCAAGCCGGGGCCACTTC | 1320 | 0 1 | 2648.5 | 4.7161036 | 4.8864894 |
| CTCACTGCAAGCTCAGCCTCCC | 1321 | 0 2 | 6344 | 15.211771 | 11.712019 |
| CCCAGGTTGGCCTACAGA | 1322 | 0 1 | 5095.5 | 4.6688876 | 17.382532 |
| GACCCCTAAACCCGCTGGGCTG | 1323 | 0 2 | 30088.5 | 13.552105 | 6.4749699 |
| TGCACCACTGCATTCCAGCCTG | 1324 | 0 2 | 41028 | 15.563788 | 31.684296 |
| CCCGGGAGGCGGAGGTTGCAGT | 1325 | 0 2 | 3131.5 | 7.7846441 | 13.396295 |
| GCTGGCCACAGATCCCCAGGGA | 1326 | 0 1 | 10408 | 25.43759 | -5.445076 |
| GGGAAGCTGGTCACCCACAGGC | 1327 | 0 2 | 12450 | 11.913556 | 20.388573 |
| AGGOAGAGAGGACCAGAGACT | 1328 | 1 0 | | | |
| AAAGTGCTTCCTTTTAGAGGCT | 1329 | 0 2 | 7504 | 6.1279302 | 9.924984 |
| AGCCCAGGCTGGAGTGCAGTGG | 1330 | 0 2 | 12054.5 | 14.262013 | 20.370312 |
| CTCCTCTTTAGCCCCAGCTGGA | 1331 | 0 1 | 1799 | 4.2898717 | 8.4259157 |
| GCAAAAAGTAGTGCTGGTTAGG | 1332 | 0 2 | 9711 | 21.974758 | 16.433075 |
| CAGGGATGGCGCTGGCTGCCCG | 1333 | 0 1 | 7317 | 5.4272056 | 19.166769 |
| CCTCCGGTCATTGTGCGGGCCT | 1334 | 0 2 | 2835 | 7.0583911 | 5.132216 |
| ACTCACTGCAACCTCCACCTCC | 1335 | 1 0 | | | |
| GGGGTGCGGGCCCCATCTGGCT | 1336 | 0 1 | 49070 | 17.152702 | -0.3207902 |

-continued

| | | | | |
|---|---|---|---|---|
| CAGCCCCACACGGTCTAGCTCT | 1337 0 1 | 11400 | 8.6508255 | -0.19845468 |
| ATGCCACTTCATTCCAGCCTCG | 1338 0 2 | 2970 | 6.3867145 | 3.6728451 |
| AGATGGGGTTTCATCATGTTGG | 1339 0 2 | 4401.5 | 10.491898 | 11.499362 |
| GTGGTGTTTGAGCTGCCAGGGA | 1340 0 1 | 2963 | 4.502933 | 8.8193016 |
| GCGCTCTCTTCTCCTGGCCCGC | 1341 0 2 | 65518 | 10.953011 | 12.865757 |
| CACTGCAACCTCTGCCTCCCAGG | 1342 0 2 | 34808 | 18.792194 | 12.987083 |
| GCCTCCTGAGTAGCTGGGATTG | 1343 0 2 | 7261 | 10.548355 | 12.900331 |
| CTTTAATTGTAGCTCCCATAAT | 1344 0 1 | 3034.5 | 4.9478436 | 10.275362 |
| AACCCAGGCTGGAGTGCAGTGG | 1345 0 2 | 5616 | 13.703417 | 16.740423 |
| TCAAGCAATTCTCCTGCCTCAG | 1346 0 2 | 22552 | 20.397219 | 19.767324 |
| ACAGTCCAGCCTAGTATGTATA | 1347 0 1 | 1760 | 5.992043 | 1.5357794 |
| TCAGGAGGCGGAGGTTGCAGTG | 1348 0 2 | 2550 | 6.5481095 | 12.094613 |
| AATGGTCTCTTTGTTCCCTGCT | 1349 0 2 | 9183 | 7.6419687 | 3.2526188 |
| GGCCGTCCCTAGAGATGGGGTT | 1350 0 2 | 11689.5 | 8.4446125 | 7.2657032 |
| ATCCTAGAATCAGCCCTTGCTG | 1351 0 1 | 2772 | 6.7080827 | -0.69137686 |
| GGAAGCTCTGCCTAGATTTCAG | 1352 0 2 | 7993 | 8.3658886 | 4.2364674 |
| CTGGGAGGCAGAGGTTGTAGTG | 1353 0 1 | 1370 | 4.1524282 | 5.7353191 |
| GTCCCAAACTCCTGACCTCAGG | 1354 0 1 | 1638 | 4.5023069 | 7.1563048 |
| TGGCGCGACGTGCCCCCTGCTT | 1355 0 1 | 2537.5 | 5.5675011 | 1.0830367 |
| GGCGTGGGCGAGGTGCTCTATC | 1356 0 2 | 1796 | 7.1220169 | 4.9086099 |
| CTCGGGCACCCTGGTTCTGGTG | 1357 0 2 | 65518 | 11.238881 | 23.126007 |
| ATGGGCTGTCCATTGCTGGCTG | 1358 0 1 | 4362 | 7.0200324 | -1.9789392 |
| TGAGCTTCCCTCCTGCACTACA | 1359 0 1 | 2569 | 4.6559782 | 11.27425 |
| CCCGGCACCTCCGCTGCACAC | 1360 0 2 | 50589.5 | 16.062937 | 10.848449 |
| GTGGGCATCACCAGGGCCTCCA | 1361 0 1 | 1305 | 4.6559782 | 1.3485987 |
| GAACCCTAGCATGTCCTTTAGG | 1362 0 1 | 783.5 | 5.8142152 | 4.4672356 |
| AGGGCAGGAGGTCCGTCCCTTC | 1363 1 0 | | | |
| AGGGCAGAGCGTTTCCTGCCCC | 1364 0 1 | 1099 | 5.4493914 | 0.13351524 |
| GCTTGGCTTTACTAGGGGACA | 1365 0 1 | 3943.5 | 4.974093 | 8.3365431 |
| CATGAAATTGTATTGGCCTCAA | 1366 0 1 | 1209 | 6.4949188 | 1.5365099 |
| CACTGCACTCCAGCCTGGGCCA | 1367 0 2 | 65518 | 31.247635 | 27.744917 |
| ATCTGAGCTCCGCCTCCTGTCA | 1368 0 2 | 3672 | 6.5016451 | 12.313261 |
| TCTGCCTTTTACTAGCTGGATG | 1369 0 2 | 12954 | 6.649405 | 9.6133747 |
| ATGGGTTCAAGTGATTCTCCTG | 1370 0 2 | 3260 | 9.7943249 | 13.811167 |
| CATGTGTCTTGCTGCCCTCCAT | 1371 0 2 | 11157 | 17.133692 | 10.310522 |
| GCCTCCTGTCCCAGGCTGAGGA | 1372 0 1 | 2413.5 | 5.771091 | -1.0079587 |
| AGGACCTGTAATCCCAGCACTT | 1373 0 1 | 1119.5 | 4.0140038 | 5.6218853 |
| TTCAAGTGTTTAAGTTCTGCTT | 1374 1 0 | | | |
| CTGCCCCAGCCTGGGCTTCGA | 1375 0 1 | 1502 | 5.1329703 | 2.1353233 |
| AGCTCCTGGCTTCAAGCAATCC | 1376 0 2 | 14107 | 10.339123 | 18.669428 |

-continued

| | | | | |
|---|---|---|---|---|
| TGGCCCACCCGTTGA | 1377 0 2 | 3982 | 17.579905 | 15.494586 |
| AGTCCGTCCTGTCAAGCAGCTG | 1378 0 2 | 19706 | 7.5470443 | 26.932724 |
| CCGGGGTAGGCCCTGAGGCAGC | 1379 0 1 | 4622.5 | 6.3919153 | -2.5578749 |
| ATGCCACTGCGCTCTAGCCTGG | 1380 0 2 | 12177 | 8.2681303 | 19.851286 |
| CATTATTCTCAGTTCTGTGCAG | 1381 0 2 | 11732.5 | 27.869678 | 16.957344 |
| CACCCGCTGGTCCCTGCAGTTC | 1382 0 2 | 20816 | 8.5344362 | 27.261486 |
| TACTGCACTCCAGCCTGGGTGA | 1383 0 2 | 65518 | 22.371189 | 36.002476 |
| GTGGCCCAGGCTGGAGTGCAGT | 1384 0 2 | 14037 | 16.79743 | 18.340912 |
| TCACTCAGGCTGGAGTGCAGTG | 1385 0 2 | 2427 | 8.9816837 | 12.445157 |
| TACCACCATTTGCCTGCTGTAT | 1386 0 1 | 2224 | 5.3224468 | 6.6427116 |
| GCCCTCCAGCCTGTGGAACCGG | 1387 0 2 | 2293 | 7.0838871 | 2.9603255 |
| CGCCCAGGCTGGAGTGCCAGTG | 1388 0 2 | 4722 | 9.6376123 | 13.758563 |
| ATGGTGCTGGTGGGAGTGTATT | 1389 0 2 | 4053 | 18.971554 | 14.625937 |
| CCAAAGTGCTGGGATTACAGGT | 1390 0 1 | 2646 | 5.0643582 | 9.7789927 |
| AGCGGCTGGCGGAGGACACG | 1391 0 1 | 8764.5 | 5.8134389 | 21.684513 |
| ATGCCACTGCACTCCAGCCTGG | 1392 0 2 | 65518 | 26.690199 | 28.459244 |
| CCTTTGATTTCCCCCGTCTCAG | 1393 0 1 | 2348 | 4.8108587 | 4.7235146 |
| GGGTTACTCTGTGTTGGTCAGG | 1394 0 2 | 7310 | 8.6937799 | 12.815997 |
| GCCCATAGTCTCTTTCTTTCTT | 1395 0 1 | 1838 | 6.1946688 | -2.755475 |
| ATTGCACTCCAGCCTGAGCAAA | 1396 0 2 | 46579 | 22.505102 | 33.557095 |
| CACTGCACCCTCAAACTCCTGG | 1397 0 1 | 6945.5 | 5.9455066 | 1.1890075 |
| TCCCATGGGGCCAGCCGCCATC | 1398 0 2 | 3581 | 15.749751 | 10.859034 |
| CACTGCACTCCAGCCTGGGCGA | 1399 0 2 | 65518 | 30.700432 | 26.58386 |
| GGGGTCTTGGAACAGGTGGCCCT | 1400 0 1 | 1856 | 5.8500195 | -1.9162606E-2 |
| CACTGCAGCCTCAAATTCCTGG | 1401 0 1 | 4509 | 5.5284224 | 3.5514677 |
| TGCAGGCTCTTGGTGACGTGGG | 1402 0 2 | 2639.5 | 6.3321967 | 6.947082 |
| GGTGGCCCCTGGGAGATGCTGG | 1403 0 2 | 65518 | 31.295538 | 14.111359 |
| AACCAAGCCAGCCAGCCTCTC | 1404 0 2 | 4971 | 17.613102 | 15.532504 |
| GCCCAGGCTGGAGTTCAGTGGT | 1405 0 2 | 1573.5 | 6.542747 | 8.0195217 |
| AGCCTGCGATCCCACCTGGCCT | 1406 0 2 | 20991 | 9.0031242 | 4.5749111 |
| TAACCTCTCTGTGCCTCAGTTT | 1407 0 1 | 4997.5 | 5.1691394 | 10.657457 |
| TAGCATGGCTCTATGGAACA | 1408 0 2 | 1393 | 10.196934 | 8.9662762 |
| CTGGCCTATCATAAGCATTTT | 1409 0 1 | 65516 | 13.391268 | 1.4583727 |
| CAGCCTGGTCCCCGGCTCACCC | 1410 0 1 | 3234 | 4.2474666 | 6.4346752 |
| GCCCAGGCTGGAGTGCAGTGGC | 1411 0 2 | 24154 | 17.516109 | 26.539131 |
| CCAGGCTGGAGTGCAATGGCAT | 1412 0 2 | 2590.5 | 6.1812749 | 11.923506 |
| CACTGCAATCTCTGCCTCCTGGG | 1413 0 2 | 27656.5 | 19.716053 | 17.422838 |
| TGCCTCAAGCCCTCCACTGCAC | 1414 0 2 | 6112 | 10.263255 | 7.5186887 |
| GACCCATCCTCCACTTGGCAGC | 1415 0 2 | 2498 | 6.505065 | 6.8388047 |
| AACCACCATTCTCTCCTCTTCC | 1416 0 1 | 2979 | 4.7405486 | 1.3000224 |

-continued

| | | | | | |
|---|---|---|---|---|---|
| TTCCATTTGGAGCTCGCAGCCT | 1417 | 0 1 | 5965 | 4.9900851 | 14.792343 |
| AAGGTTCCTCTCTCCACCCAGC | 1418 | 0 1 | 2925 | 4.0868788 | 6.821908 |
| CTCCTGGGAAAGGCTGGACACA | 1419 | 0 1 | 2176 | 4.3887382 | 5.3727546 |
| ACTGCACTCCAGCCTGGGCACA | 1420 | 0 2 | 65518 | 31.833015 | 34.428837 |
| TCACCAGCTCTGCCTCGCCAGT | 1421 | 0 2 | 10572 | 6.2146297 | 17.905064 |
| GTTGCCTAGGCTGGAGTGCAGT | 1422 | 0 2 | 3942 | 8.7036104 | 9.8695612 |
| TGCCTGGCCTCTTCAGCACTTC | 1423 | 0 2 | 27021 | 10.873885 | 26.68429 |
| CCCTGCCAGCTCCCAGCA | 1424 | 0 1 | 2367.5 | 5.8455133 | 7.8306561 |
| GAGGCCTCAGCCTGCCCTGAAC | 1425 | 0 1 | 1470.5 | 7.0200324 | -0.58433282 |
| TCACTGCAAGCTCAGCCTCCCG | 1426 | 0 2 | 6757.5 | 12.953059 | 11.945885 |
| TCCAGGCCCTCAATCCATTTCCA | 1427 | 0 2 | 8934.5 | 13.815792 | 9.5553522 |
| AAAAGCAATTGCGGGTTTTGCC | 1428 | 0 2 | 4663 | 15.116411 | 4.7130346 |
| TCCTCAGAATCACCTGGCAGCT | 1429 | 0 2 | 2574 | 6.6020346 | 3.5169666 |
| GGGTTCAGTCCCTCTTGCTACT | 1430 | 0 1 | 3765.5 | 4.6101117 | 4.239377 |
| TAGTTTCATCTCCACCCTGCCC | 1431 | 0 1 | 2083 | 5.4642267 | 0.15956412 |
| GGGTCTCTGTTGGCTTCTT | 1432 | 0 2 | 11264.5 | 7.8554482 | 5.5741806 |
| GGGGAACGCGCTGGCCCGCGCC | 1433 | 0 2 | 7005 | 6.2445078 | 11.806351 |
| AGGCGGAAGATGGCCCCATAGA | 1434 | 0 2 | 1471.5 | 6.9170618 | 3.567507 |
| TCTCTTCGCTGGCCCTCGGGGA | 1435 | 0 2 | 47791.5 | 15.379544 | 20.008915 |
| TGCCCAGGGTGGAGTGCAGTGG | 1436 | 0 2 | 6671.5 | 10.579865 | 17.748798 |
| AATTGCTTGAACCCAGGAAGTGGA | 1437 | 1 0 | | | |
| GCACACGGCAGCCTCCTCCTGA | 1438 | 0 2 | 2910 | 8.0682802 | 10.311243 |
| CTCCTGCTTCACGGGCACCGCC | 1439 | 0 2 | 10401.5 | 13.127683 | 2.1750216 |
| CCCTTTAGCCCCTGCAGAGACT | 1440 | 0 1 | 39494 | 29.852627 | 0.54301858 |
| TATTGAGACCAGTGCTTGCTTA | 1441 | 0 2 | 1212.5 | 10.770452 | 7.2894559 |
| TCGCCCAGGCTGGAAGTGCAGT | 1442 | 0 2 | 2518 | 8.9316044 | 12.591391 |
| GCTCTGCCAGCCCAAGGCGCAG | 1443 | 0 1 | 5831.5 | 4.9416537 | 10.837112 |
| GGAGGCGGAGGTTGCAGTGAGC | 1444 | 0 2 | 3959.5 | 10.600774 | 13.769753 |
| CCCTCACTCCTGCCGGG | 1445 | 0 1 | 5527 | 5.4066739 | -0.32305354 |
| GCCCCTGCCTTTGAACCTGGAG | 1446 | 0 2 | 9052 | 20.457079 | 3.550808 |
| TTCTCCAGTGCGGTAGCCAT | 1447 | 0 1 | 2372 | 15.630626 | 0.20187679 |
| GCTCCTTTATTTTCTCTCGTGT | 1448 | 0 1 | 2092 | 4.9322701 | 6.8224359 |
| CATTCTCAGTATCAGCCAGCCC | 1449 | 0 1 | 2579 | 12.640401 | 1.6748168 |
| TAGCAGAAGTTGCAAACTAGGG | 1450 | 0 1 | 964.5 | 4.0301342 | 0.67141521 |
| CCAAGCAGAGCAGCCTCTCTGG | 1451 | 0 2 | 50138.5 | 17.876169 | 21.568254 |
| CTAGGCTGGAGTGCAGTGGCAC | 1452 | 0 2 | 2019.5 | 7.9472141 | 11.208291 |
| TTCCTGCGCCCTTCTCGCCCGC | 1453 | 0 1 | 6532 | 6.8755865 | -0.67481649 |
| CTGTGCTGGGTCCTTCTTTTGA | 1454 | 0 2 | 3805 | 10.533696 | 10.867439 |
| AGCTCACCACAACCTCCGCCTC | 1455 | 0 2 | 18085 | 14.695093 | 9.1603575 |
| AGTCTTCCCAGAGGAGGTGCCA | 1456 | 0 1 | 1153.5 | 6.3185239 | -1.0385203 |

-continued

| | | | | |
|---|---|---|---|---|
| GAGGCGGAGGTTGCAGTGAGCC | 1457 0 2 | 2617 | 7.804688 | 11.36616 |
| GCCCTCCTGAGCTAGCACGTGT | 1458 0 1 | 12521 | 12.908952 | -0.01282406 |
| CATTGCACACCAGCCTGGGCAA | 1459 0 2 | 65518 | 23.259714 | 27.904207 |
| AGTTCTCTTGCTTCAGCCTCCC | 1460 0 1 | 8418 | 8.3884401 | 1.3339518 |
| TCCAGCTGTCCACGTCTTCCTG | 1461 0 1 | 4070 | 5.0534353 | 4.2019873 |
| TGCCTGGCCTCCTGATTCCCTC | 1462 0 2 | 37634.5 | 13.004288 | 2.9085336 |
| GCCTCCAGGGATGATTCCTTCC | 1463 0 2 | 2862 | 10.98442 | 5.283977 |
| GTCCCTGAGCCTGGCATTTCCC | 1464 0 2 | 9774 | 6.3336153 | 2.3762388 |
| ACTGGCCAGCCAACAACAATAG | 1465 0 1 | 877 | 5.0408092 | -4.5819459 |
| GCTGGCTCCACCTGCTGCCAGG | 1466 0 2 | 2916 | 6.3332305 | 13.052609 |
| GCCCCAGCCTCCCGAGTAGCTG | 1467 0 1 | 2330 | 5.0814857 | 9.9303665 |
| TCCCAGCTCCTGGGCCCCACAG | 1468 0 1 | 5372.5 | 4.7662401 | 7.1915674 |
| CACTGCACTCCAGCCCGGGCAA | 1469 0 2 | 65046 | 15.988069 | 31.551188 |
| TGACCTCATGATCCGCCCACCTC | 1470 0 2 | 11003 | 34.517956 | 15.899262 |
| GGCCGCTCTCCGGTGTGGATCT | 1471 0 2 | 13720 | 8.10710811 | 8.136568 |
| CTAAATGCCCCTTCTGGCACAG | 1472 0 2 | 63453 | 11.163343 | 20.293009 |
| TCACTGCAACCTCTGCCTGCCA | 1473 0 2 | 25898 | 18.696442 | 17.538256 |
| CCGGTGTTCAAAGTCTGGTATG | 1474 0 2 | 6055 | 6.6824059 | 12.060349 |
| CACCCAGGCTGGAATGCAGTGG | 1475 0 2 | 3367 | 10.824119 | 13.172818 |
| CACCCAGGCTGGAGTGCAGTGA | 1476 0 2 | 2243 | 8.5379591 | 11.457872 |
| TTCCATATCTGTTGCATATCAT | 1477 0 1 | 1059 | 4.0724583 | 4.4120793 |
| CCACTGCACTTCAGCCTGGGTG | 1478 0 2 | 61492.5 | 17.94875 | 20.821732 |
| GCCAAATAAGTGTCCGGCCCTC | 1479 0 1 | 5930 | 10.101467 | 3.6227588E-2 |
| GCCCGCGCCAGCCTCTCCATCT | 1480 0 2 | 3281 | 7.5448685 | 10.447037 |
| CATTGCACTCCAGCCTTGGCAA | 1481 0 2 | 16173.5 | 8.520524 | 19.366573 |
| TGATAGATCCATATTTTGGTAA | 1482 1 0 | | | |
| TGCTCGCCCCACATGCCCTCAT | 1483 0 2 | 5021 | 8.3489428 | 2.7518404 |
| TGCCTGCCCCAGCTGAGATATC | 1484 0 2 | 5686 | 10.380668 | 15.221783 |
| TCACTGCAACCTCTGCCTCTTG | 1485 0 2 | 48652.5 | 22.205072 | 18.44136 |
| TGGAGGAGAGTTTGTCAGTATAG | 1486 1 0 | | | |
| CCCAGGCTGGAGTGCAGTGGCG | 1487 0 2 | 5921 | 13.471205 | 18.407236 |
| CACCCAGGCTGGAGAGCAGTGG | 1488 0 2 | 2370 | 8.847928 | 11.617569 |
| TCTGCACCATCGTATGCTTAAT | 1489 0 1 | 3861 | 4.0593572 | 6.2677927 |
| CTCTGAGCTGCCTTTTGAGCTT | 1490 0 1 | 1602.5 | 4.3898053 | 5.8146801 |
| TCCCGCCCTTGTACTTGCCGAG | 1491 0 1 | 5151.5 | 5.9488397 | 7.757297 |
| CGCCCAGGCTGGAGAGCAGTGG | 1492 0 1 | 1602.5 | 5.2608914 | 6.5835171 |
| GGTGGCTATGGCTGTGCTCGC | 1493 0 2 | 3426.5 | 15.917648 | 2.9563422 |
| CCTAGAGCCGCACCTCCTCCAC | 1494 0 1 | 2369 | 5.835712 | 4.0593348 |
| GCCTCCCCAAGCAGCAGGGATT | 1495 0 2 | 2657 | 6.1669488 | 6.5350518 |
| AGAAAGTGCTTCCCTTTGGTGA | 1496 0 1 | 4890.5 | 5.1180902 | 15.543441 |

-continued

| | | | | | |
|---|---|---|---|---|---|
| ACCCTGGCCGACTGCCCCTT | 1497 | 0 2 | 35652 | 12.982363 | 11.41268 |
| TGCTGCACCCTCTGCCTCCGGG | 1498 | 0 2 | 6094.5 | 6.9428978 | 10.588869 |
| CAGGAGGTTGAGGGTGCAGTGA | 1499 | 0 1 | 1559 | 5.1060648 | 7.4941492 |
| TGGGATGCTCAGGGCCTGGAGC | 1500 | 0 1 | 1824 | 8.0682802 | 0.78988832 |
| TGCTCTGATTTTTGCCCCAGC | 1501 | 0 2 | 7060.5 | 10.413313 | 7.7476549 |
| CGTCTGGCTTCTCCACGGTAAA | 1502 | 0 1 | 8462 | 5.8395977 | 11.586881 |
| TGTCATAGTGTGGTAGCAGTGG | 1503 | 0 1 | 2076.5 | 12.082075 | -3.4609232 |
| TGTGGTAGTCACGGCCCGCCAC | 1504 | 0 2 | 5909.5 | 23.027369 | 15.816967 |
| CTCTGCCTGTCTCATCCTGCAA | 1505 | 0 1 | 5028 | 4.6244407 | 0.84503251 |
| CATCTTTGCCCATCCACTTCCA | 1506 | 0 2 | 3944 | 14.688863 | 11.31537 |
| GGCTGGTGGCTGGTTCTGGACC | 1507 | 0 2 | 20736.5 | 31.680035 | 17.914019 |
| AGTGGTCTTAGCTTGCTGGGCT | 1508 | 0 1 | 2958 | 11.094181 | 1.2701284 |
| CCCCTGCTGTGCTTGCATGGCT | 1509 | 0 2 | 12605 | 18.076384 | 11.74684 |
| AGCCAGCCAGCAGGTATGC | 1510 | 0 2 | 2011 | 11.254579 | 11.186662 |
| GAGGCTGAGGCAGGAGGATCAC | 1511 | 0 2 | 13980 | 11.834332 | 23.254768 |
| ATGAGCACACTGATAAGCCCCT | 1512 | 0 1 | 3757 | 9.4285412 | -1.0390751 |
| AGTGCTATCGAGTTCTAATGCT | 1513 | 0 1 | 1529 | 11.816049 | -1.6991031 |
| CAGCCTGTAGTCTGGTCCAGGT | 1514 | 0 1 | 1863 | 5.1711364 | 10.847687 |
| CTGGCTCCTGTTTAACCAGCTG | 1515 | 0 2 | 2294 | 6.0272546 | 8.8361721 |
| GTCCCCTGTCCAGGGCCAGCCA | 1516 | 0 1 | 3915.5 | 9.6158686 | -3.1074336 |
| CTTGCCTGCCCTGTGTCATAAA | 1517 | 0 2 | 5903.5 | 11.970026 | 3.0393276 |
| TCCCGTAGGTTGCTGTAGTCGG | 1518 | 0 1 | 3606 | 5.655231 | 9.4085045 |
| GTTGGCCAGGCTGGTCTCAATC | 1519 | 0 1 | 2090 | 5.0410533 | -4.0856218 |
| TCTCCCAGATCCTTTAGCCTCC | 1520 | 0 2 | 7384.5 | 14.663905 | 2.166656 |
| GCCTCCTGGGGTGCCATCATCT | 1521 | 0 1 | 8207 | 11.668092 | 1.0917441 |
| ATCATTAACAGTGCAGGGGTAGG | 1522 | 0 2 | 1291 | 6.7080827 | 6.8988318 |
| TGGCCACCACCAATACTTGCCT | 1523 | 0 1 | 1777 | 4.5837574 | 0.96471441 |
| GGCCTCCCGGACCGCAGCGCC | 1524 | 0 1 | 1805 | 4.437829 | 2.6645198 |
| AGCCCAGGTCCAGTTCACTGCA | 1525 | 0 2 | 910.5 | 6.2636547 | 2.1727333 |
| TCCCCTCTTGGCTTGGTCCAGA | 1526 | 0 2 | 10285 | 8.0190945 | 16.142628 |
| CTGGCCTAGACAGACCCTGATC | 1527 | 0 1 | 24673.5 | 24.969994 | -5.0956011 |
| CCCTGGCTGCGTGATGGATGAA | 1528 | 0 1 | 3966 | 4.1167688 | 10.868774 |
| GTAGGCCATGGTGGTTGTCTCT | 1529 | 0 1 | 2289.5 | 4.7606225 | 9.7036562 |
| TGTGGCTCAGGCGGCTTCTCCT | 1530 | 0 1 | 7641 | 5.5752053 | 5.2592807 |
| TCCCTGTGTCCTGGGGGCACCT | 1531 | 0 1 | 3722 | 5.4018469 | 0.76068252 |
| ACCTGAGCTCCACCTCCTGCC | 1532 | 0 1 | 3490.5 | 5.5675011 | 2.1058514 |
| CCCAGCGAGTTTGCCGGTGAAC | 1533 | 0 1 | 1491.5 | 8.489337 | 0.20919423 |
| TTCAAAGGGAAAAGCAGGCTGG | 1534 | 0 1 | 7722 | 5.5424767 | 6.6963782 |
| CGGCCCCTCCTCTCGCGCC | 1535 | 0 2 | 4246 | 7.6359258 | 11.74948 |
| AAGTGATTCAGCCCCTCA | 1536 | 0 2 | 4389 | 9.3773403 | 14.014197 |

| | | | |
|---|---|---|---|
| GGCCTGGGCTCCGGGAGTTACT | 1537 01130.5 | 4.0424356 | -4.2492251 |
| CCTCGGCCGGAGAGCCAAGTGC | 1538 02066.5 | 16.716997 | 8.8393974 |
| TCTGTGCCTGCTTCCCCACCCA | 1539 04241 | 10.529091 | 6.8799772 |
| CTGCACTCCCGCCTGGGC | 1540 01228 | 7.6034174 | 5.8922038 |
| GCACTCCAGCCTGGGTAACAGC | 1541 65218 | 29.270939 | 27.328928 |
| CTGGAGCAGACAAAAGG | 1542 08594 | 11.848651 | 3.8546574 |
| CTCACTGCAACCTCTGCCTCCC | 1543 408422 | 21.955811 | 20.696438 |
| TGTGCCTAGTTCTGTATTTACA | 1544 02504.5 | 10.873516 | 8.0277433 |
| GGTTTTCACCTCCAGAATGTGC | 1545 02724 | 8.9372482 | 2.5630777 |
| CGTAAGTCACAGCGCCTGGCCC | 1546 308226 | 11.506068 | 25.787857 |
| CTCTGTGATATGGTTTGTAATA | 1547 06262 | 19.265455 | 13.692534 |
| TCTCCCCTGGTCTCGCGCGCTG | 1548 201244.5 | 8.1104021 | 2.3839858 |
| CACTGCAACCTCCACCTCCTGG | 1549 311293 | 19.150194 | 22.611071 |
| CTGGTAGCTCCTGAATATCCCT | 1550 02223 | 17.251909 | 5.7171526 |
| ATGCCTGTAATCCCAGCACTTT | 1551 08271 | 12.921462 | 20.372988 |
| ACAAAGCGCTTCTCTTTAGAGT | 1552 65218 | 11.238881 | 26.766436 |
| AATCGCTTGAACCCAGGAAGTG | 1553 1 0 | | |
| GGGCTTTTGGAATGGTCTGT | 1554 04263 | 9.6709318 | 2.0551727 |
| AGCAACTCTCACCTGGCTGC | 1555 07806.5 | 5.9086308 | 13.562915 |
| TGCCCTCTTTCTGTACAGCTCC | 1556 06233 | 10.524484 | 4.3130703 |
| TGGTTTTAGGGAATCAATCTAT | 1557 02404 | 5.3749018 | 0.52072495 |
| TTCCCACTGTGGCAGAGCCTCG | 1558 04253 | 8.5227718 | 8.7430191 |
| CGTGTAGCATGCGCCACCACCA | 1559 01152 | 4.372324 | -1.7681072 |
| TGCCTAGGCTGGAGTGTAGTGG | 1560 01960 | 5.1336985 | -5.655652 |
| TACTCTTTTAGCCCCACAGAGA | 1561 071208.5 | 14.535069 | 18.807434 |
| CAAATCCCTGCTCTGTGCTG | 1562 08854 | 4.0554743 | 15.468264 |
| CCAAGGTGGGAGGATTGCTTGA | 1563 65218 | 19.42584 | 35.754147 |
| CCAGACTGCTTGCTTCCCAGCC | 1564 104958 | 21.194012 | -0.46141499 |
| CTCTGCAAGTCCAGCCCCTGGC | 1565 04339 | 4.6901293 | -2.0411224 |
| TGTGAGACTTTCTTTGGCCTCT | 1566 02660 | 6.6352882 | 0.18635188 |
| CTCTGAGTCCTGCACTCACCCG | 1567 02770 | 6.7869315 | 1.284364 |
| ACTGCACTTTAGCCTGGGC | 1568 208268 | 11.638906 | 27.546202 |
| TCAGCCATTCCTTACCTTTC | 1569 03289 | 10.019641 | 3.658488 |
| TCACTGAAACCTCCACCTCTCG | 1570 043239.5 | 9.3257465 | 9.4827623 |
| AGATTTGGTGTCTGGTTGATAT | 1571 03906 | 5.6260681 | 15.079812 |
| CAGGCCTCTTACCCTCTCT | 1572 02175 | 4.1754398 | 3.2060738 |
| ACGCGCTGGGGCGCTGGCCAAT | 1576 531813.337035 0 | 9.5484018 | |
| CCTGTGGCGGGGCCAGTGCCT | 1574 02232.5 | 7.5204544 | 6.9828696 |
| CACTCAGCTGAGCCCTCAGCCC | 1575 03208 | 6.236114 | 7.0009232 |

-continued

| | | | | | |
|---|---|---|---|---|---|
| TCCCCCACTGTTTCTGCTAC | 1576 | 0 1 | 4143.5 | 4.8829288 | 1.3394566 |
| GCCTGTCCTCTTCCGCCTGTCT | 1577 | 0 1 | 14508 | 12.145576 | 1.6282115 |
| CCACCTGAGATAAGAGAGCTCA | 1578 | 0 1 | 1308 | 5.8285513 | 3.6287591 |
| CCAGGAGGCGGAGGTTGCAGTG | 1579 | 0 2 | 4649 | 9.3886547 | 16.137344 |
| TCACTGCAAGCTCCTCCTCCTG | 1580 | 0 2 | 12173.5 | 21.173698 | 8.2767439 |
| GTATTGCTTGAGCCCAGGAGTT | 1581 | 0 2 | 65518 | 20.541035 | 33.582275 |
| CCCTGGCTGATACCGGAAAGGC | 1582 | 0 2 | 9281 | 7.5079288 | 7.661869 |
| CTCACTGCAACCTCTGCCCCCA | 1583 | 0 2 | 39028 | 21.537285 | 22.098822 |
| CACCACTTTCTCCTTCTCCTTGG | 1584 | 0 1 | 3132 | 5.2580366 | 8.4857149 |
| AGGAGGGGTTCTCGGGTGCTGA | 1585 | 0 2 | 1395 | 7.4959846 | 3.0751243 |
| GTAGACCATTTATCTGGGGAGT | 1586 | 0 2 | 3261 | 18.415466 | 9.8317289 |
| TCTGCACCCCAGCCTGAGTGA | 1587 | 0 1 | 3009.5 | 5.033093 | 10.499595 |
| TGCCTAGGCTGGAGTGCAGTGA | 1588 | 0 2 | 2695 | 6.3287864 | 5.4875331 |
| CCTTTTATCCCCTAATTGGCCT | 1589 | 0 2 | 8596 | 19.616385 | 9.8835402 |
| AGAAAGTGCTTCCCTTTGGACT | 1590 | 0 2 | 11968 | 7.2289524 | 23.562014 |
| TTGTCACTGCACTCCAGTCTGG | 1591 | 0 2 | 12372.5 | 9.9857264 | 24.029345 |
| TTGCTCTTGAAAATTGATGCTG | 1592 | 0 1 | 18285 | 23.095486 | 0.6942786 |
| AAGCCAATGCTAGCCCACATGC | 1593 | 0 2 | 3477 | 8.0798817 | 10.92757 |
| TCTAATCCTATGGTGGGGAGGG | 1594 | 0 2 | 1947 | 8.5338745 | 6.3978777 |
| CGTGCCACTGCACTCCAGTCTG | 1595 | 0 2 | 29565 | 13.984879 | 26.717236 |
| CCACTGCACTCCAGCCTTGGCA | 1596 | 0 2 | 65518 | 19.59687 | 23.317396 |
| GGCGGAGCTTGCAGTGAGCCGA | 1597 | 0 1 | 1587 | 4.3907022 | 2.4575887 |
| AGCTGGAGATGAGTGACGTGCC | 1598 | 0 1 | 10661 | 16.698954 | 0.85748941 |
| TTTTGGTTGTTGGGTAAGAGTA | 1599 | 0 1 | 2392 | 4.963624 | 5.6073937 |
| TTGCCGCCGTCTGCTCGCCCCG | 1600 | 0 1 | 4152.5 | 4.4578457 | 2.1733229 |
| TGATGTGGCCCCACTTAGCTGT | 1601 | 0 1 | 2921.5 | 18.344973 | -1.1306779 |
| TGACCTCATGATCCGCCCACCT | 1602 | 0 2 | 7185 | 29.981552 | 13.353135 |
| GCCGTCCACCTCGATGGCCACT | 1603 | 0 1 | 4073 | 4.6692619 | -8.5749388 |
| GACAGGCTTCCACTATGTTGCC | 1604 | 0 1 | 1321 | 5.3749018 | 6.195621 |
| TACTGCACTCCAGCCTTGCCAA | 1605 | 0 2 | 18364 | 10.029301 | 16.731598 |
| CTCTGTAGAAAGAGCCCAGGTG | 1606 | 0 2 | 1166 | 10.625381 | 5.0621781 |
| TTCTTTTCTGAGCCTTG | 1607 | 0 1 | 3674.5 | 4.927527 | -1.7429894 |
| GACGAGAGACTCCATCCACCAC | 1608 | 0 2 | 1036 | 6.9557924 | 5.046813 |
| ATCTCAGCTCTGCCTCCTGGGT | 1609 | 0 2 | 8963 | 12.361974 | 12.799247 |
| CTGGAGGTGCTTCGCTGGCCAC | 1610 | 0 1 | 33822 | 24.215584 | -8.2400523E-2 |
| TTCCCTTAAATTATGGCATCTA | 1611 | 0 1 | 4395 | 7.3068743 | -0.26304191 |
| TTAGGCTTTGATTGGGGTGCT | 1612 | 0 1 | 1685.5 | 4.1420093 | 7.9094262 |
| CCCATTTCTTGAGTTCAGCTCT | 1613 | 0 2 | 3582 | 13.552105 | 2.9659367 |
| GAGGGGAGCCCCCATCCTCCAG | 1614 | 0 2 | 3509 | 6.0553408 | 8.2040138 |
| TTCTCCCTGTCCTATCAAGACT | 1615 | 0 1 | 4699 | 4.7479568 | 12.121504 |

-continued

| | | | | | |
|---|---|---|---|---|---|
| TCATTCCCTCATTGTTCACTGG | 1616 | 0 1 | 8088 | 8.6392965 | 1.1877192 |
| GGGGGCTTGGCCCGGTCTGGTT | 1617 | 0 2 | 17107.5 | 8.3545551 | 12.59028 |
| ATGGGCCTCCTATTATCCCCAT | 1618 | 0 2 | 4745.5 | 13.363207 | 5.1394033 |
| GCCTGGATTCCTTGTTTCTCAG | 1619 | 0 1 | 2049 | 4.3417811 | 7.2988648 |
| TGTGGGTGGCATCGTCCTGGCC | 1620 | 0 1 | 9679.5 | 6.8719993 | 0.49652323 |
| GCCGGGTTCAAGCCATTCTCCT | 1621 | 0 2 | 3787 | 7.9569592 | 12.92104 |
| GCCAGCCAGAAACGTCACACTG | 1622 | 0 2 | 3409 | 16.32616 | 4.566371 |
| CTCACTGAAACCTCCGCCTCCC | 1623 | 0 2 | 18912 | 16.516399 | 5.5995822 |
| GTGCTGGTGCTCGCTCCTCTGG | 1624 | 0 2 | 8165 | 11.725875 | 9.7062302 |
| TGCCCAGGCTGGAGTGCAGTGG | 1625 | 0 2 | 22039 | 16.547016 | 22.788761 |
| TAGAGTGTCATAACAGTGCCCA | 1626 | 0 1 | 1991 | 9.5302086 | 1.9559761 |
| TATGCCACTGCTCTCCATCCTA | 1627 | 0 1 | 3874.5 | 5.9149723 | 1.1388568 |
| TGGTCTGCTGAACAGCCGTATC | 1628 | 0 1 | 1757 | 4.743588 | 1.0271198 |
| ACCAGCCTGGCCAACATGGTGA | 1629 | 0 2 | 14312.5 | 12.221603 | 21.144381 |
| GCCAGCAGCTTCTTCTCATCCT | 1630 | 0 1 | 12277 | 6.6476259 | -3.0264895 |
| TGGCTCTGTCCTCAGCT | 1631 | 0 1 | 6081 | 5.0312958 | 9.2481689 |
| ACCCAGGCTGGAGTGCAGTGGC | 1632 | 0 2 | 6072 | 13.647521 | 18.928474 |
| TCCCCAGCTTGCTACTTCTGCT | 1633 | 0 1 | 3083 | 5.0408092 | 4.8841767 |
| CTTCCCTCTGCTCCTTGGTCCA | 1634 | 0 1 | 19594.5 | 9.4720697 | 1.9364738 |
| CTTCTCGGGGTTCCCGCGCCCT | 1635 | 0 1 | 2766.5 | 4.3488479 | 3.1100295 |
| AGGGAAGGACTGCTGGGTTGGC | 1636 | 0 2 | 10310 | 6.1609344 | 2.3204882 |
| CCTGCCTATGAGACGTTTTGCC | 1637 | 0 1 | 2184 | 7.8809133 | -5.31426 |
| TTTTCCTTCATATCCCTTATGT | 1638 | 0 1 | 1319.5 | 4.0893412 | -2.6567316 |
| CATTGCACTCCAGCTCTGGGCG | 1639 | 0 2 | 59621 | 23.220642 | 28.257877 |
| GGGAGGTTGAGGCTGCAGTGAG | 1640 | 0 2 | 3383 | 10.8508 | 12.95626 |
| GGCGGCCCAGGCGCTTGGAGAT | 1641 | 0 2 | 6899.5 | 8.1672001 | 10.434432 |
| GTGCTGTGCCCTCTGCTGGGAA | 1642 | 0 1 | 3638 | 12.00617 | -1.0814483 |
| AGCAGAGCAGTCTCCGCTCA | 1643 | 0 2 | 11919 | 6.4712315 | 22.303505 |
| TGGCACAGCCTCCATGTCGTCC | 1644 | 0 2 | 2677 | 6.0342832 | 3.5939596 |
| GCCTCAGTCTCCCGAGTAGCTG | 1645 | 0 2 | 11503 | 10.848304 | 18.821283 |
| CGCGCCGTCGGGTCCAGCC | 1646 | 0 1 | 2247.5 | 4.7277126 | 7.7918286 |
| CCCCGAGGCTGGAGTGCAGTGG | 1647 | 0 2 | 8152 | 11.888549 | 9.8740635 |
| CGTGCTGGGTCTGCGGGGCCGT | 1648 | 0 1 | 5352 | 9.8540783 | -5.7792974 |
| TAGGCCCCTAGTGCCACGTGGC | 1649 | 0 1 | 1019 | 4.9789224 | -0.50027198 |
| GACCTTGTGATCCACCCGCTTT | 1650 | 0 2 | 4584 | 8.4290171 | 13.331941 |
| CCCTGGCTGGCTCTGCCCGGAC | 1651 | 0 1 | 5439.5 | 4.9906063 | 0.71976095 |
| GCACTGGCCGCACGCGTAGGGC | 1652 | 0 2 | 11799 | 10.682883 | 23.348194 |
| GACCTTGTGATCCACCCGCCTT | 1653 | 0 2 | 8371 | 11.550721 | 15.977306 |
| CAAAGTGCTGGGATTACAGGCT | 1654 | 0 1 | 2028 | 5.1953826 | 10.857911 |
| TGGTGGCTCACGTCTGTAATCT | 1655 | 0 1 | 1871 | 5.7638865 | -7.8935137 |

-continued

| | | | | | |
|---|---|---|---|---|---|
| CATCCAGGCTGAAGTGCAGTGG | 1656 | 0 2 | 2134 | 8.2575912 | 10.422696 |
| TGATATGGTTTGGCTGTGTT | 1657 | 0 2 | 4515 | 12.488225 | 16.236593 |
| TCCGGGAGGCAGAGGTTGCAGT | 1658 | 0 1 | 1221 | 4.4037938 | 7.4545732 |
| GGTGAATTTGCCTCCCGACTGA | 1659 | 0 1 | 3632.5 | 5.797946 | 13.529587 |
| GGGTGCTTTGGCTCACGCCTGT | 1660 | 0 1 | 2429 | 4.6753616 | 12.409147 |
| TTCACCATGTTGGCCAGGCTGG | 1661 | 0 2 | 8459 | 14.352482 | 9.058075 |
| TGGTGCTAGTTAAATCTTCAGG | 1662 | 0 2 | 2715 | 17.999035 | 10.341267 |
| CCTCGGCTGGGCCTTGGCCACT | 1663 | 0 2 | 7735 | 6.1994433 | 14.162719 |
| CTCACTGCAATCTCCGTCTCCC | 1664 | 0 2 | 14910 | 15.75562 | 18.259068 |
| CCTGGCCTTTGAACGCTAGACT | 1665 | 0 1 | 11406 | 7.0146093 | 0.75884587 |
| AGCTCACTGCAACCTCCGCCTC | 1666 | 0 2 | 47293.5 | 20.812145 | 17.740503 |
| GGGCAAGGAAACAGCCCCCA | 1667 | 0 1 | 2351 | 7.9984035 | -0.44823697 |
| GGCTCTGTGTCTCCACCCAAAT | 1668 | 0 1 | 3079 | 5.4224949 | 9.948535 |
| TCACTGCAACCTCTGCCTCCCG | 1669 | 0 2 | 43860.5 | 21.342369 | 14.672491 |
| TCACCCCTCCATTCTCTCATGT | 1670 | 0 1 | 3872 | 5.0523677 | 5.8481488 |
| TGCTATGTTGCCCAGGGTGGCC | 1671 | 0 2 | 5818 | 7.5935292 | 5.3837776 |
| AGCCCAATCCTAGCACTTTGAG | 1672 | 0 2 | 2126.5 | 6.5217991 | 3.5096016 |

| ROW# | INFECTION NAME | SEQ ID NOs OF GAMS ASSOCIATED WITH INFECTION |
|---|---|---|
| 2 | B19 virus | 11, 23, 28, 31, 36, 48, 66, 68, 73, 74, 85, 92, 105, 143, 144, 166, 177, 187, 216, 272, 279, 290, 293, 296, 299, 304, 315, 345, 346, 367, 380, 393, 418, 422, 433, 466, 467, 488, 492, 563, 564, 598, 610, 612, 619, 627, 637, 667, 681, 731, 746, 808, 838, 846, 855, 861, 879, 887, 891, 946, 947, 954, 973, 1009, 1012, 1053, 1065, 1078, 1128, 1133, 1161, 1163, 1166, 1172, 1174, 1181, 1186, 1195, 1206, 1270, 1273, 1299, 1303, 1328, 1348, 1363, 1385, 1406, 1442, 1469, 1486, 1520, 1523, 1547, 1579, 1594, 1642, 1670 and 119265-124793. |
| 3 | Barmah Forest virus | 2, 11, 23, 31, 48, 49, 50, 68, 72, 73, 74, 82, 84, 85, 89, 92, 101, 105, 112, 131, 135, 143, 144, 166, 177, 198, 200, 201, 212, 216, 272, 277, 279, 290, 293, 296, 304, 315, 325, 330, 342, 345, 346, 364, 367, 377, 380, 393, 405, 418, 433, 466, 467, 479, 488, 492, 497, 503, 508, 529, 535, 563, 564, 566, 594, 595, 598, 601, 605, 610, 612, 619, 627, 637, 642, 658, 667, 694, 710, 712, 731, 746, 765, 808, 831, 838, 846, 855, 861, 882, 887, 891, 900, 945, 946, 947, 954, 973, 991, 1009, 1053, 1058, 1065, 1078, 1093, 1122, 1132, 1133, 1152, 1161, 1163, 1166, 1172, 1174, 1181, 1185, 1231, 1273, 1274, 1283, 1299, 1328, 1348, 1363, 1374, 1385, 1389, 1400, 1406, 1442, 1459, 1469, 1473, 1485, 1486, 1520, 1523, 1547, 1554, 1575, 1579, 1594, 1626, 1670 and 124794-128803. |
| 4 | BK polyomavirus | 4, 11, 20, 23, 24, 29, 31, 35, 36, 37, 40, 43, 47, 48, 49, 50, 51, 66, 67, 70, 73, 74, 77, 78, 96, 114, 120, 143, 148, 169, 171, 174, 187, 188, 189, 200, 203, 212, 219, 231, 234, 239, 240, 244, 247, 252, 261, 262, 277, 279, 284, 286, 289, 290, 295, 303, 304, 310, 315, 321, 323, 334, 336, 339, 347, 356, 357, 366, 370, 374, 376, 380, 394, 395, 396, 399, 400, 401, 405, 413, 416, 424, 429, 431, 433, 437, 441, 443, 446, 453, 454, 462, 463, 465, 466, 481, 484, 500, 507, 509, 510, 515, 518, 526, 529, 537, 541, 544, 547, 551, 553, 561, 566, 567, 574, 575, 577, 579, 585, 587, 594, 605, 607, 610, 612, 617, 624, 625, 627, 635, 640, 652, 653, 654, 661, 663, 667, 676, 681, 684, 694, 696, 701, 709, 710, 713, 715, 720, 731, 734, 737, 746, 749, 754, 756, 760, 763, 773, 776, 777, 786, 801, 803, 804, 811, 813, 829, 832, 838, 839, 840, 846, 847, 854, 856, 862, 868, 872, 873, 876, 882, 886, 887, 889, 909, 911, 914, 920, 924, 925, 927, 935, 936, 938, 954, 960, 962, 966, 969, 973, 977, 979, 980, 985, 988, 998, 1006, 1008, 1019, 1020, 1037, 1038, 1040, 1049, 1050, 1058, 1062, 1065, 1069, 1070, 1084, 1086, 1090, 1096, 1101, 1106, 1123, 1129, 1133, 1138, 1139, 1144, 1152, 1153, 1159, 1163, 1168, 1172, 1190, 1195, 1196, 1204, 1205, 1212, 1219, 1225, 1239, 1245, 1251, 1254, 1257, 1258, 1262, 1268, 1270, 1271, 1274, 1284, 1290, 1293, 1297, 1299, 1306, 1321, 1328, 1330, 1335, 1338, 1339, 1349, 1353, 1363, 1364, 1390, 1391, 1392, 1411, 1412, 1416, 1423, 1424, 1426, 1432, 1456, 1459, 1467, 1469, 1473, 1476, 1481, 1485, 1487, 1488, 1503, 1505, 1507, 1511, 1526, 1549, 1552, 1574, 1578, 1579, 1580, 1584, 1586, 1598, 1606, 1617, 1631, 1633, 1637, 1639, 1640, 1642, 1643, 1654, 1656, 1665, 1669 and 128804-147105. |

-continued

| ROW# | INFECTION NAME | SEQ ID NOs OF GAMS ASSOCIATED WITH INFECTION |
|---|---|---|
| 5 | Bunyamwera virus | 166, 323, 462, 478, 484, 541, 553, 559, 798, 867, 1057, 1063, 1069, 1484, 1560 and 147106-147728. |
| 6 | Colorado tick fever virus | 20, 58, 64, 69, 88, 99, 103, 126, 130, 166, 186, 228, 245, 264, 286, 306, 319, 329, 330, 333, 346, 354, 361, 375, 386, 402, 418, 429, 451, 458, 470, 476, 502, 518, 520, 524, 527, 540, 548, 575, 584, 585, 611, 640, 677, 687, 691, 728, 732, 735, 774, 784, 803, 818, 847, 851, 876, 916, 932, 937, 940, 957, 959, 962, 964, 968, 1023, 1047, 1110, 1130, 1136, 1154, 1177, 1180, 1184, 1187, 1208, 1218, 1233, 1249, 1253, 1254, 1258, 1277, 1294, 1321, 1335, 1342, 1376, 1395, 1410, 1413, 1420, 1425, 1427, 1447, 1451, 1455, 1489, 1521, 1532, 1533, 1536, 1555, 1568, 1575, 1583, 1588, 1645, 1664 and 147729-148041. |
| 7 | Crimean-Congo hemorrhagic fever virus | 63, 166, 271, 323, 462, 478, 484, 541, 553, 559, 569, 570, 798, 867, 1057, 1063, 1069, 1285, 1484, 1560 and 148042-149020. |
| 8 | Dengue virus | 63, 64, 68, 166, 169, 196, 204, 229, 238, 271, 323, 376, 448, 462, 466, 478, 484, 541, 553, 559, 569, 570, 656, 657, 669, 798, 838, 853, 859, 867, 875, 935, 1005, 1057, 1063, 1069, 1239, 1285, 1308, 1358, 1372, 1373, 1386, 1400, 1402, 1484, 1560 and 149021-151652. |
| 9 | Dobrava virus | 9, 63, 166, 271, 323, 462, 478, 484, 541, 553, 559, 569, 570, 798, 867, 951, 1057, 1063, 1069, 1285, 1484, 1560, 1581 and 151653-152681. |
| 10 | Eastern equine encephalitis virus | 4, 5, 11, 20, 23, 24, 29, 31, 33, 35, 37, 43, 47, 48, 49, 51, 66, 67, 70, 73, 74, 77, 78, 83, 84, 96, 99, 112, 114, 120, 129, 143, 145, 148, 154, 169, 171, 172, 174, 180, 187, 188, 189, 200, 203, 212, 219, 223, 224, 232, 234, 239, 240, 247, 252, 257, 261, 262, 268, 272, 277, 279, 283, 289, 290, 295, 303, 304, 306, 310, 315, 320, 321, 323, 334, 336, 337, 339, 347, 356, 357, 366, 370, 374, 376, 380, 386, 394, 395, 396, 399, 400, 401, 405, 413, 416, 424, 429, 431, 433, 437, 441, 443, 446, 453, 454, 462, 465, 466, 467, 481, 483, 484, 500, 504, 507, 509, 510, 515, 518, 522, 526, 537, 541, 544, 547, 551, 553, 561, 562, 567, 574, 575, 577, 579, 587, 594, 605, 607, 610, 612, 617, 624, 627, 635, 637, 640, 652, 654, 661, 667, 676, 681, 684, 694, 701, 709, 710, 713, 715, 720, 731, 734, 737, 746, 749, 754, 756, 760, 763, 773, 774, 776, 777, 786, 801, 803, 804, 811, 813, 829, 838, 839, 840, 846, 847, 848, 854, 856, 862, 868, 873, 876, 882, 886, 889, 909, 911, 914, 924, 925, 927, 932, 935, 936, 938, 946, 954, 959, 960, 962, 966, 968, 969, 973, 977, 979, 985, 988, 998, 1006, 1008, 1019, 1020, 1037, 1038, 1040, 1049, 1058, 1062, 1065, 1069, 1070, 1084, 1086, 1090, 1096, 1101, 1105, 1106, 1115, 1123, 1124, 1129, 1133, 1138, 1139, 1152, 1153, 1159, 1163, 1168, 1172, 1190, 1196, 1204, 1205, 1212, 1219, 1225, 1229, 1234, 1239, 1245, 1251, 1254, 1257, 1258, 1262, 1268, 1270, 1271, 1274, 1281, 1284, 1290, 1293, 1297, 1299, 1305, 1306, 1321, 1328, 1330, 1335, 1338, 1339, 1349, 1353, 1363, 1364, 1374, 1383, 1390, 1391, 1392, 1408, 1411, 1412, 1416, 1423, 1424, 1426, 1432, 1456, 1459, 1460, 1467, 1469, 1473, 1474, 1476, 1481, 1485, 1487, 1488, 1499, 1503, 1507, 1511, 1526, 1537, 1549, 1551, 1552, 1574, 1578, 1579, 1580, 1584, 1606, 1617, 1624, 1627, 1631, 1633, 1637, 1639, 1640, 1643, 1644, 1654, 1656, 1661, 1665, 1669 and 152682-166891. |
| 11 | Hepatitis A virus | 9, 23, 31, 36, 48, 78, 88, 105, 150, 162, 189, 203, 219, 229, 232, 233, 244, 248, 272, 278, 303, 306, 315, 325, 334, 351, 353, 365, 366, 373, 404, 416, 422, 429, 453, 458, 466, 467, 492, 520, 521, 541, 544, 561, 565, 571, 575, 581, 586, 597, 604, 614, 615, 619, 625, 641, 654, 661, 694, 713, 720, 736, 760, 778, 781, 802, 803, 820, 829, 839, 846, 875, 876, 877, 901, 909, 922, 973, 985, 989, 1006, 1009, 1012, 1019, 1035, 1036, 1047, 1062, 1065, 1069, 1092, 1116, 1129, 1130, 1134, 1144, 1157, 1166, 1172, 1180, 1185, 1195, 1197, 1199, 1205, 1216, 1227, 1251, 1258, 1266, 1268, 1287, 1293, 1299, 1304, 1328, 1332, 1335, 1338, 1351, 1363, 1371, 1373, 1392, 1394, 1406, 1429, 1437, 1469, 1486, 1488, 1550, 1554, 1557, 1594, 1598, 1611, 1619, 1631, 1637, 1640 and 166892-176205. |
| 12 | Hepatitis B virus | 2, 6, 7, 8, 9, 10, 11, 13, 15, 19, 23, 24, 26, 28, 31, 36, 38, 47, 48, 50, 51, 54, 56, 57, 60, 66, 67, 68, 73, 74, 77, 78, 81, 83, 84, 85, 88, 92, 96, 101, 103, 105, 110, 114, 116, 127, 129, 130, 135, 139, 140, 142, 143, 144, 149, 150, 151, 154, 155, 158, 160, 162, 163, 166, 167, 169, 173, 174, 175, 177, 179, 182, 187, 189, 193, 194, 198, 199, 200, 202, 203, 204, 207, 208, 210, 212, 213, 216, 218, 219, 220, 221, 222, 225, 229, 230, 231, 232, 233, 234, 235, 236, 244, 247, 248, 249, 256, 261, 262, 263, 265, 272, 276, 278, 279, 280, 284, 286, 289, 290, 293, 295, 296, 298, 299, 302, 303, 304, 306, 307, 309, 312, 315, 318, 321, 323, 325, 331, 334, 336, 339, 344, 345, 346, 347, 351, 353, 356, 358, 359, 363, 365, 366, 367, 370, 372, 373, 374, 380, 382, 385, 387, 391, 393, 394, 396, 399, 400, 402, 404, 408, 409, 410, 412, 416, 418, 420, 422, 424, 425, 429, 433, 434, 435, 437, 443, 445, 446, 448, 453, 454, 457, 458, 460, 462, 463, 466, 467, 468, 469, 470, 471, 476, 478, 480, 481, 482, 484, 485, 486, 487, 488, 490, 492, 493, 499, 500, 505, 506, 509, 511, 516, 520, 521, 522, 526, 530, 531, 532, 534, 537, 539, 541, 542, 544, 545, 546, 551, 553, 555, 559, 561, 563, 564, 565, 566, 567, 569, 570, 572, 575, 579, 581, 583, 584, 585, 586, 590, 597, 598, 603, 604, 606, 610, 612, 614, 615, 618, 619, 623, 625, 627, 629, 635, 636, 637, 641, 643, 644, 645, 653, 654, 656, 661, 663, 666, 667, 668, 669, 671, 676, 679, 681, 684, 686, 688, 692, 693, 694, 698, 700, 703, 704, 707, 709, 711, 713, 715, 717, 720, 725, 731, 734, 736, 738, 744, 746, 750, 754, 760, 762, 765, 767, 778, 781, 783, 784, 786, 788, 795, 796, 797, 798, 801, 802, 803, 808, 809, 812, 813, 817, 820, 827, 829, 831, 832, 836, 838, 839, 846, 847, 848, 851, 854, 855, 857, 859, 861, 862, 867, 868, 872, 875, 876, 877, 879, 881, 882, 884, 886, 887, 889, 891, 894, 900, 901, 905, 908, 909, 910, 915, 918, 919, 920, 922, 924, 926, 927, 931, 932, 933, 935, 937, 938, 946, 947, 954, 960, 963, 965, 973, 975, 978, 980, 982, 983, 984, 985, |

| ROW# | INFECTION NAME | SEQ ID NOs OF GAMS ASSOCIATED WITH INFECTION |
|---|---|---|
| | | 989, 990, 992, 993, 995, 998, 999, 1000, 1003, 1005, 1006, 1008, 1009, 1010, 1011, 1012, 1015, 1016, 1017, 1019, 1022, 1024, 1026, 1034, 1035, 1036, 1038, 1040, 1042, 1043, 1044, 1046, 1047, 1052, 1053, 1054, 1056, 1057, 1058, 1060, 1062, 1063, 1065, 1067, 1069, 1070, 1071, 1075, 1076, 1078, 1081, 1085, 1086, 1088, 1089, 1092, 1095, 1099, 1101, 1102, 1106, 1107, 1108, 1109, 1114, 1116, 1118, 1119, 1123, 1128, 1129, 1130, 1132, 1133, 1134, 1139, 1142, 1144, 1148, 1149, 1152, 1153, 1154, 1155, 1157, 1161, 1163, 1166, 1168, 1169, 1172, 1173, 1174, 1180, 1181, 1182, 1183, 1185, 1186, 1189, 1190, 1194, 1195, 1197, 1198, 1199, 1200, 1201, 1203, 1204, 1205, 1206, 1207, 1209, 1214, 1215, 1216, 1220, 1222, 1224, 1225, 1227, 1235, 1236, 1241, 1251, 1256, 1258, 1261, 1266, 1267, 1268, 1270, 1271, 1272, 1273, 1276, 1282, 1287, 1289, 1293, 1294, 1295, 1299, 1303, 1304, 1305, 1310, 1312, 1318, 1322, 1326, 1328, 1330, 1332, 1333, 1334, 1335, 1337, 1338, 1339, 1340, 1343, 1344, 1346, 1347, 1348, 1349, 1351, 1353, 1359, 1363, 1365, 1369, 1371, 1372, 1373, 1374, 1376, 1380, 1384, 1385, 1392, 1394, 1402, 1405, 1406, 1410, 1411, 1412, 1414, 1416, 1419, 1421, 1423, 1424, 1425, 1427, 1428, 1429, 1432, 1436, 1437, 1439, 1442, 1447, 1451, 1452, 1458, 1462, 1463, 1466, 1467, 1469, 1477, 1478, 1484, 1486, 1487, 1488, 1489, 1494, 1495, 1496, 1502, 1503, 1505, 1506, 1509, 1510, 1511, 1513, 1515, 1520, 1521, 1523, 1525, 1529, 1539, 1547, 1548, 1550, 1553, 1554, 1560, 1562, 1565, 1569, 1571, 1572, 1574, 1575, 1576, 1577, 1579, 1584, 1585, 1586, 1587, 1589, 1590, 1592, 1594, 1595, 1596, 1598, 1601, 1604, 1606, 1607, 1609, 1611, 1612, 1616, 1618, 1619, 1622, 1624, 1625, 1629, 1631, 1632, 1633, 1636, 1637, 1640, 1642, 1643, 1644, 1645, 1649, 1654, 1656, 1658, 1660, 1662, 1663, 1667, 1670 and 176206-229013. |
| 13 | Hepatitis C virus | 2, 6, 7, 8, 9, 10, 11, 13, 14, 15, 19, 23, 24, 26, 28, 31, 36, 38, 40, 47, 48, 50, 51, 54, 56, 57, 60, 66, 67, 73, 74, 77, 78, 81, 84, 88, 101, 103, 105, 110, 114, 116, 127, 129, 130, 135, 139, 140, 142, 143, 149, 150, 151, 154, 155, 158, 160, 162, 163, 166, 167, 169, 173, 174, 175, 177, 179, 182, 187, 189, 193, 194, 199, 200, 203, 204, 207, 208, 209, 210, 212, 213, 218, 219, 220, 221, 222, 225, 229, 230, 231, 232, 233, 234, 235, 236, 244, 247, 248, 249, 256, 261, 262, 263, 265, 272, 276, 278, 279, 280, 286, 289, 290, 295, 298, 302, 303, 304, 306, 307, 309, 312, 315, 321, 323, 325, 328, 331, 334, 336, 339, 344, 345, 346, 351, 353, 356, 359, 363, 365, 366, 367, 370, 372, 373, 374, 380, 382, 385, 387, 391, 393, 394, 396, 399, 400, 404, 408, 409, 410, 412, 416, 420, 422, 424, 425, 429, 433, 434, 435, 437, 443, 445, 446, 448, 453, 454, 458, 460, 462, 466, 467, 468, 469, 470, 471, 476, 478, 480, 481, 482, 485, 486, 490, 492, 493, 499, 500, 505, 506, 509, 511, 516, 520, 521, 522, 526, 530, 531, 532, 534, 537, 539, 541, 542, 544, 545, 546, 551, 553, 555, 559, 561, 564, 565, 566, 567, 569, 570, 572, 575, 581, 583, 584, 586, 590, 597, 598, 603, 604, 606, 610, 612, 614, 615, 618, 619, 623, 625, 627, 629, 635, 636, 641, 643, 645, 654, 656, 661, 666, 667, 668, 669, 671, 679, 684, 686, 688, 692, 693, 694, 698, 700, 703, 704, 707, 709, 711, 713, 715, 717, 720, 725, 731, 734, 736, 738, 744, 750, 754, 756, 760, 762, 765, 767, 778, 781, 783, 784, 786, 788, 795, 797, 798, 801, 802, 803, 804, 808, 809, 812, 813, 817, 820, 827, 829, 831, 832, 836, 838, 839, 846, 847, 848, 851, 855, 856, 857, 859, 861, 862, 867, 868, 872, 875, 876, 877, 879, 881, 882, 884, 886, 889, 894, 900, 901, 905, 908, 909, 910, 915, 919, 920, 922, 924, 926, 927, 931, 932, 933, 935, 937, 938, 946, 947, 960, 963, 965, 973, 975, 978, 980, 982, 983, 984, 985, 989, 990, 992, 993, 995, 998, 999, 1000, 1003, 1005, 1006, 1008, 1009, 1010, 1011, 1012, 1015, 1016, 1017, 1019, 1024, 1026, 1035, 1036, 1038, 1040, 1042, 1043, 1044, 1046, 1047, 1052, 1053, 1054, 1056, 1057, 1058, 1060, 1062, 1063, 1065, 1067, 1068, 1069, 1070, 1071, 1075, 1078, 1081, 1085, 1086, 1088, 1089, 1092, 1095, 1099, 1102, 1106, 1107, 1108, 1109, 1114, 1116, 1118, 1119, 1123, 1124, 1129, 1130, 1132, 1134, 1135, 1138, 1139, 1142, 1144, 1148, 1149, 1152, 1153, 1154, 1155, 1157, 1163, 1166, 1168, 1169, 1172, 1173, 1180, 1181, 1182, 1183, 1185, 1189, 1190, 1194, 1195, 1197, 1198, 1199, 1200, 1203, 1204, 1205, 1206, 1209, 1214, 1215, 1216, 1220, 1222, 1224, 1225, 1227, 1230, 1235, 1236, 1251, 1256, 1258, 1261, 1266, 1267, 1268, 1270, 1271, 1276, 1282, 1287, 1289, 1293, 1294, 1295, 1299, 1304, 1305, 1310, 1312, 1318, 1322, 1326, 1328, 1330, 1332, 1333, 1334, 1335, 1337, 1338, 1339, 1340, 1343, 1344, 1346, 1347, 1348, 1349, 1351, 1353, 1359, 1363, 1369, 1371, 1372, 1373, 1374, 1376, 1380, 1384, 1385, 1392, 1393, 1394, 1397, 1402, 1405, 1406, 1410, 1411, 1412, 1414, 1416, 1419, 1421, 1423, 1424, 1427, 1428, 1429, 1432, 1436, 1437, 1439, 1442, 1447, 1451, 1452, 1458, 1462, 1463, 1466, 1467, 1469, 1477, 1478, 1483, 1484, 1486, 1487, 1488, 1489, 1494, 1495, 1496, 1502, 1503, 1506, 1509, 1510, 1511, 1513, 1515, 1520, 1521, 1525, 1529, 1547, 1548, 1550, 1552, 1553, 1554, 1560, 1562, 1565, 1569, 1571, 1572, 1574, 1575, 1576, 1577, 1579, 1584, 1585, 1587, 1589, 1590, 1592, 1594, 1595, 1596, 1598, 1601, 1604, 1606, 1607, 1609, 1611, 1612, 1616, 1618, 1619, 1622, 1624, 1625, 1629, 1631, 1632, 1633, 1636, 1637, 1640, 1643, 1645, 1649, 1654, 1656, 1658, 1660, 1662, 1663, 1667, 1670, 1672 and 229014-279918. |
| 14 | Hepatitis D virus | 2, 9, 15, 23, 26, 28, 31, 36, 48, 51, 78, 81, 88, 96, 105, 110, 139, 149, 150, 151, 162, 166, 173, 175, 189, 192, 202, 203, 204, 207, 213, 219, 229, 232, 233, 235, 244, 248, 249, 256, 272, 276, 278, 286, 289, 302, 303, 304, 306, 315, 318, 323, 325, 334, 339, 340, 346, 351, 353, 365, 366, 370, 373, 402, 404, 416, 422, 424, 429, 432, 437, 446, 448, 453, 458, 462, 466, 467, 470, 478, 480, 484, 486, 492, 500, 506, 520, 521, 522, 526, 541, 544, 553, 559, 561, 565, 575, 581, 586, 597, 600, 604, 610, 614, 615, 619, 625, 629, 635, 636, 641, 644, 645, 654, 661, |

-continued

| ROW# | INFECTION NAME | SEQ ID NOs OF GAMS ASSOCIATED WITH INFECTION |
|---|---|---|
| | | 669, 679, 688, 692, 694, 700, 709, 713, 720, 734, 736, 750, 760, 762, 765, 767, 778, 781, 798, 802, 803, 820, 825, 827, 829, 839, 846, 847, 854, 867, 875, 876, 877, 894, 901, 909, 919, 922, 933, 935, 938, 963, 973, 975, 982, 985, 989, 995, 998, 1006, 1009, 1012, 1016, 1019, 1035, 1036, 1039, 1047, 1052, 1053, 1057, 1058, 1062, 1063, 1065, 1069, 1078, 1092, 1107, 1108, 1114, 1116, 1118, 1126, 1129, 1130, 1134, 1144, 1149, 1157, 1163, 1166, 1169, 1172, 1173, 1180, 1181, 1185, 1191, 1195, 1197, 1199, 1201, 1205, 1206, 1216, 1227, 1236, 1251, 1258, 1266, 1268, 1270, 1276, 1287, 1293, 1295, 1299, 1304, 1312, 1328, 1330, 1333, 1335, 1338, 1340, 1344, 1349, 1351, 1363, 1365, 1371, 1373, 1374, 1376, 1385, 1392, 1394, 1406, 1428, 1429, 1436, 1437, 1442, 1467, 1469, 1484, 1486, 1488, 1492, 1521, 1539, 1547, 1550, 1553, 1554, 1560, 1569, 1571, 1574, 1577, 1585, 1594, 1595, 1598, 1607, 1611, 1616, 1619, 1622, 1631, 1633, 1637, 1640, 1658, 1660, 1663 and 279919-296910. |
| 15 | Hepatitis E virus | 7, 9, 23, 31, 36, 48, 78, 88, 92, 102, 105, 150, 162, 165, 166, 189, 192, 203, 218, 219, 223, 225, 229, 232, 233, 244, 248, 272, 278, 296, 303, 306, 315, 325, 334, 351, 353, 365, 366, 373, 401, 404, 416, 422, 429, 447, 453, 458, 459, 466, 467, 492, 520, 521, 541, 544, 560, 561, 565, 575, 581, 586, 597, 600, 604, 614, 615, 619, 625, 641, 654, 661, 694, 713, 720, 736, 760, 773, 778, 781, 802, 803, 818, 820, 829, 839, 846, 853, 855, 862, 875, 876, 877, 882, 895, 901, 909, 922, 928, 939, 973, 976, 985, 989, 997, 1006, 1009, 1012, 1019, 1035, 1036, 1042, 1047, 1062, 1065, 1069, 1092, 1116, 1129, 1130, 1134, 1139, 1144, 1157, 1163, 1166, 1172, 1180, 1185, 1195, 1197, 1199, 1201, 1205, 1216, 1224, 1227, 1251, 1258, 1266, 1268, 1270, 1287, 1293, 1298, 1299, 1304, 1318, 1328, 1335, 1336, 1338, 1345, 1346, 1351, 1356, 1363, 1371, 1373, 1392, 1394, 1406, 1429, 1437, 1439, 1444, 1469, 1486, 1488, 1508, 1550, 1554, 1594, 1597, 1598, 1610, 1611, 1619, 1631, 1637, 1640, 1647, 1648, 1667 and 296911-304515. |
| 16 | Human adenovirus A | 4, 11, 16, 20, 23, 24, 29, 31, 35, 36, 37, 40, 43, 47, 48, 49, 51, 66, 67, 70, 73, 74, 77, 78, 96, 102, 114, 120, 143, 148, 151, 154, 169, 171, 174, 187, 188, 189, 197, 200, 203, 212, 216, 219, 231, 234, 239, 240, 247, 248, 252, 261, 262, 271, 276, 277, 279, 284, 286, 289, 290, 295, 303, 304, 310, 315, 321, 323, 329, 334, 336, 339, 347, 356, 357, 366, 370, 374, 376, 380, 383, 394, 395, 396, 399, 400, 401, 405, 413, 416, 421, 424, 429, 431, 433, 437, 441, 443, 446, 450, 453, 454, 460, 462, 463, 465, 466, 481, 484, 485, 500, 507, 509, 510, 515, 518, 526, 537, 541, 544, 547, 551, 553, 561, 566, 567, 574, 575, 577, 579, 585, 587, 594, 605, 607, 610, 612, 617, 624, 625, 627, 635, 640, 652, 653, 654, 656, 661, 663, 667, 676, 681, 684, 694, 701, 709, 710, 713, 715, 720, 731, 734, 737, 746, 749, 750, 754, 756, 760, 763, 773, 776, 777, 786, 801, 803, 804, 811, 813, 829, 836, 838, 839, 840, 846, 847, 854, 856, 862, 868, 873, 876, 882, 886, 889, 909, 911, 914, 920, 924, 925, 927, 929, 934, 935, 936, 938, 954, 960, 962, 966, 969, 973, 977, 979, 980, 985, 988, 1006, 1008, 1019, 1020, 1035, 1037, 1038, 1040, 1049, 1058, 1062, 1065, 1068, 1069, 1070, 1078, 1079, 1084, 1086, 1090, 1096, 1101, 1106, 1123, 1129, 1133, 1138, 1139, 1142, 1144, 1146, 1152, 1153, 1155, 1159, 1163, 1168, 1172, 1190, 1195, 1196, 1198, 1204, 1205, 1212, 1219, 1225, 1239, 1245, 1251, 1254, 1257, 1258, 1262, 1268, 1270, 1271, 1274, 1284, 1290, 1293, 1297, 1299, 1306, 1315, 1321, 1328, 1330, 1335, 1338, 1339, 1349, 1353, 1363, 1364, 1390, 1391, 1392, 1393, 1411, 1412, 1416, 1423, 1424, 1426, 1432, 1456, 1459, 1460, 1467, 1469, 1473, 1476, 1481, 1485, 1487, 1488, 1503, 1505, 1507, 1511, 1526, 1549, 1552, 1574, 1578, 1579, 1580, 1584, 1586, 1606, 1617, 1631, 1633, 1637, 1639, 1640, 1642, 1643, 1645, 1654, 1656, 1665, 1669 and 304516-323838. |
| 17 | Human adenovirus B (HAdV-B) | 1, 25, 33, 51, 52, 60, 81, 91, 103, 111, 126, 129, 131, 151, 157, 162, 164, 167, 180, 183, 186, 210, 222, 247, 270, 302, 307, 309, 310, 324, 326, 349, 373, 383, 430, 434, 439, 442, 461, 473, 474, 486, 494, 505, 527, 529, 530, 531, 533, 545, 563, 571, 576, 582, 634, 657, 660, 714, 775, 795, 804, 807, 813, 850, 858, 871, 872, 893, 923, 957, 960, 981, 1001, 1011, 1022, 1042, 1046, 1063, 1066, 1074, 1075, 1083, 1093, 1115, 1126, 1133, 1143, 1209, 1214, 1223, 1229, 1261, 1292, 1315, 1316, 1337, 1346, 1352, 1353, 1375, 1391, 1405, 1408, 1411, 1423, 1425, 1443, 1475, 1489, 1490, 1496, 1498, 1517, 1540, 1545, 1568, 1577, 1593, 1596, 1606, 1610, 1632, 1642, 1643, 1654, 1664 and 325308-325714. |
| 18 | Human adenovirus C | 1, 7, 17, 26, 33, 36, 44, 46, 50, 60, 69, 73, 84, 89, 90, 91, 95, 97, 100, 103, 111, 112, 115, 117, 121, 125, 129, 136, 140, 141, 143, 144, 149, 150, 151, 164, 165, 167, 169, 174, 183, 186, 191, 192, 200, 201, 202, 203, 212, 216, 219, 228, 237, 242, 247, 248, 250, 256, 257, 264, 265, 268, 271, 275, 286, 287, 292, 294, 296, 301, 302, 303, 309, 311, 314, 316, 320, 321, 323, 325, 327, 333, 334, 343, 347, 362, 367, 370, 373, 376, 380, 382, 384, 385, 386, 389, 392, 397, 403, 406, 408, 411, 414, 418, 421, 424, 437, 441, 442, 445, 447, 450, 451, 455, 459, 468, 472, 474, 475, 477, 479, 480, 485, 486, 489, 490, 493, 494, 495, 499, 505, 510, 518, 525, 526, 532, 533, 541, 542, 544, 545, 552, 553, 563, 566, 567, 568, 572, 582, 584, 587, 591, 593, 599, 600, 611, 616, 618, 623, 626, 629, 632, 648, 656, 658, 660, 661, 663, 670, 674, 677, 679, 680, 685, 690, 691, 694, 697, 699, 702, 707, 714, 716, 720, 721, 732, 733, 736, 742, 743, 746, 749, 750, 752, 759, 760, 765, 769, 770, 775, 778, 779, 781, 783, 784, 785, 786, 794, 795, 796, 799, 804, 805, 809, 813, 819, 825, 829, 839, 842, 843, 848, 851, 856, 862, 870, 874, 880, 883, 886, 888, 893, 900, 901, 903, 912, 918, 919, 920, 924, 928, 929, 932, 933, 934, 935, 939, 940, 947, 948, 955, 956, 958, 960, 966, 974, 976, 977, 978, 979, 980, 987, 990, 993, 996, 997, 999, 1002, 1012, 1015, 1018, 1025, 1028, 1035, 1038, 1039, 1047, 1049, 1051, 1055, 1058, 1062, 1067, 1069, 1072, 1073, 1075, |

-continued

| ROW# | INFECTION NAME | SEQ ID NOs OF GAMS ASSOCIATED WITH INFECTION |
|---|---|---|
| | | 1076, 1078, 1081, 1084, 1085, 1093, 1094, 1101, 1102, 1104, 1109, 1113, 1115, 1121, 1126, 1127, 1128, 1129, 1131, 1139, 1141, 1142, 1152, 1153, 1154, 1157, 1163, 1166, 1167, 1170, 1177, 1186, 1191, 1194, 1197, 1201, 1204, 1207, 1209, 1214, 1218, 1226, 1227, 1233, 1239, 1246, 1253, 1255, 1257, 1265, 1270, 1281, 1283, 1287, 1289, 1300, 1305, 1307, 1308, 1310, 1315, 1318, 1320, 1321, 1324, 1327, 1329, 1330, 1331, 1332, 1333, 1336, 1340, 1344, 1348, 1353, 1355, 1356, 1358, 1360, 1367, 1370, 1375, 1376, 1379, 1382, 1391, 1399, 1404, 1405, 1406, 1408, 1410, 1411, 1412, 1421, 1423, 1427, 1433, 1436, 1438, 1439, 1442, 1444, 1447, 1454, 1455, 1458, 1466, 1467, 1469, 1478, 1480, 1489, 1490, 1492, 1498, 1499, 1504, 1509, 1510, 1519, 1521, 1527, 1528, 1535, 1538, 1541, 1555, 1575, 1577, 1582, 1583, 1585, 1586, 1592, 1600, 1626, 1628, 1629, 1631, 1633, 1634, 1636, 1642, 1648, 1650, 1651, 1652, 1653, 1657, 1664, 1665, 1666, 1667 and 326939-329044. |
| 19 | Human adenovirus D | 1, 4, 5, 8, 9, 12, 17, 19, 21, 23, 25, 26, 33, 36, 40, 41, 44, 45, 46, 51, 52, 58, 65, 69, 71, 73, 74, 80, 81, 84, 89, 91, 93, 97, 99, 102, 103, 111, 112, 115, 117, 121, 123, 124, 125, 126, 128, 130, 133, 137, 143, 145, 148, 149, 151, 162, 164, 167, 169, 172, 174, 182, 183, 186, 192, 194, 196, 199, 200, 201, 203, 206, 210, 216, 217, 218, 219, 222, 223, 225, 228, 232, 240, 247, 248, 250, 252, 256, 257, 264, 265, 267, 268, 272, 273, 279, 283, 286, 289, 290, 292, 296, 297, 301, 302, 303, 309, 316, 321, 323, 324, 325, 332, 334, 342, 343, 350, 352, 357, 361, 363, 365, 367, 370, 373, 375, 384, 392, 397, 401, 406, 407, 412, 418, 420, 421, 423, 424, 432, 434, 438, 439, 442, 444, 447, 450, 455, 467, 468, 469, 474, 484, 485, 486, 490, 493, 495, 496, 499, 503, 504, 505, 510, 513, 514, 518, 544, 545, 548, 553, 559, 563, 566, 567, 572, 579, 582, 586, 587, 589, 591, 593, 599, 600, 601, 613, 616, 617, 618, 623, 632, 634, 642, 645, 648, 656, 660, 661, 662, 664, 667, 670, 690, 694, 695, 696, 697, 702, 714, 719, 724, 736, 738, 742, 744, 750, 765, 766, 770, 778, 779, 781, 785, 786, 790, 795, 798, 799, 806, 809, 810, 819, 826, 829, 839, 842, 843, 847, 848, 850, 851, 852, 860, 861, 868, 872, 874, 879, 880, 882, 888, 892, 895, 897, 903, 911, 928, 929, 933, 934, 935, 940, 947, 948, 956, 957, 960, 966, 974, 975, 977, 978, 979, 980, 987, 991, 997, 999, 1001, 1004, 1009, 1011, 1012, 1015, 1018, 1022, 1028, 1029, 1035, 1039, 1040, 1043, 1046, 1047, 1048, 1049, 1053, 1058, 1062, 1063, 1069, 1072, 1075, 1076, 1078, 1079, 1080, 1083, 1088, 1093, 1101, 1102, 1109, 1112, 1115, 1121, 1126, 1128, 1129, 1133, 1139, 1142, 1143, 1146, 1152, 1153, 1155, 1162, 1163, 1164, 1177, 1181, 1188, 1191, 1192, 1194, 1199, 1201, 1204, 1208, 1209, 1219, 1223, 1225, 1227, 1228, 1231, 1239, 1240, 1245, 1247, 1250, 1257, 1258, 1259, 1263, 1265, 1276, 1277, 1282, 1287, 1289, 1292, 1295, 1298, 1300, 1307, 1308, 1309, 1310, 1311, 1316, 1318, 1320, 1321, 1328, 1330, 1331, 1332, 1333, 1334, 1335, 1336, 1337, 1340, 1341, 1342, 1345, 1348, 1355, 1356, 1358, 1375, 1376, 1379, 1391, 1395, 1404, 1405, 1406, 1410, 1411, 1414, 1419, 1421, 1423, 1425, 1426, 1427, 1436, 1439, 1443, 1444, 1447, 1454, 1455, 1458, 1466, 1467, 1469, 1475, 1476, 1480, 1489, 1492, 1493, 1498, 1499, 1508, 1509, 1510, 1515, 1519, 1521, 1523, 1528, 1533, 1535, 1536, 1537, 1538, 1540, 1549, 1575, 1579, 1581, 1582, 1585, 1597, 1600, 1602, 1628, 1631, 1632, 1642, 1643, 1647, 1648, 1651, 1652, 1661, 1664 and 329045-331119. |
| 20 | Human adenovirus E | 4, 19, 32, 33, 36, 44, 51, 58, 61, 71, 74, 81, 84, 91, 93, 95, 97, 103, 107, 115, 126, 127, 128, 129, 137, 140, 141, 145, 149, 151, 164, 165, 169, 172, 174, 182, 183, 191, 192, 200, 203, 206, 210, 216, 218, 220, 222, 223, 227, 228, 231, 232, 247, 248, 252, 253, 256, 260, 264, 268, 271, 275, 279, 288, 291, 294, 297, 301, 303, 304, 307, 309, 321, 324, 326, 329, 334, 342, 343, 349, 350, 357, 361, 364, 365, 367, 370, 373, 376, 384, 385, 386, 392, 403, 406, 408, 412, 414, 416, 421, 423, 424, 429, 434, 437, 439, 441, 444, 447, 449, 455, 459, 464, 468, 469, 478, 484, 485, 486, 490, 493, 494, 495, 496, 497, 499, 502, 503, 504, 505, 513, 524, 532, 533, 541, 544, 548, 553, 560, 563, 566, 567, 575, 577, 582, 584, 585, 586, 587, 589, 591, 599, 600, 601, 608, 613, 614, 615, 616, 618, 632, 634, 636, 643, 645, 648, 649, 656, 660, 661, 667, 670, 690, 693, 695, 697, 702, 714, 721, 722, 725, 746, 749, 750, 762, 765, 769, 770, 779, 780, 781, 786, 792, 795, 799, 803, 806, 813, 819, 821, 829, 834, 839, 842, 843, 847, 848, 850, 860, 862, 868, 872, 874, 880, 882, 886, 895, 897, 911, 919, 928, 929, 932, 933, 934, 935, 939, 940, 946, 947, 948, 960, 962, 979, 981, 987, 993, 996, 997, 999, 1001, 1002, 1012, 1022, 1035, 1039, 1040, 1042, 1043, 1046, 1047, 1049, 1051, 1053, 1058, 1062, 1063, 1067, 1069, 1072, 1073, 1076, 1077, 1078, 1083, 1088, 1102, 1104, 1109, 1112, 1115, 1126, 1127, 1129, 1133, 1139, 1142, 1146, 1152, 1153, 1163, 1164, 1177, 1181, 1191, 1192, 1194, 1197, 1201, 1202, 1204, 1206, 1208, 1209, 1212, 1219, 1225, 1228, 1229, 1239, 1247, 1249, 1250, 1254, 1263, 1269, 1274, 1277, 1287, 1292, 1307, 1310, 1318, 1320, 1321, 1324, 1330, 1331, 1336, 1337, 1340, 1341, 1353, 1356, 1358, 1360, 1363, 1375, 1376, 1391, 1398, 1400, 1403, 1405, 1410, 1411, 1416, 1419, 1421, 1430, 1436, 1439, 1443, 1444, 1454, 1455, 1458, 1466, 1470, 1474, 1478, 1480, 1489, 1492, 1495, 1498, 1499, 1521, 1523, 1526, 1530, 1532, 1535, 1537, 1538, 1540, 1560, 1572, 1578, 1579, 1588, 1597, 1598, 1600, 1602, 1610, 1613, 1624, 1628, 1631, 1632, 1642, 1643, 1647, 1648, 1665, 1667 and 331120-332804. |
| 21 | Human adenovirus F | 5, 9, 19, 25, 33, 36, 40, 44, 46, 49, 50, 52, 61, 69, 74, 81, 82, 84, 88, 97, 99, 115, 119, 131, 136, 141, 145, 151, 164, 167, 169, 172, 183, 186, 191, 192, 196, 199, 202, 210, 216, 218, 220, 222, 226, 235, 242, 245, 247, 252, 256, 257, 259, 274, 279, 288, 292, 303, 307, 309, 316, 319, 320, 323, 325, 326, 337, 343, 344, 350, 357, 364, 370, 373, 376, 378, 383, 403, 406, 408, 409, 420, 421, 423, |

| ROW# | INFECTION NAME | SEQ ID NOs OF GAMS ASSOCIATED WITH INFECTION |
|---|---|---|
| | | 432, 434, 441, 447, 458, 459, 461, 464, 468, 477, 478, 479, 481, 483, 485, 487, 490, 493, 494, 495, 505, 517, 520, 528, 529, 532, 535, 536, 541, 544, 553, 563, 567, 579, 582, 586, 587, 591, 593, 616, 623, 632, 634, 637, 648, 656, 657, 660, 661, 662, 667, 670, 685, 687, 696, 697, 703, 712, 716, 724, 733, 738, 742, 746, 750, 755, 765, 775, 776, 783, 785, 786, 790, 792, 794, 795, 799, 806, 810, 815, 819, 821, 826, 829, 834, 839, 843, 847, 848, 850, 861, 863, 864, 870, 874, 883, 888, 893, 895, 900, 901, 903, 910, 911, 912, 915, 916, 923, 928, 929, 932, 934, 949, 950, 960, 973, 974, 978, 979, 981, 982, 990, 991, 993, 997, 999, 1011, 1012, 1018, 1023, 1028, 1030, 1033, 1035, 1038, 1042, 1046, 1047, 1058, 1062, 1063, 1069, 1072, 1076, 1078, 1079, 1081, 1083, 1084, 1085, 1086, 1102, 1103, 1105, 1109, 1110, 1112, 1113, 1126, 1127, 1130, 1132, 1136, 1142, 1153, 1164, 1167, 1172, 1175, 1180, 1194, 1199, 1201, 1204, 1205, 1206, 1212, 1221, 1227, 1233, 1239, 1245, 1246, 1253, 1265, 1283, 1289, 1294, 1300, 1303, 1307, 1309, 1313, 1315, 1320, 1321, 1331, 1332, 1333, 1339, 1342, 1346, 1347, 1354, 1356, 1367, 1374, 1376, 1382, 1387, 1391, 1399, 1403, 1405, 1406, 1410, 1411, 1412, 1420, 1423, 1427, 1431, 1433, 1436, 1439, 1443, 1444, 1448, 1449, 1455, 1458, 1466, 1469, 1478, 1479, 1480, 1495, 1498, 1499, 1504, 1515, 1521, 1526, 1528, 1530, 1532, 1554, 1563, 1571, 1577, 1582, 1585, 1590, 1597, 1599, 1600, 1627, 1632, 1633, 1634, 1636, 1643, 1651, 1664 and 332805-334515. |
| 22 | Human astrovirus | 197, 450, 466, 954, 1198 and 334516-335246. |
| 23 | Human coronavirus 22 9E | 36, 120, 173, 197, 201, 225, 231, 233, 276, 284, 286, 290, 347, 356, 388, 389, 404, 408, 450, 454, 461, 463, 466, 488, 544, 545, 548, 566, 579, 585, 616, 625, 643, 653, 663, 676, 694, 712, 768, 813, 831, 839, 855, 868, 887, 894, 909, 920, 954, 959, 980, 1029, 1033, 1062, 1079, 1085, 1092, 1101, 1118, 1138, 1139, 1140, 1144, 1153, 1163, 1168, 1172, 1173, 1187, 1190, 1195, 1198, 1208, 1222, 1258, 1259, 1293, 1315, 1325, 1335, 1346, 1396, 1430, 1431, 1442, 1469, 1471, 1505, 1522, 1551, 1585, 1586, 1593, 1642 and 335247-340599. |
| 24 | Human coronavirus OC43 (HCoV-OC43) | 132, 545, 563, 1195, 1292, 1522 and 340600-340686. |
| 25 | Human echovirus 1 | 4, 11, 20, 23, 24, 29, 31, 35, 36, 37, 43, 47, 48, 49, 51, 66, 67, 68, 70, 73, 74, 77, 78, 85, 92, 96, 105, 114, 120, 143, 144, 148, 154, 166, 169, 171, 174, 177, 187, 188, 189, 200, 203, 212, 216, 219, 229, 231, 234, 239, 240, 247, 252, 261, 262, 272, 276, 277, 279, 284, 286, 289, 290, 293, 295, 296, 303, 304, 310, 315, 321, 323, 334, 336, 339, 345, 346, 347, 353, 356, 357, 366, 367, 370, 374, 376, 380, 393, 394, 395, 396, 399, 400, 401, 405, 413, 416, 418, 424, 429, 431, 433, 437, 441, 443, 446, 453, 454, 462, 463, 465, 466, 467, 481, 484, 488, 492, 500, 507, 509, 510, 515, 518, 526, 537, 541, 544, 547, 548, 551, 553, 561, 563, 564, 566, 567, 574, 575, 577, 579, 585, 587, 594, 598, 605, 607, 610, 612, 614, 616, 617, 619, 624, 625, 627, 635, 637, 640, 641, 643, 652, 653, 654, 661, 663, 667, 676, 681, 684, 694, 701, 709, 710, 713, 715, 720, 731, 734, 737, 746, 749, 754, 756, 760, 763, 773, 776, 777, 786, 801, 803, 804, 808, 811, 813, 829, 838, 839, 840, 846, 847, 854, 855, 856, 861, 862, 868, 873, 876, 882, 886, 887, 889, 891, 894, 901, 909, 911, 914, 920, 924, 925, 927, 935, 936, 938, 946, 947, 954, 960, 962, 966, 969, 973, 977, 979, 980, 985, 988, 998, 1006, 1008, 1009, 1019, 1020, 1029, 1037, 1038, 1040, 1047, 1049, 1053, 1058, 1062, 1065, 1069, 1070, 1078, 1079, 1084, 1086, 1090, 1092, 1096, 1101, 1106, 1118, 1123, 1129, 1133, 1134, 1138, 1139, 1140, 1144, 1152, 1153, 1159, 1161, 1163, 1166, 1168, 1172, 1173, 1174, 1181, 1185, 1187, 1190, 1195, 1196, 1199, 1204, 1205, 1208, 1212, 1219, 1225, 1239, 1245, 1251, 1254, 1257, 1258, 1262, 1268, 1270, 1271, 1273, 1274, 1284, 1290, 1293, 1297, 1299, 1306, 1315, 1321, 1325, 1328, 1330, 1332, 1335, 1338, 1339, 1348, 1349, 1351, 1353, 1363, 1364, 1373, 1385, 1390, 1391, 1392, 1406, 1411, 1412, 1416, 1423, 1424, 1426, 1432, 1442, 1456, 1459, 1467, 1469, 1471, 1473, 1476, 1481, 1485, 1486, 1487, 1488, 1503, 1505, 1507, 1511, 1520, 1523, 1526, 1547, 1549, 1552, 1557, 1574, 1578, 1579, 1580, 1584, 1585, 1586, 1594, 1598, 1606, 1611, 1617, 1631, 1633, 1637, 1639, 1640, 1642, 1643, 1654, 1656, 1665, 1669, 1670 and 345885-370019. |
| 26 | Human enterovirus A | 4, 11, 20, 23, 24, 29, 31, 35, 36, 37, 43, 47, 48, 49, 51, 66, 67, 68, 70, 73, 74, 77, 78, 85, 92, 96, 105, 114, 120, 143, 144, 148, 154, 166, 169, 171, 174, 177, 187, 188, 189, 200, 203, 212, 216, 219, 229, 231, 234, 239, 240, 247, 252, 261, 262, 272, 276, 277, 279, 284, 286, 289, 290, 293, 295, 296, 303, 304, 310, 315, 321, 323, 334, 336, 339, 345, 346, 347, 353, 356, 357, 366, 367, 370, 374, 376, 380, 393, 394, 395, 396, 399, 400, 401, 405, 413, 416, 418, 424, 429, 431, 433, 437, 441, 443, 446, 453, 454, 462, 463, 465, 466, 467, 481, 484, 488, 492, 500, 507, 509, 510, 515, 518, 526, 537, 541, 544, 547, 548, 551, 553, 561, 563, 564, 566, 567, 574, 575, 577, 579, 585, 587, 594, 598, 605, 607, 610, 612, 614, 616, 617, 619, 624, 625, 627, 635, 637, 640, 641, 643, 652, 653, 654, 661, 663, 667, 676, 681, 684, 694, 701, 709, 710, 713, 715, 720, 731, 734, 737, 746, 749, 754, 756, 760, 763, 773, 776, 777, 786, 801, 803, 804, 808, 811, 813, 829, 838, 839, 840, 846, 847, 854, 855, 856, 861, 862, 868, 873, 876, 882, 886, 887, 889, 891, 894, 901, 909, 911, 914, 920, 924, 925, 927, 935, 936, 938, 946, 947, 954, 960, 962, 966, 969, 973, 977, 979, 980, 985, 988, 998, 1006, 1008, 1009, 1019, 1020, 1029, 1037, 1038, 1040, 1047, 1049, 1053, 1058, 1062, 1065, 1069, 1070, 1078, 1079, 1084, 1086, 1090, 1092, 1096, 1101, 1106, 1118, 1123, 1129, 1133, 1134, 1138, 1139, 1140, 1144, 1152, 1153, 1159, 1161, 1163, 1166, 1168, 1172, 1173, 1174, 1181, 1185, 1187, 1190, 1195, 1196, 1199, 1204, 1205, 1208, 1212, 1219, 1225, 1239, 1245, 1251, 1254, 1257, 1258, 1262, 1268, 1270, 1271, 1273, 1274, 1284, 1290, 1293, 1297, 1299, 1306, 1315, 1321, 1325, 1328, 1330, 1332, |

-continued

| ROW# | INFECTION NAME | SEQ ID NOs OF GAMS ASSOCIATED WITH INFECTION |
|---|---|---|
| | | 1335, 1338, 1339, 1348, 1349, 1351, 1353, 1363, 1364, 1373, 1385, 1390, 1391, 1392, 1406, 1411, 1412, 1416, 1423, 1424, 1426, 1431, 1432, 1442, 1456, 1459, 1467, 1469, 1471, 1473, 1476, 1481, 1485, 1486, 1487, 1488, 1503, 1505, 1507, 1511, 1520, 1523, 1526, 1547, 1549, 1552, 1557, 1574, 1578, 1579, 1580, 1584, 1585, 1586, 1594, 1598, 1606, 1611, 1617, 1631, 1633, 1637, 1639, 1640, 1642, 1643, 1654, 1656, 1665, 1669, 1670 and 370020-394641. |
| 27 | Human enterovirus B | 466, 876, 1332, 1431, 1557 and 394642-397190. |
| 28 | Human enterovirus C | 466, 876, 1332, 1431, 1557 and 397191-399739. |
| 29 | Human enterovirus D | 36, 231, 284, 286, 347, 356, 463, 466, 544, 566, 579, 585, 625, 653, 663, 676, 694, 839, 876, 909, 920, 980, 1062, 1101, 1144, 1195, 1258, 1293, 1332, 1335, 1431, 1469, 1505, 1557, 1586 and 399740-404272. |
| 30 | Human enterovirus E | 466, 876, 1332, 1431, 1557 and 404273-406821. |
| 31 | Human erythrovirus V9 | 28, 36, 66, 187, 299, 422, 681, 1128, 1186, 1195, 1206, 1270, 1303, 1642 and 406822-408538. |
| 32 | Human herpesvirus 1 | 1, 4, 9, 11, 12, 17, 19, 20, 21, 23, 24, 29, 31, 33, 35, 37, 40, 43, 45, 47, 48, 49, 51, 54, 58, 60, 61, 66, 67, 68, 69, 70, 73, 74, 77, 78, 80, 84, 85, 88, 89, 92, 93, 95, 96, 101, 102, 105, 114, 115, 117, 119, 120, 123, 128, 130, 136, 141, 143, 144, 148, 154, 166, 167, 169, 171, 172, 174, 177, 182, 183, 186, 187, 188, 189, 191, 192, 196, 200, 201, 202, 203, 206, 210, 212, 216, 217, 218, 219, 220, 222, 223, 227, 229, 231, 234, 235, 239, 240, 247, 248, 250, 252, 255, 256, 257, 259, 261, 262, 264, 267, 272, 277, 279, 282, 284, 286, 287, 288, 289, 290, 291, 292, 293, 295, 296, 297, 301, 303, 304, 310, 314, 315, 316, 321, 322, 323, 324, 326, 332, 334, 336, 339, 340, 343, 345, 346, 347, 349, 351, 352, 353, 355, 356, 357, 362, 363, 365, 366, 367, 370, 374, 376, 377, 379, 380, 381, 385, 387, 389, 393, 394, 395, 396, 399, 400, 401, 402, 403, 405, 407, 408, 409, 412, 413, 416, 418, 419, 421, 424, 429, 431, 432, 433, 434, 437, 438, 439, 441, 443, 444, 446, 447, 448, 451, 453, 454, 455, 459, 462, 463, 465, 466, 467, 469, 472, 473, 477, 478, 481, 484, 485, 486, 488, 492, 493, 495, 499, 500, 504, 505, 507, 509, 510, 515, 518, 520, 523, 524, 526, 532, 533, 537, 541, 544, 547, 548, 551, 552, 553, 560, 561, 563, 564, 566, 567, 568, 572, 574, 575, 577, 578, 579, 582, 585, 586, 587, 589, 593, 594, 598, 600, 605, 607, 610, 611, 612, 613, 614, 616, 617, 618, 619, 624, 625, 626, 627, 628, 632, 635, 636, 637, 640, 641, 643, 645, 652, 653, 654, 661, 663, 667, 670, 674, 676, 678, 681, 684, 690, 693, 695, 696, 697, 699, 701, 706, 709, 710, 713, 715, 716, 718, 719, 720, 724, 725, 728, 731, 734, 736, 737, 738, 742, 746, 749, 750, 754, 756, 760, 762, 763, 768, 770, 771, 773, 776, 777, 778, 779, 780, 781, 786, 794, 796, 798, 799, 801, 802, 803, 804, 805, 808, 809, 811, 812, 813, 815, 819, 821, 822, 824, 825, 826, 829, 836, 838, 839, 840, 842, 846, 847, 848, 850, 852, 854, 855, 856, 860, 861, 862, 868, 869, 873, 874, 876, 879, 880, 882, 883, 885, 886, 887, 889, 891, 892, 897, 901, 903, 909, 911, 914, 919, 920, 923, 924, 925, 927, 928, 932, 933, 934, 935, 936, 937, 938, 939, 944, 945, 946, 947, 948, 949, 951, 954, 955, 957, 960, 962, 966, 968, 969, 973, 976, 977, 978, 979, 980, 981, 985, 988, 993, 997, 998, 1001, 1002, 1006, 1008, 1009, 1012, 1019, 1020, 1022, 1026, 1028, 1030, 1032, 1033, 1034, 1036, 1037, 1038, 1039, 1040, 1043, 1046, 1047, 1049, 1051, 1053, 1058, 1059, 1062, 1065, 1066, 1067, 1069, 1070, 1072, 1075, 1077, 1078, 1083, 1084, 1085, 1086, 1089, 1090, 1096, 1098, 1101, 1102, 1103, 1106, 1109, 1115, 1120, 1122, 1123, 1124, 1129, 1133, 1134, 1137, 1138, 1139, 1144, 1146, 1152, 1153, 1155, 1157, 1159, 1161, 1163, 1166, 1168, 1170, 1172, 1174, 1179, 1181, 1184, 1185, 1190, 1191, 1192, 1194, 1195, 1196, 1197, 1199, 1204, 1205, 1208, 1212, 1214, 1218, 1219, 1222, 1223, 1224, 1225, 1226, 1228, 1229, 1230, 1233, 1239, 1240, 1245, 1246, 1251, 1254, 1255, 1257, 1258, 1262, 1263, 1265, 1268, 1270, 1271, 1273, 1274, 1277, 1282, 1284, 1285, 1289, 1290, 1293, 1295, 1297, 1299, 1300, 1305, 1306, 1307, 1308, 1310, 1318, 1321, 1324, 1328, 1329, 1330, 1333, 1334, 1335, 1336, 1338, 1339, 1340, 1341, 1342, 1345, 1348, 1349, 1351, 1353, 1355, 1356, 1358, 1360, 1361, 1363, 1364, 1365, 1370, 1373, 1375, 1376, 1379, 1382, 1385, 1389, 1390, 1391, 1392, 1395, 1400, 1403, 1405, 1406, 1411, 1412, 1413, 1416, 1419, 1421, 1423, 1424, 1426, 1427, 1430, 1432, 1433, 1434, 1438, 1439, 1442, 1443, 1444, 1456, 1459, 1462, 1466, 1467, 1469, 1473, 1474, 1476, 1481, 1485, 1486, 1487, 1488, 1489, 1492, 1495, 1497, 1499, 1503, 1504, 1505, 1507, 1508, 1509, 1510, 1511, 1515, 1520, 1523, 1526, 1533, 1535, 1537, 1538, 1547, 1549, 1552, 1558, 1560, 1574, 1578, 1579, 1580, 1583, 1584, 1585, 1586, 1588, 1589, 1594, 1597, 1600, 1606, 1608, 1611, 1612, 1615, 1617, 1631, 1632, 1633, 1634, 1636, 1637, 1639, 1640, 1642, 1643, 1647, 1648, 1649, 1654, 1656, 1663, 1664, 1665, 1667, 1669, 1670 and 408539-430762. |
| 33 | Human herpesvirus 10 | 6, 19, 20, 23, 24, 29, 31, 34, 48, 50, 51, 67, 69, 70, 73, 74, 77, 78, 104, 112, 114, 116, 120, 121, 141, 143, 151, 167, 174, 177, 179, 188, 204, 212, 219, 223, 231, 234, 239, 240, 247, 259, 276, 277, 279, 288, 290, 298, 303, 304, 306, 310, 315, 323, 334, 336, 339, 345, 351, 366, 367, 370, 380, 384, 385, 394, 396, 399, 400, 401, 410, 413, 422, 423, 424, 429, 431, 433, 452, 454, 462, 466, 478, 480, 481, 484, 500, 509, 510, 515, 518, 526, 544, 546, 561, 564, 568, 569, 572, 575, 576, 577, 582, 587, 598, 607, 609, 610, 612, 617, 624, 625, 627, 640, 643, 651, 652, 654, 661, 667, 674, 676, 681, 684, 688, 693, 710, 713, 720, 725, 731, 734, 737, 746, 749, 750, 754, 760, 770, 772, 777, 784, 795, 803, 812, 813, 816, 829, 839, 846, 847, 854, 859, 861, 862, 868, 873, 876, 879, 880, 881, 886, 887, 889, 909, 914, 935, 938, 947, 960, 962, 966, 973, 985, 988, 993, 1005, 1006, 1019, 1020, 1022, 1038, 1040, 1043, 1044, 1047, 1058, 1060, 1062, 1065, 1069, 1075, 1086, 1101, 1103, 1106, 1108, 1115, 1118, 1126, 1128, 1129, 1132, 1133, 1134, |

| ROW# | INFECTION NAME | SEQ ID NOs OF GAMS ASSOCIATED WITH INFECTION |
|---|---|---|
| | | 1135, 1139, 1153, 1156, 1164, 1165, 1168, 1172, 1176, 1185, 1190, 1195, 1196, 1197, 1198, 1203, 1204, 1225, 1251, 1257, 1258, 1268, 1293, 1299, 1310, 1321, 1327, 1328, 1335, 1338, 1343, 1353, 1357, 1363, 1364, 1392, 1394, 1397, 1402, 1410, 1411, 1412, 1423, 1424, 1426, 1467, 1469, 1473, 1476, 1485, 1486, 1487, 1488, 1507, 1510, 1511, 1520, 1526, 1538, 1553, 1572, 1574, 1579, 1580, 1585, 1606, 1631, 1633, 1637, 1640, 1643, 1657, 1669, 1672 and 430763-447103. |
| 34 | Human herpesvirus 2 | 4, 5, 9, 11, 12, 17, 19, 20, 23, 24, 29, 31, 33, 35, 37, 43, 47, 48, 49, 51, 54, 58, 59, 66, 67, 68, 70, 73, 74, 77, 78, 84, 85, 88, 89, 90, 91, 92, 93, 96, 101, 102, 105, 114, 117, 120, 127, 128, 129, 140, 143, 144, 145, 148, 151, 152, 154, 155, 162, 164, 166, 167, 169, 171, 174, 176, 177, 178, 182, 184, 185, 187, 188, 189, 192, 194, 196, 200, 203, 206, 210, 211, 212, 216, 217, 218, 219, 222, 223, 228, 229, 231, 232, 234, 235, 237, 239, 240, 245, 247, 250, 252, 253, 255, 256, 257, 259, 261, 262, 264, 267, 270, 272, 275, 277, 279, 284, 286, 287, 289, 290, 291, 292, 293, 294, 295, 296, 299, 303, 304, 306, 307, 310, 314, 315, 321, 323, 324, 325, 330, 332, 334, 335, 336, 339, 340, 343, 345, 346, 347, 350, 351, 352, 353, 356, 357, 362, 363, 365, 366, 367, 370, 374, 375, 376, 377, 378, 380, 381, 383, 385, 387, 393, 394, 395, 396, 397, 399, 400, 401, 403, 405, 406, 409, 412, 413, 416, 418, 420, 421, 423, 424, 429, 430, 431, 432, 433, 434, 437, 438, 439, 440, 441, 443, 446, 447, 448, 451, 453, 454, 457, 458, 462, 463, 465, 466, 467, 470, 472, 480, 481, 483, 484, 488, 490, 492, 493, 495, 496, 499, 500, 504, 505, 507, 509, 510, 514, 515, 518, 520, 524, 526, 527, 532, 533, 535, 537, 541, 543, 544, 547, 548, 550, 551, 553, 554, 555, 559, 560, 561, 562, 563, 564, 566, 567, 572, 574, 575, 577, 579, 582, 584, 585, 587, 591, 593, 594, 598, 599, 600, 605, 607, 610, 611, 612, 613, 614, 615, 617, 618, 619, 624, 625, 626, 627, 632, 635, 637, 640, 641, 642, 648, 652, 653, 654, 655, 660, 661, 663, 667, 670, 674, 676, 681, 684, 685, 687, 693, 695, 697, 701, 702, 703, 709, 710, 712, 713, 714, 715, 719, 720, 721, 731, 734, 736, 737, 746, 749, 750, 754, 756, 760, 763, 773, 776, 777, 779, 780, 783, 786, 796, 798, 799, 801, 802, 803, 804, 805, 808, 811, 812, 813, 815, 819, 821, 822, 826, 829, 836, 838, 839, 840, 843, 845, 846, 847, 848, 853, 854, 855, 856, 860, 861, 862, 868, 869, 873, 874, 876, 879, 882, 886, 887, 889, 890, 891, 892, 901, 909, 911, 912, 914, 916, 919, 920, 921, 924, 925, 927, 929, 933, 934, 935, 936, 937, 938, 945, 946, 947, 948, 954, 956, 959, 960, 962, 966, 969, 973, 976, 977, 979, 980, 981, 985, 988, 990, 993, 994, 997, 998, 999, 1001, 1002, 1006, 1008, 1009, 1012, 1018, 1019, 1020, 1022, 1023, 1026, 1032, 1033, 1035, 1037, 1038, 1039, 1040, 1043, 1046, 1047, 1049, 1051, 1053, 1055, 1058, 1062, 1065, 1069, 1070, 1072, 1073, 1075, 1076, 1078, 1081, 1083, 1084, 1086, 1088, 1090, 1091, 1096, 1101, 1102, 1103, 1104, 1106, 1112, 1118, 1120, 1121, 1122, 1123, 1128, 1129, 1130, 1131, 1133, 1134, 1136, 1137, 1138, 1139, 1144, 1146, 1152, 1153, 1157, 1158, 1159, 1161, 1162, 1163, 1166, 1167, 1168, 1172, 1174, 1177, 1179, 1180, 1181, 1185, 1190, 1191, 1192, 1194, 1195, 1196, 1197, 1199, 1204, 1205, 1208, 1212, 1214, 1219, 1222, 1225, 1226, 1227, 1228, 1230, 1239, 1245, 1250, 1251, 1254, 1255, 1257, 1258, 1262, 1268, 1270, 1271, 1273, 1274, 1284, 1289, 1290, 1293, 1297, 1298, 1299, 1300, 1301, 1305, 1306, 1307, 1316, 1318, 1319, 1321, 1324, 1328, 1330, 1334, 1335, 1336, 1337, 1338, 1339, 1340, 1344, 1348, 1349, 1351, 1353, 1356, 1360, 1363, 1364, 1367, 1373, 1375, 1379, 1383, 1385, 1389, 1390, 1391, 1392, 1399, 1400, 1403, 1406, 1411, 1412, 1416, 1420, 1421, 1423, 1424, 1425, 1426, 1427, 1432, 1433, 1435, 1436, 1439, 1442, 1444, 1456, 1459, 1462, 1464, 1467, 1469, 1473, 1476, 1480, 1481, 1485, 1486, 1487, 1488, 1492, 1493, 1495, 1497, 1498, 1499, 1503, 1505, 1507, 1508, 1511, 1514, 1515, 1520, 1521, 1523, 1526, 1533, 1535, 1540, 1547, 1549, 1552, 1555, 1559, 1568, 1572, 1574, 1577, 1578, 1579, 1580, 1581, 1584, 1585, 1586, 1589, 1594, 1597, 1600, 1606, 1610, 1611, 1612, 1613, 1617, 1628, 1631, 1632, 1633, 1634, 1636, 1637, 1638, 1639, 1640, 1643, 1644, 1647, 1648, 1649, 1651, 1652, 1654, 1656, 1665, 1667, 1669, 1670 and 447104-468934. |
| 35 | Human herpesvirus 3 | 4, 9, 11, 18, 19, 20, 23, 24, 29, 31, 35, 37, 43, 45, 47, 48, 49, 51, 54, 59, 66, 67, 68, 70, 72, 73, 74, 77, 78, 85, 88, 89, 92, 93, 96, 99, 101, 105, 114, 120, 130, 143, 144, 148, 152, 154, 166, 169, 171, 174, 177, 187, 188, 189, 191, 192, 200, 203, 211, 212, 216, 219, 229, 231, 234, 235, 239, 240, 242, 247, 252, 261, 262, 272, 274, 275, 277, 279, 284, 286, 289, 290, 292, 293, 295, 296, 303, 304, 310, 315, 321, 322, 323, 327, 334, 336, 339, 345, 346, 347, 353, 355, 356, 357, 366, 367, 369, 370, 374, 376, 377, 380, 393, 394, 395, 396, 399, 400, 401, 405, 411, 413, 414, 416, 418, 423, 424, 429, 431, 433, 437, 439, 441, 443, 446, 447, 449, 451, 453, 454, 462, 463, 465, 466, 467, 481, 484, 486, 487, 488, 492, 495, 500, 507, 509, 510, 515, 518, 520, 523, 526, 529, 537, 541, 544, 547, 551, 553, 560, 561, 563, 564, 566, 567, 574, 575, 577, 579, 585, 587, 589, 594, 598, 600, 605, 607, 610, 612, 614, 615, 617, 619, 624, 625, 627, 632, 635, 637, 640, 641, 652, 653, 654, 661, 663, 667, 673, 676, 681, 684, 701, 709, 710, 713, 715, 716, 720, 721, 731, 734, 737, 740, 742, 746, 749, 754, 756, 759, 760, 763, 773, 776, 777, 786, 798, 801, 803, 804, 805, 808, 811, 813, 826, 829, 838, 839, 840, 846, 847, 848, 854, 855, 856, 861, 862, 863, 868, 873, 876, 879, 882, 886, 887, 889, 891, 901, 909, 911, 914, 918, 920, 924, 925, 927, 935, 936, 938, 945, 946, 947, 954, 960, 962, 966, 969, 973, 977, 979, 980, 985, 987, 988, 996, 997, 998, 1001, 1006, 1008, 1009, 1011, 1018, 1019, 1020, 1030, 1033, 1037, 1038, 1040, 1047, 1049, 1053, 1058, 1062, 1065, 1069, 1070, 1073, 1078, 1084, 1086, 1090, 1096, 1098, 1101, 1103, 1104, 1106, 1121, 1122, 1123, 1126, 1129, 1133, 1134, 1138, 1139, 1144, 1152, 1153, 1159, 1161, 1163, 1166, 1167, 1168, 1172, 1174, 1179, 1181, 1185, 1190, 1192, 1195, 1196, 1199, 1204, 1205, 1212, 1214, 1219, |

| ROW# | INFECTION NAME | SEQ ID NOs OF GAMS ASSOCIATED WITH INFECTION |
|---|---|---|
| | | 1222, 1224, 1225, 1230, 1231, 1239, 1245, 1251, 1254, 1257, 1258, 1262, 1268, 1270, 1271, 1272, 1273, 1274, 1283, 1284, 1290, 1293, 1297, 1299, 1306, 1307, 1321, 1328, 1330, 1335, 1336, 1338, 1339, 1340, 1344, 1345, 1348, 1349, 1351, 1353, 1355, 1359, 1362, 1363, 1364, 1367, 1373, 1378, 1385, 1390, 1391, 1392, 1399, 1406, 1407, 1411, 1412, 1416, 1423, 1424, 1426, 1432, 1438, 1442, 1444, 1449, 1455, 1456, 1459, 1460, 1467, 1469, 1472, 1473, 1474, 1476, 1479, 1481, 1485, 1486, 1487, 1488, 1497, 1503, 1504, 1505, 1507, 1511, 1520, 1523, 1526, 1541, 1547, 1549, 1551, 1552, 1554, 1570, 1574, 1578, 1579, 1580, 1584, 1586, 1589, 1591, 1594, 1598, 1606, 1608, 1611, 1617, 1631, 1633, 1637, 1639, 1640, 1643, 1647, 1652, 1654, 1656, 1661, 1665, 1669, 1670 and 468935-489881. |
| 36 | Human herpesvirus 4 (Epstein-Barr virus) | 19, 24, 29, 33, 51, 60, 74, 77, 81, 93, 97, 99, 117, 118, 121, 126, 127, 129, 130, 131, 133, 148, 151, 155, 162, 164, 167, 169, 183, 186, 189, 198, 203, 210, 212, 222, 223, 231, 234, 240, 247, 250, 253, 267, 270, 279, 290, 291, 302, 304, 307, 310, 314, 324, 326, 332, 335, 342, 347, 349, 352, 367, 370, 373, 376, 382, 383, 384, 392, 406, 412, 423, 424, 429, 432, 441, 442, 447, 461, 476, 493, 494, 502, 505, 517, 529, 530, 532, 533, 545, 548, 553, 563, 571, 575, 584, 587, 598, 602, 604, 614, 632, 636, 643, 645, 654, 657, 673, 677, 690, 691, 696, 697, 733, 735, 746, 770, 771, 779, 784, 792, 795, 798, 801, 803, 808, 813, 819, 825, 847, 858, 861, 863, 872, 877, 919, 923, 942, 947, 960, 978, 981, 990, 997, 999, 1011, 1012, 1015, 1022, 1023, 1038, 1039, 1042, 1046, 1051, 1052, 1053, 1063, 1067, 1075, 1083, 1085, 1086, 1090, 1092, 1120, 1126, 1128, 1129, 1131, 1133, 1139, 1146, 1154, 1163, 1166, 1179, 1184, 1188, 1194, 1195, 1201, 1205, 1209, 1223, 1224, 1226, 1228, 1241, 1245, 1264, 1269, 1285, 1287, 1289, 1293, 1295, 1298, 1305, 1308, 1315, 1316, 1330, 1337, 1341, 1352, 1356, 1359, 1360, 1363, 1375, 1378, 1382, 1387, 1391, 1394, 1404, 1405, 1406, 1408, 1410, 1411, 1412, 1423, 1425, 1443, 1444, 1451, 1458, 1466, 1467, 1485, 1489, 1490, 1493, 1495, 1501, 1509, 1517, 1526, 1528, 1538, 1545, 1566, 1577, 1583, 1593, 1596, 1600, 1610, 1627, 1632, 1633, 1642, 1643, 1645, 1650, 1653, 1664, 1669 and 489882-493677. |
| 37 | Human herpesvirus 5 | 1, 2, 4, 6, 7, 9, 11, 13, 17, 19, 20, 21, 23, 24, 27, 29, 31, 35, 36, 37, 40, 41, 43, 45, 47, 48, 49, 50, 51, 63, 64, 66, 67, 68, 69, 70, 71, 72, 73, 74, 77, 78, 83, 85, 86, 88, 92, 93, 95, 96, 97, 99, 100, 105, 112, 114, 120, 121, 123, 127, 128, 129, 130, 133, 134, 140, 141, 143, 144, 148, 149, 150, 152, 154, 156, 159, 162, 164, 165, 166, 167, 168, 169, 171, 172, 174, 176, 177, 179, 180, 181, 182, 184, 186, 187, 188, 189, 192, 195, 196, 200, 201, 202, 203, 204, 206, 207, 209, 210, 211, 212, 216, 217, 218, 219, 220, 222, 227, 228, 229, 231, 232, 233, 234, 235, 238, 239, 240, 247, 250, 251, 252, 253, 254, 255, 256, 259, 261, 262, 264, 265, 271, 272, 274, 276, 277, 279, 284, 286, 289, 290, 292, 293, 294, 295, 296, 297, 301, 302, 303, 304, 309, 310, 311, 314, 315, 316, 317, 319, 321, 323, 325, 326, 327, 332, 334, 336, 339, 340, 342, 345, 346, 347, 348, 349, 350, 353, 356, 357, 360, 361, 362, 363, 366, 367, 368, 369, 370, 373, 374, 376, 380, 381, 382, 386, 387, 392, 393, 394, 395, 396, 397, 398, 399, 400, 401, 404, 405, 406, 407, 410, 412, 413, 415, 416, 418, 419, 423, 424, 429, 431, 433, 437, 440, 441, 443, 444, 446, 447, 448, 451, 452, 453, 454, 456, 458, 459, 462, 463, 464, 465, 466, 467, 468, 469, 472, 476, 477, 478, 481, 482, 484, 485, 488, 490, 492, 493, 495, 496, 500, 504, 505, 507, 508, 509, 510, 511, 515, 518, 520, 521, 523, 524, 526, 530, 532, 533, 535, 537, 540, 541, 543, 544, 545, 547, 548, 550, 551, 552, 553, 555, 559, 560, 561, 562, 563, 564, 566, 567, 569, 570, 572, 574, 575, 577, 578, 579, 582, 585, 586, 587, 594, 596, 597, 598, 600, 604, 605, 607, 610, 612, 613, 614, 615, 616, 617, 618, 619, 624, 625, 626, 627, 632, 634, 635, 636, 637, 640, 641, 648, 649, 652, 653, 654, 656, 657, 658, 661, 663, 667, 669, 670, 671, 674, 676, 680, 681, 684, 688, 693, 696, 697, 698, 701, 702, 709, 710, 712, 713, 715, 720, 724, 729, 731, 733, 734, 735, 737, 738, 739, 740, 741, 742, 746, 748, 749, 754, 756, 758, 759, 760, 762, 763, 765, 766, 767, 769, 773, 776, 777, 779, 784, 786, 793, 795, 798, 799, 801, 802, 803, 804, 806, 808, 809, 811, 813, 815, 817, 819, 821, 827, 829, 833, 834, 838, 839, 840, 841, 842, 843, 844, 846, 847, 848, 851, 853, 854, 855, 856, 858, 859, 860, 861, 862, 864, 867, 868, 869, 873, 874, 875, 876, 877, 880, 881, 882, 883, 884, 885, 886, 887, 889, 891, 892, 893, 895, 901, 904, 909, 910, 911, 914, 919, 920, 921, 924, 925, 927, 929, 931, 932, 934, 935, 936, 937, 938, 939, 940, 942, 946, 947, 948, 954, 955, 956, 958, 959, 960, 962, 966, 969, 973, 976, 977, 978, 979, 980, 985, 987, 988, 989, 990, 991, 992, 993, 997, 998, 999, 1000, 1001, 1002, 1005, 1006, 1008, 1009, 1012, 1013, 1014, 1015, 1017, 1019, 1020, 1022, 1028, 1029, 1031, 1033, 1034, 1035, 1037, 1038, 1039, 1040, 1043, 1046, 1047, 1049, 1052, 1053, 1058, 1060, 1062, 1063, 1065, 1066, 1067, 1068, 1069, 1070, 1071, 1075, 1076, 1078, 1079, 1081, 1083, 1084, 1086, 1088, 1090, 1094, 1096, 1101, 1102, 1106, 1109, 1115, 1118, 1119, 1120, 1123, 1128, 1129, 1130, 1131, 1132, 1133, 1134, 1137, 1138, 1139, 1140, 1144, 1145, 1150, 1152, 1153, 1155, 1157, 1159, 1161, 1162, 1163, 1166, 1168, 1172, 1174, 1177, 1180, 1181, 1185, 1186, 1190, 1191, 1192, 1194, 1195, 1196, 1197, 1198, 1199, 1201, 1204, 1205, 1207, 1208, 1211, 1212, 1219, 1223, 1224, 1225, 1226, 1228, 1229, 1234, 1239, 1245, 1249, 1250, 1251, 1253, 1254, 1257, 1258, 1261, 1262, 1263, 1264, 1265, 1268, 1270, 1271, 1272, 1273, 1274, 1277, 1284, 1285, 1290, 1291, 1293, 1294, 1297, 1299, 1300, 1306, 1307, 1308, 1309, 1318, 1320, 1321, 1324, 1326, 1327, 1328, 1330, 1331, 1332, 1334, 1335, 1337, 1338, 1339, 1340, 1343, 1345, 1346, 1348, 1349, 1351, 1353, 1355, 1356, 1358, 1359, 1360, 1363, 1364, 1370, 1372, 1373, 1377, 1378, 1379, 1380, 1382, 1385, 1386, 1389, 1390, 1391, 1392, 1396, 1398, 1400, 1402, 1403, 1404, 1405, 1406, 1408, 1410, 1411, 1412, 1414, 1416, 1418, 1421, 1423, 1424, 1425, 1426, 1427, |

-continued

| ROW# | INFECTION NAME | SEQ ID NOs OF GAMS ASSOCIATED WITH INFECTION |
|---|---|---|
| | | 1432, 1434, 1436, 1437, 1438, 1439, 1442, 1444, 1447, 1449, 1451, 1453, 1456, 1457, 1459, 1460, 1464, 1466, 1467, 1469, 1473, 1474, 1475, 1476, 1477, 1478, 1481, 1485, 1486, 1487, 1488, 1492, 1493, 1499, 1501, 1503, 1505, 1507, 1509, 1511, 1513, 1514, 1519, 1520, 1521, 1522, 1523, 1526, 1530, 1533, 1535, 1538, 1541, 1544, 1545, 1546, 1547, 1549, 1552, 1553, 1555, 1559, 1563, 1566, 1567, 1569, 1570, 1574, 1578, 1579, 1580, 1582, 1584, 1585, 1586, 1594, 1596, 1597, 1600, 1606, 1607, 1608, 1609, 1611, 1612, 1615, 1617, 1618, 1625, 1626, 1628, 1629, 1630, 1631, 1632, 1633, 1634, 1636, 1637, 1638, 1639, 1640, 1643, 1644, 1648, 1652, 1654, 1656, 1664, 1665, 1669, 1670 and 527975-565503. |
| 38 | Human herpesvirus 6 | 2, 5, 8, 9, 17, 23, 26, 46, 48, 50, 60, 61, 72, 77, 88, 93, 97, 105, 112, 118, 122, 132, 133, 141, 148, 152, 164, 167, 178, 182, 183, 185, 191, 192, 196, 199, 202, 212, 220, 223, 232, 233, 243, 252, 260, 264, 275, 279, 287, 290, 296, 297, 302, 303, 315, 317, 343, 352, 355, 357, 360, 361, 362, 373, 378, 380, 383, 384, 386, 403, 404, 407, 409, 419, 423, 438, 441, 442, 447, 449, 450, 451, 455, 456, 464, 466, 469, 470, 487, 489, 490, 493, 494, 499, 505, 508, 520, 522, 525, 532, 537, 544, 545, 557, 560, 561, 562, 585, 589, 595, 599, 623, 626, 628, 632, 649, 661, 670, 695, 696, 697, 698, 706, 713, 714, 716, 718, 720, 721, 728, 733, 736, 739, 740, 744, 752, 760, 769, 774, 781, 785, 786, 805, 808, 829, 831, 839, 846, 847, 852, 854, 855, 873, 876, 892, 896, 911, 921, 929, 932, 933, 935, 937, 946, 956, 957, 958, 964, 968, 979, 982, 991, 997, 1009, 1015, 1023, 1028, 1029, 1030, 1040, 1047, 1052, 1062, 1065, 1069, 1073, 1094, 1103, 1104, 1105, 1109, 1110, 1121, 1124, 1128, 1138, 1153, 1154, 1157, 1170, 1172, 1184, 1192, 1194, 1195, 1201, 1205, 1209, 1214, 1219, 1221, 1222, 1230, 1231, 1239, 1241, 1249, 1265, 1269, 1272, 1275, 1282, 1284, 1292, 1294, 1311, 1328, 1330, 1331, 1332, 1333, 1334, 1335, 1337, 1338, 1342, 1344, 1356, 1359, 1360, 1363, 1368, 1378, 1385, 1392, 1396, 1401, 1403, 1404, 1407, 1413, 1416, 1427, 1431, 1434, 1435, 1436, 1439, 1444, 1448, 1460, 1462, 1464, 1467, 1474, 1482, 1492, 1495, 1496, 1497, 1504, 1523, 1526, 1536, 1537, 1540, 1551, 1555, 1558, 1560, 1563, 1567, 1571, 1577, 1588, 1589, 1593, 1594, 1597, 1604, 1628, 1634, 1636, 1638, 1644, 1659 and 565504-567893. |
| 39 | Human herpesvirus 6B | 1, 4, 5, 8, 9, 17, 18, 19, 20, 23, 26, 29, 40, 46, 48, 50, 54, 61, 88, 93, 95, 99, 100, 122, 124, 132, 134, 141, 143, 145, 150, 152, 161, 165, 176, 196, 201, 226, 231, 233, 240, 242, 250, 264, 277, 289, 290, 292, 296, 297, 300, 302, 310, 315, 316, 320, 321, 340, 343, 347, 349, 355, 362, 365, 369, 370, 375, 378, 380, 384, 388, 403, 406, 407, 418, 423, 424, 429, 439, 447, 450, 466, 469, 472, 473, 485, 487, 489, 490, 493, 496, 501, 502, 503, 505, 510, 517, 520, 522, 525, 528, 529, 530, 532, 533, 537, 542, 550, 552, 553, 560, 563, 566, 575, 577, 579, 599, 602, 614, 615, 620, 626, 628, 633, 652, 677, 678, 685, 695, 703, 706, 710, 712, 721, 722, 724, 725, 728, 735, 737, 740, 765, 769, 774, 777, 782, 783, 786, 790, 793, 801, 803, 805, 808, 810, 821, 826, 831, 846, 850, 854, 861, 863, 873, 874, 876, 883, 886, 890, 892, 918, 924, 932, 933, 934, 937, 939, 941, 944, 946, 949, 957, 958, 962, 968, 974, 975, 977, 980, 987, 992, 993, 997, 999, 1001, 1009, 1012, 1014, 1015, 1025, 1032, 1047, 1051, 1053, 1059, 1065, 1066, 1069, 1072, 1076, 1081, 1091, 1094, 1103, 1105, 1110, 1121, 1127, 1138, 1152, 1155, 1157, 1166, 1172, 1179, 1195, 1197, 1199, 1201, 1205, 1207, 1214, 1219, 1222, 1227, 1228, 1230, 1231, 1239, 1245, 1270, 1272, 1281, 1285, 1292, 1295, 1297, 1303, 1307, 1309, 1311, 1315, 1320, 1321, 1324, 1328, 1331, 1334, 1340, 1342, 1344, 1352, 1355, 1358, 1362, 1363, 1366, 1378, 1385, 1391, 1396, 1403, 1407, 1413, 1415, 1416, 1426, 1431, 1433, 1435, 1439, 1444, 1447, 1451, 1462, 1467, 1473, 1478, 1480, 1485, 1495, 1497, 1509, 1518, 1526, 1530, 1535, 1545, 1547, 1551, 1554, 1559, 1577, 1578, 1580, 1585, 1589, 1591, 1594, 1596, 1597, 1608, 1619, 1626, 1628, 1634, 1638, 1643, 1644, 1650, 1653, 1657, 1660, 1661, 1669 and 567894-570313. |
| 40 | Human herpesvirus 7 | 4, 5, 7, 8, 9, 10, 14, 15, 16, 17, 18, 19, 20, 22, 23, 24, 25, 26, 28, 29, 31, 36, 37, 40, 42, 47, 48, 49, 50, 51, 56, 60, 61, 62, 63, 67, 68, 70, 72, 73, 74, 77, 78, 86, 88, 89, 96, 97, 101, 105, 106, 109, 112, 114, 116, 120, 122, 127, 130, 132, 133, 134, 140, 141, 143, 144, 150, 151, 154, 158, 159, 162, 163, 166, 169, 171, 173, 174, 177, 179, 180, 183, 187, 188, 189, 190, 191, 196, 197, 199, 200, 201, 202, 203, 204, 207, 210, 211, 212, 218, 221, 222, 226, 231, 232, 233, 235, 236, 237, 239, 240, 241, 244, 246, 247, 248, 249, 252, 253, 262, 265, 266, 267, 269, 271, 276, 277, 279, 280, 281, 285, 286, 288, 290, 293, 296, 298, 299, 302, 303, 304, 306, 308, 310, 314, 315, 316, 319, 321, 323, 325, 328, 332, 334, 339, 342, 345, 347, 348, 350, 356, 357, 358, 359, 360, 361, 366, 367, 368, 369, 370, 374, 376, 378, 380, 382, 388, 389, 391, 393, 394, 397, 399, 400, 401, 404, 407, 408, 409, 413, 424, 426, 427, 429, 431, 433, 442, 443, 444, 446, 447, 450, 452, 453, 454, 460, 462, 463, 466, 470, 475, 478, 481, 482, 484, 485, 486, 488, 489, 500, 502, 503, 506, 507, 508, 509, 510, 512, 515, 516, 517, 518, 519, 520, 522, 523, 525, 526, 536, 537, 538, 541, 544, 546, 549, 551, 553, 557, 559, 561, 563, 564, 567, 571, 575, 576, 577, 579, 580, 583, 585, 586, 587, 592, 602, 607, 608, 610, 611, 612, 617, 620, 621, 624, 626, 627, 631, 633, 634, 635, 636, 637, 638, 639, 640, 641, 643, 645, 646, 649, 651, 652, 654, 656, 657, 659, 661, 663, 667, 670, 671, 673, 676, 681, 682, 684, 686, 688, 689, 691, 692, 693, 694, 701, 703, 707, 709, 710, 712, 713, 714, 715, 716, 717, 720, 724, 729, 731, 734, 737, 739, 742, 744, 746, 749, 750, 751, 753, 754, 758, 760, 761, 764, 765, 766, 767, 769, 771, 777, 779, 780, 781, 784, 786, 790, 793, 795, 801, 802, 803, 805, 808, 810, 812, 813, 817, 820, 821, 827, 829, 830, 836, 838, 839, 842, 846, 847, 854, 855, 856, 858, 860, 861, 862, 864, 867, 873, 875, 876, 877, 879, 881, 882, 883, |

| ROW# | INFECTION NAME | SEQ ID NOs OF GAMS ASSOCIATED WITH INFECTION |
|---|---|---|
| | | 884, 886, 888, 889, 891, 894, 898, 899, 900, 901, 903, 905, 907, 909, 911, 913, 914, 920, 924, 927, 929, 931, 935, 938, 947, 953, 954, 959, 960, 961, 962, 965, 966, 971, 973, 975, 977, 980, 982, 983, 985, 988, 991, 992, 996, 997, 1002, 1004, 1005, 1006, 1007, 1008, 1009, 1013, 1015, 1016, 1017, 1019, 1020, 1021, 1022, 1024, 1028, 1029, 1031, 1036, 1038, 1039, 1041, 1046, 1049, 1050, 1058, 1060, 1062, 1063, 1065, 1069, 1070, 1071, 1074, 1076, 1078, 1083, 1086, 1092, 1094, 1095, 1099, 1101, 1103, 1106, 1108, 1109, 1110, 1111, 1114, 1118, 1120, 1122, 1123, 1126, 1127, 1128, 1129, 1131, 1133, 1134, 1135, 1138, 1139, 1140, 1141, 1144, 1146, 1152, 1153, 1154, 1156, 1157, 1159, 1163, 1166, 1168, 1172, 1173, 1174, 1175, 1181, 1182, 1184, 1185, 1186, 1187, 1190, 1191, 1194, 1195, 1196, 1197, 1198, 1199, 1202, 1204, 1205, 1206, 1207, 1211, 1212, 1214, 1215, 1218, 1219, 1220, 1221, 1222, 1225, 1226, 1227, 1230, 1233, 1235, 1237, 1243, 1248, 1249, 1251, 1252, 1255, 1256, 1257, 1258, 1259, 1260, 1261, 1266, 1267, 1268, 1270, 1271, 1272, 1275, 1277, 1279, 1280, 1282, 1283, 1284, 1285, 1288, 1289, 1293, 1295, 1296, 1297, 1299, 1300, 1303, 1305, 1310, 1311, 1312, 1314, 1316, 1321, 1326, 1327, 1328, 1330, 1331, 1333, 1335, 1338, 1344, 1346, 1349, 1353, 1355, 1356, 1358, 1359, 1363, 1366, 1370, 1374, 1377, 1380, 1388, 1390, 1392, 1394, 1401, 1409, 1411, 1412, 1416, 1419, 1422, 1423, 1424, 1426, 1429, 1433, 1436, 1437, 1440, 1441, 1442, 1444, 1445, 1463, 1464, 1467, 1468, 1469, 1472, 1473, 1475, 1476, 1483, 1484, 1485, 1486, 1487, 1488, 1492, 1497, 1505, 1507, 1509, 1511, 1512, 1513, 1516, 1517, 1520, 1521, 1522, 1523, 1526, 1533, 1534, 1538, 1543, 1545, 1547, 1549, 1553, 1557, 1558, 1560, 1562, 1565, 1567, 1570, 1574, 1578, 1579, 1580, 1582, 1583, 1585, 1589, 1594, 1596, 1599, 1606, 1611, 1614, 1615, 1619, 1621, 1622, 1625, 1627, 1629, 1631, 1632, 1633, 1636, 1637, 1638, 1640, 1642, 1643, 1644, 1645, 1647, 1654, 1655, 1656, 1658, 1660, 1661, 1663, 1669 and 570314-612723. |
| 41 | Human herpesvirus 9 | 6, 9, 24, 40, 47, 68, 78, 128, 130, 150, 174, 177, 221, 223, 234, 247, 248, 271, 272, 279, 304, 306, 328, 334, 336, 345, 356, 370, 380, 384, 394, 403, 429, 431, 437, 466, 467, 478, 512, 537, 553, 561, 564, 575, 577, 590, 596, 598, 601, 619, 643, 688, 691, 713, 731, 770, 779, 803, 822, 823, 827, 836, 847, 855, 879, 881, 909, 931, 935, 945, 979, 993, 998, 1006, 1031, 1047, 1068, 1078, 1106, 1117, 1118, 1129, 1133, 1139, 1161, 1173, 1178, 1186, 1195, 1198, 1249, 1250, 1251, 1261, 1273, 1302, 1304, 1326, 1328, 1331, 1333, 1335, 1338, 1339, 1340, 1363, 1370, 1374, 1380, 1385, 1392, 1393, 1394, 1396, 1416, 1419, 1424, 1425, 1431, 1480, 1502, 1513, 1523, 1538, 1549, 1585, 1630, 1656 and 614865-620650. |
| 42 | Human immunodeficiency virus 1 (HIV-1) | 33, 61, 117, 132, 133, 210, 222, 243, 352, 505, 553, 776, 777, 960, 1039, 1046, 1154, 1195, 1292, 1298, 1353, 1391, 1405, 1411, 1489, 1504, 1546, 1632 and 620651-620770. |
| 43 | Human immunodeficiency virus 2 (HIV-2) | 198, 210, 222, 260, 310, 658, 714, 810, 860, 958, 999, 1046, 1074, 1143, 1195, 1261, 1264, 1287, 1305, 1460, 1509, 1546, 1632, 1645 and 701430-701510. |
| 44 | Human metapneumovirus | 1, 17, 20, 29, 36, 44, 73, 77, 112, 120, 154, 161, 186, 224, 231, 240, 276, 277, 284, 286, 288, 289, 290, 310, 321, 347, 356, 361, 429, 454, 455, 463, 488, 518, 527, 529, 544, 548, 554, 566, 575, 579, 585, 616, 625, 626, 643, 652, 653, 663, 676, 694, 696, 710, 712, 737, 739, 742, 768, 793, 795, 803, 813, 826, 839, 855, 876, 890, 894, 909, 920, 925, 941, 959, 962, 980, 1015, 1028, 1029, 1062, 1079, 1091, 1092, 1094, 1101, 1118, 1139, 1140, 1143, 1144, 1163, 1168, 1170, 1173, 1187, 1190, 1195, 1206, 1208, 1218, 1233, 1241, 1244, 1250, 1258, 1274, 1282, 1292, 1293, 1297, 1310, 1315, 1321, 1325, 1335, 1340, 1344, 1359, 1426, 1442, 1469, 1471, 1473, 1482, 1485, 1505, 1562, 1568, 1580, 1583, 1585, 1586, 1592, 1599, 1624, 1642, 1664, 1669 and 782091-786807. |
| 45 | Human papillomavirus type 11 | 69, 126, 162, 233, 235, 408, 411, 528, 578, 615, 776, 806, 822, 987, 1035, 1103, 1222, 1277, 1320, 1331, 1335, 1513, 1515, 1551, 1637, 1644, 1661 and 786808-787035. |
| 46 | Human papillomavirus type 16 | 26, 64, 110, 162, 165, 166, 388, 466, 511, 555, 630, 649, 682, 723, 724, 1221, 1239, 1331, 1671 and 787036-787200. |
| 47 | Human papillomavirus type 17 | 97, 114, 169, 262, 410, 446, 541, 714, 787, 862, 884, 939, 1035, 1061, 1092, 1152, 1195, 1271, 1323, 1363, 1402, 1416, 1486, 1506, 1598, 1636 and 787201-788364. |
| 48 | Human papillomavirus type 18 | 125, 134, 223, 265, 320, 438, 501, 545, 806, 872, 999, 1015, 1272, 1275, 1285, 1362, 1376, 1422, 1454, 1466, 1489, 1521, 1558, 1559 and 788365-788549. |
| 49 | Human papillomavirus type 18, complete genome | 10, 410, 639, 1043, 1060, 1118, 1186, 1374, 1637 and 788550-789320. |
| 50 | Human papillomavirus type 19 | 7, 10, 19, 21, 33, 34, 42, 48, 49, 51, 53, 56, 59, 68, 77, 78, 80, 84, 88, 92, 96, 101, 102, 105, 113, 122, 125, 127, 129, 134, 148, 151, 157, 159, 168, 169, 173, 174, 177, 180, 184, 190, 193, 200, 203, 205, 207, 210, 211, 217, 221, 222, 231, 233, 234, 236, 249, 252, 256, 260, 261, 262, 272, 274, 279, 280, 286, 289, 290, 295, 296, 298, 303, 312, 315, 319, 323, 325, 328, 334, 338, 339, 343, 344, 345, 349, 356, 357, 358, 366, 367, 370, 371, 373, 378, 380, 387, 394, 396, 399, 402, 404, 408, 409, 410, 412, 419, 421, 422, 423, 425, 429, 433, 434, 437, 443, 446, 450, 454, 458, 462, 463, 466, 467, 469, 474, 478, 481, 484, 485, 486, 491, 492, 493, 498, 500, 505, 506, 507, 510, 515, 520, 521, 522, 526, 527, 537, 539, 540, 544, 546, 551, 552, 553, 563, 564, 565, 567, 568, 569, 570, 575, 582, 585, 586, 595, 597, 598, 603, 607, 610, 613, 617, 619, 627, 635, 639, 641, 654, 661, 665, 668, 669, 671, 674, 684, 688, 691, 693, 697, 700, 701, 706, 707, 731, 736, 745, 749, 750, 758, 762, 767, 776, 777, 783, 786, 788, 798, 803, 809, 812, 813, 814, 816, 817, 830, 835, 839, 846, 850, 854, 860, 862, 875, 876, 879, 881, 884, 894, 905, 908, 909, 911, 914, 919, 920, 924, 927, 932, 935, 939, 940, 945, 947, |

-continued

| ROW# | INFECTION NAME | SEQ ID NOs OF GAMS ASSOCIATED WITH INFECTION |
|---|---|---|
| | | 949, 954, 959, 960, 962, 965, 972, 973, 977, 978, 983, 984, 985, 989, 992, 993, 994, 1002, 1005, 1006, 1008, 1009, 1011, 1012, 1031, 1033, 1038, 1039, 1046, 1047, 1062, 1065, 1068, 1069, 1070, 1071, 1076, 1078, 1081, 1082, 1086, 1092, 1095, 1099, 1106, 1108, 1119, 1122, 1125, 1128, 1129, 1130, 1132, 1133, 1135, 1144, 1149, 1152, 1156, 1157, 1159, 1163, 1168, 1173, 1174, 1177, 1180, 1182, 1185, 1186, 1187, 1190, 1191, 1193, 1195, 1196, 1197, 1198, 1200, 1204, 1205, 1212, 1216, 1218, 1219, 1224, 1227, 1237, 1249, 1250, 1251, 1261, 1266, 1267, 1269, 1270, 1271, 1278, 1287, 1293, 1295, 1297, 1299, 1300, 1305, 1312, 1316, 1318, 1319, 1327, 1328, 1330, 1335, 1340, 1343, 1345, 1349, 1350, 1353, 1359, 1363, 1364, 1366, 1372, 1374, 1376, 1377, 1380, 1381, 1382, 1384, 1388, 1390, 1402, 1403, 1405, 1410, 1411, 1412, 1416, 1423, 1424, 1427, 1428, 1429, 1442, 1452, 1455, 1467, 1469, 1476, 1478, 1482, 1484, 1486, 1488, 1492, 1495, 1496, 1503, 1507, 1509, 1510, 1511, 1513, 1521, 1525, 1537, 1538, 1543, 1549, 1568, 1569, 1573, 1578, 1584, 1585, 1590, 1591, 1592, 1596, 1605, 1611, 1620, 1621, 1622, 1629, 1632, 1636, 1637, 1640, 1645, 1653, 1654, 1656, 1663, 1665, 1670 and 789321-813754. |
| 51 | Human papillomavirus type 31 | 1, 77, 110, 145, 162, 301, 321, 511, 531, 762, 768, 783, 1081, 1219, 1366, 1374, 1454, 1551 and 813755-813950. |
| 52 | Human papillomavirus type 45 | 1, 62, 64, 165, 288, 319, 408, 430, 533, 545, 776, 843, 886, 946, 991, 999, 1089, 1138, 1292, 1324, 1466, 1551, 1638 and 813951-814099. |
| 53 | Human papillomavirus type 5 | 4, 33, 118, 165, 201, 232, 240, 321, 368, 386, 449, 476, 484, 694, 749, 824, 876, 890, 946, 1091, 1124, 1155, 1225, 1316, 1320, 1331, 1337, 1359, 1366, 1426, 1448, 1588, 1627, 1637, 1650, 1669 and 814100-814228. |
| 54 | Human papillomavirus type 6 | 17, 26, 27, 77, 90, 112, 126, 132, 224, 269, 272, 288, 297, 319, 346, 384, 404, 408, 467, 496, 504, 578, 682, 716, 749, 774, 831, 847, 924, 949, 1187, 1221, 1273, 1277, 1335, 1396, 1551, 1661 and 814229-814460. |
| 55 | Human papillomavirus type 8 | 33, 73, 98, 118, 134, 228, 297, 311, 321, 334, 545, 739, 844, 977, 1110, 1153, 1154, 1374, 1423, 1570 and 814461-814585. |
| 56 | Human parainfluenza virus 1 strain Washington/ 1964 | 36, 98, 120, 132, 219, 231, 276, 284, 286, 288, 290, 347, 356, 360, 408, 438, 454, 463, 488, 522, 544, 548, 566, 579, 585, 602, 616, 620, 625, 633, 643, 653, 663, 676, 685, 694, 785, 793, 810, 813, 839, 855, 894, 903, 909, 910, 920, 951, 974, 980, 1011, 1025, 1029, 1036, 1062, 1076, 1079, 1084, 1092, 1101, 1109, 1118, 1139, 1140, 1144, 1163, 1168, 1173, 1187, 1190, 1195, 1207, 1208, 1222, 1258, 1281, 1293, 1315, 1325, 1335, 1368, 1442, 1469, 1471, 1482, 1505, 1545, 1554, 1562, 1578, 1585, 1586, 1624, 1631, 1642, 1650, 1653 and 814586-819257. |
| 57 | Human parainfluenza virus 2 | 36, 120, 223, 231, 276, 284, 286, 290, 347, 356, 360, 384, 404, 454, 455, 463, 488, 508, 544, 548, 563, 566, 579, 585, 616, 625, 637, 643, 653, 658, 663, 676, 694, 725, 739, 813, 839, 844, 855, 894, 909, 920, 958, 980, 1029, 1062, 1079, 1092, 1101, 1109, 1118, 1139, 1140, 1144, 1163, 1168, 1173, 1187, 1190, 1195, 1208, 1258, 1275, 1293, 1315, 1325, 1335, 1344, 1442, 1469, 1471, 1505, 1562, 1567, 1585, 1586, 1642 and 819258-823843. |
| 58 | Human parainfluenza virus 3 | 26, 36, 48, 60, 120, 132, 201, 231, 237, 276, 284, 286, 289, 290, 310, 347, 356, 454, 455, 463, 473, 476, 488, 544, 548, 566, 579, 585, 616, 620, 625, 626, 643, 653, 663, 676, 694, 714, 813, 839, 846, 855, 888, 894, 900, 909, 920, 958, 980, 1015, 1029, 1062, 1079, 1092, 1094, 1101, 1113, 1118, 1126, 1139, 1140, 1144, 1154, 1163, 1168, 1170, 1173, 1187, 1190, 1195, 1208, 1222, 1258, 1293, 1315, 1325, 1331, 1335, 1340, 1442, 1469, 1471, 1482, 1505, 1555, 1562, 1585, 1586, 1626, 1638, 1642, 1657 and 823844-828574. |
| 59 | Human parechovirus 2 | 4, 11, 20, 23, 24, 29, 31, 35, 36, 37, 43, 47, 48, 49, 51, 66, 67, 70, 73, 74, 77, 78, 96, 114, 120, 143, 148, 169, 171, 174, 187, 188, 189, 197, 200, 203, 212, 219, 234, 239, 240, 247, 252, 261, 262, 276, 277, 279, 289, 290, 295, 303, 304, 310, 315, 321, 323, 334, 336, 339, 347, 356, 357, 366, 370, 374, 376, 380, 394, 395, 396, 399, 400, 401, 405, 413, 416, 424, 429, 431, 433, 437, 441, 443, 446, 450, 453, 454, 462, 465, 466, 481, 484, 488, 500, 507, 509, 510, 515, 518, 526, 537, 541, 544, 547, 548, 551, 553, 561, 567, 574, 575, 577, 579, 587, 594, 605, 607, 610, 612, 616, 617, 624, 625, 627, 635, 640, 643, 652, 654, 661, 667, 676, 681, 684, 694, 701, 709, 710, 713, 715, 720, 731, 734, 737, 746, 749, 754, 756, 760, 763, 773, 776, 777, 786, 801, 803, 804, 811, 813, 829, 838, 839, 840, 846, 847, 854, 855, 856, 862, 868, 873, 876, 882, 886, 889, 894, 909, 911, 914, 924, 925, 927, 935, 936, 938, 954, 960, 962, 966, 969, 973, 977, 979, 985, 988, 998, 1006, 1008, 1019, 1020, 1029, 1037, 1038, 1040, 1049, 1058, 1062, 1065, 1069, 1070, 1079, 1084, 1086, 1090, 1092, 1096, 1101, 1106, 1118, 1123, 1129, 1133, 1138, 1139, 1140, 1152, 1153, 1159, 1163, 1168, 1172, 1173, 1187, 1190, 1195, 1196, 1198, 1204, 1205, 1208, 1212, 1219, 1225, 1239, 1245, 1251, 1254, 1257, 1258, 1262, 1268, 1270, 1271, 1274, 1284, 1290, 1293, 1297, 1299, 1306, 1315, 1321, 1325, 1328, 1330, 1332, 1335, 1338, 1339, 1349, 1353, 1363, 1364, 1390, 1391, 1392, 1411, 1412, 1416, 1423, 1424, 1426, 1432, 1442, 1456, 1459, 1467, 1469, 1471, 1473, 1476, 1481, 1485, 1487, 1488, 1503, 1507, 1511, 1526, 1549, 1552, 1557, 1574, 1578, 1579, 1580, 1584, 1585, 1606, 1617, 1631, 1633, 1637, 1639, 1640, 1642, 1643, 1654, 1656, 1665, 1669 and 828575-848188. |
| 60 | Human respiratory syncytial virus | 5, 36, 61, 67, 96, 109, 120, 131, 132, 173, 231, 233, 263, 276, 284, 286, 290, 291, 302, 310, 316, 319, 321, 325, 332, 347, 350, 356, 359, 361, 367, 378, 382, 399, 403, 412, 426, 430, 433, 454, 455, 462, 463, 465, 466, 473, 488, 544, 548, 553, 559, 566, 567, 579, 585, 616, 625, 626, 627, 643, 653, 663, 676, 694, 701, 716, 746, 765, 785, 792, 813, 820, 826, 839, 855, 873, 887, 894, 909, 912, 920, 938, 947, 974, 980, 991, 1002, 1003, 1028, 1029, 1038, 1047, 1052, 1058, 1062, 1078, 1079, 1081, 1092, 1101, 1105, 1118, 1135, 1139, 1140, 1144, 1152, 1163, |

-continued

| ROW# | INFECTION NAME | SEQ ID NOs OF GAMS ASSOCIATED WITH INFECTION |
|---|---|---|
| | | 1166, 1168, 1170, 1171, 1173, 1184, 1185, 1187, 1190, 1195, 1208, 1220, 1222, 1227, 1258, 1293, 1310, 1315, 1325, 1326, 1328, 1335, 1412, 1423, 1442, 1465, 1469, 1471, 1482, 1505, 1509, 1511, 1522, 1562, 1585, 1586, 1588, 1589, 1599, 1635, 1642 and 848189-856593. |
| 61 | Human rhinovirus 89 | 36, 120, 231, 276, 284, 286, 290, 347, 356, 454, 463, 488, 544, 548, 566, 579, 585, 616, 625, 643, 653, 663, 676, 694, 813, 839, 855, 876, 894, 909, 920, 980, 1029, 1062, 1079, 1092, 1101, 1118, 1139, 1140, 1144, 1163, 1168, 1173, 1187, 1190, 1195, 1208, 1258, 1293, 1315, 1325, 1332, 1335, 1442, 1469, 1471, 1505, 1557, 1585, 1586, 1642 and 856594-862881. |
| 62 | Human rhinovirus B | 36, 120, 231, 276, 284, 286, 290, 347, 356, 454, 463, 488, 544, 548, 566, 579, 585, 616, 625, 643, 653, 663, 676, 694, 813, 839, 855, 876, 894, 909, 920, 980, 1029, 1062, 1079, 1092, 1101, 1118, 1139, 1140, 1144, 1163, 1168, 1173, 1187, 1190, 1195, 1208, 1258, 1293, 1315, 1325, 1332, 1335, 1442, 1469, 1471, 1505, 1557, 1585, 1586, 1642 and 862882-869169. |
| 63 | Human T-lymphotropic virus 1 | 2, 5, 6, 8, 9, 10, 11, 13, 15, 19, 20, 22, 23, 24, 25, 27, 29, 31, 32, 33, 35, 36, 39, 40, 41, 42, 47, 48, 50, 51, 52, 56, 57, 60, 61, 63, 66, 67, 68, 70, 73, 74, 75, 76, 77, 78, 79, 81, 84, 85, 86, 88, 89, 92, 94, 96, 97, 99, 100, 101, 105, 108, 113, 114, 117, 120, 121, 123, 124, 125, 127, 128, 130, 134, 135, 139, 141, 143, 144, 145, 150, 151, 155, 166, 167, 168, 169, 171, 173, 174, 177, 178, 188, 189, 190, 191, 195, 197, 202, 203, 204, 205, 207, 208, 210, 212, 213, 216, 217, 218, 219, 221, 222, 223, 225, 228, 231, 233, 234, 236, 237, 239, 240, 241, 244, 246, 247, 248, 249, 252, 253, 257, 260, 262, 266, 267, 269, 270, 271, 272, 276, 277, 278, 279, 280, 281, 285, 286, 290, 293, 296, 300, 303, 304, 306, 307, 310, 315, 316, 317, 321, 323, 324, 325, 327, 328, 334, 336, 339, 340, 341, 344, 345, 346, 347, 348, 350, 351, 353, 356, 357, 358, 359, 360, 361, 364, 366, 367, 370, 371, 373, 376, 378, 379, 380, 382, 384, 387, 389, 391, 393, 394, 397, 398, 399, 400, 401, 404, 405, 407, 409, 410, 413, 418, 419, 421, 424, 425, 426, 429, 431, 432, 433, 434, 436, 437, 441, 442, 443, 444, 446, 447, 449, 450, 454, 458, 459, 462, 463, 464, 465, 466, 467, 468, 470, 474, 478, 482, 484, 485, 486, 488, 491, 492, 493, 500, 502, 505, 507, 509, 512, 513, 515, 516, 518, 519, 520, 521, 526, 529, 537, 539, 541, 544, 551, 552, 553, 558, 561, 563, 564, 569, 572, 573, 575, 576, 577, 579, 582, 583, 585, 586, 587, 594, 596, 598, 601, 603, 604, 605, 607, 608, 610, 611, 612, 613, 616, 617, 619, 623, 624, 625, 626, 627, 634, 635, 637, 638, 639, 640, 641, 643, 645, 649, 651, 652, 654, 656, 657, 658, 659, 661, 667, 669, 671, 672, 673, 676, 680, 684, 688, 689, 691, 692, 693, 696, 701, 705, 707, 710, 711, 713, 714, 715, 716, 720, 722, 725, 726, 729, 731, 734, 736, 737, 742, 744, 745, 746, 747, 749, 750, 754, 755, 757, 759, 760, 761, 764, 766, 767, 775, 777, 779, 781, 783, 784, 785, 787, 788, 789, 800, 801, 802, 803, 808, 809, 812, 813, 814, 817, 818, 822, 823, 827, 828, 829, 830, 836, 838, 839, 842, 846, 847, 849, 850, 854, 855, 858, 859, 860, 861, 862, 867, 868, 869, 872, 873, 874, 875, 876, 877, 879, 880, 881, 882, 883, 884, 886, 887, 889, 891, 894, 900, 901, 902, 903, 906, 908, 909, 910, 911, 914, 917, 918, 919, 920, 924, 927, 928, 929, 930, 931, 932, 935, 938, 943, 945, 946, 947, 953, 954, 955, 959, 960, 961, 962, 963, 966, 967, 970, 971, 973, 975, 977, 978, 979, 980, 982, 983, 984, 985, 986, 988, 989, 993, 995, 997, 998, 1005, 1006, 1007, 1008, 1009, 1011, 1014, 1015, 1016, 1017, 1019, 1020, 1022, 1033, 1035, 1037, 1038, 1040, 1046, 1047, 1050, 1052, 1053, 1055, 1056, 1058, 1062, 1063, 1065, 1067, 1068, 1069, 1071, 1076, 1077, 1078, 1083, 1086, 1087, 1088, 1090, 1092, 1095, 1099, 1100, 1101, 1102, 1103, 1105, 1106, 1107, 1113, 1114, 1116, 1117, 1118, 1119, 1122, 1123, 1127, 1128, 1129, 1130, 1131, 1132, 1133, 1134, 1135, 1139, 1140, 1142, 1144, 1147, 1149, 1152, 1153, 1155, 1156, 1157, 1159, 1160, 1161, 1162, 1163, 1165, 1166, 1168, 1172, 1173, 1174, 1175, 1177, 1178, 1180, 1181, 1182, 1183, 1184, 1185, 1187, 1188, 1190, 1194, 1195, 1196, 1197, 1198, 1199, 1200, 1201, 1204, 1205, 1206, 1210, 1211, 1212, 1215, 1217, 1218, 1219, 1220, 1222, 1223, 1224, 1225, 1227, 1233, 1235, 1237, 1238, 1242, 1243, 1244, 1249, 1251, 1252, 1255, 1257, 1258, 1261, 1265, 1268, 1270, 1273, 1275, 1276, 1278, 1282, 1284, 1285, 1286, 1289, 1293, 1294, 1297, 1299, 1300, 1301, 1304, 1305, 1310, 1312, 1321, 1326, 1327, 1328, 1330, 1331, 1333, 1335, 1337, 1338, 1339, 1346, 1347, 1348, 1349, 1351, 1353, 1354, 1355, 1356, 1358, 1359, 1363, 1364, 1370, 1374, 1380, 1381, 1384, 1385, 1389, 1390, 1391, 1392, 1393, 1394, 1395, 1396, 1397, 1398, 1403, 1405, 1406, 1409, 1411, 1412, 1414, 1416, 1417, 1418, 1419, 1422, 1423, 1424, 1426, 1427, 1428, 1429, 1430, 1431, 1432, 1433, 1438, 1442, 1444, 1446, 1447, 1450, 1451, 1452, 1453, 1459, 1460, 1461, 1462, 1466, 1467, 1469, 1473, 1475, 1476, 1477, 1478, 1479, 1480, 1482, 1483, 1484, 1485, 1486, 1487, 1488, 1490, 1497, 1499, 1500, 1502, 1504, 1505, 1506, 1507, 1509, 1511, 1512, 1513, 1515, 1517, 1520, 1522, 1523, 1524, 1525, 1526, 1531, 1532, 1533, 1537, 1538, 1543, 1547, 1549, 1551, 1552, 1553, 1554, 1556, 1557, 1560, 1561, 1562, 1569, 1571, 1572, 1574, 1579, 1580, 1584, 1585, 1586, 1588, 1589, 1592, 1594, 1598, 1604, 1606, 1607, 1612, 1613, 1614, 1616, 1619, 1621, 1622, 1626, 1627, 1629, 1630, 1631, 1632, 1633, 1634, 1636, 1638, 1640, 1642, 1643, 1646, 1652, 1654, 1655, 1657, 1658, 1660, 1665, 1669, 1670 and 869170-930394. |
| 64 | Human T-lymphotropic virus 2 | 9, 19, 26, 51, 58, 91, 102, 124, 148, 153, 174, 192, 196, 200, 203, 218, 223, 276, 290, 292, 296, 302, 316, 340, 345, 349, 369, 380, 382, 404, 421, 426, 432, 437, 444, 447, 456, 459, 466, 477, 480, 485, 504, 525, 526, 530, 545, 548, 553, 554, 571, 586, 591, 602, 625, 654, 692, 719, 750, 779, 785, 790, 793, 798, 802, 805, 813, 824, 825, 834, 850, 851, 862, 872, 879, 883, 903, 952, 973, 978, 993, 997, 999, 1022, 1029, 1035, 1036, 1042, 1059, 1063, 1067, 1069, 1072, 1075, |

-continued

| ROW# | INFECTION NAME | SEQ ID NOs OF GAMS ASSOCIATED WITH INFECTION |
|---|---|---|
| | | 1077, 1083, 1084, 1094, 1108, 1133, 1139, 1143, 1146, 1197, 1201, 1204, 1208, 1222, 1224, 1250, 1253, 1265, 1279, 1287, 1298, 1300, 1301, 1303, 1316, 1333, 1336, 1348, 1353, 1359, 1363, 1365, 1373, 1419, 1427, 1430, 1436, 1444, 1486, 1499, 1504, 1511, 1537, 1545, 1560, 1561, 1566, 1579, 1585, 1588, 1589, 1610, 1636, 1637, 1647, 1650, 1651, 1668 and 930395-933934. |
| 65 | Influenza A virus | 4, 7, 11, 20, 23, 24, 29, 31, 35, 36, 37, 43, 47, 48, 49, 51, 66, 67, 68, 70, 73, 74, 77, 78, 96, 114, 120, 122, 133, 143, 148, 154, 169, 171, 174, 187, 188, 189, 190, 200, 203, 207, 212, 219, 221, 231, 234, 239, 240, 247, 252, 253, 257, 261, 262, 263, 266, 276, 277, 279, 284, 286, 289, 290, 291, 295, 303, 304, 310, 315, 321, 323, 325, 332, 334, 336, 339, 347, 356, 357, 366, 370, 374, 376, 380, 394, 395, 396, 399, 400, 401, 405, 413, 416, 424, 429, 431, 433, 437, 441, 443, 446, 453, 454, 462, 463, 465, 466, 481, 484, 488, 500, 507, 509, 510, 512, 515, 518, 523, 526, 537, 541, 544, 547, 548, 551, 553, 555, 559, 561, 566, 567, 574, 575, 577, 579, 585, 587, 594, 605, 607, 610, 612, 616, 617, 624, 625, 627, 635, 640, 643, 646, 652, 653, 654, 661, 663, 667, 676, 681, 684, 694, 701, 709, 710, 713, 715, 720, 731, 734, 737, 746, 749, 754, 756, 760, 763, 773, 776, 777, 781, 785, 786, 792, 801, 803, 804, 811, 813, 829, 838, 839, 840, 846, 847, 854, 855, 856, 862, 868, 873, 876, 881, 882, 884, 886, 889, 894, 909, 911, 914, 920, 924, 925, 927, 935, 936, 938, 954, 960, 962, 966, 969, 973, 977, 979, 980, 985, 988, 998, 1006, 1008, 1010, 1019, 1020, 1029, 1037, 1038, 1040, 1047, 1049, 1058, 1062, 1065, 1069, 1070, 1078, 1079, 1084, 1086, 1090, 1092, 1096, 1101, 1105, 1106, 1118, 1123, 1126, 1129, 1133, 1138, 1139, 1140, 1144, 1152, 1153, 1159, 1163, 1168, 1171, 1172, 1173, 1187, 1190, 1195, 1196, 1204, 1205, 1208, 1210, 1212, 1218, 1219, 1225, 1233, 1239, 1245, 1251, 1254, 1257, 1258, 1262, 1265, 1268, 1270, 1271, 1274, 1284, 1290, 1293, 1297, 1299, 1306, 1312, 1315, 1318, 1321, 1325, 1326, 1328, 1330, 1332, 1335, 1338, 1339, 1349, 1353, 1363, 1364, 1390, 1391, 1392, 1411, 1412, 1416, 1423, 1424, 1426, 1429, 1432, 1442, 1456, 1459, 1465, 1467, 1469, 1471, 1473, 1476, 1481, 1484, 1485, 1487, 1488, 1503, 1505, 1507, 1511, 1526, 1538, 1543, 1549, 1552, 1562, 1574, 1578, 1579, 1580, 1584, 1585, 1586, 1589, 1606, 1617, 1631, 1633, 1635, 1636, 1637, 1639, 1640, 1642, 1643, 1653, 1654, 1656, 1663, 1665, 1669 and 933935-955070. |
| 66 | Influenza B virus | 4, 7, 11, 20, 23, 24, 29, 31, 35, 36, 37, 43, 47, 48, 49, 51, 66, 67, 68, 70, 73, 74, 77, 78, 96, 114, 120, 122, 133, 143, 148, 154, 169, 171, 174, 187, 188, 189, 190, 200, 203, 207, 212, 219, 221, 231, 234, 239, 240, 247, 252, 253, 257, 261, 262, 263, 266, 276, 277, 279, 284, 286, 289, 290, 291, 295, 303, 304, 310, 315, 321, 323, 325, 332, 334, 336, 339, 347, 356, 357, 366, 370, 374, 376, 380, 394, 395, 396, 399, 400, 401, 405, 413, 416, 424, 429, 431, 433, 437, 441, 443, 446, 453, 454, 462, 463, 465, 466, 481, 484, 488, 500, 507, 509, 510, 512, 515, 518, 523, 526, 537, 541, 544, 547, 548, 551, 553, 555, 559, 561, 566, 567, 574, 575, 577, 579, 585, 587, 594, 605, 607, 610, 612, 616, 617, 624, 625, 627, 635, 640, 643, 646, 652, 653, 654, 661, 663, 667, 676, 681, 684, 694, 701, 709, 710, 713, 715, 720, 731, 734, 737, 746, 749, 754, 756, 760, 763, 773, 776, 777, 781, 785, 786, 792, 801, 803, 804, 811, 813, 829, 838, 839, 840, 846, 847, 854, 855, 856, 862, 868, 873, 876, 881, 882, 884, 886, 889, 894, 909, 911, 914, 920, 924, 925, 927, 935, 936, 938, 954, 960, 962, 966, 969, 973, 977, 979, 980, 985, 988, 998, 1006, 1008, 1010, 1019, 1020, 1029, 1037, 1038, 1040, 1047, 1049, 1058, 1062, 1065, 1069, 1070, 1078, 1079, 1084, 1086, 1090, 1092, 1096, 1101, 1105, 1106, 1118, 1123, 1126, 1129, 1133, 1138, 1139, 1140, 1144, 1152, 1153, 1159, 1163, 1168, 1171, 1172, 1173, 1187, 1190, 1195, 1196, 1204, 1205, 1208, 1210, 1212, 1218, 1219, 1225, 1233, 1239, 1245, 1251, 1254, 1257, 1258, 1262, 1265, 1268, 1270, 1271, 1274, 1284, 1290, 1293, 1297, 1299, 1306, 1312, 1315, 1318, 1321, 1325, 1326, 1328, 1330, 1332, 1335, 1338, 1339, 1349, 1353, 1363, 1364, 1390, 1391, 1392, 1411, 1412, 1416, 1423, 1424, 1426, 1429, 1432, 1442, 1456, 1459, 1465, 1467, 1469, 1471, 1473, 1476, 1481, 1484, 1485, 1487, 1488, 1503, 1505, 1507, 1511, 1526, 1538, 1543, 1549, 1552, 1562, 1574, 1578, 1579, 1580, 1584, 1585, 1586, 1589, 1606, 1617, 1631, 1633, 1635, 1636, 1637, 1639, 1640, 1642, 1643, 1653, 1654, 1656, 1663, 1665, 1669 and 959226-980361. |
| 67 | Japanese encephalitis virus | 4, 7, 11, 20, 23, 24, 29, 31, 35, 37, 43, 47, 48, 49, 51, 66, 67, 70, 73, 74, 77, 78, 96, 114, 120, 124, 143, 148, 154, 169, 171, 174, 187, 188, 189, 196, 200, 203, 207, 212, 219, 231, 234, 239, 240, 247, 252, 261, 262, 263, 265, 277, 279, 289, 290, 291, 295, 303, 304, 310, 315, 321, 323, 325, 332, 334, 336, 339, 347, 356, 357, 363, 366, 370, 374, 376, 380, 387, 388, 394, 395, 396, 399, 400, 401, 405, 413, 416, 424, 429, 431, 433, 437, 441, 443, 446, 453, 454, 462, 465, 466, 481, 484, 500, 507, 509, 510, 515, 518, 526, 537, 541, 544, 545, 547, 551, 553, 561, 567, 574, 575, 577, 579, 587, 594, 605, 607, 610, 612, 617, 624, 627, 629, 635, 640, 652, 654, 661, 667, 676, 681, 684, 701, 702, 709, 710, 713, 715, 720, 731, 734, 737, 746, 749, 754, 756, 760, 763, 773, 776, 777, 785, 786, 792, 801, 803, 804, 811, 813, 815, 829, 838, 839, 840, 846, 847, 854, 856, 861, 862, 868, 873, 876, 879, 882, 886, 889, 909, 911, 914, 924, 925, 927, 935, 936, 938, 954, 960, 962, 964, 966, 969, 973, 977, 979, 981, 985, 988, 998, 999, 1006, 1008, 1019, 1020, 1036, 1037, 1038, 1040, 1047, 1049, 1058, 1062, 1065, 1069, 1070, 1078, 1084, 1086, 1090, 1096, 1101, 1105, 1106, 1113, 1123, 1129, 1133, 1138, 1139, 1150, 1152, 1153, 1159, 1162, 1163, 1168, 1171, 1172, 1190, 1196, 1204, 1205, 1212, 1219, 1225, 1239, 1245, 1251, 1254, 1257, 1258, 1262, 1268, 1269, 1270, 1271, 1274, 1277, 1284, 1287, 1290, 1293, 1294, 1297, 1299, 1306, 1312, 1321, 1326, 1328, 1330, 1332, 1335, 1338, 1339, 1349, 1353, 1363, 1364, 1390, 1391, 1392, 1407, 1411, 1412, 1416, 1419, 1423, 1424, 1426, 1432, 1456, |

| ROW# | INFECTION NAME | SEQ ID NOs OF GAMS ASSOCIATED WITH INFECTION |
|---|---|---|
| | | 1459, 1465, 1467, 1469, 1473, 1476, 1481, 1485, 1487, 1488, 1493, 1503, 1507, 1511, 1521, 1526, 1549, 1552, 1562, 1567, 1574, 1578, 1579, 1580, 1584, 1589, 1606, 1617, 1631, 1633, 1635, 1637, 1639, 1640, 1643, 1654, 1656, 1665, 1669 and 982439-998310. |
| 68 | JC virus | 36, 40, 50, 116, 244, 466, 529, 656, 696, 766, 817, 832, 872, 887, 971, 1050, 1129, 1483, 1523, 1640, 1642 and 998311-1001489. |
| 69 | Machupo virus | 166, 323, 462, 478, 484, 541, 553, 559, 798, 867, 1057, 1063, 1069, 1484, 1560 and 1001490-1002112. |
| 70 | Marburg virus | 45, 63, 64, 68, 140, 166, 169, 189, 196, 197, 201, 204, 229, 233, 237, 238, 271, 310, 316, 323, 326, 353, 366, 376, 378, 416, 448, 450, 462, 466, 478, 484, 541, 553, 557, 559, 569, 570, 614, 625, 626, 641, 656, 657, 669, 714, 720, 743, 760, 770, 798, 838, 853, 856, 859, 864, 867, 875, 887, 901, 909, 935, 954, 1002, 1005, 1015, 1029, 1047, 1057, 1063, 1069, 1094, 1134, 1138, 1185, 1186, 1195, 1198, 1199, 1205, 1222, 1239, 1276, 1285, 1299, 1308, 1328, 1340, 1344, 1351, 1358, 1372, 1373, 1386, 1400, 1402, 1406, 1484, 1488, 1508, 1545, 1560, 1611, 1623, 1638, 1642 and 1002113-1007260. |
| 71 | Measles virus | 4, 11, 20, 21, 23, 24, 26, 29, 31, 35, 36, 37, 43, 47, 48, 49, 51, 65, 66, 67, 70, 73, 74, 77, 78, 84, 89, 96, 101, 105, 114, 120, 140, 143, 148, 154, 169, 171, 174, 183, 187, 188, 189, 197, 198, 200, 201, 203, 212, 219, 229, 231, 234, 239, 240, 247, 248, 250, 252, 253, 257, 258, 261, 262, 276, 277, 279, 284, 286, 289, 290, 292, 295, 303, 304, 306, 309, 310, 315, 321, 323, 334, 336, 339, 342, 347, 349, 350, 353, 356, 357, 363, 364, 366, 370, 374, 376, 377, 378, 380, 386, 388, 389, 394, 395, 396, 399, 400, 401, 405, 413, 415, 416, 421, 424, 429, 431, 433, 437, 441, 443, 445, 446, 450, 452, 453, 454, 462, 463, 465, 466, 475, 479, 481, 484, 485, 496, 497, 500, 507, 509, 510, 515, 518, 526, 537, 541, 544, 547, 551, 553, 559, 561, 563, 566, 567, 572, 574, 575, 577, 579, 585, 587, 594, 605, 607, 610, 612, 614, 615, 616, 617, 624, 625, 627, 635, 640, 641, 645, 646, 652, 653, 654, 658, 661, 662, 663, 667, 676, 678, 681, 684, 691, 694, 695, 701, 709, 710, 713, 715, 720, 731, 734, 737, 742, 746, 749, 754, 756, 760, 763, 765, 769, 770, 771, 773, 775, 776, 777, 779, 781, 783, 786, 801, 803, 804, 811, 813, 821, 829, 831, 838, 839, 840, 843, 846, 847, 850, 854, 856, 862, 868, 872, 873, 876, 881, 882, 884, 886, 889, 901, 909, 911, 914, 920, 924, 925, 927, 935, 936, 938, 942, 945, 950, 954, 960, 962, 966, 969, 973, 977, 978, 979, 980, 981, 985, 988, 991, 998, 1002, 1006, 1008, 1010, 1019, 1020, 1037, 1038, 1040, 1047, 1049, 1053, 1058, 1062, 1065, 1069, 1070, 1079, 1084, 1086, 1088, 1090, 1093, 1096, 1101, 1102, 1103, 1106, 1109, 1122, 1123, 1129, 1133, 1134, 1138, 1139, 1140, 1141, 1144, 1146, 1152, 1153, 1154, 1159, 1163, 1168, 1170, 1172, 1181, 1185, 1190, 1195, 1196, 1198, 1199, 1204, 1205, 1210, 1212, 1214, 1219, 1221, 1222, 1225, 1234, 1239, 1245, 1251, 1254, 1257, 1258, 1262, 1265, 1268, 1270, 1271, 1274, 1276, 1284, 1290, 1293, 1294, 1297, 1299, 1300, 1306, 1315, 1317, 1318, 1321, 1328, 1330, 1331, 1335, 1338, 1339, 1349, 1351, 1353, 1363, 1364, 1368, 1373, 1390, 1391, 1392, 1406, 1411, 1412, 1416, 1423, 1424, 1426, 1429, 1431, 1432, 1456, 1459, 1464, 1467, 1469, 1473, 1476, 1481, 1485, 1487, 1488, 1490, 1501, 1503, 1505, 1507, 1508, 1509, 1511, 1521, 1526, 1538, 1549, 1552, 1562, 1567, 1574, 1578, 1579, 1580, 1584, 1585, 1586, 1606, 1611, 1617, 1619, 1631, 1633, 1636, 1637, 1639, 1640, 1642, 1643, 1648, 1654, 1656, 1665, 1669 and 1007261-1027883. |
| 72 | Molluscum contagiosum virus | 1, 4, 7, 12, 18, 20, 23, 26, 27, 32, 33, 35, 41, 43, 44, 46, 51, 53, 54, 58, 59, 61, 69, 72, 73, 74, 77, 81, 84, 89, 90, 93, 95, 97, 99, 100, 103, 107, 111, 115, 117, 119, 121, 123, 125, 128, 129, 134, 137, 140, 141, 143, 144, 148, 149, 151, 152, 155, 161, 162, 164, 165, 167, 173, 174, 176, 181, 182, 183, 184, 186, 191, 192, 194, 198, 202, 203, 206, 207, 211, 212, 216, 217, 218, 219, 220, 224, 225, 227, 228, 230, 231, 232, 233, 240, 245, 247, 248, 252, 253, 255, 256, 257, 258, 259, 260, 264, 265, 267, 268, 269, 274, 275, 277, 282, 283, 286, 287, 288, 290, 291, 292, 297, 300, 302, 303, 306, 307, 310, 311, 313, 314, 316, 318, 319, 321, 322, 323, 324, 326, 327, 329, 332, 334, 340, 343, 345, 346, 351, 354, 355, 357, 360, 361, 362, 365, 370, 373, 377, 380, 381, 382, 384, 385, 386, 387, 397, 401, 402, 403, 405, 406, 407, 409, 411, 415, 416, 418, 419, 423, 424, 429, 432, 434, 437, 438, 439, 441, 445, 447, 457, 464, 469, 470, 472, 473, 478, 480, 481, 483, 485, 486, 489, 490, 492, 493, 495, 496, 499, 501, 503, 504, 511, 512, 513, 514, 522, 523, 524, 529, 530, 532, 533, 535, 540, 541, 542, 543, 544, 550, 553, 559, 562, 566, 572, 574, 575, 582, 584, 586, 587, 589, 591, 594, 595, 600, 601, 605, 613, 614, 615, 616, 618, 626, 630, 632, 637, 642, 643, 648, 650, 658, 660, 661, 667, 670, 677, 678, 679, 682, 694, 695, 696, 697, 699, 710, 712, 714, 718, 719, 720, 723, 724, 728, 732, 733, 736, 738, 741, 746, 750, 755, 759, 760, 765, 768, 771, 776, 777, 778, 779, 783, 785, 790, 792, 793, 798, 799, 800, 801, 803, 804, 805, 809, 812, 813, 815, 819, 839, 840, 843, 845, 848, 850, 852, 855, 856, 864, 869, 872, 874, 876, 879, 880, 882, 883, 886, 890, 892, 893, 895, 897, 900, 901, 911, 916, 921, 924, 925, 927, 929, 932, 933, 935, 939, 940, 941, 942, 944, 948, 949, 951, 956, 957, 958, 959, 960, 962, 974, 975, 976, 977, 978, 980, 981, 991, 992, 993, 997, 999, 1001, 1004, 1008, 1012, 1014, 1015, 1017, 1018, 1023, 1026, 1028, 1029, 1032, 1033, 1035, 1038, 1039, 1040, 1043, 1047, 1049, 1062, 1067, 1069, 1072, 1075, 1076, 1077, 1079, 1083, 1088, 1089, 1091, 1093, 1098, 1102, 1109, 1115, 1118, 1120, 1121, 1126, 1128, 1129, 1131, 1133, 1136, 1137, 1139, 1152, 1153, 1154, 1155, 1163, 1167, 1170, 1177, 1179, 1181, 1185, 1187, 1191, 1192, 1194, 1197, 1201, 1205, 1206, 1207, 1209, 1215, 1218, 1219, 1222, 1223, 1224, 1225, 1226, 1227, 1230, 1233, 1239, 1240, 1245, 1249, 1253, 1254, 1255, |

| ROW# | INFECTION NAME | SEQ ID NOs OF GAMS ASSOCIATED WITH INFECTION |
|---|---|---|
| | | 1258, 1263, 1264, 1268, 1273, 1277, 1281, 1284, 1287, 1289, 1291, 1292, 1294, 1300, 1301, 1303, 1307, 1310, 1316, 1317, 1318, 1320, 1321, 1324, 1327, 1328, 1330, 1331, 1333, 1334, 1336, 1337, 1340, 1341, 1342, 1345, 1346, 1348, 1352, 1355, 1356, 1358, 1359, 1360, 1363, 1366, 1367, 1370, 1375, 1378, 1382, 1387, 1389, 1391, 1396, 1399, 1405, 1406, 1408, 1410, 1411, 1412, 1414, 1416, 1420, 1421, 1422, 1423, 1426, 1433, 1435, 1436, 1438, 1439, 1442, 1443, 1444, 1447, 1448, 1454, 1455, 1458, 1459, 1462, 1466, 1467, 1469, 1472, 1473, 1474, 1480, 1481, 1482, 1485, 1490, 1492, 1498, 1499, 1504, 1508, 1514, 1515, 1518, 1519, 1528, 1529, 1530, 1533, 1535, 1537, 1538, 1541, 1546, 1551, 1555, 1559, 1572, 1575, 1577, 1580, 1581, 1582, 1583, 1591, 1592, 1597, 1598, 1600, 1604, 1609, 1624, 1628, 1631, 1634, 1636, 1638, 1642, 1643, 1644, 1647, 1648, 1650, 1651, 1652, 1653, 1654, 1664, 1665, 1667, 1668, 1669, 1671 and 1027884-1030599. |
| 73 | Murray Valley encephalitis virus | 4, 11, 20, 23, 24, 29, 31, 35, 37, 43, 47, 48, 49, 51, 66, 67, 70, 73, 74, 77, 78, 90, 96, 114, 120, 143, 148, 169, 171, 174, 176, 187, 188, 189, 196, 200, 203, 212, 219, 234, 239, 240, 247, 252, 261, 262, 277, 279, 289, 290, 295, 303, 304, 310, 315, 321, 323, 325, 334, 336, 339, 347, 356, 357, 363, 366, 370, 374, 376, 380, 387, 388, 394, 395, 396, 399, 400, 401, 405, 413, 416, 424, 429, 431, 433, 437, 441, 443, 446, 453, 454, 462, 465, 466, 481, 484, 500, 507, 509, 510, 515, 518, 526, 528, 537, 541, 544, 545, 547, 551, 561, 567, 574, 575, 577, 579, 587, 594, 605, 607, 610, 612, 617, 624, 627, 635, 640, 652, 654, 661, 667, 676, 681, 684, 701, 709, 710, 713, 715, 720, 731, 734, 737, 746, 749, 754, 756, 760, 763, 773, 776, 777, 786, 801, 803, 804, 811, 813, 829, 838, 839, 840, 846, 847, 854, 856, 862, 868, 873, 876, 879, 882, 886, 889, 909, 911, 914, 924, 925, 927, 935, 936, 938, 954, 960, 962, 964, 966, 969, 973, 977, 979, 985, 987, 988, 998, 999, 1006, 1008, 1019, 1020, 1022, 1037, 1038, 1040, 1049, 1058, 1062, 1065, 1069, 1070, 1084, 1086, 1090, 1096, 1101, 1106, 1123, 1129, 1133, 1138, 1139, 1152, 1153, 1159, 1162, 1163, 1168, 1172, 1190, 1196, 1204, 1205, 1212, 1219, 1225, 1239, 1245, 1251, 1254, 1257, 1258, 1262, 1268, 1270, 1271, 1274, 1284, 1290, 1293, 1297, 1299, 1306, 1321, 1328, 1330, 1335, 1338, 1339, 1349, 1353, 1363, 1364, 1390, 1391, 1392, 1407, 1411, 1412, 1416, 1419, 1423, 1424, 1426, 1432, 1456, 1459, 1467, 1469, 1473, 1476, 1481, 1485, 1487, 1488, 1503, 1507, 1511, 1521, 1526, 1549, 1552, 1574, 1578, 1579, 1580, 1584, 1606, 1617, 1631, 1633, 1637, 1639, 1640, 1643, 1654, 1656, 1665, 1669 and 1030600-1044555. |
| 74 | Norwalk virus | 148, 197, 299, 337, 401, 420, 430, 450, 466, 636, 781, 812, 824, 844, 883, 901, 915, 929, 937, 954, 1128, 1198, 1224, 1320, 1339, 1585, 1610 and 1044556-1045454. |
| 75 | Poliovirus | 143, 154, 166, 207, 223, 239, 307, 383, 459, 533, 553, 583, 611, 683, 795, 827, 855, 876, 883, 914, 1126, 1140, 1194, 1212, 1258, 1305, 1312, 1324, 1332, 1333, 1363, 1497, 1557, 1636, 1651 and 1045455-1048772. |
| 76 | Puumala virus | 63, 166, 271, 323, 462, 478, 484, 541, 553, 559, 569, 570, 798, 867, 1057, 1063, 1069, 1285, 1484, 1560 and 1048773-1049751. |
| 77 | Respiratory syncytial virus | 5, 36, 61, 67, 72, 96, 109, 120, 132, 135, 201, 225, 231, 263, 269, 276, 284, 286, 290, 291, 302, 316, 319, 321, 325, 327, 332, 347, 349, 350, 356, 359, 360, 364, 367, 369, 381, 382, 386, 399, 403, 404, 408, 412, 426, 430, 433, 454, 461, 462, 463, 465, 466, 470, 473, 479, 488, 502, 540, 544, 548, 553, 559, 566, 567, 579, 585, 616, 625, 627, 643, 653, 663, 676, 680, 694, 701, 712, 716, 746, 759, 765, 785, 792, 802, 813, 820, 826, 829, 831, 839, 855, 873, 887, 894, 896, 909, 920, 932, 938, 947, 958, 980, 991, 1003, 1009, 1028, 1029, 1038, 1047, 1058, 1062, 1078, 1079, 1092, 1093, 1101, 1105, 1118, 1132, 1135, 1138, 1139, 1140, 1141, 1144, 1152, 1154, 1157, 1163, 1166, 1168, 1171, 1173, 1185, 1186, 1187, 1190, 1195, 1208, 1220, 1222, 1227, 1241, 1258, 1275, 1276, 1283, 1293, 1315, 1325, 1326, 1328, 1335, 1340, 1389, 1408, 1412, 1423, 1442, 1465, 1469, 1471, 1482, 1493, 1505, 1509, 1511, 1547, 1559, 1562, 1571, 1585, 1586, 1589, 1599, 1623, 1635, 1642, 1657 and 1049752-1058276. |
| 78 | Reston Ebola virus (REBOV) | 132, 310, 392, 801, 1214, 1346, 1613 and 1058277-1058330. |
| 79 | Rubella virus | 4, 6, 11, 13, 20, 23, 24, 29, 30, 31, 35, 36, 37, 40, 43, 47, 48, 49, 51, 57, 63, 64, 66, 67, 68, 70, 73, 74, 77, 78, 85, 86, 88, 92, 96, 105, 112, 114, 120, 128, 129, 138, 141, 143, 144, 148, 150, 154, 156, 159, 164, 166, 167, 168, 169, 171, 174, 177, 180, 184, 187, 188, 189, 192, 193, 195, 196, 200, 202, 203, 204, 206, 207, 209, 212, 216, 218, 219, 227, 229, 231, 233, 234, 238, 239, 240, 247, 252, 254, 256, 261, 262, 264, 265, 271, 272, 276, 277, 279, 284, 286, 290, 292, 293, 295, 296, 303, 304, 306, 310, 315, 319, 321, 323, 326, 329, 334, 336, 339, 340, 345, 346, 347, 356, 357, 366, 367, 370, 373, 374, 376, 380, 393, 394, 395, 396, 399, 400, 401, 405, 413, 418, 420, 424, 429, 431, 433, 437, 439, 441, 443, 446, 447, 448, 453, 454, 458, 462, 463, 465, 466, 467, 468, 478, 481, 482, 484, 485, 486, 488, 492, 500, 503, 505, 507, 509, 510, 515, 517, 518, 520, 521, 526, 532, 537, 540, 541, 544, 545, 547, 551, 553, 559, 561, 563, 564, 566, 567, 569, 570, 574, 575, 577, 578, 579, 585, 587, 589, 594, 597, 598, 600, 604, 605, 607, 610, 612, 614, 617, 619, 622, 624, 625, 627, 634, 635, 637, 640, 652, 653, 654, 656, 657, 661, 663, 667, 669, 671, 676, 680, 681, 684, 693, 695, 701, 709, 710, 713, 715, 720, 724, 727, 731, 734, 737, 740, 741, 746, 747, 748, 749, 750, 754, 758, 760, 763, 765, 766, 773, 776, 777, 779, 786, 796, 801, 803, 808, 809, 811, 813, 817, 829, 833, 838, 839, 840, 841, 846, 847, 848, 853, 854, 855, 858, 859, 861, 862, 867, 869, 873, 874, 875, 876, 877, 881, 882, 884, 886, 887, 889, 891, 901, 904, 909, 911, 914, 917, 919, 920, 924, 925, 927, 928, 935, 936, 938, 946, 947, 954, 955, 957, 959, 960, 962, 966, 968, 969, 971, 973, 977, 978, 979, 980, |

-continued

| ROW# | INFECTION NAME | SEQ ID NOs OF GAMS ASSOCIATED WITH INFECTION |
|---|---|---|
| | | 985, 988, 989, 997, 998, 999, 1001, 1005, 1006, 1008, 1009, 1013, 1017, 1019, 1020, 1022, 1029, 1031, 1033, 1035, 1037, 1038, 1039, 1040, 1049, 1052, 1053, 1058, 1062, 1065, 1068, 1069, 1070, 1071, 1078, 1079, 1083, 1084, 1086, 1090, 1094, 1096, 1101, 1106, 1108, 1118, 1123, 1128, 1129, 1130, 1132, 1133, 1139, 1140, 1144, 1145, 1152, 1153, 1159, 1161, 1163, 1166, 1168, 1172, 1174, 1180, 1181, 1182, 1185, 1187, 1188, 1190, 1191, 1195, 1196, 1197, 1201, 1204, 1205, 1211, 1212, 1219, 1222, 1225, 1234, 1239, 1245, 1251, 1254, 1257, 1258, 1261, 1262, 1268, 1270, 1271, 1272, 1273, 1274, 1283, 1284, 1285, 1289, 1290, 1293, 1297, 1299, 1306, 1307, 1308, 1315, 1317, 1321, 1327, 1328, 1330, 1335, 1338, 1339, 1343, 1348, 1349, 1353, 1358, 1359, 1362, 1363, 1364, 1366, 1372, 1373, 1377, 1380, 1385, 1386, 1390, 1391, 1392, 1398, 1400, 1402, 1403, 1406, 1410, 1411, 1412, 1423, 1424, 1425, 1426, 1427, 1428, 1432, 1436, 1437, 1442, 1444, 1445, 1456, 1457, 1459, 1460, 1466, 1467, 1469, 1473, 1476, 1477, 1481, 1485, 1486, 1487, 1488, 1492, 1495, 1505, 1507, 1508, 1509, 1511, 1513, 1520, 1521, 1523, 1526, 1527, 1541, 1544, 1547, 1549, 1553, 1566, 1569, 1574, 1578, 1579, 1580, 1582, 1585, 1586, 1594, 1597, 1600, 1606, 1607, 1611, 1612, 1616, 1617, 1618, 1625, 1631, 1633, 1634, 1636, 1637, 1639, 1640, 1642, 1643, 1649, 1654, 1656, 1665, 1667, 1669, 1670 and 1063298-1098229. |
| 80 | SARS coronavirus | 36, 40, 167, 173, 197, 198, 201, 226, 231, 237, 276, 284, 286, 289, 310, 342, 347, 356, 385, 389, 418, 441, 450, 455, 463, 466, 473, 483, 504, 514, 522, 544, 554, 566, 578, 579, 585, 616, 625, 645, 648, 653, 655, 663, 676, 694, 712, 716, 744, 768, 807, 839, 844, 855, 909, 920, 939, 954, 980, 982, 1036, 1062, 1076, 1079, 1093, 1101, 1118, 1128, 1144, 1158, 1171, 1195, 1198, 1209, 1221, 1231, 1258, 1293, 1297, 1315, 1335, 1359, 1421, 1448, 1469, 1505, 1509, 1586, 1593, 1615, 1642, 1668 and 1098230-1102172. |
| 81 | Seoul virus | 63, 166, 271, 323, 462, 478, 484, 541, 553, 559, 569, 570, 798, 867, 1057, 1063, 1069, 1285, 1484, 1560 and 1102173-1103153. |
| 82 | Sin Nombre virus | 8, 45, 63, 166, 271, 323, 368, 462, 478, 484, 497, 541, 553, 559, 569, 570, 798, 867, 951, 1029, 1057, 1063, 1069, 1205, 1285, 1484, 1560, 1581 and 1103154-1104234. |
| 83 | Tula virus | 63, 231, 271, 284, 286, 347, 356, 463, 544, 566, 569, 570, 579, 585, 653, 663, 676, 839, 909, 920, 951, 980, 1062, 1101, 1144, 1195, 1221, 1258, 1285, 1335, 1469, 1505, 1581, 1586, 1659 and 1104235-1105729. |
| 84 | Uukuniemi virus | 29, 74, 140, 645, 652, 667, 716, 737, 949, 1164 and 1105730-1105756. |
| 85 | Vaccinia virus | 7, 8, 40, 44, 60, 61, 72, 75, 83, 112, 123, 132, 134, 144, 151, 173, 180, 201, 226, 248, 255, 282, 289, 315, 342, 344, 349, 360, 365, 368, 378, 388, 389, 404, 415, 440, 504, 517, 530, 536, 540, 576, 620, 626, 633, 636, 637, 639, 655, 703, 714, 716, 722, 724, 737, 742, 769, 773, 790, 804, 805, 826, 846, 847, 856, 879, 900, 910, 964, 982, 990, 1004, 1015, 1017, 1029, 1074, 1081, 1083, 1094, 1110, 1133, 1138, 1154, 1157, 1158, 1195, 1199, 1221, 1222, 1223, 1241, 1242, 1255, 1270, 1274, 1275, 1276, 1311, 1328, 1344, 1349, 1366, 1419, 1431, 1435, 1455, 1482, 1513, 1522, 1545, 1547, 1566, 1571, 1593, 1599, 1613, 1638, 1661 and 1105757-1107056. |
| 86 | Variola virus | 2, 7, 8, 44, 61, 132, 134, 151, 152, 164, 173, 180, 226, 237, 247, 248, 255, 342, 344, 349, 360, 365, 368, 388, 389, 404, 414, 415, 440, 455, 464, 517, 522, 525, 530, 536, 540, 576, 585, 586, 616, 626, 633, 640, 654, 655, 694, 703, 716, 724, 742, 773, 782, 786, 790, 793, 804, 808, 826, 856, 883, 896, 900, 939, 957, 958, 964, 1004, 1017, 1029, 1042, 1094, 1154, 1157, 1158, 1170, 1171, 1186, 1195, 1199, 1221, 1222, 1227, 1231, 1241, 1242, 1249, 1255, 1270, 1272, 1275, 1276, 1280, 1311, 1342, 1344, 1347, 1349, 1362, 1366, 1416, 1455, 1479, 1482, 1522, 1547, 1551, 1566, 1599, 1638 and 1107057-1108297. |
| 87 | West Nile virus | 4, 11, 20, 23, 24, 29, 31, 35, 37, 43, 47, 48, 49, 51, 66, 67, 70, 73, 74, 77, 78, 96, 114, 120, 143, 148, 154, 169, 171, 174, 187, 188, 189, 200, 203, 212, 219, 234, 239, 240, 247, 252, 261, 262, 277, 279, 289, 290, 295, 303, 304, 310, 315, 321, 323, 334, 336, 339, 347, 356, 357, 366, 370, 374, 376, 380, 394, 395, 396, 399, 400, 401, 405, 413, 416, 424, 429, 431, 433, 437, 441, 443, 446, 453, 454, 462, 465, 466, 481, 484, 500, 507, 509, 510, 515, 518, 526, 537, 541, 544, 547, 551, 553, 561, 567, 574, 575, 577, 579, 587, 594, 605, 607, 610, 612, 617, 624, 627, 635, 640, 652, 654, 661, 667, 676, 681, 684, 701, 709, 710, 713, 715, 720, 731, 734, 737, 746, 749, 754, 756, 760, 763, 773, 776, 777, 786, 801, 803, 804, 811, 813, 829, 838, 839, 840, 846, 847, 854, 856, 862, 868, 873, 876, 882, 886, 889, 909, 911, 914, 924, 925, 927, 935, 936, 938, 954, 960, 962, 966, 969, 973, 977, 979, 985, 988, 998, 1006, 1008, 1019, 1020, 1037, 1038, 1040, 1049, 1058, 1062, 1065, 1069, 1070, 1084, 1086, 1090, 1096, 1101, 1106, 1123, 1129, 1133, 1138, 1139, 1152, 1153, 1159, 1163, 1168, 1172, 1190, 1196, 1204, 1205, 1212, 1219, 1225, 1239, 1245, 1251, 1254, 1257, 1258, 1262, 1268, 1270, 1271, 1274, 1284, 1290, 1293, 1297, 1299, 1306, 1321, 1328, 1330, 1335, 1338, 1339, 1349, 1353, 1363, 1364, 1390, 1391, 1392, 1411, 1412, 1416, 1423, 1424, 1426, 1432, 1456, 1459, 1467, 1469, 1473, 1476, 1481, 1485, 1487, 1488, 1503, 1507, 1511, 1526, 1549, 1552, 1574, 1578, 1579, 1580, 1584, 1606, 1617, 1631, 1633, 1637, 1639, 1640, 1643, 1654, 1656, 1665, 1669 and 1108298-1122207. |
| 88 | Western equine encephalomyelitis virus | 4, 11, 20, 23, 24, 29, 31, 35, 37, 43, 47, 48, 49, 51, 66, 67, 70, 73, 74, 77, 78, 96, 114, 120, 143, 148, 154, 169, 171, 174, 187, 188, 189, 200, 203, 212, 219, 234, 239, 240, 247, 252, 261, 262, 277, 279, 289, 290, 295, 303, 304, 310, 315, 321, 323, 334, 336, 339, 347, 356, 357, 366, 370, 374, 376, 380, 394, 395, 396, 399, 400, 401, 405, 413, 416, 424, 429, 431, 433, 437, 441, 443, 446, 453, 454, 462, 465, 466, 481, 484, 500, 507, 509, 510, 515, 518, 526, 529, 537, 541, |

| ROW# | INFECTION NAME | SEQ ID NOs OF GAMS ASSOCIATED WITH INFECTION |
|---|---|---|
| | | 544, 547, 551, 553, 561, 567, 574, 575, 577, 579, 587, 594, 605, 607, 610, 612, 617, 624, 627, 635, 640, 652, 654, 661, 667, 676, 681, 684, 701, 709, 710, 713, 715, 720, 722, 731, 734, 737, 746, 749, 754, 756, 760, 763, 773, 776, 777, 786, 801, 803, 804, 811, 813, 829, 838, 839, 840, 846, 847, 854, 856, 862, 868, 873, 876, 882, 886, 889, 909, 911, 914, 924, 925, 927, 935, 936, 938, 954, 960, 962, 966, 969, 973, 977, 979, 985, 988, 998, 1006, 1008, 1019, 1020, 1037, 1038, 1040, 1049, 1058, 1062, 1065, 1069, 1070, 1084, 1086, 1090, 1096, 1101, 1106, 1123, 1129, 1133, 1138, 1139, 1152, 1153, 1159, 1163, 1168, 1172, 1190, 1196, 1204, 1205, 1212, 1219, 1225, 1239, 1245, 1251, 1254, 1257, 1258, 1262, 1268, 1270, 1271, 1274, 1284, 1290, 1293, 1297, 1299, 1306, 1321, 1328, 1330, 1335, 1338, 1339, 1349, 1353, 1363, 1364, 1390, 1391, 1392, 1411, 1412, 1416, 1423, 1424, 1426, 1432, 1456, 1459, 1467, 1469, 1473, 1476, 1481, 1485, 1487, 1488, 1503, 1507, 1511, 1526, 1549, 1552, 1574, 1578, 1579, 1580, 1584, 1606, 1617, 1631, 1633, 1637, 1639, 1640, 1643, 1654, 1656, 1665, 1669 and 1122296-1136577. |
| 89 | Yellow fever virus | 166, 323, 462, 478, 484, 541, 553, 559, 798, 867, 1057, 1063, 1069, 1484, 1560 and 1136701-1137323. |
| 90 | Zaire Ebola virus (ZEBOV) | 563, 637, 872, 1052, 1063, 1094, 1154, 1401, 1522, 1624 and 1137324-1137407. |

SEQUENCE LISTING (4205095 sequences)

SEQ ID NO: 1 - RNA, 22 nt, Human
uuugcugccucucccagcuccc

SEQ ID NO: 2 - RNA, 17 nt, Human
cacuaguagucucuggc

SEQ ID NO: 3 - RNA, 22 nt, Human
gcuagugcagggaaaucuuugg

SEQ ID NO: 4 - RNA, 22 nt, Human
cgcugcuccgccuuguccauau

SEQ ID NO: 5 - RNA, 22 nt, Human
ccccacuguccccggagcuggc

SEQ ID NO: 6 - RNA, 22 nt, Human
ugcccuggcucuucuuguucca

SEQ ID NO: 7 - RNA, 22 nt, Human
acauucucugauuggugccucc

SEQ ID NO: 8 - RNA, 22 nt, Human
aauauuucuucuaaagcccuuu

SEQ ID NO: 9 - RNA, 22 nt, Human
guugaggugaugccagcccugc

SEQ ID NO: 10 - RNA, 22 nt, Human
ucauggggccacagcugccagc

SEQ ID NO: 11 - RNA, 22 nt, Human
ugggggacaccagucucucucu

SEQ ID NO: 12 - RNA, 20 nt, Human
ugguccccauccuugcgauu

SEQ ID NO: 13 - RNA, 22 nt, Human
uccugggaggcggagguugcag

SEQ ID NO: 14 - RNA, 22 nt, Human
agcaagaccaggguuuuguguu

SEQ ID NO: 15 - RNA, 22 nt, Human
cccaggcuggaguguaauggug

SEQ ID NO: 16 - RNA, 19 nt, Human
agccccuugguacuguccu

SEQ ID NO: 17 - RNA, 21 nt, Human
cucuguuugccugcugccauc

SEQ ID NO: 18 - RNA, 22 nt, Human
gucucccagccuacaucuuucu

SEQ ID NO: 19 - RNA, 22 nt, Human
cccggguggagccugggcugug

SEQ ID NO: 20 - RNA, 22 nt, Human
ucacugcaagcuccacccuccg

SEQ ID NO: 21 - RNA, 22 nt, Human
aacccaggagguggagguugug

SEQ ID NO: 22 - RNA, 22 nt, Human
accuugugauccaccugcuuug

SEQ ID NO: 23 - RNA, 22 nt, Human
ccggcuacucgggaggcugacg

SEQ ID NO: 24 - RNA, 22 nt, Human
cugcccuggggggccuccuugc

SEQ ID NO: 25 - RNA, 22 nt, Human
gaccucaugauccaccugccuu

SEQ ID NO: 26 - RNA, 22 nt, Human
uucucugugcuggguccugagg

SEQ ID NO: 27 - RNA, 22 nt, Human
uggguaguuuccccugcccugc

SEQ ID NO: 28 - RNA, 23 nt, Human
aaaacagcuuccuccaguggcuc

SEQ ID NO: 29 - RNA, 22 nt, Human
ucacugcacuccagccugggug

SEQ ID NO: 30 - RNA, 22 nt, Human
caccaggaggacaggccccuac

SEQ ID NO: 31 - RNA, 22 nt, Human
acgccuguaaucccagcacuuu

SEQ ID NO: 32 - RNA, 22 nt, Human
ugaccuccuuucucgacuaauu

SEQ ID NO: 33 - RNA, 22 nt, Human
ccuggcucugccacuuacugcc

SEQ ID NO: 34 - RNA, 22 nt, Human
cugcuccccagccugcgccuuu

SEQ ID NO: 35 - RNA, 22 nt, Human
cauugcacuccagccucccaua

SEQ ID NO: 36 - RNA, 22 nt, Human
uucugaugguuaaguucuguca

SEQ ID NO: 37 - RNA, 22 nt, Human
cugcaguaugagcuacccaggu

SEQ ID NO: 38 - RNA, 19 nt, Human
uaccauccaagcugguuug

SEQ ID NO: 39 - RNA, 22 nt, Human
ugguuucccuuuuggccucucc

SEQ ID NO: 40 - RNA, 18 nt, Human
acucuuucugcccacagg

SEQ ID NO: 41 - RNA, 22 nt, Human
ggcucacugcaaacugugccuc

SEQ ID NO: 42 - RNA, 22 nt, Human
accauugcccccuagugucugu

SEQ ID NO: 43 - RNA, 22 nt, Human
cauugcacuccagccuggguga

SEQ ID NO: 44 - RNA, 22 nt, Human
uuccuggucacugcuguucccu

SEQ ID NO: 45 - RNA, 22 nt, Human
gucauggugcuagcgggaaugu

SEQ ID NO: 46 - RNA, 17 nt, Human
gcgccugugccuccuaa

SEQ ID NO: 47 - RNA, 22 nt, Human
gcccuccuggcaggcagugaug

SEQ ID NO: 48 - RNA, 22 nt, Human
cuguaaucccagcuaccuggga

SEQ ID NO: 49 - RNA, 20 nt, Human
caaggguuugcauuggcuuu

SEQ ID NO: 50 - RNA, 19 nt, Human
guuucucugggcuuggcau

SEQ ID NO: 51 - RNA, 22 nt, Human
ccugggaggcugaggcugcagu

SEQ ID NO: 52 - RNA, 22 nt, Human
cacugcaagcuccaccucccgg

SEQ ID NO: 53 - RNA, 22 nt, Human
cacugcagccucgacuucccug

SEQ ID NO: 54 - RNA, 22 nt, Human
cccggguuguccgcgcguccgg

SEQ ID NO: 55 - RNA, 22 nt, Human
uagcacagggcuccucaaccca

SEQ ID NO: 56 - RNA, 22 nt, Human
uccuccccaaagcccagccugg

SEQ ID NO: 57 - RNA, 22 nt, Human
acaaagugccuccuuuuagagu

SEQ ID NO: 58 - RNA, 22 nt, Human
cccgggagguggagcuugcagu

SEQ ID NO: 59 - RNA, 22 nt, Human
cacugcacuccagccuggcgac

SEQ ID NO: 60 - RNA, 22 nt, Human
cugggcucaagugauccaccca

SEQ ID NO: 61 - RNA, 22 nt, Human
ucuuugcuauugugaauagugc

SEQ ID NO: 62 - RNA, 22 nt, Human
guaugugcugagcuuuccccgc

SEQ ID NO: 63 - RNA, 22 nt, Human
acagauucacugcacuggccau

SEQ ID NO: 64 - RNA, 22 nt, Human
caccuguaaucccagcacuuca

SEQ ID NO: 65 - RNA, 22 nt, Human
ccccuacacaccccucuuggca

SEQ ID NO: 66 - RNA, 22 nt, Human
uccuuccucugucaggcaggcc

SEQ ID NO: 67 - RNA, 22 nt, Human
caggcugaagugcaguggugug

SEQ ID NO: 68 - RNA, 22 nt, Human
cggagucuugcuauguugccca

SEQ ID NO: 69 - RNA, 22 nt, Human
gccauccugaugacaggccacu

SEQ ID NO: 70 - RNA, 22 nt, Human
gcucacugcaaccuccgccuuc

SEQ ID NO: 71 - RNA, 18 nt, Human
ucaagccauucuccugcc

SEQ ID NO: 72 - RNA, 22 nt, Human
uauuccagccgcuugagcucgc

SEQ ID NO: 73 - RNA, 22 nt, Human
gcagccugggcaacagagugag

SEQ ID NO: 74 - RNA, 22 nt, Human
ucaccaggcuggagugcagugg

SEQ ID NO: 75 - RNA, 22 nt, Human
ugugacacuggccaucuggguu

SEQ ID NO: 76 - RNA, 22 nt, Human
ugcaauccccgccucaacagga

SEQ ID NO: 77 - RNA, 22 nt, Human
ugccuguugcccaccugauaaa

SEQ ID NO: 78 - RNA, 22 nt, Human
ucacugcaaccuccaccuucag

SEQ ID NO: 79 - RNA, 22 nt, Human
ugcgcgccagcucccagguucg

SEQ ID NO: 80 - RNA, 22 nt, Human
gcgggguuccgugccccagagu

SEQ ID NO: 81 - RNA, 22 nt, Human
uugcccaggcuggagugcagug

SEQ ID NO: 82 - RNA, 22 nt, Human
accauugcacucuagccugggc

SEQ ID NO: 83 - RNA, 22 nt, Human
cuagagugcagguguaugguua

SEQ ID NO: 84 - RNA, 22 nt, Human
ugugcuggccuuuggugacuuc

SEQ ID NO: 85 - RNA, 22 nt, Human
gcccuuugugucuggcuggggu

SEQ ID NO: 86 - RNA, 22 nt, Human
ggaggcggaggcugcagugagc

SEQ ID NO: 87 - RNA, 22 nt, Human
agcucauugcaaccuccgccuc

SEQ ID NO: 88 - RNA, 22 nt, Human
acugcacuccugccuggguaac

SEQ ID NO: 89 - RNA, 22 nt, Human
ucgcggguugcacauggccauc

SEQ ID NO: 90 - RNA, 22 nt, Human
auugcacuccagccugggcgac

SEQ ID NO: 91 - RNA, 22 nt, Human
guggccccagggcccugucugg

SEQ ID NO: 92 - RNA, 22 nt, Human
gggcagaucaccugaggucagg

SEQ ID NO: 93 - RNA, 22 nt, Human
guccccgccgucgcucaggcug

SEQ ID NO: 94 - RNA, 23 nt, Human
ggcccccggaacgcucugugacc

SEQ ID NO: 95 - RNA, 22 nt, Human
cggugcaaggguagcggcaggc

SEQ ID NO: 96 - RNA, 22 nt, Human
gcucaagccuucugcccaccuc

SEQ ID NO: 97 - RNA, 22 nt, Human
gagcccaggaguuugaugcugc

SEQ ID NO: 98 - RNA, 22 nt, Human
ugagucagccuuggcagccccu

SEQ ID NO: 99 - RNA, 22 nt, Human
uuucaccaucuuggccaggcug

SEQ ID NO: 100 - RNA, 22 nt, Human
ggacacguggcugaaggcggcc

SEQ ID NO: 101 - RNA, 22 nt, Human
cgggguucauccaugcuguggc

SEQ ID NO: 102 - RNA, 19 nt, Human
aguccuggccugggggacc

SEQ ID NO: 103 - RNA, 22 nt, Human
gcugcaccccagccuggguaac

SEQ ID NO: 104 - RNA, 22 nt, Human
augcagcccccuggugcccggg

SEQ ID NO: 105 - RNA, 22 nt, Human
uuaggguuacaccagccuccug

SEQ ID NO: 106 - RNA, 22 nt, Human
guggcucacgccuguaauccca

SEQ ID NO: 107 - RNA, 22 nt, Human
ccauugcacuccauccugggca

SEQ ID NO: 108 - RNA, 22 nt, Human
gaccuugugaucugccugccuu

SEQ ID NO: 109 - RNA, 22 nt, Human
uguccccacccaaaucucaucu

SEQ ID NO: 110 - RNA, 23 nt, Human
accugucugccucccaccaucaa

SEQ ID NO: 111 - RNA, 22 nt, Human
guuggccaggcuggucucaaac

SEQ ID NO: 112 - RNA, 22 nt, Human
cagcuguucauuguugccaccc

SEQ ID NO: 113 - RNA, 22 nt, Human
auagcagcgcuggcccucugcc

SEQ ID NO: 114 - RNA, 22 nt, Human
aguggccuggagccccgccugg

SEQ ID NO: 115 - RNA, 22 nt, Human
ggccgucagccccgauuugcca

SEQ ID NO: 116 - RNA, 22 nt, Human
gcugaccccuacagguuguguu

SEQ ID NO: 117 - RNA, 22 nt, Human
ccuggcuccuacggguauuuug

SEQ ID NO: 118 - RNA, 22 nt, Human
cucagcuuggccuggacguagc

SEQ ID NO: 119 - RNA, 19 nt, Human
cuccuugccauuucuuuuc

SEQ ID NO: 120 - RNA, 22 nt, Human
cccaggaggcggagguugcagu

SEQ ID NO: 121 - RNA, 22 nt, Human
cccagcaguagagcucauaugg

SEQ ID NO: 122 - RNA, 22 nt, Human
ucucgaucuccugaccuuguga

SEQ ID NO: 123 - RNA, 22 nt, Human
caccaugcccggcuaauuuugg

SEQ ID NO: 124 - RNA, 21 nt, Human
uagcccuucuccaccucgccc

SEQ ID NO: 125 - RNA, 22 nt, Human
ccugugcuuggccagagagguu

SEQ ID NO: 126 - RNA, 22 nt, Human
caugccuguaaucccagcacuu

SEQ ID NO: 127 - RNA, 22 nt, Human
ccugggccucucaaagugcugg

SEQ ID NO: 128 - RNA, 22 nt, Human
guccccgacguuuggcuugaug

SEQ ID NO: 129 - RNA, 22 nt, Human
cugcacugacuuccccggcugc

SEQ ID NO: 130 - RNA, 22 nt, Human
uccugggaucaagugauccucc

SEQ ID NO: 131 - RNA, 22 nt, Human
uugcuaguguuugguugauggu

SEQ ID NO: 132 - RNA, 22 nt, Human
aucauuauccuccuauuugccu

SEQ ID NO: 133 - RNA, 22 nt, Human
ugcucugauuuuugccccagcu

SEQ ID NO: 134 - RNA, 23 nt, Human
ucugugucuccacccaaaucuca

SEQ ID NO: 135 - RNA, 23 nt, Human
uacuaugguuauuaucccucucc

SEQ ID NO: 136 - RNA, 22 nt, Human
ggagugcaguggcgugaucucg

SEQ ID NO: 137 - RNA, 22 nt, Human
ucgaaggccucuugcuccucga

SEQ ID NO: 138 - RNA, 22 nt, Human
guauuuggaaaccaccagugcc

SEQ ID NO: 139 - RNA, 22 nt, Human
uugcccaggcuggagugcagua

SEQ ID NO: 140 - RNA, 22 nt, Human
cugucccugagcaacuccuguu

SEQ ID NO: 141 - RNA, 22 nt, Human
agcguguugggaggagcugcag

SEQ ID NO: 142 - RNA, 22 nt, Human
ccgggcuggagugcaauggcuc

SEQ ID NO: 143 - RNA, 22 nt, Human
gggcguggagcuggaaugaugu

SEQ ID NO: 144 - RNA, 22 nt, Human
gcugaacgagcuggccaaguuc

SEQ ID NO: 145 - RNA, 22 nt, Human
ccacugcacuccagccugccaa

SEQ ID NO: 146 - RNA, 19 nt, Human
ucucuaguccugccucccc

SEQ ID NO: 147 - RNA, 22 nt, Human
cacugcacugcagccuggagac

SEQ ID NO: 148 - RNA, 20 nt, Human
auggggugagugacgcccuc

SEQ ID NO: 149 - RNA, 22 nt, Human
agcacgguggguuuggcuggca

SEQ ID NO: 150 - RNA, 22 nt, Human
augccacugcacuucagcuugg

SEQ ID NO: 151 - RNA, 22 nt, Human
acauccucccgaucuacuggcu

SEQ ID NO: 152 - RNA, 22 nt, Human
acuguccgggacaggcccaucc

SEQ ID NO: 153 - RNA, 22 nt, Human
ugacaaugaggcccuccacaaa

SEQ ID NO: 154 - RNA, 22 nt, Human
aagugcuagugagucuauugua

SEQ ID NO: 155 - RNA, 22 nt, Human
gaccucgugauccgccugcuuu

SEQ ID NO: 156 - RNA, 20 nt, Human
ugaccuccugggcucaagcc

SEQ ID NO: 157 - RNA, 23 nt, Human
cucgacuucccuggcuugcguga

SEQ ID NO: 158 - RNA, 22 nt, Human
agagaugggguuucaccacguu

SEQ ID NO: 159 - RNA, 22 nt, Human
gguggcaguagcacugggccug

SEQ ID NO: 160 - RNA, 22 nt, Human
gugaccuggccgccuaaaccca

SEQ ID NO: 161 - RNA, 22 nt, Human
aauugcacgguauccaucugua

SEQ ID NO: 162 - RNA, 22 nt, Human
cuguccugugcuuuuuacuguc

SEQ ID NO: 163 - RNA, 22 nt, Human
ccugccuacugaguuuuauauu

SEQ ID NO: 164 - RNA, 22 nt, Human
gcggcggcgguagcaaaaauga

SEQ ID NO: 165 - RNA, 21 nt, Human
cuggccacugcaccucuuccu

SEQ ID NO: 166 - RNA, 22 nt, Human
ucagccuccuccaccccagagu

SEQ ID NO: 167 - RNA, 22 nt, Human
agcagcaguauccuuccccggc

SEQ ID NO: 168 - RNA, 22 nt, Human
ccaggagguggagguugcggug

SEQ ID NO: 169 - RNA, 23 nt, Human
ggcuggccccauccaggcuggca

SEQ ID NO: 170 - RNA, 22 nt, Human
ugcagguugcuggucugaucuc

SEQ ID NO: 171 - RNA, 22 nt, Human
uggugcagcgugugguggcucu

SEQ ID NO: 172 - RNA, 22 nt, Human
uugccuuccugcccagcuucug

SEQ ID NO: 173 - RNA, 22 nt, Human
cucuuugguugguuccugaugc

SEQ ID NO: 174 - RNA, 22 nt, Human
ucaccgaggcuggagugcagug

SEQ ID NO: 175 - RNA, 23 nt, Human
gcguccggccucucucgcucccg

SEQ ID NO: 176 - RNA, 22 nt, Human
cggugccuccuccaguguugcu

SEQ ID NO: 177 - RNA, 22 nt, Human
caggcuggagugcaguggcgcu

SEQ ID NO: 178 - RNA, 21 nt, Human
aggcaccacaucucccucccc

SEQ ID NO: 179 - RNA, 18 nt, Human
gauauggaaggccaugcc

SEQ ID NO: 180 - RNA, 21 nt, Human
uagaacuauggcuaugugcca

SEQ ID NO: 181 - RNA, 22 nt, Human
guugccuaggcuggucuugaac

SEQ ID NO: 182 - RNA, 22 nt, Human
agcaccuccagagcuugaagcu

SEQ ID NO: 183 - RNA, 22 nt, Human
ggguuggcaucaggguucugug

SEQ ID NO: 184 - RNA, 22 nt, Human
acugcacugcagccuggccaac

SEQ ID NO: 185 - RNA, 22 nt, Human
uucacugcaaccuccgccuccc

SEQ ID NO: 186 - RNA, 22 nt, Human
cucacugcaaccuccgucuccc

SEQ ID NO: 187 - RNA, 22 nt, Human
auaugcagucucuugcccuucu

SEQ ID NO: 188 - RNA, 22 nt, Human
ggccuguaaucccagcuacuca

SEQ ID NO: 189 - RNA, 20 nt, Human
agcagagugcccaucccgga

SEQ ID NO: 190 - RNA, 22 nt, Human
cucacugcaagcucugccucca

SEQ ID NO: 191 - RNA, 22 nt, Human
gugguagcuccaggcugucuga

SEQ ID NO: 192 - RNA, 22 nt, Human
uggcggcguguggacugaggac

SEQ ID NO: 193 - RNA, 22 nt, Human
ccccucaguuugcuaguauuuu

SEQ ID NO: 194 - RNA, 22 nt, Human
acugcccuccagccugggugac

SEQ ID NO: 195 - RNA, 22 nt, Human
guuggucuucauuaaaugcuuu

SEQ ID NO: 196 - RNA, 22 nt, Human
agcuuugguugccaugaucuga

SEQ ID NO: 197 - RNA, 22 nt, Human
cauaauuucuaccagggccaua

SEQ ID NO: 198 - RNA, 22 nt, Human
uccuugugcugaggguguugcu

SEQ ID NO: 199 - RNA, 22 nt, Human
ucuggcuucccucuguucuggg

SEQ ID NO: 200 - RNA, 22 nt, Human
ucccccaggcuggagugcagug

SEQ ID NO: 201 - RNA, 22 nt, Human
cuucaucagcuggcuuacuguu

SEQ ID NO: 202 - RNA, 22 nt, Human
ugcguuccaguugcugccaggc

SEQ ID NO: 203 - RNA, 22 nt, Human
ccuggaggcggagguugcagug

SEQ ID NO: 204 - RNA, 22 nt, Human
ccucugcaccaaccugucaaga

SEQ ID NO: 205 - RNA, 22 nt, Human
cacugcagccuccaucucuggg

SEQ ID NO: 206 - RNA, 22 nt, Human
ggugccccaucgcggguggcug

SEQ ID NO: 207 - RNA, 21 nt, Human
gcagggaacuggcugggcuuu

SEQ ID NO: 208 - RNA, 22 nt, Human
ccguccccggugcugccugcgc

SEQ ID NO: 209 - RNA, 22 nt, Human
auuaggagagugggugcuaagu

SEQ ID NO: 210 - RNA, 22 nt, Human
acccaggcuggagugcagugau

SEQ ID NO: 211 - RNA, 22 nt, Human
cacugcacuccagcuugggcaa

SEQ ID NO: 212 - RNA, 23 nt, Human
cagagcuggcuucaugggugugc

SEQ ID NO: 213 - RNA, 22 nt, Human
ucuuccugucaaugagaauuaa

SEQ ID NO: 214 - RNA, 22 nt, Human
gcaggcggagguugcagugagc

SEQ ID NO: 215 - RNA, 22 nt, Human
gucuuuugcuagccagagagcu

SEQ ID NO: 216 - RNA, 22 nt, Human
cacugcacuccagccugggcaa

SEQ ID NO: 217 - RNA, 22 nt, Human
gcccccguaguagaugaggcgc

SEQ ID NO: 218 - RNA, 22 nt, Human
ggucgcuguguagguucagcua

SEQ ID NO: 219 - RNA, 22 nt, Human
ucuggcucuggaguccaccugc

SEQ ID NO: 220 - RNA, 22 nt, Human
gacagcuccagcuccuccaggc

SEQ ID NO: 221 - RNA, 22 nt, Human
ucacuacaaccuccgccuccug

SEQ ID NO: 222 - RNA, 22 nt, Human
acccaggcuggcgugcaguggc

SEQ ID NO: 223 - RNA, 22 nt, Human
ccuguggucccugucugugccu

SEQ ID NO: 224 - RNA, 22 nt, Human
auugcacuccagccugggcaac

SEQ ID NO: 225 - RNA, 23 nt, Human
ucaagcaauucuccugccucggc

SEQ ID NO: 226 - RNA, 22 nt, Human
aaugcugaguccugugagucuu

SEQ ID NO: 227 - RNA, 22 nt, Human
agucgcuguuggucguggcacu

SEQ ID NO: 228 - RNA, 22 nt, Human
cugcaagcuaccccuagcauca

SEQ ID NO: 229 - RNA, 22 nt, Human
aggaccuguccccuggcccacu

SEQ ID NO: 230 - RNA, 22 nt, Human
gcaggcauuagcccccauggcu

SEQ ID NO: 231 - RNA, 21 nt, Human
aggccaagaaggaagcagagg

SEQ ID NO: 232 - RNA, 22 nt, Human
cuuccugccucucgccgcccgc

SEQ ID NO: 233 - RNA, 22 nt, Human
auuguugcccauguuuuuauuu

SEQ ID NO: 234 - RNA, 22 nt, Human
cuggcagguuauagagcugccc

SEQ ID NO: 235 - RNA, 22 nt, Human
ucuccacagcuggcccccaaga

SEQ ID NO: 236 - RNA, 22 nt, Human
ggguuggauccugguggcugcc

SEQ ID NO: 237 - RNA, 22 nt, Human
ccuuuuguccugcuugguuucg

SEQ ID NO: 238 - RNA, 22 nt, Human
uggugcuuguggagcuggugcu

SEQ ID NO: 239 - RNA, 20 nt, Human
cagccugcaucaucugcagc

SEQ ID NO: 240 - RNA, 22 nt, Human
ucacugcaaucucagccuccug

SEQ ID NO: 241 - RNA, 22 nt, Human
uggguggagcaggcuggugcuu

SEQ ID NO: 242 - RNA, 22 nt, Human
cugagauaggacucugcuggcu

SEQ ID NO: 243 - RNA, 22 nt, Human
gccuaucugucaaauuucucug

SEQ ID NO: 244 - RNA, 22 nt, Human
uucuucugccccuugccugaca

SEQ ID NO: 245 - RNA, 22 nt, Human
acugcacuccagccugggcaac

SEQ ID NO: 246 - RNA, 22 nt, Human
ugccuaggcuggagugcaaugg

SEQ ID NO: 247 - RNA, 22 nt, Human
cuggccuggcgcaguggcucac

SEQ ID NO: 248 - RNA, 22 nt, Human
cuccuucugggccuggcagugg

SEQ ID NO: 249 - RNA, 22 nt, Human
caaggugccaugcugggcgggg

SEQ ID NO: 250 - RNA, 22 nt, Human
agugggccggacagcccaggcc

SEQ ID NO: 251 - RNA, 22 nt, Human
ugcuuauauuucauuggcccaa

SEQ ID NO: 252 - RNA, 22 nt, Human
ccaaagugcuaggauuacaggc

SEQ ID NO: 253 - RNA, 22 nt, Human
cggcacuguagucuggcuggga

SEQ ID NO: 254 - RNA, 22 nt, Human
ugccgcaaguacugcugccugu

SEQ ID NO: 255 - RNA, 22 nt, Human
gaugucgugauccacccgccuu

SEQ ID NO: 256 - RNA, 22 nt, Human
cgugccacugcacucuagccug

SEQ ID NO: 257 - RNA, 22 nt, Human
cauggcagcuccuccaguguga

SEQ ID NO: 258 - RNA, 22 nt, Human
ggaauccugccagcucugcccc

SEQ ID NO: 259 - RNA, 22 nt, Human
ccaguacguugcucagcuccuc

SEQ ID NO: 260 - RNA, 22 nt, Human
ugucuccccacuggucuuccag

SEQ ID NO: 261 - RNA, 22 nt, Human
cuggccuaaaaauacagaacaa

SEQ ID NO: 262 - RNA, 22 nt, Human
caggcucuucccucuggccaag

SEQ ID NO: 263 - RNA, 22 nt, Human
acucuggccaucuuggaccuug

SEQ ID NO: 264 - RNA, 22 nt, Human
cggcgagcgggaccugcgccug

SEQ ID NO: 265 - RNA, 22 nt, Human
ugugccuguucccacuuugccu

SEQ ID NO: 266 - RNA, 22 nt, Human
cucacugcaaccuccgccuccu

SEQ ID NO: 267 - RNA, 22 nt, Human
aggcucccugaaucgcccguuc

SEQ ID NO: 268 - RNA, 22 nt, Human
cucugccucccagguucaagcg

SEQ ID NO: 269 - RNA, 22 nt, Human
gcuaguguuugccagcguagcc

SEQ ID NO: 270 - RNA, 22 nt, Human
ggaguuccagaccagacuggcc

SEQ ID NO: 271 - RNA, 22 nt, Human
cucagcucauccacuaaauccc

SEQ ID NO: 272 - RNA, 22 nt, Human
auugcacuccggccugggugac

SEQ ID NO: 273 - RNA, 22 nt, Human
caacauggugaaaccccgucuc

SEQ ID NO: 274 - RNA, 23 nt, Human
gugccgacgcuccagcaccaucc

SEQ ID NO: 275 - RNA, 22 nt, Human
acuguacuccagccugguggca

SEQ ID NO: 276 - RNA, 22 nt, Human
gugacagugaaucuagacagac

SEQ ID NO: 277 - RNA, 22 nt, Human
ucacugcaaccuccgccugcug

SEQ ID NO: 278 - RNA, 22 nt, Human
ucugcgguccccuucucgcccu

SEQ ID NO: 279 - RNA, 22 nt, Human
caggcuggagugcaguggugcc

SEQ ID NO: 280 - RNA, 22 nt, Human
ccucuuucaccgugccuguccc

SEQ ID NO: 281 - RNA, 22 nt, Human
cugagcucacgccauucuccuu

SEQ ID NO: 282 - RNA, 22 nt, Human
ggugauccaccagccucggccu

SEQ ID NO: 283 - RNA, 22 nt, Human
ugaccccuauauccuguuucuu

SEQ ID NO: 284 - RNA, 17 nt, Human
acuucccaccccuccag

SEQ ID NO: 285 - RNA, 22 nt, Human
cuuuaugaaaaccugaauuaug

SEQ ID NO: 286 - RNA, 22 nt, Human
cggcucacugcagcuccgccuc

SEQ ID NO: 287 - RNA, 22 nt, Human
ggccuguggugcgcuauuucag

SEQ ID NO: 288 - RNA, 22 nt, Human
cuugcuuucagucucggccuca

SEQ ID NO: 289 - RNA, 22 nt, Human
aucacuuugaguccaggaguuu

SEQ ID NO: 290 - RNA, 22 nt, Human
gaggcagagguugcagugagcu

SEQ ID NO: 291 - RNA, 22 nt, Human
cuggccaagauggugaaacccc

SEQ ID NO: 292 - RNA, 22 nt, Human
gccuggguccaccgcucgcgcu

SEQ ID NO: 293 - RNA, 22 nt, Human
gaggccacugucccugccuucc

SEQ ID NO: 294 - RNA, 22 nt, Human
acccgccgcacguccaggcuga

SEQ ID NO: 295 - RNA, 22 nt, Human
uggcuuccccggagugacaugu

SEQ ID NO: 296 - RNA, 22 nt, Human
ggaggagcaugagaggguagug

SEQ ID NO: 297 - RNA, 22 nt, Human
gcuguccagcccuuguucaccu

SEQ ID NO: 298 - RNA, 22 nt, Human
gccuccaggucggucuuucucu

SEQ ID NO: 299 - RNA, 22 nt, Human
agggaaaucucagcucuaaaau

SEQ ID NO: 300 - RNA, 22 nt, Human
cucagugcaaccuccgccuacu

SEQ ID NO: 301 - RNA, 22 nt, Human
ccggucuguguacuugcuggcc

SEQ ID NO: 302 - RNA, 22 nt, Human
cacugucuuccuuuggcuccuc

SEQ ID NO: 303 - RNA, 22 nt, Human
cacugcacuccagccugggaga

SEQ ID NO: 304 - RNA, 22 nt, Human
uacugugugcccagccgagcug

SEQ ID NO: 305 - RNA, 22 nt, Human
gcccagaucuccugacccucag

SEQ ID NO: 306 - RNA, 22 nt, Human
ucacuucccagacgggguggca

SEQ ID NO: 307 - RNA, 20 nt, Human
ugcugcccuaagaccaccuu

SEQ ID NO: 308 - RNA, 22 nt, Human
acacugauguuggcccugguca

SEQ ID NO: 309 - RNA, 22 nt, Human
auggcugccugggcgcuggccg

SEQ ID NO: 310 - RNA, 22 nt, Human
uuucuccucaugacugguugug

SEQ ID NO: 311 - RNA, 22 nt, Human
aaagcgcuucccuuuggagcgu

SEQ ID NO: 312 - RNA, 22 nt, Human
aacgcccagccuugaucaaaug

SEQ ID NO: 313 - RNA, 22 nt, Human
ugagcacaugccagcccuucuc

SEQ ID NO: 314 - RNA, 22 nt, Human
gaccucgugaucugccggccuu

SEQ ID NO: 315 - RNA, 22 nt, Human
uggcuaacaaggugaaaccccg

SEQ ID NO: 316 - RNA, 22 nt, Human
ugugcucugacuuucuccuggu

SEQ ID NO: 317 - RNA, 22 nt, Human
ucuagguaggcuguguguggaa

SEQ ID NO: 318 - RNA, 22 nt, Human
gaaguguagucuugagccccca

SEQ ID NO: 319 - RNA, 23 nt, Human
ccugccuccccaucaguuauaca

SEQ ID NO: 320 - RNA, 22 nt, Human
accacugcacuccagucugggc

SEQ ID NO: 321 - RNA, 20 nt, Human
cugcucugguuuccucuguc

SEQ ID NO: 322 - RNA, 22 nt, Human
ggggcauugugucuggguuccu

SEQ ID NO: 323 - RNA, 22 nt, Human
gcuggcagacuuccucuggaac

SEQ ID NO: 324 - RNA, 22 nt, Human
ccuccaaccauagguccagggg

SEQ ID NO: 325 - RNA, 22 nt, Human
ucuccuggagcccagaugcugg

SEQ ID NO: 326 - RNA, 22 nt, Human
cuccuugcuggucugguguaau

SEQ ID NO: 327 - RNA, 22 nt, Human
aaagugcugguauuacaggugu

SEQ ID NO: 328 - RNA, 22 nt, Human
cuccaguuggccccaguugguu

SEQ ID NO: 329 - RNA, 22 nt, Human
ccucacucagguuuggacccug

SEQ ID NO: 330 - RNA, 20 nt, Human
acugcacuccagccuuccag

SEQ ID NO: 331 - RNA, 22 nt, Human
ugccuagccaaguccaguauuu

SEQ ID NO: 332 - RNA, 22 nt, Human
cgcaugagaccugccggccauc

SEQ ID NO: 333 - RNA, 22 nt, Human
augccccuggccuggggaacau

SEQ ID NO: 334 - RNA, 22 nt, Human
ucucgcucugucgcccaggcug

SEQ ID NO: 335 - RNA, 22 nt, Human
uagugcccuccccuuugggaua

SEQ ID NO: 336 - RNA, 22 nt, Human
ggcuccugggggugcuccugcc

SEQ ID NO: 337 - RNA, 22 nt, Human
aaugggguagugggcagccugg

SEQ ID NO: 338 - RNA, 22 nt, Human
aacccaggaggcggagguugug

SEQ ID NO: 339 - RNA, 22 nt, Human
ggcucacugcaacuuccgccuc

SEQ ID NO: 340 - RNA, 22 nt, Human
cccggaggcagagguugcagug

SEQ ID NO: 341 - RNA, 22 nt, Human
cgccuggcccccaguacuuugu

SEQ ID NO: 342 - RNA, 22 nt, Human
uggcuguacauuggaauuaucu

SEQ ID NO: 343 - RNA, 22 nt, Human
cgugcgccucagccucgugcgc

SEQ ID NO: 344 - RNA, 22 nt, Human
ucagaauauggcuaggagugcu

SEQ ID NO: 345 - RNA, 22 nt, Human
caggcuggagugcaguggggcg

SEQ ID NO: 346 - RNA, 22 nt, Human
uacgccuguaaucccagcacuu

SEQ ID NO: 347 - RNA, 18 nt, Human
ugucccugcaaauaacau

SEQ ID NO: 348 - RNA, 21 nt, Human
cuuccccaggcuggucuguau

SEQ ID NO: 349 - RNA, 22 nt, Human
cauguuggugugcugcacccgu

SEQ ID NO: 350 - RNA, 22 nt, Human
aggcuguagugcaugugcuaug

SEQ ID NO: 351 - RNA, 22 nt, Human
acugcgcuccagccugggugac

SEQ ID NO: 352 - RNA, 22 nt, Human
agucccccucugagcccaggga

SEQ ID NO: 353 - RNA, 22 nt, Human
uagguauaggauucuagguugg

SEQ ID NO: 354 - RNA, 22 nt, Human
caauucccagcugccgggcugc

SEQ ID NO: 355 - RNA, 23 nt, Human
ccaucccuuggaagcugguuuua

SEQ ID NO: 356 - RNA, 22 nt, Human
gugcucccuccuuccucaagga

SEQ ID NO: 357 - RNA, 22 nt, Human
ccaaagugcuaggauuacaggu

SEQ ID NO: 358 - RNA, 22 nt, Human
uggauucacaccauucuccugc

SEQ ID NO: 359 - RNA, 22 nt, Human
aagugcugggauuacaggcaug

SEQ ID NO: 360 - RNA, 22 nt, Human
ugagauggagucucgcucuguu

SEQ ID NO: 361 - RNA, 22 nt, Human
uugcugcucugccgguacagcu

SEQ ID NO: 362 - RNA, 22 nt, Human
gccugucccgcaccggagcccg

SEQ ID NO: 363 - RNA, 22 nt, Human
gucuccccagggcccucuucau

SEQ ID NO: 364 - RNA, 22 nt, Human
uggauggcuguggucuuugccc

SEQ ID NO: 365 - RNA, 22 nt, Human
cuuccuucucacuagcagcgcc

SEQ ID NO: 366 - RNA, 22 nt, Human
uccuuugcuucugucauucucc

SEQ ID NO: 367 - RNA, 22 nt, Human
gaggcugagguugcagugagcu

SEQ ID NO: 368 - RNA, 19 nt, Human
guaauaugugcugaguccu

SEQ ID NO: 369 - RNA, 22 nt, Human
cugguuaucucggccacagaga

SEQ ID NO: 370 - RNA, 22 nt, Human
ggccacugcucuccagccuggg

SEQ ID NO: 371 - RNA, 22 nt, Human
ccuggcucuggcuuccuguugu

SEQ ID NO: 372 - RNA, 22 nt, Human
agccccaaacaccaggauuacu

SEQ ID NO: 373 - RNA, 21 nt, Human
ccgccgcugauagcucugggc

SEQ ID NO: 374 - RNA, 22 nt, Human
aggggcuccuuugugcugcguc

SEQ ID NO: 375 - RNA, 22 nt, Human
ucuucacgccaagugccccuca

SEQ ID NO: 376 - RNA, 23 nt, Human
ggccucagugaugauggguuaaa

SEQ ID NO: 377 - RNA, 22 nt, Human
aaggcucggcaaugugcggcuc

SEQ ID NO: 378 - RNA, 22 nt, Human
uuucccuuuagccugagaaucc

SEQ ID NO: 379 - RNA, 22 nt, Human
caaagugcuaggauuauaggug

SEQ ID NO: 380 - RNA, 22 nt, Human
gaggcaggaggauugcuugagc

SEQ ID NO: 381 - RNA, 22 nt, Human
uccgggugcccacgugccccua

SEQ ID NO: 382 - RNA, 22 nt, Human
gaggcugaggcggauggaucac

SEQ ID NO: 383 - RNA, 22 nt, Human
accacccagccagcuucucccu

SEQ ID NO: 384 - RNA, 22 nt, Human
uguccagccggcccacgcccau

SEQ ID NO: 385 - RNA, 22 nt, Human
ggcucuuccgccaccagccaca

SEQ ID NO: 386 - RNA, 22 nt, Human
ugcagcauugcacuccagccug

SEQ ID NO: 387 - RNA, 22 nt, Human
ugggucucuggccaccccagcc

SEQ ID NO: 388 - RNA, 22 nt, Human
ucucuagucuccuuuaaccuga

SEQ ID NO: 389 - RNA, 22 nt, Human
uagguuguccaucucuagaagc

SEQ ID NO: 390 - RNA, 23 nt, Human
acugcagucuugaucuccugggc

SEQ ID NO: 391 - RNA, 22 nt, Human
acaucuagacucuugcccucuu

SEQ ID NO: 392 - RNA, 22 nt, Human
cuggucugccacccacaccccu

SEQ ID NO: 393 - RNA, 22 nt, Human
gugccaggcacaggaagcagcc

SEQ ID NO: 394 - RNA, 22 nt, Human
uccucccucaccucagucuggg

SEQ ID NO: 395 - RNA, 22 nt, Human
guccucacuggccgcacgcuga

SEQ ID NO: 396 - RNA, 22 nt, Human
cuggccucggcagcaggaacag

SEQ ID NO: 397 - RNA, 22 nt, Human
gagugcaguggcgugaucucug

SEQ ID NO: 398 - RNA, 22 nt, Human
guguuccugugcuggaugguca

SEQ ID NO: 399 - RNA, 22 nt, Human
ccaggcuggaguauaguggcgc

SEQ ID NO: 400 - RNA, 22 nt, Human
ccagacccuccauucaagcucc

SEQ ID NO: 401 - RNA, 22 nt, Human
cacuaggcuggagugcaguggc

SEQ ID NO: 402 - RNA, 22 nt, Human
ucacugcgcuucagccugggug

SEQ ID NO: 403 - RNA, 22 nt, Human
ucuuugcuauugugaguagugc

SEQ ID NO: 404 - RNA, 22 nt, Human
uuguauagcccagagagugaga

SEQ ID NO: 405 - RNA, 22 nt, Human
cauugcacuccagccugggcca

SEQ ID NO: 406 - RNA, 22 nt, Human
cugcccgcaccauccccgggcu

SEQ ID NO: 407 - RNA, 22 nt, Human
cggcaugggcgucccccucacu

SEQ ID NO: 408 - RNA, 22 nt, Human
uugcauuugguucugccuggua

SEQ ID NO: 409 - RNA, 22 nt, Human
gagccccacccuagacauucug

SEQ ID NO: 410 - RNA, 23 nt, Human
ggauggacgugaugccuuagcca

SEQ ID NO: 411 - RNA, 19 nt, Human
ugccugcuguauuccagag

SEQ ID NO: 412 - RNA, 22 nt, Human
ccuggucggcguggugacggcg

SEQ ID NO: 413 - RNA, 22 nt, Human
ucacugcagccucugccucccg

SEQ ID NO: 414 - RNA, 22 nt, Human
acuguacuccagccuuggcgac

SEQ ID NO: 415 - RNA, 22 nt, Human
cuccagucuucucauguauccc

SEQ ID NO: 416 - RNA, 22 nt, Human
uagcagugucuagguaggccau

SEQ ID NO: 417 - RNA, 22 nt, Human
gcccuuggccucuuuggcccgg

SEQ ID NO: 418 - RNA, 22 nt, Human
cauucugcgauccucaagcaca

SEQ ID NO: 419 - RNA, 22 nt, Human
agcagcuuucaccuccccgccu

SEQ ID NO: 420 - RNA, 22 nt, Human
uggagccagcggccugcugagg

SEQ ID NO: 421 - RNA, 22 nt, Human
agcuggggcugugguugugauu

SEQ ID NO: 422 - RNA, 22 nt, Human
uagcugagccgccuggcugggg

SEQ ID NO: 423 - RNA, 18 nt, Human
ccaucacccuaacuagug

SEQ ID NO: 424 - RNA, 22 nt, Human
gccuggccuaauuccagcauuu

SEQ ID NO: 425 - RNA, 22 nt, Human
cacagccuccucuggcucacgg

SEQ ID NO: 426 - RNA, 22 nt, Human
ccgagguccuggacuuggcccu

SEQ ID NO: 427 - RNA, 22 nt, Human
gcagagugcugucguacgcccc

SEQ ID NO: 428 - RNA, 20 nt, Human
cuguaacugucccuuuugcc

SEQ ID NO: 429 - RNA, 22 nt, Human
ucacugcaaccuccaccuccug

SEQ ID NO: 430 - RNA, 22 nt, Human
uugcuuugcagugccuauagga

SEQ ID NO: 431 - RNA, 22 nt, Human
uggaggcuggagugcaguggcg

SEQ ID NO: 432 - RNA, 22 nt, Human
aagguggagguugcagugagcu

SEQ ID NO: 433 - RNA, 22 nt, Human
gcaggcugucuaaaguuagagu

SEQ ID NO: 434 - RNA, 22 nt, Human
gcgccccaucuacaguacuuuu

SEQ ID NO: 435 - RNA, 22 nt, Human
ucugccuucuaucuuuugucug

SEQ ID NO: 436 - RNA, 22 nt, Human
ccuucccaugcagccugucuga

SEQ ID NO: 437 - RNA, 22 nt, Human
gccuggccuaaauuaguaauuu

SEQ ID NO: 438 - RNA, 22 nt, Human
uucuggcuucucccaggcggcc

SEQ ID NO: 439 - RNA, 22 nt, Human
ggcgcccccuucaaacagagca

SEQ ID NO: 440 - RNA, 22 nt, Human
ucccaauagccuaagagccugg

SEQ ID NO: 441 - RNA, 22 nt, Human
gccuggccaacguggugaaacc

SEQ ID NO: 442 - RNA, 22 nt, Human
ugucuggcuuucuucaguuagc

SEQ ID NO: 443 - RNA, 22 nt, Human
uggguuuuguuuguacagugua

SEQ ID NO: 444 - RNA, 23 nt, Human
cuguggugaggcccuagaaucug

SEQ ID NO: 445 - RNA, 22 nt, Human
uugcucaggcuggcgugcaaug

SEQ ID NO: 446 - RNA, 22 nt, Human
ggagguggagguugcagugagc

SEQ ID NO: 447 - RNA, 22 nt, Human
ggaggcggagguugcagugagu

SEQ ID NO: 448 - RNA, 22 nt, Human
cugagccuccugcuucuauuuc

SEQ ID NO: 449 - RNA, 22 nt, Human
acuguacuccagccugggaaac

SEQ ID NO: 450 - RNA, 22 nt, Human
ucacauuuucaaaagcuggugc

SEQ ID NO: 451 - RNA, 22 nt, Human
cgcaccccacugucccucaacc

SEQ ID NO: 452 - RNA, 22 nt, Human
acacuuugccccuggccgccuu

SEQ ID NO: 453 - RNA, 22 nt, Human
gcaacugaacauguguguggcc

SEQ ID NO: 454 - RNA, 22 nt, Human
cccaggaguuggaggcugcagu

SEQ ID NO: 455 - RNA, 22 nt, Human
gucuguuuucucuucuguggga

SEQ ID NO: 456 - RNA, 22 nt, Human
augguacuccagccugggugac

SEQ ID NO: 457 - RNA, 19 nt, Human
agaaucccaggccccacug

SEQ ID NO: 458 - RNA, 22 nt, Human
acugcacuccagccugggugac

SEQ ID NO: 459 - RNA, 18 nt, Human
ugguagguugggcaguuc

SEQ ID NO: 460 - RNA, 22 nt, Human
cagcccuccuacccugccaggc

SEQ ID NO: 461 - RNA, 22 nt, Human
agugagcaaguugauaauggcc

SEQ ID NO: 462 - RNA, 22 nt, Human
cccugccuguccuggucccguu

SEQ ID NO: 463 - RNA, 22 nt, Human
cacugcuaccucugccucccgg

SEQ ID NO: 464 - RNA, 18 nt, Human
gcuguggaagucuuuaua

SEQ ID NO: 465 - RNA, 22 nt, Human
ucugagccagggucuccucccu

SEQ ID NO: 466 - RNA, 22 nt, Human
aggaaaaaaauuaaugugaguc

SEQ ID NO: 467 - RNA, 22 nt, Human
auugcacuccagccugggugac

SEQ ID NO: 468 - RNA, 22 nt, Human
gccugugucuggguggccagag

SEQ ID NO: 469 - RNA, 22 nt, Human
uguccucguccgccucgaacuc

SEQ ID NO: 470 - RNA, 22 nt, Human
cacugcacuccagcacuccagc

SEQ ID NO: 471 - RNA, 22 nt, Human
ggucuuuucugcugcagguugu

SEQ ID NO: 472 - RNA, 19 nt, Human
ggagccgccgcccuucauu

SEQ ID NO: 473 - RNA, 22 nt, Human
uuugguguuccggucauugcug

SEQ ID NO: 474 - RNA, 22 nt, Human
gaacuugugauccgcccaccuu

SEQ ID NO: 475 - RNA, 20 nt, Human
cuucuggcuggucaaggacu

SEQ ID NO: 476 - RNA, 22 nt, Human
gucagucauugaaugcuggccu

SEQ ID NO: 477 - RNA, 22 nt, Human
ggaguuugccuauugcuuuugg

SEQ ID NO: 478 - RNA, 22 nt, Human
caggcuggagugcaaugacgcc

SEQ ID NO: 479 - RNA, 22 nt, Human
cucugaugucugccccucaccu

SEQ ID NO: 480 - RNA, 22 nt, Human
aagcccuggacggcccuucccc

SEQ ID NO: 481 - RNA, 22 nt, Human
gacccucuagauggaagcacug

SEQ ID NO: 482 - RNA, 22 nt, Human
cuggccagauguuacguccaau

SEQ ID NO: 483 - RNA, 22 nt, Human
agcugguuuaauaugcugucug

SEQ ID NO: 484 - RNA, 19 nt, Human
uccugccuggggccgccug

SEQ ID NO: 485 - RNA, 22 nt, Human
gagcugggccugcgagugcugc

SEQ ID NO: 486 - RNA, 22 nt, Human
acgcccagacucccauacuuug

SEQ ID NO: 487 - RNA, 21 nt, Human
uuaaagccucccucauaagga

SEQ ID NO: 488 - RNA, 22 nt, Human
cccagggguucaaggcugcagu

SEQ ID NO: 489 - RNA, 22 nt, Human
uuccaguucugggcuggcugcu

SEQ ID NO: 490 - RNA, 21 nt, Human
ucucuuccuccgcgccgccgc

SEQ ID NO: 491 - RNA, 21 nt, Human
cgugacuggguccgucuggcu

SEQ ID NO: 492 - RNA, 22 nt, Human
aacccgggaggcggagguugug

SEQ ID NO: 493 - RNA, 21 nt, Human
ggccccgcagacccagcacgu

SEQ ID NO: 494 - RNA, 22 nt, Human
acuguacuccaaccugggcaac

SEQ ID NO: 495 - RNA, 22 nt, Human
cgcccgcuggcccugcgaucuc

SEQ ID NO: 496 - RNA, 22 nt, Human
cucaccuccaggagcugcuggc

SEQ ID NO: 497 - RNA, 22 nt, Human
auggcccuaaugaguugguguu

SEQ ID NO: 498 - RNA, 22 nt, Human
gguagucggccuugcccugggc

SEQ ID NO: 499 - RNA, 22 nt, Human
cucgccccucucagcccugcaa

SEQ ID NO: 500 - RNA, 22 nt, Human
gccccagcucaccggcucacug

SEQ ID NO: 501 - RNA, 22 nt, Human
aagugcucauagugcagguagu

SEQ ID NO: 502 - RNA, 22 nt, Human
caacucacugcggccucaaccu

SEQ ID NO: 503 - RNA, 22 nt, Human
ccucuucaggcacucgaaggcc

SEQ ID NO: 504 - RNA, 22 nt, Human
cugccaugccacugugacugca

SEQ ID NO: 505 - RNA, 22 nt, Human
cccaggcccuggcagagcuugu

SEQ ID NO: 506 - RNA, 22 nt, Human
ugcagaaacaagccaucauuca

SEQ ID NO: 507 - RNA, 22 nt, Human
ggcucaaugcaacuucugccuc

SEQ ID NO: 508 - RNA, 22 nt, Human
auuguacuccagccugggugac

SEQ ID NO: 509 - RNA, 22 nt, Human
cugggaggcagagguugcagug

SEQ ID NO: 510 - RNA, 22 nt, Human
gcagcugacaucuggcugggcc

SEQ ID NO: 511 - RNA, 22 nt, Human
guccaguuguauguccaguguc

SEQ ID NO: 512 - RNA, 22 nt, Human
ugacuacaaccuccaccucccg

SEQ ID NO: 513 - RNA, 22 nt, Human
aggcuggagugcaguugcauga

SEQ ID NO: 514 - RNA, 22 nt, Human
caccuggcuggcaauuuauaau

SEQ ID NO: 515 - RNA, 22 nt, Human
gcucccugguagccaugcucuc

SEQ ID NO: 516 - RNA, 22 nt, Human
cuagacugaagcuccuugagga

SEQ ID NO: 517 - RNA, 22 nt, Human
gagaaauauggcucaguuccac

SEQ ID NO: 518 - RNA, 22 nt, Human
cucacugcaagcuccaccucuu

SEQ ID NO: 519 - RNA, 22 nt, Human
ucaccuugugauccgcccaccu

SEQ ID NO: 520 - RNA, 22 nt, Human
acugcacuccagccuggguaac

SEQ ID NO: 521 - RNA, 22 nt, Human
acugcacuccaaccugggugac

SEQ ID NO: 522 - RNA, 22 nt, Human
uuccuggucuauuuagaauugc

SEQ ID NO: 523 - RNA, 22 nt, Human
cucgugauccgcccaccucagc

SEQ ID NO: 524 - RNA, 22 nt, Human
cacugcacuccagccugcgcaa

SEQ ID NO: 525 - RNA, 22 nt, Human
acaaugcucccuguagucagga

SEQ ID NO: 526 - RNA, 17 nt, Human
aggaggcccuggcguuu

SEQ ID NO: 527 - RNA, 19 nt, Human
acugcacuccagccugggu

SEQ ID NO: 528 - RNA, 22 nt, Human
cucacagucugccuuucccuug

SEQ ID NO: 529 - RNA, 22 nt, Human
ucucucuuuuuugaacccgcuc

SEQ ID NO: 530 - RNA, 22 nt, Human
aaauguggggcuggaggcagga

SEQ ID NO: 531 - RNA, 22 nt, Human
caagccauucuccugccucagc

SEQ ID NO: 532 - RNA, 22 nt, Human
ccugcccugcucacugucggua

SEQ ID NO: 533 - RNA, 22 nt, Human
ugcaccacugcacuccagccug

SEQ ID NO: 534 - RNA, 22 nt, Human
ggcccugguccuagggguggaa

SEQ ID NO: 535 - RNA, 22 nt, Human
cacgccuguaaucccagcacuu

SEQ ID NO: 536 - RNA, 22 nt, Human
acuuggaacuggccccuuucau

SEQ ID NO: 537 - RNA, 22 nt, Human
caggaaaaggcggcucggggcu

SEQ ID NO: 538 - RNA, 22 nt, Human
ucgcccaggcuggagugcagug

SEQ ID NO: 539 - RNA, 22 nt, Human
guggcccaucacguuucgccuu

SEQ ID NO: 540 - RNA, 22 nt, Human
caagugauccucccaucuuggc

SEQ ID NO: 541 - RNA, 22 nt, Human
gagagguggagguugcagugag

SEQ ID NO: 542 - RNA, 22 nt, Human
uuucccagccucagcucagcag

SEQ ID NO: 543 - RNA, 22 nt, Human
gugcggccuggccuucaagugg

SEQ ID NO: 544 - RNA, 22 nt, Human
cacugcacuccagccuggguca

SEQ ID NO: 545 - RNA, 22 nt, Human
accuccuggccucaagcaaucc

SEQ ID NO: 546 - RNA, 22 nt, Human
ugggaggccaaggcaggcggau

SEQ ID NO: 547 - RNA, 22 nt, Human
uguccuucuugucuugcccaaa

SEQ ID NO: 548 - RNA, 22 nt, Human
cccgggagguggagguugcagu

SEQ ID NO: 549 - RNA, 22 nt, Human
gccacugagcccggccauuguu

SEQ ID NO: 550 - RNA, 22 nt, Human
gucucggacuccugaucucagg

SEQ ID NO: 551 - RNA, 22 nt, Human
caggaggauugcuugaggccag

SEQ ID NO: 552 - RNA, 22 nt, Human
aacccgugauccugacuccccu

SEQ ID NO: 553 - RNA, 22 nt, Human
gcuccuggccgggcugcuccug

SEQ ID NO: 554 - RNA, 22 nt, Human
aagggaauguuguggcugguuu

SEQ ID NO: 555 - RNA, 22 nt, Human
accaucuccugugccuccagcu

SEQ ID NO: 556 - RNA, 22 nt, Human
ucugccuagaaacaguguuugc

SEQ ID NO: 557 - RNA, 22 nt, Human
uugguccccuucaaccagcuac

SEQ ID NO: 558 - RNA, 22 nt, Human
gccugcucccaguuggcgccuc

SEQ ID NO: 559 - RNA, 22 nt, Human
cgggcaaggcgagacuaggccc

SEQ ID NO: 560 - RNA, 22 nt, Human
ggggggcgccauggucucuugg

SEQ ID NO: 561 - RNA, 22 nt, Human
augccacugcacuccagccuag

SEQ ID NO: 562 - RNA, 22 nt, Human
ggucugucuucccaaucguggc

SEQ ID NO: 563 - RNA, 22 nt, Human
ggcuguggagcugcagaguugg

SEQ ID NO: 564 - RNA, 22 nt, Human
caggcuggagugcaguggcgcc

SEQ ID NO: 565 - RNA, 22 nt, Human
ggccccucugagcuuacucugu

SEQ ID NO: 566 - RNA, 16 nt, Human
gcgccuccucggccuc

SEQ ID NO: 567 - RNA, 22 nt, Human
caccaggcuggagugcaguggc

SEQ ID NO: 568 - RNA, 22 nt, Human
uggcuaggcuggugucaagcuc

SEQ ID NO: 569 - RNA, 22 nt, Human
gcccagccacagucacuuucau

SEQ ID NO: 570 - RNA, 17 nt, Human
cuucccaccaucuccug

SEQ ID NO: 571 - RNA, 17 nt, Human
gaccucaggugaucugc

SEQ ID NO: 572 - RNA, 22 nt, Human
uucccugggacuggccugcacc

SEQ ID NO: 573 - RNA, 22 nt, Human
auguucauauccccauucugau

SEQ ID NO: 574 - RNA, 16 nt, Human
cauugcacucuagccu

SEQ ID NO: 575 - RNA, 22 nt, Human
ucacugcaaccuccaccuccca

SEQ ID NO: 576 - RNA, 21 nt, Human
gccauuucacacagacauuug

SEQ ID NO: 577 - RNA, 22 nt, Human
guagucccagcuaccccggagg

SEQ ID NO: 578 - RNA, 22 nt, Human
ccugucauauacauaccuccuc

SEQ ID NO: 579 - RNA, 22 nt, Human
ucucucaggcuggagugcagug

SEQ ID NO: 580 - RNA, 22 nt, Human
uagcuaccauuauugagcaccu

SEQ ID NO: 581 - RNA, 22 nt, Human
guuuacuugugccuuggcuuaa

SEQ ID NO: 582 - RNA, 22 nt, Human
agcgccgccccugcugguguug

SEQ ID NO: 583 - RNA, 22 nt, Human
uccagggccaucuccaugaggc

SEQ ID NO: 584 - RNA, 22 nt, Human
ucagucuugaacagcccccugu

SEQ ID NO: 585 - RNA, 22 nt, Human
acugcaaccuccaccuccuggg

SEQ ID NO: 586 - RNA, 22 nt, Human
ugguggaggcgcugcuggccag

SEQ ID NO: 587 - RNA, 23 nt, Human
cugcagccuuugccuccuggguu

SEQ ID NO: 588 - RNA, 22 nt, Human
ggcucacugcaaccucugccuc

SEQ ID NO: 589 - RNA, 22 nt, Human
ugccgaggcuggagugcagugg

SEQ ID NO: 590 - RNA, 22 nt, Human
ccggguugagguucccauagau

SEQ ID NO: 591 - RNA, 22 nt, Human
cugcugcgcuggccgucacggu

SEQ ID NO: 592 - RNA, 22 nt, Human
uccuggucuucagguugcaaaa

SEQ ID NO: 593 - RNA, 22 nt, Human
cacccuccagcucccgggggcu

SEQ ID NO: 594 - RNA, 22 nt, Human
cauugcacuccagccugggcaa

SEQ ID NO: 595 - RNA, 22 nt, Human
ucagggguuggcuuguuguguu

SEQ ID NO: 596 - RNA, 22 nt, Human
agccucugguccuuuuuucccu

SEQ ID NO: 597 - RNA, 22 nt, Human
acugcacuccagccucgggguc

SEQ ID NO: 598 - RNA, 21 nt, Human
gccagccuccauccucccuug

SEQ ID NO: 599 - RNA, 22 nt, Human
gcuccgccacgcccacuccuac

SEQ ID NO: 600 - RNA, 22 nt, Human
ccgcggggucauggcugggccg

SEQ ID NO: 601 - RNA, 22 nt, Human
auggcccucuuaucacagcucc

SEQ ID NO: 602 - RNA, 22 nt, Human
aaccuugugauccacccaccuu

SEQ ID NO: 603 - RNA, 22 nt, Human
caaagggaaaagccaugugggc

SEQ ID NO: 604 - RNA, 22 nt, Human
uccuggcuugucacaucuacgu

SEQ ID NO: 605 - RNA, 22 nt, Human
cauugcacuccugccugggcaa

SEQ ID NO: 606 - RNA, 22 nt, Human
ggccucuuaucuggcuccugca

SEQ ID NO: 607 - RNA, 22 nt, Human
aguggcgugaucucggcucggu

SEQ ID NO: 608 - RNA, 19 nt, Human
uggcuauuccuuggacaca

SEQ ID NO: 609 - RNA, 22 nt, Human
gcuccccaaaagcuccaggaaa

SEQ ID NO: 610 - RNA, 22 nt, Human
ccaggagguugaggcugcagug

SEQ ID NO: 611 - RNA, 21 nt, Human
acagccuccaucuccugggcu

SEQ ID NO: 612 - RNA, 22 nt, Human
ccaggaggcggagguugcagcg

SEQ ID NO: 613 - RNA, 21 nt, Human
ugcccggauaccccuggccuc

SEQ ID NO: 614 - RNA, 22 nt, Human
ugcgacccuagcccccucacuu

SEQ ID NO: 615 - RNA, 22 nt, Human
cuguccuggggaaagccagccc

SEQ ID NO: 616 - RNA, 23 nt, Human
gcagcuccuggaggugagaggcg

SEQ ID NO: 617 - RNA, 22 nt, Human
cacccaggcuggagugcagugg

SEQ ID NO: 618 - RNA, 22 nt, Human
agcccucguuucugcauccugu

SEQ ID NO: 619 - RNA, 22 nt, Human
auugcacuucagccugggugac

SEQ ID NO: 620 - RNA, 22 nt, Human
ucuucuauccucagccccugcc

SEQ ID NO: 621 - RNA, 22 nt, Human
guggcucacaccuguaauccca

SEQ ID NO: 622 - RNA, 22 nt, Human
cacugcaagcuccgccuccugg

SEQ ID NO: 623 - RNA, 22 nt, Human
guggcagaccuucccuucuccu

SEQ ID NO: 624 - RNA, 22 nt, Human
gcucacugcaaccuccaccucc

SEQ ID NO: 625 - RNA, 22 nt, Human
ucuaagagaaaggaaguucaga

SEQ ID NO: 626 - RNA, 22 nt, Human
uuguucuugucuuugccuucac

SEQ ID NO: 627 - RNA, 22 nt, Human
ccaggcuggagugcaguggcac

SEQ ID NO: 628 - RNA, 22 nt, Human
aaagugcuuccuuuuugagggu

SEQ ID NO: 629 - RNA, 22 nt, Human
uccaaaugagcucugccuucca

SEQ ID NO: 630 - RNA, 22 nt, Human
gccuguaaucccagcacuuugu

SEQ ID NO: 631 - RNA, 22 nt, Human
aauguguugaauaaauugugcc

SEQ ID NO: 632 - RNA, 22 nt, Human
ccagcccgaaucccuggccagg

SEQ ID NO: 633 - RNA, 22 nt, Human
cuagauaacuuauuuucaagga

SEQ ID NO: 634 - RNA, 20 nt, Human
gcugcugggccauuuguugg

SEQ ID NO: 635 - RNA, 22 nt, Human
cucauugcccagauccccacag

SEQ ID NO: 636 - RNA, 21 nt, Human
cugugguacagcugggacgga

SEQ ID NO: 637 - RNA, 23 nt, Human
guguugucgcuggguuuugaggg

SEQ ID NO: 638 - RNA, 22 nt, Human
uggaguuggcugcagaugaguc

SEQ ID NO: 639 - RNA, 22 nt, Human
cagucacaagcguaccuaauuu

SEQ ID NO: 640 - RNA, 22 nt, Human
acugcaaagggaagcccuuucu

SEQ ID NO: 641 - RNA, 22 nt, Human
agcgccacugcacuccagccug

SEQ ID NO: 642 - RNA, 22 nt, Human
cacugcacuccagccucgguga

SEQ ID NO: 643 - RNA, 22 nt, Human
gggcuagccucuucccugcucc

SEQ ID NO: 644 - RNA, 22 nt, Human
ugcgccaugugcucucggcccu

SEQ ID NO: 645 - RNA, 22 nt, Human
uuuuggccacauccuuuugagu

SEQ ID NO: 646 - RNA, 22 nt, Human
cggcauccccacuuccuccugc

SEQ ID NO: 647 - RNA, 22 nt, Human
cuggcucucaggcuggucccca

SEQ ID NO: 648 - RNA, 22 nt, Human
ugcaccacugcaccccagucug

SEQ ID NO: 649 - RNA, 22 nt, Human
ugccaguauccuucugagaccc

SEQ ID NO: 650 - RNA, 18 nt, Human
gcaagugucuguccccuu

SEQ ID NO: 651 - RNA, 22 nt, Human
ugacauuuccuagugcuuugug

SEQ ID NO: 652 - RNA, 22 nt, Human
ucacugcacuccagccugggca

SEQ ID NO: 653 - RNA, 22 nt, Human
aagaccagccuauguuuuccau

SEQ ID NO: 654 - RNA, 22 nt, Human
cuuagagauggguuuuacuuag

SEQ ID NO: 655 - RNA, 22 nt, Human
aaagugcugggauuacaggcau

SEQ ID NO: 656 - RNA, 22 nt, Human
cuggccccuuucauucuggaag

SEQ ID NO: 657 - RNA, 19 nt, Human
gccucauuuccaccucccc

SEQ ID NO: 658 - RNA, 22 nt, Human
uucccugccauaccugaaggca

SEQ ID NO: 659 - RNA, 22 nt, Human
gguuuuauccuacccacacagc

SEQ ID NO: 660 - RNA, 22 nt, Human
ugcgccuggggcccuggcuguc

SEQ ID NO: 661 - RNA, 22 nt, Human
cacugcacuccauccugggaaa

SEQ ID NO: 662 - RNA, 22 nt, Human
caguucccuccgccagcacuuc

SEQ ID NO: 663 - RNA, 20 nt, Human
ccagaccauuuugccuuacc

SEQ ID NO: 664 - RNA, 22 nt, Human
uacaaccucugccucccaaguu

SEQ ID NO: 665 - RNA, 22 nt, Human
cgccauguccagcgucuucggg

SEQ ID NO: 666 - RNA, 22 nt, Human
ugccuccaacagcccauccuag

SEQ ID NO: 667 - RNA, 22 nt, Human
ucaccaggcuagagugcagugg

SEQ ID NO: 668 - RNA, 22 nt, Human
cccacugcugcgccgggcgccg

SEQ ID NO: 669 - RNA, 22 nt, Human
gcaggcucuggcuuauucuggg

SEQ ID NO: 670 - RNA, 22 nt, Human
gcgccgccauccgcauccucgu

SEQ ID NO: 671 - RNA, 22 nt, Human
ucacaucuaauuccauuucugc

SEQ ID NO: 672 - RNA, 22 nt, Human
gugacacccgcaugccacugug

SEQ ID NO: 673 - RNA, 22 nt, Human
ugcagccucuuguuucagcccc

SEQ ID NO: 674 - RNA, 22 nt, Human
ggcccagugcaagcucuuucug

SEQ ID NO: 675 - RNA, 22 nt, Human
aggcuggagugcagugguguga

SEQ ID NO: 676 - RNA, 22 nt, Human
gcucacugcaagcucugccucc

SEQ ID NO: 677 - RNA, 22 nt, Human
caaauuccauucaugcucccuu

SEQ ID NO: 678 - RNA, 19 nt, Human
gccaucccaagcauuuugg

SEQ ID NO: 679 - RNA, 22 nt, Human
gacaagcucccgguggcccucc

SEQ ID NO: 680 - RNA, 22 nt, Human
agcuaccugauccuucuucuga

SEQ ID NO: 681 - RNA, 22 nt, Human
ggguaaaucucuuuucauggcu

SEQ ID NO: 682 - RNA, 22 nt, Human
cuguccuuccagccgaaaucua

SEQ ID NO: 683 - RNA, 22 nt, Human
gcauggcuucggggugcugccu

SEQ ID NO: 684 - RNA, 19 nt, Human
uaggacccugguggccccc

SEQ ID NO: 685 - RNA, 22 nt, Human
aaaagggacgacaacaggccac

SEQ ID NO: 686 - RNA, 22 nt, Human
cccagcucuucaagucaccccc

SEQ ID NO: 687 - RNA, 22 nt, Human
acugcacuccagccugggacac

SEQ ID NO: 688 - RNA, 22 nt, Human
agcuggcuuacuugagaugcau

SEQ ID NO: 689 - RNA, 22 nt, Human
gaccuugugaucccccugccuu

SEQ ID NO: 690 - RNA, 22 nt, Human
ccgccuggcccauugcagggca

SEQ ID NO: 691 - RNA, 22 nt, Human
ugaacuccugaccucaugaucc

SEQ ID NO: 692 - RNA, 22 nt, Human
gaccauccuggccaacguggua

SEQ ID NO: 693 - RNA, 22 nt, Human
cccaggcuuuucucuugcccca

SEQ ID NO: 694 - RNA, 22 nt, Human
uucuucagccuaccuugaccuc

SEQ ID NO: 695 - RNA, 22 nt, Human
cugcggggccuggacagggagg

SEQ ID NO: 696 - RNA, 22 nt, Human
ggcuguguggccgugggcucua

SEQ ID NO: 697 - RNA, 22 nt, Human
gggccaccccacugcccacgcu

SEQ ID NO: 698 - RNA, 22 nt, Human
ccccacuguuuucuucauccua

SEQ ID NO: 699 - RNA, 22 nt, Human
ggagugcaguggcgugagcucg

SEQ ID NO: 700 - RNA, 22 nt, Human
uaggaggauugcuuguggccag

SEQ ID NO: 701 - RNA, 22 nt, Human
cugagggcagguggugcugcca

SEQ ID NO: 702 - RNA, 22 nt, Human
gcaccaccaccaucggcaccuc

SEQ ID NO: 703 - RNA, 22 nt, Human
cuuguuuaucucuguagcccug

SEQ ID NO: 704 - RNA, 22 nt, Human
guggguucguggucucgcuggc

SEQ ID NO: 705 - RNA, 22 nt, Human
aaagcccuggccagacaccagu

SEQ ID NO: 706 - RNA, 22 nt, Human
aucggcaagccccacaccgucc

SEQ ID NO: 707 - RNA, 21 nt, Human
agccucagguuguugguucuu

SEQ ID NO: 708 - RNA, 22 nt, Human
cggugggugcuucaggcggugg

SEQ ID NO: 709 - RNA, 23 nt, Human
aauggucuuccuccaccccucug

SEQ ID NO: 710 - RNA, 22 nt, Human
ucacugcaagcucugccuuccg

SEQ ID NO: 711 - RNA, 22 nt, Human
uggucuuugucccuccuugauc

SEQ ID NO: 712 - RNA, 22 nt, Human
agugcaauggcgugaucuuggc

SEQ ID NO: 713 - RNA, 22 nt, Human
augccacugcgcuccagccugg

SEQ ID NO: 714 - RNA, 22 nt, Human
uuucuuccugcuuugucccaug

SEQ ID NO: 715 - RNA, 22 nt, Human
cucucgccagcggggcugcgcu

SEQ ID NO: 716 - RNA, 22 nt, Human
uauguuuggccuggcaauuuca

SEQ ID NO: 717 - RNA, 22 nt, Human
ccaccagcugcauaugcacgua

SEQ ID NO: 718 - RNA, 22 nt, Human
guguccccacccaaaucucauc

SEQ ID NO: 719 - RNA, 22 nt, Human
ggaaaggccuggguguccuggg

SEQ ID NO: 720 - RNA, 22 nt, Human
gggcggaucauuugaggucagg

SEQ ID NO: 721 - RNA, 22 nt, Human
acuguacuccagccucggugac

SEQ ID NO: 722 - RNA, 22 nt, Human
gauaauccacucugcugacuuu

SEQ ID NO: 723 - RNA, 22 nt, Human
gccuguaaucccagcacuuugg

SEQ ID NO: 724 - RNA, 22 nt, Human
uuuaaaucacaacucugccccu

SEQ ID NO: 725 - RNA, 22 nt, Human
gaugaguuugccuggccugcag

SEQ ID NO: 726 - RNA, 22 nt, Human
ugccaccccggaccccgaagug

SEQ ID NO: 727 - RNA, 22 nt, Human
cacugcaaccuccgccuccugg

SEQ ID NO: 728 - RNA, 22 nt, Human
cacugcaagcaagcuccgccuc

SEQ ID NO: 729 - RNA, 22 nt, Human
ggcucauaucccggccaucauu

SEQ ID NO: 730 - RNA, 22 nt, Human
auucugugcuaacugcaggcca

SEQ ID NO: 731 - RNA, 22 nt, Human
caggcuggaguucaguggugug

SEQ ID NO: 732 - RNA, 22 nt, Human
cauuccuggcccgggcgccguc

SEQ ID NO: 733 - RNA, 22 nt, Human
cagguucaagcgauucuccugc

SEQ ID NO: 734 - RNA, 22 nt, Human
gccuggccgggucuuggauuuu

SEQ ID NO: 735 - RNA, 22 nt, Human
gguucucagccugagccgcccc

SEQ ID NO: 736 - RNA, 22 nt, Human
cgcgagguggagguugcaguga

SEQ ID NO: 737 - RNA, 22 nt, Human
ucacugcacuucagcuugggca

SEQ ID NO: 738 - RNA, 22 nt, Human
aagugcugggauuacaggcgug

SEQ ID NO: 739 - RNA, 22 nt, Human
augugagugcuaugauagacag

SEQ ID NO: 740 - RNA, 22 nt, Human
aucacccaggcuggagugcagu

SEQ ID NO: 741 - RNA, 22 nt, Human
uaucgagcuggacgggcugguc

SEQ ID NO: 742 - RNA, 22 nt, Human
gcuguuuucccauagcugguca

SEQ ID NO: 743 - RNA, 22 nt, Human
ggagugcaauggcuugaucuug

SEQ ID NO: 744 - RNA, 22 nt, Human
aggaucuugcuauguuggccag

SEQ ID NO: 745 - RNA, 18 nt, Human
cuuuuccccuuuggacuc

SEQ ID NO: 746 - RNA, 22 nt, Human
cugaggcuggagugcaguggug

SEQ ID NO: 747 - RNA, 22 nt, Human
gccaugacucuccauaccaaag

SEQ ID NO: 748 - RNA, 22 nt, Human
ccugcuggcucuguugcucggc

SEQ ID NO: 749 - RNA, 22 nt, Human
cccugccuugucugggcuaggu

SEQ ID NO: 750 - RNA, 22 nt, Human
ggcccagguuggagugcaguga

SEQ ID NO: 751 - RNA, 22 nt, Human
ugcucuguuggcuucuuuuguc

SEQ ID NO: 752 - RNA, 22 nt, Human
agugauucuccugccucagccu

SEQ ID NO: 753 - RNA, 22 nt, Human
aguuggcacugagcugugauug

SEQ ID NO: 754 - RNA, 22 nt, Human
aagguggguggaucacgagguc

SEQ ID NO: 755 - RNA, 22 nt, Human
gaaucccuugcauuaucccuuu

SEQ ID NO: 756 - RNA, 22 nt, Human
uccccaagcaggcaaucucccg

SEQ ID NO: 757 - RNA, 22 nt, Human
ugcccacugcuggccaccaccc

SEQ ID NO: 758 - RNA, 22 nt, Human
gcccugcccucucggcacucgc

SEQ ID NO: 759 - RNA, 22 nt, Human
aaagugcuaggauuacaggugu

SEQ ID NO: 760 - RNA, 22 nt, Human
gggcggaucaccugaggucagg

SEQ ID NO: 761 - RNA, 22 nt, Human
cugugcucuuuccacggcccca

SEQ ID NO: 762 - RNA, 22 nt, Human
cuccccagcccugguauucuga

SEQ ID NO: 763 - RNA, 22 nt, Human
cauugcacuccagccuggguaa

SEQ ID NO: 764 - RNA, 22 nt, Human
gcgcugcgccuccucuuccgca

SEQ ID NO: 765 - RNA, 22 nt, Human
agugcugggcuaucuacugcua

SEQ ID NO: 766 - RNA, 22 nt, Human
ugugacugguugucccgcuuuc

SEQ ID NO: 767 - RNA, 22 nt, Human
cucauugcaaccuccgccuccc

SEQ ID NO: 768 - RNA, 22 nt, Human
gccauugcacuccagccuaggc

SEQ ID NO: 769 - RNA, 22 nt, Human
uuccacauguuagcugguuaaa

SEQ ID NO: 770 - RNA, 22 nt, Human
gacuguggggaagcagaugcca

SEQ ID NO: 771 - RNA, 19 nt, Human
uguccguggccuucuggau

SEQ ID NO: 772 - RNA, 22 nt, Human
acugcauuccagccugggcaac

SEQ ID NO: 773 - RNA, 22 nt, Human
uccauuggccuuuuauccuaga

SEQ ID NO: 774 - RNA, 22 nt, Human
cacugcaagcuccgccucuggg

SEQ ID NO: 775 - RNA, 22 nt, Human
cuugggaggcagagguugcagu

SEQ ID NO: 776 - RNA, 22 nt, Human
uccacaaggcagcuccuccagg

SEQ ID NO: 777 - RNA, 22 nt, Human
gcucccaccgccgcuaugggua

SEQ ID NO: 778 - RNA, 22 nt, Human
cucgcaugcccugccucaucca

SEQ ID NO: 779 - RNA, 22 nt, Human
ggccggggccugcucgccugug

SEQ ID NO: 780 - RNA, 22 nt, Human
ggucaggagcccuuggcccccu

SEQ ID NO: 781 - RNA, 19 nt, Human
uggucuggcccacaugguc

SEQ ID NO: 782 - RNA, 22 nt, Human
gguucagagccugcccaguaua

SEQ ID NO: 783 - RNA, 22 nt, Human
cauuggccuuuuauccuagagg

SEQ ID NO: 784 - RNA, 22 nt, Human
uccucagcuuggccacggaguu

SEQ ID NO: 785 - RNA, 22 nt, Human
auguuggccaggcuggucuuga

SEQ ID NO: 786 - RNA, 22 nt, Human
guccacagcucugaggucuccc

SEQ ID NO: 787 - RNA, 21 nt, Human
gccuaguggauuugaagggcc

SEQ ID NO: 788 - RNA, 22 nt, Human
ucagcuccuaccccggccccag

SEQ ID NO: 789 - RNA, 22 nt, Human
agagucucccuguguugcccug

SEQ ID NO: 790 - RNA, 22 nt, Human
guguaagaaccuucuagagccc

SEQ ID NO: 791 - RNA, 22 nt, Human
acuguaaccucaaacuccuggg

SEQ ID NO: 792 - RNA, 22 nt, Human
guggccaaccuggcccugaacu

SEQ ID NO: 793 - RNA, 22 nt, Human
uauuugucuggucuaaggaggg

SEQ ID NO: 794 - RNA, 22 nt, Human
ggagugcaguggcgugaucuca

SEQ ID NO: 795 - RNA, 22 nt, Human
uccuccagagcuucauccugcc

SEQ ID NO: 796 - RNA, 22 nt, Human
ugaggcccaccuuggccccggc

SEQ ID NO: 797 - RNA, 22 nt, Human
augauggcuaggcugguuuuga

SEQ ID NO: 798 - RNA, 22 nt, Human
cgccccggacgucugaccaaac

SEQ ID NO: 799 - RNA, 22 nt, Human
ggccgcccuuuccacgguuucu

SEQ ID NO: 800 - RNA, 18 nt, Human
aggcuuacagcagcaggc

SEQ ID NO: 801 - RNA, 22 nt, Human
ggcuuccugccucgggcuggcc

SEQ ID NO: 802 - RNA, 21 nt, Human
gauggguuuguuggagagguc

SEQ ID NO: 803 - RNA, 22 nt, Human
ucacugcaaccuccaccucccg

SEQ ID NO: 804 - RNA, 22 nt, Human
gaauguguacugagugccccuu

SEQ ID NO: 805 - RNA, 21 nt, Human
uccacugucccuggcacuuuu

SEQ ID NO: 806 - RNA, 22 nt, Human
gcaccacuacacuccagccugg

SEQ ID NO: 807 - RNA, 22 nt, Human
augguagcuguccacaucagga

SEQ ID NO: 808 - RNA, 22 nt, Human
cugaggcaggcagaucacuuga

SEQ ID NO: 809 - RNA, 22 nt, Human
guggcccagguuggagugcagu

SEQ ID NO: 810 - RNA, 22 nt, Human
gaccuugugaucugcccaccuu

SEQ ID NO: 811 - RNA, 22 nt, Human
gugaucugccagccucagccuc

SEQ ID NO: 812 - RNA, 22 nt, Human
agacagggugaucgcuugagcc

SEQ ID NO: 813 - RNA, 22 nt, Human
cccaggaggucaaggcugcagu

SEQ ID NO: 814 - RNA, 22 nt, Human
cggucucccgugugugugcgcu

SEQ ID NO: 815 - RNA, 22 nt, Human
agcgggguguuuuggguggccu

SEQ ID NO: 816 - RNA, 22 nt, Human
gucuccucccuuucauucaccu

SEQ ID NO: 817 - RNA, 22 nt, Human
ccugcucucuguucuuaagcuu

SEQ ID NO: 818 - RNA, 22 nt, Human
caaguggaaugcucuuccuccc

SEQ ID NO: 819 - RNA, 22 nt, Human
aaggccgccccuucaugcuccu

SEQ ID NO: 820 - RNA, 22 nt, Human
uguccucauccuccagucuguc

SEQ ID NO: 821 - RNA, 18 nt, Human
uggcgauggucauuuuuc

SEQ ID NO: 822 - RNA, 22 nt, Human
uugggggaggccugcugcccau

SEQ ID NO: 823 - RNA, 22 nt, Human
gcggggcccggacccagccucu

SEQ ID NO: 824 - RNA, 22 nt, Human
ugggguauccguuaguaagaug

SEQ ID NO: 825 - RNA, 22 nt, Human
uggaguuggccgcccggaccga

SEQ ID NO: 826 - RNA, 22 nt, Human
aguguguuguaggcucaaaugg

SEQ ID NO: 827 - RNA, 22 nt, Human
cgcuuccagaguaaggcgcugc

SEQ ID NO: 828 - RNA, 22 nt, Human
gauaucauugagcccaggaguu

SEQ ID NO: 829 - RNA, 22 nt, Human
cacugcacuccagcuuggguga

SEQ ID NO: 830 - RNA, 16 nt, Human
cugaagcccagcuucc

SEQ ID NO: 831 - RNA, 22 nt, Human
caucucuggcuuggauuauggu

SEQ ID NO: 832 - RNA, 22 nt, Human
uuuaccuuugugggucucccuc

SEQ ID NO: 833 - RNA, 21 nt, Human
cuagccccuacuccaaguuga

SEQ ID NO: 834 - RNA, 22 nt, Human
gcuggcaaggugcuggagggcc

SEQ ID NO: 835 - RNA, 22 nt, Human
uuccaaaggcugcaccuugccc

SEQ ID NO: 836 - RNA, 22 nt, Human
gaagggggaagagagcuggccg

SEQ ID NO: 837 - RNA, 21 nt, Human
uuguuccuaucugccuccugc

SEQ ID NO: 838 - RNA, 19 nt, Human
uggagcugggucuggggca

SEQ ID NO: 839 - RNA, 22 nt, Human
cacugcacuccagccuggguga

SEQ ID NO: 840 - RNA, 22 nt, Human
cauugcacucuagccuggguga

SEQ ID NO: 841 - RNA, 18 nt, Human
agccugucccuucuccug

SEQ ID NO: 842 - RNA, 22 nt, Human
ucacccaggcuggaguguagug

SEQ ID NO: 843 - RNA, 19 nt, Human
cugcugccggagacucguc

SEQ ID NO: 844 - RNA, 22 nt, Human
aaaaccuaagccaguagcuccc

SEQ ID NO: 845 - RNA, 22 nt, Human
ggcucacugcaaccuccaccuc

SEQ ID NO: 846 - RNA, 22 nt, Human
cuguaaucccagcuacucggga

SEQ ID NO: 847 - RNA, 22 nt, Human
gccaucauauccccugugaccu

SEQ ID NO: 848 - RNA, 22 nt, Human
ccagguuggaguucaguggcgc

SEQ ID NO: 849 - RNA, 22 nt, Human
ugguuaacuucugagcaggcug

SEQ ID NO: 850 - RNA, 22 nt, Human
gcuggcugacagauuuggggug

SEQ ID NO: 851 - RNA, 22 nt, Human
caucccugucgucaagucucug

SEQ ID NO: 852 - RNA, 22 nt, Human
aaagugcugcgacauuugagcg

SEQ ID NO: 853 - RNA, 22 nt, Human
augucaugaggcuagcccccaa

SEQ ID NO: 854 - RNA, 22 nt, Human
aaucacuugaacccaagaagug

SEQ ID NO: 855 - RNA, 23 nt, Human
ugaggcaggcggaucacgagguc

SEQ ID NO: 856 - RNA, 22 nt, Human
aagagguagcagucacaaaaga

SEQ ID NO: 857 - RNA, 22 nt, Human
ccguggucaccugagcuccuug

SEQ ID NO: 858 - RNA, 22 nt, Human
caguuucuuccucccccagaga

SEQ ID NO: 859 - RNA, 22 nt, Human
aucuuuuaucacucccacugcu

SEQ ID NO: 860 - RNA, 22 nt, Human
ucacccaggcuggagugcagug

SEQ ID NO: 861 - RNA, 22 nt, Human
ucucccaggcaggagugcagug

SEQ ID NO: 862 - RNA, 22 nt, Human
ggggcuggucuuuccacuuacu

SEQ ID NO: 863 - RNA, 22 nt, Human
uguaaucccagcuacucgggag

SEQ ID NO: 864 - RNA, 22 nt, Human
cugaucucaagugauccaccca

SEQ ID NO: 865 - RNA, 18 nt, Human
uagguuacagccagccag

SEQ ID NO: 866 - RNA, 22 nt, Human
ccucugugucuccaagaggccu

SEQ ID NO: 867 - RNA, 22 nt, Human
cugccugccuggcccaggaacc

SEQ ID NO: 868 - RNA, 22 nt, Human
acaaagugccucccuuuagagu

SEQ ID NO: 869 - RNA, 22 nt, Human
ggggaaagccagcccugcuucc

SEQ ID NO: 870 - RNA, 22 nt, Human
ggagugcaguggugggaucuca

SEQ ID NO: 871 - RNA, 22 nt, Human
aucgaucccgcguaaggccccg

SEQ ID NO: 872 - RNA, 22 nt, Human
ucugugcuaggcagccuggccc

SEQ ID NO: 873 - RNA, 22 nt, Human
cuguccccacccaaaucucauc

SEQ ID NO: 874 - RNA, 22 nt, Human
gagccgcccuccacgauguccc

SEQ ID NO: 875 - RNA, 22 nt, Human
ggugguggagcgggcccaggcc

SEQ ID NO: 876 - RNA, 22 nt, Human
ucacugcaaccuccaccagccu

SEQ ID NO: 877 - RNA, 22 nt, Human
cuguccugccaguccuggacuc

SEQ ID NO: 878 - RNA, 22 nt, Human
ggcgggcagcgucuugcuggcc

SEQ ID NO: 879 - RNA, 22 nt, Human
uccuggggcuugucgcuggcca

SEQ ID NO: 880 - RNA, 22 nt, Human
cagcuggugcuugccuggcuaa

SEQ ID NO: 881 - RNA, 22 nt, Human
caggcuggcucccugaagguuc

SEQ ID NO: 882 - RNA, 22 nt, Human
agguggccacaagguggcuggc

SEQ ID NO: 883 - RNA, 22 nt, Human
uggagacacaggaccagacugc

SEQ ID NO: 884 - RNA, 22 nt, Human
ggcucuggcuuuggaggagcag

SEQ ID NO: 885 - RNA, 22 nt, Human
cuggcuaagauccaagaaaggc

SEQ ID NO: 886 - RNA, 22 nt, Human
gcuguagugaauggccgcguuc

SEQ ID NO: 887 - RNA, 20 nt, Human
uguuuguguggggccuuggc

SEQ ID NO: 888 - RNA, 22 nt, Human
aucaagagcacagugcuggcau

SEQ ID NO: 889 - RNA, 22 nt, Human
cugggaggcggagguugcagug

SEQ ID NO: 890 - RNA, 22 nt, Human
ucacugcaaccuccgccucccg

SEQ ID NO: 891 - RNA, 22 nt, Human
ucucuauuugccuaggcuugug

SEQ ID NO: 892 - RNA, 22 nt, Human
guggcgugaucucggcucacug

SEQ ID NO: 893 - RNA, 22 nt, Human
ucguuaccauagccuugucccu

SEQ ID NO: 894 - RNA, 22 nt, Human
cccaggaggccugccuggccgg

SEQ ID NO: 895 - RNA, 22 nt, Human
cagcucgggccucccucucccg

SEQ ID NO: 896 - RNA, 22 nt, Human
augagaugaggaauggcccucc

SEQ ID NO: 897 - RNA, 22 nt, Human
aggccgaggcgggcggaucacc

SEQ ID NO: 898 - RNA, 22 nt, Human
acggugcagccugucccuucuc

SEQ ID NO: 899 - RNA, 21 nt, Human
ggagguacuguagcuggcguu

SEQ ID NO: 900 - RNA, 22 nt, Human
cuuuggaacacccagcucugug

SEQ ID NO: 901 - RNA, 22 nt, Human
ugggcgacagagcaagacuccg

SEQ ID NO: 902 - RNA, 22 nt, Human
ugggugacagagcaagacucug

SEQ ID NO: 903 - RNA, 22 nt, Human
uggcuuuaguaauaaguuucuc

SEQ ID NO: 904 - RNA, 22 nt, Human
ugcuagcugcccgaaggucuca

SEQ ID NO: 905 - RNA, 22 nt, Human
gcuucagagaggggugaagcug

SEQ ID NO: 906 - RNA, 22 nt, Human
gcugccuugcccucuucccaua

SEQ ID NO: 907 - RNA, 22 nt, Human
gcuguaagucaccuggcccgau

SEQ ID NO: 908 - RNA, 22 nt, Human
ugcuggcuauccugcgccuuuc

SEQ ID NO: 909 - RNA, 22 nt, Human
ccaggcuggagugcaagcagca

SEQ ID NO: 910 - RNA, 22 nt, Human
gcuagguuggggaaguucuccu

SEQ ID NO: 911 - RNA, 22 nt, Human
ccaaagugcugggauuacaggc

SEQ ID NO: 912 - RNA, 22 nt, Human
gccuggacuguucuaccauuuu

SEQ ID NO: 913 - RNA, 19 nt, Human
gccgggcccggguuggccg

SEQ ID NO: 914 - RNA, 22 nt, Human
cagccucuaugcccccgucacc

SEQ ID NO: 915 - RNA, 22 nt, Human
cuggcuagauguguggccauga

SEQ ID NO: 916 - RNA, 22 nt, Human
acugcacuccauccugggcaac

SEQ ID NO: 917 - RNA, 22 nt, Human
ccuucucagccccagcucccgc

SEQ ID NO: 918 - RNA, 22 nt, Human
gucucccaaacucugauggucc

SEQ ID NO: 919 - RNA, 22 nt, Human
gguccccccauggugagcacug

SEQ ID NO: 920 - RNA, 22 nt, Human
cggguucacgccauucuccugc

SEQ ID NO: 921 - RNA, 22 nt, Human
agcgacaccgccugcaggccau

SEQ ID NO: 922 - RNA, 22 nt, Human
gaacuuggccugucugucuggc

SEQ ID NO: 923 - RNA, 21 nt, Human
ugggucagagggaaaguguau

SEQ ID NO: 924 - RNA, 22 nt, Human
uguugcccagguucucuccugc

SEQ ID NO: 925 - RNA, 22 nt, Human
cauugcacuccagucugggcca

SEQ ID NO: 926 - RNA, 22 nt, Human
ugguucuucgcugggcggcugc

SEQ ID NO: 927 - RNA, 22 nt, Human
caaagugcuaggauuacaggcg

SEQ ID NO: 928 - RNA, 21 nt, Human
ugguagguacuggcuucaggc

SEQ ID NO: 929 - RNA, 21 nt, Human
cacugcacuccagcucugggu

SEQ ID NO: 930 - RNA, 22 nt, Human
gucuugucccagcucugccacu

SEQ ID NO: 931 - RNA, 23 nt, Human
gccugggaguugcgaucugcccg

SEQ ID NO: 932 - RNA, 22 nt, Human
gcagcaucccggccuccacugu

SEQ ID NO: 933 - RNA, 18 nt, Human
ucugccccagccgcacug

SEQ ID NO: 934 - RNA, 22 nt, Human
acccauccagugucccugcuag

SEQ ID NO: 935 - RNA, 22 nt, Human
gccuggccaacauagugggacc

SEQ ID NO: 936 - RNA, 22 nt, Human
cauugcacucuagucuggguga

SEQ ID NO: 937 - RNA, 20 nt, Human
aagacaccaguggcagcccc

SEQ ID NO: 938 - RNA, 22 nt, Human
uccugggcuuuggcuuguuggg

SEQ ID NO: 939 - RNA, 22 nt, Human
ugguagucggccucgguggcuc

SEQ ID NO: 940 - RNA, 22 nt, Human
uacugcgccuucaccaagcggc

SEQ ID NO: 941 - RNA, 22 nt, Human
ucacugcaagcuccgccuuccg

SEQ ID NO: 942 - RNA, 22 nt, Human
agugccuucagauuugccccag

SEQ ID NO: 943 - RNA, 22 nt, Human
acccucuugagggaagcacuuu

SEQ ID NO: 944 - RNA, 22 nt, Human
gccccaagucccuauguuucca

SEQ ID NO: 945 - RNA, 22 nt, Human
aucccccuguaucuggaagaau

SEQ ID NO: 946 - RNA, 22 nt, Human
gugcuuugcuggaaucgaggaa

SEQ ID NO: 947 - RNA, 22 nt, Human
gaggcugagguugcagugagcc

SEQ ID NO: 948 - RNA, 22 nt, Human
uggucgggcugcaucuuccggc

SEQ ID NO: 949 - RNA, 21 nt, Human
accacugccuccaagguucag

SEQ ID NO: 950 - RNA, 22 nt, Human
uuugguccccuucaaccagcua

SEQ ID NO: 951 - RNA, 22 nt, Human
gguaugcugaagccagcucgca

SEQ ID NO: 952 - RNA, 22 nt, Human
uugcuugggcuggagugcaaug

SEQ ID NO: 953 - RNA, 22 nt, Human
uaucuaugugcucugaccucuc

SEQ ID NO: 954 - RNA, 22 nt, Human
aggagaagccaaguugugagca

SEQ ID NO: 955 - RNA, 22 nt, Human
acccauggucugguggggcccu

SEQ ID NO: 956 - RNA, 22 nt, Human
accccgcuccuugcagccucug

SEQ ID NO: 957 - RNA, 22 nt, Human
cacugcaagcuccgccucccgg

SEQ ID NO: 958 - RNA, 22 nt, Human
auucuuggauuuggcucuagug

SEQ ID NO: 959 - RNA, 22 nt, Human
acugcacuccauccagccuggc

SEQ ID NO: 960 - RNA, 22 nt, Human
gcccaggcuggagugcaguggu

SEQ ID NO: 961 - RNA, 22 nt, Human
cugcguucugccuggcggccua

SEQ ID NO: 962 - RNA, 22 nt, Human
ucacugcaagcuccaccucccg

SEQ ID NO: 963 - RNA, 22 nt, Human
cacugccuuggccaccuauccu

SEQ ID NO: 964 - RNA, 22 nt, Human
uccuuuaaacaaccagcucuca

SEQ ID NO: 965 - RNA, 22 nt, Human
ggccucucuugggacagcuguc

SEQ ID NO: 966 - RNA, 22 nt, Human
gaagagugguuaucccugcugu

SEQ ID NO: 967 - RNA, 22 nt, Human
cccugauagccccuaucaucag

SEQ ID NO: 968 - RNA, 22 nt, Human
cacugcaaccucugccuccugg

SEQ ID NO: 969 - RNA, 22 nt, Human
ucauugcaaccuccuccugggu

SEQ ID NO: 970 - RNA, 22 nt, Human
cugcagucuaccuggauuuuua

SEQ ID NO: 971 - RNA, 22 nt, Human
ggacccuagagagagccagccu

SEQ ID NO: 972 - RNA, 22 nt, Human
acccgauguuggugcucuagua

SEQ ID NO: 973 - RNA, 22 nt, Human
cggagguugaggcugcagugag

SEQ ID NO: 974 - RNA, 22 nt, Human
uugcaucuucugguugagcccc

SEQ ID NO: 975 - RNA, 22 nt, Human
gagagagcucugugccugggau

SEQ ID NO: 976 - RNA, 17 nt, Human
ggcccggugacgucacu

SEQ ID NO: 977 - RNA, 22 nt, Human
ucuagcucugcuuaucauggcu

SEQ ID NO: 978 - RNA, 22 nt, Human
cuggcuggagugcaggugagug

SEQ ID NO: 979 - RNA, 22 nt, Human
gauggccucauggcugcaggcc

SEQ ID NO: 980 - RNA, 22 nt, Human
gaggccaaggugggcagaucac

SEQ ID NO: 981 - RNA, 22 nt, Human
guccuuccacauggccaacuuc

SEQ ID NO: 982 - RNA, 22 nt, Human
caggaguuuuaaaucuagcaug

SEQ ID NO: 983 - RNA, 22 nt, Human
ggaggggcucagucuuucuugg

SEQ ID NO: 984 - RNA, 22 nt, Human
aaggcaaggcuuccagcucccc

SEQ ID NO: 985 - RNA, 22 nt, Human
ucacugcaaccuccaccacgug

SEQ ID NO: 986 - RNA, 22 nt, Human
caccgaggcuggagugcagugg

SEQ ID NO: 987 - RNA, 22 nt, Human
ccacaguccuggcuucugucug

SEQ ID NO: 988 - RNA, 22 nt, Human
gcccgcuggcugggcuccagcu

SEQ ID NO: 989 - RNA, 22 nt, Human
acugcacuucagccugggugac

SEQ ID NO: 990 - RNA, 22 nt, Human
cuucccaccaaagcccuuguug

SEQ ID NO: 991 - RNA, 22 nt, Human
aagugcugggauuauaggcaug

SEQ ID NO: 992 - RNA, 22 nt, Human
ucgugaucuguccaccucggcc

SEQ ID NO: 993 - RNA, 22 nt, Human
gcggcaggaguaaaggaggaag

SEQ ID NO: 994 - RNA, 22 nt, Human
ggcucacugcaagcuccgccuc

SEQ ID NO: 995 - RNA, 22 nt, Human
gugcccagcagcagcguccccg

SEQ ID NO: 996 - RNA, 22 nt, Human
acuguacuccagcucuggguga

SEQ ID NO: 997 - RNA, 22 nt, Human
ggaggcggaaguugcagugagc

SEQ ID NO: 998 - RNA, 22 nt, Human
ugguuguuagggaagauucauc

SEQ ID NO: 999 - RNA, 20 nt, Human
accuccuggcgggcauccuc

SEQ ID NO: 1000 - RNA, 22 nt, Human
uagcugaauugugggagaccua

SEQ ID NO: 1001 - RNA, 22 nt, Human
uccugccguccuccggggccuc

SEQ ID NO: 1002 - RNA, 19 nt, Human
ugguugugcacggguuggu

SEQ ID NO: 1003 - RNA, 22 nt, Human
uguccaggcuggagugcagugg

SEQ ID NO: 1004 - RNA, 22 nt, Human
aaagauguugcugcuccgcccu

SEQ ID NO: 1005 - RNA, 22 nt, Human
ugggaggccgaggcagguggau

SEQ ID NO: 1006 - RNA, 22 nt, Human
ucacugcaaccuccaccuuccg

SEQ ID NO: 1007 - RNA, 22 nt, Human
cuccugaauugucccucacagc

SEQ ID NO: 1008 - RNA, 22 nt, Human
caaagugcugggauuacaggug

SEQ ID NO: 1009 - RNA, 19 nt, Human
cauggugaaaccccgucuc

SEQ ID NO: 1010 - RNA, 22 nt, Human
cauccaggcuggaguacagugg

SEQ ID NO: 1011 - RNA, 22 nt, Human
uuggccaucuaagcccagccac

SEQ ID NO: 1012 - RNA, 21 nt, Human
ggccgccgccuugugcucugc

SEQ ID NO: 1013 - RNA, 22 nt, Human
cccucuggccccugugguggau

SEQ ID NO: 1014 - RNA, 22 nt, Human
uaacagaugucauuucggcggc

SEQ ID NO: 1015 - RNA, 22 nt, Human
ucucuuugccugcugccaucca

SEQ ID NO: 1016 - RNA, 22 nt, Human
gcucuaguaggaaugucccucu

SEQ ID NO: 1017 - RNA, 22 nt, Human
agcucaaugcaaccuccgccuc

SEQ ID NO: 1018 - RNA, 21 nt, Human
ccugguucaagugaugccccu

SEQ ID NO: 1019 - RNA, 22 nt, Human
caccuguacagggccgggcugg

SEQ ID NO: 1020 - RNA, 22 nt, Human
cugcagccuccacuuucugggc

SEQ ID NO: 1021 - RNA, 22 nt, Human
gcccccgaggaggugaugucgc

SEQ ID NO: 1022 - RNA, 22 nt, Human
gagguuggggcugcagugagcu

SEQ ID NO: 1023 - RNA, 22 nt, Human
acugcacuccagccugggcggc

SEQ ID NO: 1024 - RNA, 22 nt, Human
cucugugguggagugggucacc

SEQ ID NO: 1025 - RNA, 22 nt, Human
gaccuugugauccgcccacuuu

SEQ ID NO: 1026 - RNA, 22 nt, Human
ggggcuucuagggugccagauc

SEQ ID NO: 1027 - RNA, 22 nt, Human
uugcugaccuuugcucuccguu

SEQ ID NO: 1028 - RNA, 22 nt, Human
aagugcugggauuacaggugug

SEQ ID NO: 1029 - RNA, 22 nt, Human
cagcagagaaauuacauauuug

SEQ ID NO: 1030 - RNA, 22 nt, Human
uggcuuucucacagaccaccuc

SEQ ID NO: 1031 - RNA, 22 nt, Human
aauaaacaaaggacaaggaggu

SEQ ID NO: 1032 - RNA, 22 nt, Human
gcucacagccucccccggccug

SEQ ID NO: 1033 - RNA, 22 nt, Human
gugguucacuugaggucaggag

SEQ ID NO: 1034 - RNA, 21 nt, Human
cccaaaaguucugagauggcu

SEQ ID NO: 1035 - RNA, 17 nt, Human
cuggaggagcugccaug

SEQ ID NO: 1036 - RNA, 22 nt, Human
ugucuauucccccaccuccguu

SEQ ID NO: 1037 - RNA, 22 nt, Human
ggccuggcagagcgcgcggcug

SEQ ID NO: 1038 - RNA, 22 nt, Human
ccaggcuggagugcaauggcgu

SEQ ID NO: 1039 - RNA, 22 nt, Human
cgcccaggcuggagugcagugg

SEQ ID NO: 1040 - RNA, 22 nt, Human
uggcuccucacguccucagagc

SEQ ID NO: 1041 - RNA, 22 nt, Human
uccuccaguuccuugguuucag

SEQ ID NO: 1042 - RNA, 22 nt, Human
ugguggaauuguaaaauagugu

SEQ ID NO: 1043 - RNA, 22 nt, Human
cgaccuugugauccucccgccu

SEQ ID NO: 1044 - RNA, 22 nt, Human
uagcuccucccagaucucaucu

SEQ ID NO: 1045 - RNA, 22 nt, Human
ccacgcaucccuccacagagag

SEQ ID NO: 1046 - RNA, 22 nt, Human
acccaggcuggagugcaguggg

SEQ ID NO: 1047 - RNA, 22 nt, Human
gcaccgccuuggaccgcccgcu

SEQ ID NO: 1048 - RNA, 22 nt, Human
caacaugguaaaaccccgucuc

SEQ ID NO: 1049 - RNA, 22 nt, Human
ggcugggccucucccucagcug

SEQ ID NO: 1050 - RNA, 22 nt, Human
uuuucucuucccucuggaccug

SEQ ID NO: 1051 - RNA, 22 nt, Human
aggcccccuccacccauucugg

SEQ ID NO: 1052 - RNA, 18 nt, Human
aguuuguguaagaaaagc

SEQ ID NO: 1053 - RNA, 22 nt, Human
ucagggcugcacuggcuggucu

SEQ ID NO: 1054 - RNA, 22 nt, Human
cccucgugcauccaucauuuag

SEQ ID NO: 1055 - RNA, 22 nt, Human
cacugcacuccagccuggccug

SEQ ID NO: 1056 - RNA, 22 nt, Human
uucacugcucuagcccuaauuu

SEQ ID NO: 1057 - RNA, 22 nt, Human
aagacaccagagacuggccuca

SEQ ID NO: 1058 - RNA, 22 nt, Human
cagagcugguguguccuggcau

SEQ ID NO: 1059 - RNA, 22 nt, Human
uauuggccgggcgcgguggcuc

SEQ ID NO: 1060 - RNA, 22 nt, Human
aggucucuugcugucucugggc

SEQ ID NO: 1061 - RNA, 22 nt, Human
uagcccaggcuggagugcaggg

SEQ ID NO: 1062 - RNA, 22 nt, Human
cacugcacuucagccuggguga

SEQ ID NO: 1063 - RNA, 22 nt, Human
aguguuggcucggcuggcugcc

SEQ ID NO: 1064 - RNA, 22 nt, Human
cucugcugugccgccagggccu

SEQ ID NO: 1065 - RNA, 21 nt, Human
ugcaauccagccugggcgaca

SEQ ID NO: 1066 - RNA, 22 nt, Human
agugauccacccgccucaaccu

SEQ ID NO: 1067 - RNA, 22 nt, Human
ugccguggggcugaggcuggag

SEQ ID NO: 1068 - RNA, 22 nt, Human
uuuagauugugaccucccccca

SEQ ID NO: 1069 - RNA, 22 nt, Human
ggaggcuggccuucagacgggu

SEQ ID NO: 1070 - RNA, 22 nt, Human
ccugccagagcagcuuguccuc

SEQ ID NO: 1071 - RNA, 22 nt, Human
uggccucggcauccagcaagag

SEQ ID NO: 1072 - RNA, 22 nt, Human
ccacgggcagaugugguugguu

SEQ ID NO: 1073 - RNA, 22 nt, Human
acuguacuccagccugggggac

SEQ ID NO: 1074 - RNA, 22 nt, Human
cccucuuggcuucuaucccacc

SEQ ID NO: 1075 - RNA, 19 nt, Human
gcccacggcccugcucugc

SEQ ID NO: 1076 - RNA, 22 nt, Human
ggcugcugguuucuuguuuuag

SEQ ID NO: 1077 - RNA, 21 nt, Human
ggagccucuggcagggggcca

SEQ ID NO: 1078 - RNA, 22 nt, Human
uccuggccauccagccugggga

SEQ ID NO: 1079 - RNA, 22 nt, Human
ucuugccacuucauccccuuuc

SEQ ID NO: 1080 - RNA, 22 nt, Human
gcgucucauccucccgcuaauu

SEQ ID NO: 1081 - RNA, 22 nt, Human
ccuucccacauuccuuacaugc

SEQ ID NO: 1082 - RNA, 22 nt, Human
cgcgcucuccuucuggcaccca

SEQ ID NO: 1083 - RNA, 22 nt, Human
gaggcgggcagaucaccugagg

SEQ ID NO: 1084 - RNA, 22 nt, Human
gggaguugugguuggcuucugg

SEQ ID NO: 1085 - RNA, 22 nt, Human
uggggccaucucacccacuguu

SEQ ID NO: 1086 - RNA, 22 nt, Human
gcuaggcugcuggccacugagg

SEQ ID NO: 1087 - RNA, 22 nt, Human
ugccgcccggccaucucggcuc

SEQ ID NO: 1088 - RNA, 22 nt, Human
agcuggaauuacaggagcccau

SEQ ID NO: 1089 - RNA, 22 nt, Human
gggaacagcuugggcucugcca

SEQ ID NO: 1090 - RNA, 22 nt, Human
cccuggcucacuuucuguugug

SEQ ID NO: 1091 - RNA, 22 nt, Human
ucacugcaagcuccgccucccg

SEQ ID NO: 1092 - RNA, 22 nt, Human
cuggacugagcuccuugaggcc

SEQ ID NO: 1093 - RNA, 22 nt, Human
cuggguugggguuacaugacug

SEQ ID NO: 1094 - RNA, 22 nt, Human
cugguguugggucuugcuuuua

SEQ ID NO: 1095 - RNA, 22 nt, Human
acaggcgauccacccgccucag

SEQ ID NO: 1096 - RNA, 22 nt, Human
ucaggcaccuuccucuuaucug

SEQ ID NO: 1097 - RNA, 23 nt, Human
cggguucacgccauucuccugcc

SEQ ID NO: 1098 - RNA, 22 nt, Human
aaagugcuucucuuuggugggu

SEQ ID NO: 1099 - RNA, 22 nt, Human
ggcucccugcaaccuccgccuc

SEQ ID NO: 1100 - RNA, 22 nt, Human
aguuguucgugguggauucgcu

SEQ ID NO: 1101 - RNA, 22 nt, Human
gcucacugcaaccucugccucc

SEQ ID NO: 1102 - RNA, 22 nt, Human
cuccuccacccgcuggggccca

SEQ ID NO: 1103 - RNA, 22 nt, Human
uuauugcacuccagccugggua

SEQ ID NO: 1104 - RNA, 22 nt, Human
acuguacuccagccugggagac

SEQ ID NO: 1105 - RNA, 22 nt, Human
acaacuccuucuuggguccugg

SEQ ID NO: 1106 - RNA, 22 nt, Human
ccaggaguuggaggcugcagug

SEQ ID NO: 1107 - RNA, 22 nt, Human
aagucucucacauaucuggucc

SEQ ID NO: 1108 - RNA, 22 nt, Human
gaauuuuauuacuagucaacug

SEQ ID NO: 1109 - RNA, 23 nt, Human
ggcugcuggucuuucauaguggg

SEQ ID NO: 1110 - RNA, 22 nt, Human
cacugcaaucuccaucuccugg

SEQ ID NO: 1111 - RNA, 22 nt, Human
ccggagugucuggccugcuggg

SEQ ID NO: 1112 - RNA, 22 nt, Human
uccccuggugccacgaucugcu

SEQ ID NO: 1113 - RNA, 22 nt, Human
ucuugggcagcuugcucgcccc

SEQ ID NO: 1114 - RNA, 21 nt, Human
uuucuugggccgugugcuggu

SEQ ID NO: 1115 - RNA, 22 nt, Human
ggcucugcuugaggccagccug

SEQ ID NO: 1116 - RNA, 22 nt, Human
uggguccuggcugaagaucucu

SEQ ID NO: 1117 - RNA, 22 nt, Human
gcgggcggcuucaucuugcccu

SEQ ID NO: 1118 - RNA, 22 nt, Human
gcagcuauugucuccugggccc

SEQ ID NO: 1119 - RNA, 19 nt, Human
gccuucccaccacccgucc

SEQ ID NO: 1120 - RNA, 22 nt, Human
gaccucgugauccgcccgcuuu

SEQ ID NO: 1121 - RNA, 22 nt, Human
cacugcacuccagcugggugac

SEQ ID NO: 1122 - RNA, 22 nt, Human
cgucccggguucacgccauucu

SEQ ID NO: 1123 - RNA, 22 nt, Human
cucuggagugucuggccagggu

SEQ ID NO: 1124 - RNA, 22 nt, Human
gccuguauucccagcacuuugg

SEQ ID NO: 1125 - RNA, 22 nt, Human
ggcggucucagcacccucuugg

SEQ ID NO: 1126 - RNA, 22 nt, Human
ugcccaggcuggaguacagugg

SEQ ID NO: 1127 - RNA, 22 nt, Human
aucagaguaguuguugcccaga

SEQ ID NO: 1128 - RNA, 22 nt, Human
cagcagcacacugugguuugua

SEQ ID NO: 1129 - RNA, 22 nt, Human
gccuggccuccuacaguacuuu

SEQ ID NO: 1130 - RNA, 22 nt, Human
acugcacuucagccuggguguc

SEQ ID NO: 1131 - RNA, 22 nt, Human
gaccucgugauccgcccuccuu

SEQ ID NO: 1132 - RNA, 22 nt, Human
caguuuguccccauggccaugu

SEQ ID NO: 1133 - RNA, 20 nt, Human
gggcagagccagccaguccc

SEQ ID NO: 1134 - RNA, 22 nt, Human
gcucaugacuguaaucccagca

SEQ ID NO: 1135 - RNA, 22 nt, Human
gcugcucuccaagccuccuuga

SEQ ID NO: 1136 - RNA, 22 nt, Human
acugcacuccaaccugggcaau

SEQ ID NO: 1137 - RNA, 22 nt, Human
ggcgugcccuggccccgaggcu

SEQ ID NO: 1138 - RNA, 22 nt, Human
aaaugcaacgggcuuuccuuau

SEQ ID NO: 1139 - RNA, 22 nt, Human
cccuggagguugaggcugcagu

SEQ ID NO: 1140 - RNA, 22 nt, Human
gcccaggaggagaggcugcagu

SEQ ID NO: 1141 - RNA, 18 nt, Human
ucaagugauucuccugcc

SEQ ID NO: 1142 - RNA, 22 nt, Human
gcccugugcaggugugcagcag

SEQ ID NO: 1143 - RNA, 22 nt, Human
cuugcugccagccaccauacug

SEQ ID NO: 1144 - RNA, 20 nt, Human
ucugccuccaggagcuggca

SEQ ID NO: 1145 - RNA, 22 nt, Human
ugauuucaagccagggggcguu

SEQ ID NO: 1146 - RNA, 22 nt, Human
ugggggagcucaguccagccca

SEQ ID NO: 1147 - RNA, 22 nt, Human
aggccagccugcccaaagcugc

SEQ ID NO: 1148 - RNA, 22 nt, Human
uuguccguggugaguucgcauu

SEQ ID NO: 1149 - RNA, 22 nt, Human
auggccgccuguccuucccgcc

SEQ ID NO: 1150 - RNA, 22 nt, Human
cauucuaggccuggcuugggcc

SEQ ID NO: 1151 - RNA, 22 nt, Human
cagugcccgccgccguuccugg

SEQ ID NO: 1152 - RNA, 22 nt, Human
aggugcuggggcuuggccugcu

SEQ ID NO: 1153 - RNA, 22 nt, Human
cagcagcucagccuccuuccca

SEQ ID NO: 1154 - RNA, 23 nt, Human
cucauuguagccuccaguucuug

SEQ ID NO: 1155 - RNA, 22 nt, Human
cucagugcugcuggcuccuguc

SEQ ID NO: 1156 - RNA, 22 nt, Human
agccugggcaacagagcaaaac

SEQ ID NO: 1157 - RNA, 22 nt, Human
auuuacauacccagcagccucc

SEQ ID NO: 1158 - RNA, 22 nt, Human
aaagugcugggauuacaggcgu

SEQ ID NO: 1159 - RNA, 22 nt, Human
gcucccaccuuaaccuucacau

SEQ ID NO: 1160 - RNA, 22 nt, Human
cuacuggccaucugaucuacaa

SEQ ID NO: 1161 - RNA, 22 nt, Human
ugccuaguucuguauuuacagu

SEQ ID NO: 1162 - RNA, 22 nt, Human
uacccagugccacccucugagg

SEQ ID NO: 1163 - RNA, 22 nt, Human
agcccaggaguuugaggcugug

SEQ ID NO: 1164 - RNA, 22 nt, Human
cacugcaagcucugccaccugg

SEQ ID NO: 1165 - RNA, 22 nt, Human
cgccuccucucuguccugauuu

SEQ ID NO: 1166 - RNA, 22 nt, Human
uagccccugccuuugaaccugg

SEQ ID NO: 1167 - RNA, 22 nt, Human
cacugcacuucagccugggcga

SEQ ID NO: 1168 - RNA, 22 nt, Human
cccaggagguggaggcugcagu

SEQ ID NO: 1169 - RNA, 22 nt, Human
ugagugaccagaagucccccuc

SEQ ID NO: 1170 - RNA, 22 nt, Human
uugaucuuuucuugcugcccca

SEQ ID NO: 1171 - RNA, 22 nt, Human
cauuaggacgccccgcccauac

SEQ ID NO: 1172 - RNA, 22 nt, Human
ggugguucacgccuauaauccc

SEQ ID NO: 1173 - RNA, 22 nt, Human
guagcucuguuuaaaguucuuu

SEQ ID NO: 1174 - RNA, 22 nt, Human
aggcgccugcgggauccuugcc

SEQ ID NO: 1175 - RNA, 22 nt, Human
gcacuuugccccuccuuuggca

SEQ ID NO: 1176 - RNA, 22 nt, Human
ucgcucaggcaggagugcagug

SEQ ID NO: 1177 - RNA, 22 nt, Human
ugccagcugcuugucccccaca

SEQ ID NO: 1178 - RNA, 22 nt, Human
aagugauacgccugccucggcc

SEQ ID NO: 1179 - RNA, 22 nt, Human
gggcucucccacaacgugccag

SEQ ID NO: 1180 - RNA, 22 nt, Human
acugcacuccagccugggugau

SEQ ID NO: 1181 - RNA, 22 nt, Human
ucaucagggauauuggccugaa

SEQ ID NO: 1182 - RNA, 22 nt, Human
gggaggcagugcuggaggcugg

SEQ ID NO: 1183 - RNA, 22 nt, Human
ccaguuccagugcucacaucca

SEQ ID NO: 1184 - RNA, 22 nt, Human
ugccuaggucuggccuccuugg

SEQ ID NO: 1185 - RNA, 22 nt, Human
cggggcccuggggcugaagguc

SEQ ID NO: 1186 - RNA, 22 nt, Human
auugguaguuuuguauuucucu

SEQ ID NO: 1187 - RNA, 22 nt, Human
cuggcaagaaauauauaucuua

SEQ ID NO: 1188 - RNA, 20 nt, Human
gccgacugccuugugagccu

SEQ ID NO: 1189 - RNA, 22 nt, Human
gcuccagugaccaucguuuuag

SEQ ID NO: 1190 - RNA, 22 nt, Human
cccaggagguugaggcugcagu

SEQ ID NO: 1191 - RNA, 22 nt, Human
cgcccaggcuggagugcaguga

SEQ ID NO: 1192 - RNA, 22 nt, Human
cucccggcugcuccggcucccg

SEQ ID NO: 1193 - RNA, 22 nt, Human
guuacuccugguugagcuuggu

SEQ ID NO: 1194 - RNA, 22 nt, Human
gccuccagcccacgcaggccug

SEQ ID NO: 1195 - RNA, 22 nt, Human
uauucauugcccauguuuguga

SEQ ID NO: 1196 - RNA, 22 nt, Human
cacccagguuggagugcagugg

SEQ ID NO: 1197 - RNA, 19 nt, Human
agaagggcuggcaggaguu

SEQ ID NO: 1198 - RNA, 22 nt, Human
gaaguuugaagccuguuguuca

SEQ ID NO: 1199 - RNA, 22 nt, Human
gcuuuauccgcuugacccuuac

SEQ ID NO: 1200 - RNA, 22 nt, Human
ucgcccagcucaucucccacaa

SEQ ID NO: 1201 - RNA, 22 nt, Human
gaggcggagguugcagugagcu

SEQ ID NO: 1202 - RNA, 22 nt, Human
gcuuggcccauugaucagcugg

SEQ ID NO: 1203 - RNA, 22 nt, Human
gcccugggcaagguucuggcca

SEQ ID NO: 1204 - RNA, 22 nt, Human
cugggaggcggagcuugcagug

SEQ ID NO: 1205 - RNA, 22 nt, Human
aaagccucccagguuaugagua

SEQ ID NO: 1206 - RNA, 17 nt, Human
gcacugcugccuccugg

SEQ ID NO: 1207 - RNA, 22 nt, Human
gaccuugugauccaccugccuu

SEQ ID NO: 1208 - RNA, 22 nt, Human
cccgggaggcagagguugcagu

SEQ ID NO: 1209 - RNA, 22 nt, Human
uggccuuggccgugcugggguc

SEQ ID NO: 1210 - RNA, 22 nt, Human
gaggccugggcaagggggucug

SEQ ID NO: 1211 - RNA, 22 nt, Human
ccagaaaaauccucccuugucc

SEQ ID NO: 1212 - RNA, 22 nt, Human
gcucccacugcuguccugccau

SEQ ID NO: 1213 - RNA, 22 nt, Human
ggccgggugcucuggaggugcu

SEQ ID NO: 1214 - RNA, 22 nt, Human
ggcugguuagauuuguggucuu

SEQ ID NO: 1215 - RNA, 22 nt, Human
cugaggcaggagaguugcuuga

SEQ ID NO: 1216 - RNA, 22 nt, Human
ucccgucuugcuguugucugcg

SEQ ID NO: 1217 - RNA, 22 nt, Human
ggugucagacuuugcauauccu

SEQ ID NO: 1218 - RNA, 22 nt, Human
cucacugcaagcucugccuccc

SEQ ID NO: 1219 - RNA, 22 nt, Human
cugcucugcugaucagugucuc

SEQ ID NO: 1220 - RNA, 21 nt, Human
ggaauggugguuguaugguug

SEQ ID NO: 1221 - RNA, 22 nt, Human
ugauaugucccucgacaucagg

SEQ ID NO: 1222 - RNA, 22 nt, Human
uugucuuuugugggaaauaugg

SEQ ID NO: 1223 - RNA, 22 nt, Human
caccaugccuggcuaauuuuuu

SEQ ID NO: 1224 - RNA, 22 nt, Human
ccgaggcuggagugcaguggcg

SEQ ID NO: 1225 - RNA, 22 nt, Human
caggagcucagaugacaucuca

SEQ ID NO: 1226 - RNA, 22 nt, Human
gaccucgugaucugccagccuu

SEQ ID NO: 1227 - RNA, 22 nt, Human
cucuccuuggccaccuccauga

SEQ ID NO: 1228 - RNA, 19 nt, Human
ccuggccgcugugcccccu

SEQ ID NO: 1229 - RNA, 22 nt, Human
aggugcucuguguaugcauaga

SEQ ID NO: 1230 - RNA, 22 nt, Human
agucggaagcugugcguaaauc

SEQ ID NO: 1231 - RNA, 22 nt, Human
ugucugaucaugaggcagggcu

SEQ ID NO: 1232 - RNA, 17 nt, Human
gcccgcggcccggggug

SEQ ID NO: 1233 - RNA, 22 nt, Human
cucacugcaagcuccgccuccc

SEQ ID NO: 1234 - RNA, 22 nt, Human
cuuggaguaggucauugggugg

SEQ ID NO: 1235 - RNA, 22 nt, Human
ucagccagccagcuacaggcuu

SEQ ID NO: 1236 - RNA, 22 nt, Human
cauucugugagcugcuggcuuu

SEQ ID NO: 1237 - RNA, 22 nt, Human
ugccucccuggcaagucucucc

SEQ ID NO: 1238 - RNA, 22 nt, Human
cagcccgcccugaacuuucggg

SEQ ID NO: 1239 - RNA, 22 nt, Human
cuuccuccuccaucucgaaggc

SEQ ID NO: 1240 - RNA, 22 nt, Human
cugugcucccucuggcgccccg

SEQ ID NO: 1241 - RNA, 22 nt, Human
acaugauugucuggcuuggcca

SEQ ID NO: 1242 - RNA, 22 nt, Human
acuauagaugcuggcgaggcug

SEQ ID NO: 1243 - RNA, 22 nt, Human
uggcucauuucuaaacccagcu

SEQ ID NO: 1244 - RNA, 22 nt, Human
gugcuuaaagaauggcuguccg

SEQ ID NO: 1245 - RNA, 22 nt, Human
ggacagccgaguggccuucucc

SEQ ID NO: 1246 - RNA, 22 nt, Human
ggagugcaauggcgugaucuca

SEQ ID NO: 1247 - RNA, 22 nt, Human
cccugcauccaaaggccuccuc

SEQ ID NO: 1248 - RNA, 22 nt, Human
cucaggugauccaccccucuug

SEQ ID NO: 1249 - RNA, 22 nt, Human
acugcaaccuccgccugccagg

SEQ ID NO: 1250 - RNA, 22 nt, Human
gcugcacuucagccuggguguc

SEQ ID NO: 1251 - RNA, 22 nt, Human
gcagguggaucaccugagguca

SEQ ID NO: 1252 - RNA, 22 nt, Human
ggcccuggcagccacgaaagcc

SEQ ID NO: 1253 - RNA, 22 nt, Human
ucagugacuccuucuuccugcu

SEQ ID NO: 1254 - RNA, 22 nt, Human
cgaggccuccucgccgccaccg

SEQ ID NO: 1255 - RNA, 22 nt, Human
ugguggcucacaccuguaaucc

SEQ ID NO: 1256 - RNA, 22 nt, Human
ugaucucgugaucuacccgccu

SEQ ID NO: 1257 - RNA, 22 nt, Human
gcucacugcaagcuccgccucc

SEQ ID NO: 1258 - RNA, 22 nt, Human
cacugcacuccagcccgagcaa

SEQ ID NO: 1259 - RNA, 22 nt, Human
cagugcacgggccaguccugcc

SEQ ID NO: 1260 - RNA, 22 nt, Human
auccuccagcuccugcuucugc

SEQ ID NO: 1261 - RNA, 22 nt, Human
augccacugcacuucagccugg

SEQ ID NO: 1262 - RNA, 22 nt, Human
cauugcacuccagccuaggcaa

SEQ ID NO: 1263 - RNA, 22 nt, Human
cguucagcgggcuggccgugga

SEQ ID NO: 1264 - RNA, 22 nt, Human
agcccucuuccagccagcacag

SEQ ID NO: 1265 - RNA, 22 nt, Human
gugugucucccaagaaggccca

SEQ ID NO: 1266 - RNA, 18 nt, Human
uccuuucucccucaucuu

SEQ ID NO: 1267 - RNA, 22 nt, Human
ggcccaggcuggagugcagugg

SEQ ID NO: 1268 - RNA, 22 nt, Human
ucgcaccauugcacuccagcca

SEQ ID NO: 1269 - RNA, 21 nt, Human
ccucaagugccuccugcugcu

SEQ ID NO: 1270 - RNA, 22 nt, Human
gggaaauaauuaaugugaaguc

SEQ ID NO: 1271 - RNA, 22 nt, Human
gaggugggcggaucacaagguc

SEQ ID NO: 1272 - RNA, 22 nt, Human
uugacaugccuccuacaugauc

SEQ ID NO: 1273 - RNA, 22 nt, Human
auugcacuccagccugggggac

SEQ ID NO: 1274 - RNA, 22 nt, Human
cucuggacccuccugcugagag

SEQ ID NO: 1275 - RNA, 22 nt, Human
uuggaaugcacacugagccugc

SEQ ID NO: 1276 - RNA, 22 nt, Human
ccaugaauucacuccaugcuag

SEQ ID NO: 1277 - RNA, 22 nt, Human
uccuucacucccucugcaucca

SEQ ID NO: 1278 - RNA, 22 nt, Human
ccacugagguagcuggugacug

SEQ ID NO: 1279 - RNA, 22 nt, Human
ugucucuuuucaagcuacccuu

SEQ ID NO: 1280 - RNA, 22 nt, Human
cgaugguaucggccagccccgg

SEQ ID NO: 1281 - RNA, 22 nt, Human
caccuugugauccacccgccuu

SEQ ID NO: 1282 - RNA, 22 nt, Human
cugagcucaagcgauccuccca

SEQ ID NO: 1283 - RNA, 22 nt, Human
aggguugugugcuggccgcugg

SEQ ID NO: 1284 - RNA, 22 nt, Human
agauuucccuuccugcuugccu

SEQ ID NO: 1285 - RNA, 22 nt, Human
acacagagccaaaccauaucac

SEQ ID NO: 1286 - RNA, 22 nt, Human
ucucaacagugcaagcugcucc

SEQ ID NO: 1287 - RNA, 22 nt, Human
ucuggagggaagcacuuucugu

SEQ ID NO: 1288 - RNA, 22 nt, Human
ugucuccucggcuguccagcca

SEQ ID NO: 1289 - RNA, 22 nt, Human
cagagccccucgucuccaccac

SEQ ID NO: 1290 - RNA, 22 nt, Human
ugcuugcugugguuggcuggua

SEQ ID NO: 1291 - RNA, 22 nt, Human
uccagucggauaacuagacggu

SEQ ID NO: 1292 - RNA, 22 nt, Human
acuugcuggcuccuugcuucua

SEQ ID NO: 1293 - RNA, 22 nt, Human
acugcacuccagccugggcuac

SEQ ID NO: 1294 - RNA, 22 nt, Human
cugagcagaugaccagccccag

SEQ ID NO: 1295 - RNA, 19 nt, Human
gguauaugggccucacuug

SEQ ID NO: 1296 - RNA, 22 nt, Human
ggccguggucgcugacucucgu

SEQ ID NO: 1297 - RNA, 22 nt, Human
uccuucagccucccagcucaaa

SEQ ID NO: 1298 - RNA, 20 nt, Human
gccuuggugguuuugguagu

SEQ ID NO: 1299 - RNA, 22 nt, Human
guucaagaccagccuggccaac

SEQ ID NO: 1300 - RNA, 22 nt, Human
ggaggcugaggcaggcggauca

SEQ ID NO: 1301 - RNA, 16 nt, Human
gaggagccccucugcc

SEQ ID NO: 1302 - RNA, 23 nt, Human
gcagccauguucccgucucagcu

SEQ ID NO: 1303 - RNA, 22 nt, Human
cacuucccuucucugcucaugg

SEQ ID NO: 1304 - RNA, 22 nt, Human
cucuuccuagugugcagcgugg

SEQ ID NO: 1305 - RNA, 22 nt, Human
accagccuggccaacauggcaa

SEQ ID NO: 1306 - RNA, 22 nt, Human
cccucugcauacaggcgaggag

SEQ ID NO: 1307 - RNA, 22 nt, Human
gugaggcgaaggugcuggcgcc

SEQ ID NO: 1308 - RNA, 22 nt, Human
acuggggacucuggccuuuuga

SEQ ID NO: 1309 - RNA, 23 nt, Human
gauuacugguauuugcuggcucc

SEQ ID NO: 1310 - RNA, 22 nt, Human
agcuggugcucggggagcuggc

SEQ ID NO: 1311 - RNA, 20 nt, Human
ucucuaugccaugcuggccu

SEQ ID NO: 1312 - RNA, 22 nt, Human
gcagggaacuggcugggcuuuc

SEQ ID NO: 1313 - RNA, 22 nt, Human
uuuggcuucuccuaccaccucu

SEQ ID NO: 1314 - RNA, 22 nt, Human
gaccuugugauccgcccgccuu

SEQ ID NO: 1315 - RNA, 18 nt, Human
aaacugcuuccuuggccu

SEQ ID NO: 1316 - RNA, 22 nt, Human
ugccugccguuaaauguuacuu

SEQ ID NO: 1317 - RNA, 22 nt, Human
ucaggugccuuggcuaauuguu

SEQ ID NO: 1318 - RNA, 22 nt, Human
ggcgcuggccugugggaucccg

SEQ ID NO: 1319 - RNA, 22 nt, Human
ggcucacuacaaccuccgccuu

SEQ ID NO: 1320 - RNA, 22 nt, Human
uccaccaagccggggccacuuc

SEQ ID NO: 1321 - RNA, 22 nt, Human
cucacugcaagcucagccuccc

SEQ ID NO: 1322 - RNA, 18 nt, Human
cccagguuggccuacaga

SEQ ID NO: 1323 - RNA, 22 nt, Human
gaccccuaaacccgcugggcug

SEQ ID NO: 1324 - RNA, 22 nt, Human
ugcaccacugcauuccagccug

SEQ ID NO: 1325 - RNA, 22 nt, Human
cccgggaggcggagguugcagu

SEQ ID NO: 1326 - RNA, 22 nt, Human
gcuggccacagauccccaggga

SEQ ID NO: 1327 - RNA, 22 nt, Human
gggaagcuggucacccacaggc

SEQ ID NO: 1328 - RNA, 21 nt, Human
aggcagagaggaccagagacu

SEQ ID NO: 1329 - RNA, 22 nt, Human
aaagugcuuccuuuuagaggcu

SEQ ID NO: 1330 - RNA, 22 nt, Human
agcccaggcuggagugcagugg

SEQ ID NO: 1331 - RNA, 22 nt, Human
cuccucuuuagccccagcugga

SEQ ID NO: 1332 - RNA, 22 nt, Human
gcaaaaaguagugcugguuagg

SEQ ID NO: 1333 - RNA, 22 nt, Human
cagggauggcgcuggcugcccg

SEQ ID NO: 1334 - RNA, 22 nt, Human
ccuccggucauugugcgggccu

SEQ ID NO: 1335 - RNA, 22 nt, Human
acucacugcaaccuccaccucc

SEQ ID NO: 1336 - RNA, 22 nt, Human
ggggugcgggccccaucuggcu

SEQ ID NO: 1337 - RNA, 22 nt, Human
cagccccacacggucuagcucu

SEQ ID NO: 1338 - RNA, 22 nt, Human
augccacuucauuccagccucg

SEQ ID NO: 1339 - RNA, 22 nt, Human
agaugggguuucaucauguugg

SEQ ID NO: 1340 - RNA, 22 nt, Human
gugguguuugagcugccaggga

SEQ ID NO: 1341 - RNA, 22 nt, Human
gcgcucucuucuccuggcccgc

SEQ ID NO: 1342 - RNA, 23 nt, Human
cacugcaaccucugccucccagg

SEQ ID NO: 1343 - RNA, 22 nt, Human
gccuccugaguagcugggauug

SEQ ID NO: 1344 - RNA, 22 nt, Human
cuuuaauuguagcucccauaau

SEQ ID NO: 1345 - RNA, 22 nt, Human
aacccaggcuggagugcagugg

SEQ ID NO: 1346 - RNA, 22 nt, Human
ucaagcaauucuccugccucag

SEQ ID NO: 1347 - RNA, 22 nt, Human
acaguccagccuaguauguaua

SEQ ID NO: 1348 - RNA, 22 nt, Human
ucaggaggcggagguugcagug

SEQ ID NO: 1349 - RNA, 22 nt, Human
aauggucucuuuguucccugcu

SEQ ID NO: 1350 - RNA, 22 nt, Human
ggccgucccuagagaugggguu

SEQ ID NO: 1351 - RNA, 22 nt, Human
auccuagaaucagcccuugcug

SEQ ID NO: 1352 - RNA, 22 nt, Human
ggaagcucugccuagauuucag

SEQ ID NO: 1353 - RNA, 22 nt, Human
cugggaggcagagguuguagug

SEQ ID NO: 1354 - RNA, 22 nt, Human
gucccaaacuccugaccucagg

SEQ ID NO: 1355 - RNA, 22 nt, Human
uggcgcgacgugcccccugcuu

SEQ ID NO: 1356 - RNA, 22 nt, Human
ggcgugggcgaggugcucuauc

SEQ ID NO: 1357 - RNA, 22 nt, Human
cucgggcacccugguucuggug

SEQ ID NO: 1358 - RNA, 22 nt, Human
augggcuguccauugcuggcug

SEQ ID NO: 1359 - RNA, 22 nt, Human
ugagcuucccuccugcacuaca

SEQ ID NO: 1360 - RNA, 21 nt, Human
cccggcaccuccgcugcacac

SEQ ID NO: 1361 - RNA, 22 nt, Human
gugggcaucaccagggccucca

SEQ ID NO: 1362 - RNA, 22 nt, Human
gaacccuagcauguccuuuagg

SEQ ID NO: 1363 - RNA, 22 nt, Human
agggcaggagguccgucccuuc

SEQ ID NO: 1364 - RNA, 22 nt, Human
agggcagagcguuuccugcccc

SEQ ID NO: 1365 - RNA, 22 nt, Human
gcuuggcuuuacuagggggaca

SEQ ID NO: 1366 - RNA, 22 nt, Human
caugaaauuguauuggccucaa

SEQ ID NO: 1367 - RNA, 22 nt, Human
cacugcacuccagccugggcca

SEQ ID NO: 1368 - RNA, 22 nt, Human
aucugagcuccgccuccuguca

SEQ ID NO: 1369 - RNA, 22 nt, Human
ucugccuuuuacuagcuggaug

SEQ ID NO: 1370 - RNA, 22 nt, Human
auggguucaagugauucuccug

SEQ ID NO: 1371 - RNA, 22 nt, Human
caugugucuugcugcccuccau

SEQ ID NO: 1372 - RNA, 22 nt, Human
gccuccugucccaggcugagga

SEQ ID NO: 1373 - RNA, 22 nt, Human
aggaccuguaaucccagcacuu

SEQ ID NO: 1374 - RNA, 22 nt, Human
uucaaguguuuaaguucugcuu

SEQ ID NO: 1375 - RNA, 22 nt, Human
cugcccccagccugggcuucga

SEQ ID NO: 1376 - RNA, 22 nt, Human
agcuccuggcuucaagcaaucc

SEQ ID NO: 1377 - RNA, 15 nt, Human
uggcccacccguuga

SEQ ID NO: 1378 - RNA, 22 nt, Human
aguccguccugucaagcagcug

SEQ ID NO: 1379 - RNA, 22 nt, Human
ccgggguaggcccugaggcagc

SEQ ID NO: 1380 - RNA, 22 nt, Human
augccacugcgcucuagccugg

SEQ ID NO: 1381 - RNA, 22 nt, Human
cauuauucucaguucugugcag

SEQ ID NO: 1382 - RNA, 22 nt, Human
cacccgcuggucccugcaguuc

SEQ ID NO: 1383 - RNA, 22 nt, Human
uacugcacuccagccuggguga

SEQ ID NO: 1384 - RNA, 22 nt, Human
guggcccaggcuggagugcagu

SEQ ID NO: 1385 - RNA, 22 nt, Human
ucacucaggcuggagugcagug

SEQ ID NO: 1386 - RNA, 22 nt, Human
uaccaccauuugccugcuguau

SEQ ID NO: 1387 - RNA, 22 nt, Human
gcccuccagccuguggaaccgg

SEQ ID NO: 1388 - RNA, 22 nt, Human
cgcccaggcuggagugccagug

SEQ ID NO: 1389 - RNA, 22 nt, Human
auggugcuggugggaguguauu

SEQ ID NO: 1390 - RNA, 22 nt, Human
ccaaagugcugggauuacaggu

SEQ ID NO: 1391 - RNA, 20 nt, Human
agcggcuggcggaggacacg

SEQ ID NO: 1392 - RNA, 22 nt, Human
augccacugcacuccagccugg

SEQ ID NO: 1393 - RNA, 22 nt, Human
ccuuugauuucccccgucucag

SEQ ID NO: 1394 - RNA, 22 nt, Human
ggguuacucuguguuggucagg

SEQ ID NO: 1395 - RNA, 22 nt, Human
gcccauagucucuuucuuucuu

SEQ ID NO: 1396 - RNA, 22 nt, Human
auugcacuccagccugagcaaa

SEQ ID NO: 1397 - RNA, 22 nt, Human
cacugcacccucaaacuccugg

SEQ ID NO: 1398 - RNA, 22 nt, Human
ucccauggggccagccgccauc

SEQ ID NO: 1399 - RNA, 22 nt, Human
cacugcacuccagccugggcga

SEQ ID NO: 1400 - RNA, 23 nt, Human
ggggucuuggaacagguggcccu

SEQ ID NO: 1401 - RNA, 22 nt, Human
cacugcagccucaaauuccugg

SEQ ID NO: 1402 - RNA, 22 nt, Human
ugcaggcucuuggugacguggg

SEQ ID NO: 1403 - RNA, 22 nt, Human
gguggccccugggagaugcugg

SEQ ID NO: 1404 - RNA, 21 nt, Human
aaccaagccagccagccucuc

SEQ ID NO: 1405 - RNA, 22 nt, Human
gcccaggcuggaguucaguggu

SEQ ID NO: 1406 - RNA, 22 nt, Human
agccugcgaucccaccuggccu

SEQ ID NO: 1407 - RNA, 22 nt, Human
uaaccucucugugccucaguuu

SEQ ID NO: 1408 - RNA, 20 nt, Human
uagcauggcucuauggaaca

SEQ ID NO: 1409 - RNA, 21 nt, Human
cuggccuaucauaagcauuuu

SEQ ID NO: 1410 - RNA, 22 nt, Human
cagccugguccccggcucaccc

SEQ ID NO: 1411 - RNA, 22 nt, Human
gcccaggcuggagugcaguggc

SEQ ID NO: 1412 - RNA, 22 nt, Human
ccaggcuggagugcaauggcau

SEQ ID NO: 1413 - RNA, 23 nt, Human
cacugcaaucucugccuccuggg

SEQ ID NO: 1414 - RNA, 22 nt, Human
ugccucaagcccuccacugcac

SEQ ID NO: 1415 - RNA, 22 nt, Human
gacccauccuccacuuggcagc

SEQ ID NO: 1416 - RNA, 22 nt, Human
aaccaccauucucuccucuucc

SEQ ID NO: 1417 - RNA, 22 nt, Human
uuccauuuggagcucgcagccu

SEQ ID NO: 1418 - RNA, 22 nt, Human
aagguuccucucuccacccagc

SEQ ID NO: 1419 - RNA, 22 nt, Human
cuccugggaaaggcuggacaca

SEQ ID NO: 1420 - RNA, 22 nt, Human
acugcacuccagccugggcaca

SEQ ID NO: 1421 - RNA, 22 nt, Human
ucaccagcucugccucgccagu

SEQ ID NO: 1422 - RNA, 22 nt, Human
guugccuaggcuggagugcagu

SEQ ID NO: 1423 - RNA, 22 nt, Human
ugccuggccucuucagcacuuc

SEQ ID NO: 1424 - RNA, 18 nt, Human
cccugccagcucccagca

SEQ ID NO: 1425 - RNA, 22 nt, Human
gaggccucagccugcccugaac

SEQ ID NO: 1426 - RNA, 22 nt, Human
ucacugcaagcucagccucccg

SEQ ID NO: 1427 - RNA, 23 nt, Human
uccaggcccucaauccauuucca

SEQ ID NO: 1428 - RNA, 22 nt, Human
aaaagcaauugcggguuuugcc

SEQ ID NO: 1429 - RNA, 22 nt, Human
uccucagaaucaccuggcagcu

SEQ ID NO: 1430 - RNA, 22 nt, Human
ggguucagucccucuugcuacu

SEQ ID NO: 1431 - RNA, 22 nt, Human
uaguuucaucuccacccugccc

SEQ ID NO: 1432 - RNA, 19 nt, Human
gggucucuguuggcuucuu

SEQ ID NO: 1433 - RNA, 22 nt, Human
ggggaacgcgcuggcccgcgcc

SEQ ID NO: 1434 - RNA, 22 nt, Human
aggcggaagauggccccauaga

SEQ ID NO: 1435 - RNA, 22 nt, Human
ucucuucgcuggcccucgggga

SEQ ID NO: 1436 - RNA, 22 nt, Human
ugcccaggguggagugcagugg

SEQ ID NO: 1437 - RNA, 24 nt, Human
aauugcuugaacccaggaagugga

SEQ ID NO: 1438 - RNA, 22 nt, Human
gcacacggcagccuccuccuga

SEQ ID NO: 1439 - RNA, 22 nt, Human
cuccugcuucacgggcaccgcc

SEQ ID NO: 1440 - RNA, 22 nt, Human
cccuuuagccccugcagagacu

SEQ ID NO: 1441 - RNA, 22 nt, Human
uauugagaccagugcuugcuua

SEQ ID NO: 1442 - RNA, 22 nt, Human
ucgcccaggcuggaagugcagu

SEQ ID NO: 1443 - RNA, 22 nt, Human
gcucugccagcccaaggcgcag

SEQ ID NO: 1444 - RNA, 22 nt, Human
ggaggcggagguugcagugagc

SEQ ID NO: 1445 - RNA, 17 nt, Human
cccucacuccugccggg

SEQ ID NO: 1446 - RNA, 22 nt, Human
gccccugccuuugaaccuggag

SEQ ID NO: 1447 - RNA, 20 nt, Human
uucuccagugcgguagccau

SEQ ID NO: 1448 - RNA, 22 nt, Human
gcuccuuuauuuucucucgugu

SEQ ID NO: 1449 - RNA, 22 nt, Human
cauucucaguaucagccagccc

SEQ ID NO: 1450 - RNA, 22 nt, Human
uagcagaaguugcaaacuaggg

SEQ ID NO: 1451 - RNA, 22 nt, Human
ccaagcagagcagccucucugg

SEQ ID NO: 1452 - RNA, 22 nt, Human
cuaggcuggagugcaguggcac

SEQ ID NO: 1453 - RNA, 22 nt, Human
uuccugcgcccuucucgcccgc

SEQ ID NO: 1454 - RNA, 22 nt, Human
cugugcuggguccuucuuuuga

SEQ ID NO: 1455 - RNA, 22 nt, Human
agcucaccacaaccuccgccuc

SEQ ID NO: 1456 - RNA, 22 nt, Human
agucuucccagaggaggugcca

SEQ ID NO: 1457 - RNA, 22 nt, Human
gaggcggagguugcagugagcc

SEQ ID NO: 1458 - RNA, 22 nt, Human
gcccuccugagcuagcacgugu

SEQ ID NO: 1459 - RNA, 22 nt, Human
cauugcacaccagccugggcaa

SEQ ID NO: 1460 - RNA, 22 nt, Human
aguucucuugcuucagccuccc

SEQ ID NO: 1461 - RNA, 22 nt, Human
uccagcuguccacgucuuccug

SEQ ID NO: 1462 - RNA, 22 nt, Human
ugccuggccuccugauucccuc

SEQ ID NO: 1463 - RNA, 22 nt, Human
gccuccagggaugauuccuucc

SEQ ID NO: 1464 - RNA, 22 nt, Human
gucccugagccuggcauuuccc

SEQ ID NO: 1465 - RNA, 22 nt, Human
acuggccagccaacaacaauag

SEQ ID NO: 1466 - RNA, 22 nt, Human
gcuggcuccaccugcugccagg

SEQ ID NO: 1467 - RNA, 22 nt, Human
gccccagccucccgaguagcug

SEQ ID NO: 1468 - RNA, 22 nt, Human
ucccagcuccugggccccacag

SEQ ID NO: 1469 - RNA, 22 nt, Human
cacugcacuccagcccgggcaa

SEQ ID NO: 1470 - RNA, 23 nt, Human
ugaccucaugauccgcccaccuc

SEQ ID NO: 1471 - RNA, 22 nt, Human
ggccgcucuccgguguggaucu

SEQ ID NO: 1472 - RNA, 22 nt, Human
cuaaaugccccuucuggcacag

SEQ ID NO: 1473 - RNA, 22 nt, Human
ucacugcaaccucugccugcca

SEQ ID NO: 1474 - RNA, 22 nt, Human
ccgguguucaaagucugguaug

SEQ ID NO: 1475 - RNA, 22 nt, Human
cacccaggcuggaaugcagugg

SEQ ID NO: 1476 - RNA, 22 nt, Human
cacccaggcuggagugcaguga

SEQ ID NO: 1477 - RNA, 22 nt, Human
uuccauaucuguugcauaucau

SEQ ID NO: 1478 - RNA, 22 nt, Human
ccacugcacuucagccugggug

SEQ ID NO: 1479 - RNA, 22 nt, Human
gccaaauaaguguccggcccuc

SEQ ID NO: 1480 - RNA, 22 nt, Human
gcccgcgccagccucuccaucu

SEQ ID NO: 1481 - RNA, 22 nt, Human
cauugcacuccagccuuggcaa

SEQ ID NO: 1482 - RNA, 22 nt, Human
ugauagauccauauuuugguaa

SEQ ID NO: 1483 - RNA, 22 nt, Human
ugcucgccccacaugcccucau

SEQ ID NO: 1484 - RNA, 22 nt, Human
ugccugccccagcugagauauc

SEQ ID NO: 1485 - RNA, 22 nt, Human
ucacugcaaccucugccucuug

SEQ ID NO: 1486 - RNA, 23 nt, Human
uggaggagaguuugucaguauag

SEQ ID NO: 1487 - RNA, 22 nt, Human
cccaggcuggagugcaguggcg

SEQ ID NO: 1488 - RNA, 22 nt, Human
cacccaggcuggagagcagugg

SEQ ID NO: 1489 - RNA, 22 nt, Human
ucugcaccaucguaugcuuaau

SEQ ID NO: 1490 - RNA, 22 nt, Human
cucugagcugccuuuugagcuu

SEQ ID NO: 1491 - RNA, 22 nt, Human
ucccgcccuuguacuugccgag

SEQ ID NO: 1492 - RNA, 22 nt, Human
cgcccaggcuggagagcagugg

SEQ ID NO: 1493 - RNA, 21 nt, Human
gguggcuauggcugugcucgc

SEQ ID NO: 1494 - RNA, 22 nt, Human
ccuagagccgcaccuccuccac

SEQ ID NO: 1495 - RNA, 22 nt, Human
gccuccccaagcagcagggauu

SEQ ID NO: 1496 - RNA, 22 nt, Human
agaaagugcuucccuuugguga

SEQ ID NO: 1497 - RNA, 20 nt, Human
acccuggccgacugccccuu

SEQ ID NO: 1498 - RNA, 22 nt, Human
ugcugcacccucugccuccggg

SEQ ID NO: 1499 - RNA, 22 nt, Human
caggagguugagggugcaguga

SEQ ID NO: 1500 - RNA, 22 nt, Human
ugggaugcucagggccuggagc

SEQ ID NO: 1501 - RNA, 21 nt, Human
ugcucugauuuuugccccagc

SEQ ID NO: 1502 - RNA, 22 nt, Human
cgucuggcuucuccacgguaaa

SEQ ID NO: 1503 - RNA, 22 nt, Human
ugucauagugugguagcagugg

SEQ ID NO: 1504 - RNA, 22 nt, Human
ugugguagucacggcccgccac

SEQ ID NO: 1505 - RNA, 22 nt, Human
cucugccugucucauccugcaa

SEQ ID NO: 1506 - RNA, 22 nt, Human
caucuuugcccauccacuucca

SEQ ID NO: 1507 - RNA, 22 nt, Human
ggcugguggcugguucuggacc

SEQ ID NO: 1508 - RNA, 22 nt, Human
aguggucuuagcuugcugggcu

SEQ ID NO: 1509 - RNA, 22 nt, Human
ccccugcugugcuugcauggcu

SEQ ID NO: 1510 - RNA, 19 nt, Human
agccagccagcagguaugc

SEQ ID NO: 1511 - RNA, 22 nt, Human
gaggcugaggcaggaggaucac

SEQ ID NO: 1512 - RNA, 22 nt, Human
augagcacacugauaagccccu

SEQ ID NO: 1513 - RNA, 22 nt, Human
agugcuaucgaguucuaaugcu

SEQ ID NO: 1514 - RNA, 22 nt, Human
cagccuguagucugguccaggu

SEQ ID NO: 1515 - RNA, 22 nt, Human
cuggcuccuguuuaaccagcug

SEQ ID NO: 1516 - RNA, 22 nt, Human
guccccuguccagggccagcca

SEQ ID NO: 1517 - RNA, 22 nt, Human
cuugccugcccugugucauaaa

SEQ ID NO: 1518 - RNA, 22 nt, Human
ucccguagguugcuguagucgg

SEQ ID NO: 1519 - RNA, 22 nt, Human
guuggccaggcuggucucaauc

SEQ ID NO: 1520 - RNA, 22 nt, Human
ucucccagauccuuuagccucc

SEQ ID NO: 1521 - RNA, 22 nt, Human
gccuccuggggugccaucaucu

SEQ ID NO: 1522 - RNA, 23 nt, Human
aucauuaacagugcagggguagg

SEQ ID NO: 1523 - RNA, 22 nt, Human
uggccaccaccaauacuugccu

SEQ ID NO: 1524 - RNA, 21 nt, Human
ggccucccggaccgcagcgcc

SEQ ID NO: 1525 - RNA, 22 nt, Human
agcccagguccaguucacugca

SEQ ID NO: 1526 - RNA, 22 nt, Human
uccccucuuggcuugguccaga

SEQ ID NO: 1527 - RNA, 22 nt, Human
cuggccuagacagacccugauc

SEQ ID NO: 1528 - RNA, 22 nt, Human
cccuggcugcgugauggaugaa

SEQ ID NO: 1529 - RNA, 22 nt, Human
guaggccauggugguugucucu

SEQ ID NO: 1530 - RNA, 22 nt, Human
uguggcucaggcggcuucuccu

SEQ ID NO: 1531 - RNA, 22 nt, Human
ucccuguguccugggggcaccu

SEQ ID NO: 1532 - RNA, 21 nt, Human
accugagcuccaccuccugcc

SEQ ID NO: 1533 - RNA, 22 nt, Human
cccagcgaguuugccggugaac

SEQ ID NO: 1534 - RNA, 22 nt, Human
uucaaagggaaaagcaggcugg

SEQ ID NO: 1535 - RNA, 19 nt, Human
cggccccuccucucgcgcc

SEQ ID NO: 1536 - RNA, 17 nt, Human
aagugauucagcccuca

SEQ ID NO: 1537 - RNA, 22 nt, Human
ggccugggcuccgggaguuacu

SEQ ID NO: 1538 - RNA, 22 nt, Human
ccucggccggagagccaagugc

SEQ ID NO: 1539 - RNA, 22 nt, Human
ucugugccugcuuccccaccca

SEQ ID NO: 1540 - RNA, 18 nt, Human
cugcacucccgccugggc

SEQ ID NO: 1541 - RNA, 22 nt, Human
gcacuccagccuggguaacagc

SEQ ID NO: 1542 - RNA, 17 nt, Human
cuggagcagacaaaagg

SEQ ID NO: 1543 - RNA, 22 nt, Human
cucacugcaaccucugccuccc

SEQ ID NO: 1544 - RNA, 22 nt, Human
ugugccuaguucuguauuuaca

SEQ ID NO: 1545 - RNA, 22 nt, Human
gguuuucaccuccagaaugugc

SEQ ID NO: 1546 - RNA, 22 nt, Human
cguaagucacagcgccuggccc

SEQ ID NO: 1547 - RNA, 22 nt, Human
cucugugauaugguuuguaaua

SEQ ID NO: 1548 - RNA, 22 nt, Human
ucuccccuggucucgcgcgcug

SEQ ID NO: 1549 - RNA, 22 nt, Human
cacugcaaccuccaccuccugg

SEQ ID NO: 1550 - RNA, 22 nt, Human
cugguagcuccugaauaucccu

SEQ ID NO: 1551 - RNA, 22 nt, Human
augccuguaaucccagcacuuu

SEQ ID NO: 1552 - RNA, 22 nt, Human
acaaagcgcuucucuuuagagu

SEQ ID NO: 1553 - RNA, 22 nt, Human
aaucgcuugaacccaggaagug

SEQ ID NO: 1554 - RNA, 20 nt, Human
gggcuuuuggaauggucugu

SEQ ID NO: 1555 - RNA, 20 nt, Human
agcaacucucaccuggcugc

SEQ ID NO: 1556 - RNA, 22 nt, Human
ugcccucuuucuguacagcucc

SEQ ID NO: 1557 - RNA, 22 nt, Human
ugguuuuagggaaucaaucuau

SEQ ID NO: 1558 - RNA, 22 nt, Human
uucccacuguggcagagccucg

SEQ ID NO: 1559 - RNA, 22 nt, Human
cguguagcaugcgccaccacca

SEQ ID NO: 1560 - RNA, 22 nt, Human
ugccuaggcuggaguguagugg

SEQ ID NO: 1561 - RNA, 22 nt, Human
uacucuuuuagccccacagaga

SEQ ID NO: 1562 - RNA, 20 nt, Human
caaaucccugcucugugcug

SEQ ID NO: 1563 - RNA, 22 nt, Human
ccaaggugggaggauugcuuga

SEQ ID NO: 1564 - RNA, 22 nt, Human
ccagacugcuugcuucccagcc

SEQ ID NO: 1565 - RNA, 22 nt, Human
cucugcaaguccagccccuggc

SEQ ID NO: 1566 - RNA, 22 nt, Human
ugugagacuuucuuuggccucu

SEQ ID NO: 1567 - RNA, 22 nt, Human
cucugaguccugcacucacccg

SEQ ID NO: 1568 - RNA, 19 nt, Human
acugcacuuuagccugggc

SEQ ID NO: 1569 - RNA, 20 nt, Human
ucagccauuccuuaccuuuc

SEQ ID NO: 1570 - RNA, 22 nt, Human
ucacugaaaccuccaccucucg

SEQ ID NO: 1571 - RNA, 22 nt, Human
agauuuggugucugguugauau

SEQ ID NO: 1572 - RNA, 19 nt, Human
caggccucuuacccucucu

SEQ ID NO: 1573 - RNA, 22 nt, Human
acgcgcuggggcgcuggccaau

SEQ ID NO: 1574 - RNA, 22 nt, Human
ccuguggcgggggccagugccu

SEQ ID NO: 1575 - RNA, 22 nt, Human
cacucagcugagcccucagccc

SEQ ID NO: 1576 - RNA, 20 nt, Human
ucccccacuguuucugcuac

SEQ ID NO: 1577 - RNA, 22 nt, Human
gccuguccucuuccgccugucu

SEQ ID NO: 1578 - RNA, 22 nt, Human
ccaccugagauaagagagcuca

SEQ ID NO: 1579 - RNA, 22 nt, Human
ccaggaggcggagguugcagug

SEQ ID NO: 1580 - RNA, 22 nt, Human
ucacugcaagcuccuccuccug

SEQ ID NO: 1581 - RNA, 22 nt, Human
guauugcuugagcccaggaguu

SEQ ID NO: 1582 - RNA, 22 nt, Human
cccuggcugauaccggaaaggc

SEQ ID NO: 1583 - RNA, 22 nt, Human
cucacugcaaccucugccccca

SEQ ID NO: 1584 - RNA, 23 nt, Human
caccacuuucuccuucuccuugg

SEQ ID NO: 1585 - RNA, 22 nt, Human
aggagggguucucgggugcuga

SEQ ID NO: 1586 - RNA, 22 nt, Human
guagaccauuuaucuggggagu

SEQ ID NO: 1587 - RNA, 21 nt, Human
ucugcaccccagccugaguga

SEQ ID NO: 1588 - RNA, 22 nt, Human
ugccuaggcuggagugcaguga

SEQ ID NO: 1589 - RNA, 22 nt, Human
ccuuuuauccccuaauuggccu

SEQ ID NO: 1590 - RNA, 22 nt, Human
agaaagugcuucccuuuggacu

SEQ ID NO: 1591 - RNA, 22 nt, Human
uugucacugcacuccagucugg

SEQ ID NO: 1592 - RNA, 22 nt, Human
uugcucuugaaaauugaugcug

SEQ ID NO: 1593 - RNA, 22 nt, Human
aagccaaugcuagcccacaugc

SEQ ID NO: 1594 - RNA, 22 nt, Human
ucuaauccuaugguggggaggg

SEQ ID NO: 1595 - RNA, 22 nt, Human
cgugccacugcacuccagucug

SEQ ID NO: 1596 - RNA, 22 nt, Human
ccacugcacuccagccuuggca

SEQ ID NO: 1597 - RNA, 22 nt, Human
ggcggagcuugcagugagccga

SEQ ID NO: 1598 - RNA, 22 nt, Human
agcuggagaugagugacgugcc

SEQ ID NO: 1599 - RNA, 22 nt, Human
uuuugguuguuggguaagagua

SEQ ID NO: 1600 - RNA, 22 nt, Human
uugccgccgucugcucgccccg

SEQ ID NO: 1601 - RNA, 22 nt, Human
ugauguggccccacuuagcugu

SEQ ID NO: 1602 - RNA, 22 nt, Human
ugaccucaugauccgcccaccu

SEQ ID NO: 1603 - RNA, 22 nt, Human
gccguccaccucgauggccacu

SEQ ID NO: 1604 - RNA, 22 nt, Human
gacaggcuuccacuauguugcc

SEQ ID NO: 1605 - RNA, 22 nt, Human
uacugcacuccagccuugccaa

SEQ ID NO: 1606 - RNA, 22 nt, Human
cucuguagaaagagcccaggug

SEQ ID NO: 1607 - RNA, 17 nt, Human
uucuuuucugagccuug

SEQ ID NO: 1608 - RNA, 22 nt, Human
gacgagagacuccauccaccac

SEQ ID NO: 1609 - RNA, 22 nt, Human
aucucagcucugccuccugggu

SEQ ID NO: 1610 - RNA, 22 nt, Human
cuggaggugcuucgcuggccac

SEQ ID NO: 1611 - RNA, 22 nt, Human
uucccuuaaauuauggcaucua

SEQ ID NO: 1612 - RNA, 22 nt, Human
uuaggccuuugauuggggugcu

SEQ ID NO: 1613 - RNA, 22 nt, Human
cccauuucuugaguucagcucu

SEQ ID NO: 1614 - RNA, 22 nt, Human
gaggggagcccccauccuccag

SEQ ID NO: 1615 - RNA, 22 nt, Human
uucucccuguccuaucaagacu

SEQ ID NO: 1616 - RNA, 22 nt, Human
ucauucccucauuguucacugg

SEQ ID NO: 1617 - RNA, 22 nt, Human
gggggcuuggcccggucugguu

SEQ ID NO: 1618 - RNA, 22 nt, Human
augggccuccuauuauccccau

SEQ ID NO: 1619 - RNA, 22 nt, Human
gccuggauuccuuguuucucag

SEQ ID NO: 1620 - RNA, 22 nt, Human
uguggguggcaucguccuggcc

SEQ ID NO: 1621 - RNA, 22 nt, Human
gccggguucaagccauucuccu

SEQ ID NO: 1622 - RNA, 22 nt, Human
gccagccagaaacgucacacug

SEQ ID NO: 1623 - RNA, 22 nt, Human
cucacugaaaccuccgccuccc

SEQ ID NO: 1624 - RNA, 22 nt, Human
gugcuggugcucgcuccucugg

SEQ ID NO: 1625 - RNA, 22 nt, Human
ugcccaggcuggagugcagugg

SEQ ID NO: 1626 - RNA, 22 nt, Human
uagagugucauaacagugccca

SEQ ID NO: 1627 - RNA, 22 nt, Human
uaugccacugcucuccauccua

SEQ ID NO: 1628 - RNA, 22 nt, Human
uggucugcugaacagccguauc

SEQ ID NO: 1629 - RNA, 22 nt, Human
accagccuggccaacaugguga

SEQ ID NO: 1630 - RNA, 22 nt, Human
gccagcagcuucuucucauccu

SEQ ID NO: 1631 - RNA, 17 nt, Human
uggcucuguccucagcu

SEQ ID NO: 1632 - RNA, 22 nt, Human
acccaggcuggagugcaguggc

SEQ ID NO: 1633 - RNA, 22 nt, Human
uccccagcuugcuacuucugcu

SEQ ID NO: 1634 - RNA, 22 nt, Human
cuucccucugcuccuuggucca

SEQ ID NO: 1635 - RNA, 22 nt, Human
cuucucgggguucccgcgcccu

SEQ ID NO: 1636 - RNA, 22 nt, Human
agggaaggacugcuggguuggc

SEQ ID NO: 1637 - RNA, 22 nt, Human
ccugccuaugagacguuuugcc

SEQ ID NO: 1638 - RNA, 22 nt, Human
uuuuccuucauaucccuuaugu

SEQ ID NO: 1639 - RNA, 22 nt, Human
cauugcacuccagcucugggcg

SEQ ID NO: 1640 - RNA, 22 nt, Human
gggagguugaggcugcagugag

SEQ ID NO: 1641 - RNA, 22 nt, Human
ggcggcccaggcgcuuggagau

SEQ ID NO: 1642 - RNA, 22 nt, Human
gugcugugcccucugcugggaa

SEQ ID NO: 1643 - RNA, 20 nt, Human
agcagagcagucuccgcuca

SEQ ID NO: 1644 - RNA, 22 nt, Human
uggcacagccuccaugucgucc

SEQ ID NO: 1645 - RNA, 22 nt, Human
gccucagucucccgaguagcug

SEQ ID NO: 1646 - RNA, 19 nt, Human
cgcgccgucggguccagcc

SEQ ID NO: 1647 - RNA, 22 nt, Human
ccccgaggcuggagugcagugg

SEQ ID NO: 1648 - RNA, 22 nt, Human
cgugcugggucugcggggccgu

SEQ ID NO: 1649 - RNA, 22 nt, Human
uaggccccuagugccacguggc

SEQ ID NO: 1650 - RNA, 22 nt, Human
gaccuugugauccacccgcuuu

SEQ ID NO: 1651 - RNA, 22 nt, Human
cccuggcuggcucugcccggac

SEQ ID NO: 1652 - RNA, 22 nt, Human
gcacuggccgcacgcguagggc

SEQ ID NO: 1653 - RNA, 22 nt, Human
gaccuugugauccacccgccuu

SEQ ID NO: 1654 - RNA, 22 nt, Human
caaagugcugggauuacaggcu

SEQ ID NO: 1655 - RNA, 22 nt, Human
ugguggcucacgucuguaaucu

SEQ ID NO: 1656 - RNA, 22 nt, Human
cauccaggcugaagugcagugg

SEQ ID NO: 1657 - RNA, 20 nt, Human
ugauaugguuuggcuguguu

SEQ ID NO: 1658 - RNA, 22 nt, Human
uccgggaggcagagguugcagu

SEQ ID NO: 1659 - RNA, 22 nt, Human
ggugaauuugccucccgacuga

SEQ ID NO: 1660 - RNA, 22 nt, Human
gggugcuuuggcucacgccugu

SEQ ID NO: 1661 - RNA, 22 nt, Human
uucaccauguuggccaggcugg

SEQ ID NO: 1662 - RNA, 22 nt, Human
uggugcuaguuaaaucuucagg

SEQ ID NO: 1663 - RNA, 22 nt, Human
ccucggcugggccuuggccacu

SEQ ID NO: 1664 - RNA, 22 nt, Human
cucacugcaaucuccgucuccc

SEQ ID NO: 1665 - RNA, 22 nt, Human
ccuggccuuugaacgcuagacu

SEQ ID NO: 1666 - RNA, 22 nt, Human
agcucacugcaaccuccgccuc

SEQ ID NO: 1667 - RNA, 20 nt, Human
gggcaaggaaacagccccca

SEQ ID NO: 1668 - RNA, 22 nt, Human
ggcucugugucuccacccaaau

SEQ ID NO: 1669 - RNA, 22 nt, Human
ucacugcaaccucugccucccg

SEQ ID NO: 1670 - RNA, 22 nt, Human
ucaccccuccauucucucaugu

SEQ ID NO: 1671 - RNA, 22 nt, Human
ugcuauguugcccaggguggcc

SEQ ID NO: 1672 - RNA, 22 nt, Human
agcccaauccuagcacuuugag

SEQ ID NO: 1673 - RNA, 22 nt, B19 virus
aguuuugucuguaacauccuua

SEQ ID NO: 1674 - RNA, 22 nt, B19 virus
ggcagccauuuuaaguguuuca

SEQ ID NO: 1675 - RNA, 22 nt, Barmah Forest virus
gucauaguaaugugagacuaug

SEQ ID NO: 1676 - RNA, 22 nt, Barmah Forest virus
auaagauuaguuuguuauguaa

SEQ ID NO: 1677 - RNA, 22 nt, Barmah Forest virus
cuagacucgcuaguacugugau

SEQ ID NO: 1678 - RNA, 22 nt, BK polyomavirus
gugcuugauccauguccagagu

SEQ ID NO: 1679 - RNA, 22 nt, Colorado tick fever virus
ucgcaaggugaggcaguucaug

SEQ ID NO: 1680 - RNA, 22 nt, Colorado tick fever virus
cauuuguauugcacaauguacu

SEQ ID NO: 1681 - RNA, 22 nt, Dengue virus
gcuuccuccauuucagcugcca

SEQ ID NO: 1682 - RNA, 20 nt, Dobrava virus
ucaugugggguuuacuauug

SEQ ID NO: 1683 - RNA, 22 nt, Dobrava virus
aaaggaaaauuuuauguauuca

SEQ ID NO: 1684 - RNA, 22 nt, Dobrava virus
uaguaguagacuccgcaagaaa

SEQ ID NO: 1685 - RNA, 21 nt, Eastern equine encephalitis virus
acguaguucaccucguagcgu

SEQ ID NO: 1686 - RNA, 22 nt, Eastern equine encephalitis virus
augcuaauguggucaacgcugu

SEQ ID NO: 1687 - RNA, 22 nt, Eastern equine encephalitis virus
caagucacugcaaagaugcuuu

SEQ ID NO: 1688 - RNA, 22 nt, Eastern equine encephalitis virus
ggguuaaucggcgccauaggcg

SEQ ID NO: 1689 - RNA, 20 nt, Eastern equine encephalitis virus
gcucucgauguauaccacau

SEQ ID NO: 1690 - RNA, 22 nt, Eastern equine encephalitis virus
guguggauauucgguagcagca

SEQ ID NO: 1691 - RNA, 21 nt, Eastern equine encephalitis virus
uggucgcacagugucgcuggc

SEQ ID NO: 1692 - RNA, 22 nt, Eastern equine encephalitis virus
cgccuaggcggauuaggauccc

SEQ ID NO: 1693 - RNA, 22 nt, Hepatitis A virus
aaucuuaugauugguggagaau

SEQ ID NO: 1694 - RNA, 22 nt, Hepatitis A virus
ccauuuaucaucacauugauaa

SEQ ID NO: 1695 - RNA, 22 nt, Hepatitis A virus
cugauuuauagauccaagguuu

SEQ ID NO: 1696 - RNA, 22 nt, Hepatitis A virus
ugcaggaaaauuaaucaugguu

SEQ ID NO: 1697 - RNA, 22 nt, Hepatitis A virus
gaacucuugcuauacaaucucu

SEQ ID NO: 1698 - RNA, 22 nt, Hepatitis B virus
gaugaugugguauugggggcca

SEQ ID NO: 1699 - RNA, 22 nt, Hepatitis B virus
ugagucccuuuuuaccucuauu

SEQ ID NO: 1700 - RNA, 22 nt, Hepatitis B virus
gguggcuuuggggcauggacau

SEQ ID NO: 1701 - RNA, 22 nt, Hepatitis B virus
cauguccuacuguucaagccuc

SEQ ID NO: 1702 - RNA, 22 nt, Hepatitis C virus
acuccccacaacgcagcuucga

SEQ ID NO: 1703 - RNA, 22 nt, Hepatitis C virus
caaugaggguugcgggugggcg

SEQ ID NO: 1704 - RNA, 22 nt, Hepatitis C virus
cacccaaggguccugucaucca

SEQ ID NO: 1705 - RNA, 23 nt, Hepatitis C virus
gcagcccugccuccucuggacag

SEQ ID NO: 1706 - RNA, 22 nt, Hepatitis C virus
uggaccaagaccuugugggcug

SEQ ID NO: 1707 - RNA, 22 nt, Hepatitis C virus
ugucuccccguggcucucggcc

SEQ ID NO: 1708 - RNA, 22 nt, Hepatitis C virus
aacuguagucucggcgggcgug

SEQ ID NO: 1709 - RNA, 22 nt, Hepatitis C virus
aggccgcuuccguuggcauaac

SEQ ID NO: 1710 - RNA, 22 nt, Hepatitis C virus
gccgggagaagguuggcgagag

SEQ ID NO: 1711 - RNA, 22 nt, Hepatitis C virus
acgacugguuccacagccacgg

SEQ ID NO: 1712 - RNA, 22 nt, Hepatitis C virus
aguaccucuucaacugggcagu

SEQ ID NO: 1713 - RNA, 22 nt, Hepatitis C virus
cagcccgcgucauagcacucac

SEQ ID NO: 1714 - RNA, 22 nt, Hepatitis C virus
gcgcucccgacaagcagaucga

SEQ ID NO: 1715 - RNA, 22 nt, Hepatitis C virus
ucgaucugcuugucgggagcgc

SEQ ID NO: 1716 - RNA, 22 nt, Hepatitis C virus
gcacacuccggggugugucccu

SEQ ID NO: 1717 - RNA, 22 nt, Hepatitis C virus
uccuccugcuccugcuggcguu

SEQ ID NO: 1718 - RNA, 22 nt, Hepatitis C virus
ucuguccagaggaggcagggcu

SEQ ID NO: 1719 - RNA, 22 nt, Hepatitis C virus
uuguucuaucuaucccggccau

SEQ ID NO: 1720 - RNA, 21 nt, Hepatitis D virus
cuagagagauuuguggguccc

SEQ ID NO: 1721 - RNA, 22 nt, Hepatitis D virus
agggagagccacuuuucucucg

SEQ ID NO: 1722 - RNA, 22 nt, Hepatitis D virus
acugguccccaauguucaaagu

SEQ ID NO: 1723 - RNA, 22 nt, Hepatitis D virus
cuagagagauuuguggguccca

SEQ ID NO: 1724 - RNA, 22 nt, Hepatitis E virus
agagauuguggcgcucugggcc

SEQ ID NO: 1725 - RNA, 22 nt, Hepatitis E virus
caccgccggaaccgccgcugcg

SEQ ID NO: 1726 - RNA, 23 nt, Hepatitis E virus
ucgcuacauuaaccaaggucaca

SEQ ID NO: 1727 - RNA, 22 nt, Hepatitis E virus
ugaccuugguccagucgagcga

SEQ ID NO: 1728 - RNA, 22 nt, Hepatitis E virus
caccgcccggucagccgucugg

SEQ ID NO: 1729 - RNA, 23 nt, Hepatitis E virus
ccagacggcugaccgggcggugg

SEQ ID NO: 1730 - RNA, 22 nt, Hepatitis E virus
cgcagcggcgguuccggcggug

SEQ ID NO: 1731 - RNA, 22 nt, Hepatitis E virus
gaccuugguuaauguagcgacc

SEQ ID NO: 1732 - RNA, 22 nt, Human
aaaaacacaacugucuuucucu

SEQ ID NO: 1733 - RNA, 22 nt, Human
aaaaaccauugucuucagucuc

SEQ ID NO: 1734 - RNA, 22 nt, Human
aaaaacugguaacuauucccca

SEQ ID NO: 1735 - RNA, 22 nt, Human
aaaaacuguaauuacuuuugca

SEQ ID NO: 1736 - RNA, 22 nt, Human
aaaaagacagaggaugaggcag

SEQ ID NO: 1737 - RNA, 22 nt, Human
aaaaagagaaaugcucuagucc

SEQ ID NO: 1738 - RNA, 22 nt, Human
aaaaagcuuaaaugagcaguuc

SEQ ID NO: 1739 - RNA, 22 nt, Human
aaaaagucugcaaaggagguug

SEQ ID NO: 1740 - RNA, 22 nt, Human
aaaaauagaaggauugacugag

SEQ ID NO: 1741 - RNA, 22 nt, Human
aaaaauagcuucucuugucccu

SEQ ID NO: 1742 - RNA, 22 nt, Human
aaaaaugaaacggcugguuggc

SEQ ID NO: 1743 - RNA, 21 nt, Human
aaaaaugaaguuguucaggaa

SEQ ID NO: 1744 - RNA, 22 nt, Human
aaaaauguuaucuacuguccga

SEQ ID NO: 1745 - RNA, 22 nt, Human
aaaacacacuggaccaauuuaa

SEQ ID NO: 1746 - RNA, 22 nt, Human
aaaacagaggugccugggccca

SEQ ID NO: 1747 - RNA, 22 nt, Human
aaaacaggaguuuugguaggcu

SEQ ID NO: 1748 - RNA, 22 nt, Human
aaaacaggugucagcaaacuau

SEQ ID NO: 1749 - RNA, 22 nt, Human
aaaacauugaauugcacacuau

SEQ ID NO: 1750 - RNA, 22 nt, Human
aaaaccaaguuuuccuuagucu

SEQ ID NO: 1751 - RNA, 22 nt, Human
aaaaccacaauuauuuuugcac

SEQ ID NO: 1752 - RNA, 22 nt, Human
aaaaccaggcguuuccuauuau

SEQ ID NO: 1753 - RNA, 22 nt, Human
aaaacccuucugcagacucuga

SEQ ID NO: 1754 - RNA, 22 nt, Human
aaaaccucaguucugcucuuaa

SEQ ID NO: 1755 - RNA, 22 nt, Human
aaaaccugauugaauucuauuu

SEQ ID NO: 1756 - RNA, 22 nt, Human
aaaaccugugaauaguuaacuc

SEQ ID NO: 1757 - RNA, 22 nt, Human
aaaaccuucagguuuggaguuu

SEQ ID NO: 1758 - RNA, 22 nt, Human
aaaacguuaugcauuguuuauc

SEQ ID NO: 1759 - RNA, 22 nt, Human
aaaacugaaccuugagaucuuu

SEQ ID NO: 1760 - RNA, 22 nt, Human
aaaacugagguuuccugaagaa

SEQ ID NO: 1761 - RNA, 22 nt, Human
aaaacuuucagggauacagaaa

SEQ ID NO: 1762 - RNA, 22 nt, Human
aaaagagcuugguugauuuugc

SEQ ID NO: 1763 - RNA, 22 nt, Human
aaaagaggagugguuuaugaca

SEQ ID NO: 1764 - RNA, 22 nt, Human
aaaagagucuuaggcagucaua

SEQ ID NO: 1765 - RNA, 22 nt, Human
aaaagaugaaauggugucuugg

SEQ ID NO: 1766 - RNA, 22 nt, Human
aaaagcaaguugccuagguuga

SEQ ID NO: 1767 - RNA, 22 nt, Human
aaaagcaauugcaguucuugcc

SEQ ID NO: 1768 - RNA, 22 nt, Human
aaaagccaagguccucuucaga

SEQ ID NO: 1769 - RNA, 22 nt, Human
aaaagccaugcauaccuaagag

SEQ ID NO: 1770 - RNA, 22 nt, Human
aaaaggaggcaaacagccuaga

SEQ ID NO: 1771 - RNA, 22 nt, Human
aaaaggaggucacuuuauuccu

SEQ ID NO: 1772 - RNA, 22 nt, Human
aaaaggcauggagguugauagu

SEQ ID NO: 1773 - RNA, 22 nt, Human
aaaaggcauuuugucaaccaua

SEQ ID NO: 1774 - RNA, 22 nt, Human
aaaaggcuagcuaguaacagaa

SEQ ID NO: 1775 - RNA, 22 nt, Human
aaaaggcuuggaaccuuucccu

SEQ ID NO: 1776 - RNA, 22 nt, Human
aaaagggacuacucucagcucc

SEQ ID NO: 1777 - RNA, 22 nt, Human
aaagcuggcuuuuacaggggcu

SEQ ID NO: 1778 - RNA, 22 nt, Human
aaagcuguuguauggcccuugg

SEQ ID NO: 1779 - RNA, 22 nt, Human
aaagcuuaggauagggaauaua

SEQ ID NO: 1780 - RNA, 22 nt, Human
aaagcuucuauucacuuacuug

SEQ ID NO: 1781 - RNA, 22 nt, Human
aaagcuuucuagcuauguucua

SEQ ID NO: 1782 - RNA, 22 nt, Human
aaagcuuugcuggaaggaagag

SEQ ID NO: 1783 - RNA, 22 nt, Human
aaagcuuuucaguauguucaug

SEQ ID NO: 1784 - RNA, 22 nt, Human
aaaggaagaucuauacacccca

SEQ ID NO: 1785 - RNA, 22 nt, Human
aaaggacucagacugaagggag

SEQ ID NO: 1786 - RNA, 22 nt, Human
aaaggacugaugcugaguaccu

SEQ ID NO: 1787 - RNA, 22 nt, Human
aaaggagaaaacauacaggacu

SEQ ID NO: 1788 - RNA, 22 nt, Human
aaaggagacagucuuaccugga

SEQ ID NO: 1789 - RNA, 22 nt, Human
aaaggagauaaagggcccuuca

SEQ ID NO: 1790 - RNA, 22 nt, Human
aaaggaggccacauggcuagga

SEQ ID NO: 1791 - RNA, 22 nt, Human
aaaggaguuacucauaaagcuu

SEQ ID NO: 1792 - RNA, 22 nt, Human
aaaggcaaaggcugguauggcu

SEQ ID NO: 1793 - RNA, 20 nt, Human
aaaggcacagcaacagagcu

SEQ ID NO: 1794 - RNA, 22 nt, Human
aaaggcacuggauagcugggga

SEQ ID NO: 1795 - RNA, 22 nt, Human
aaaggcaggcuuucacaucuca

SEQ ID NO: 1796 - RNA, 22 nt, Human
aaaggcauaggauguggaaucg

SEQ ID NO: 1797 - RNA, 22 nt, Human
aaaggcaucuagccaaguugag

SEQ ID NO: 1798 - RNA, 22 nt, Human
aaaggcauggauagugaauuca

SEQ ID NO: 1799 - RNA, 22 nt, Human
aaaggcaugugggcugguugua

SEQ ID NO: 1800 - RNA, 22 nt, Human
aaaggccaagcaugagguggac

SEQ ID NO: 1801 - RNA, 22 nt, Human
aaaggccaccaacaugaagcau

SEQ ID NO: 1802 - RNA, 22 nt, Human
aaaggccagguuggcugguauu

SEQ ID NO: 1803 - RNA, 22 nt, Human
aaaggcccacagucagucuacc

SEQ ID NO: 1804 - RNA, 22 nt, Human
aaaggccuugagcugggugcca

SEQ ID NO: 1805 - RNA, 22 nt, Human
aaaggcuaugagauagaagaua

SEQ ID NO: 1806 - RNA, 22 nt, Human
aaaggcuaugauaguccagugg

SEQ ID NO: 1807 - RNA, 22 nt, Human
aaaggcuauucagggacuugcc

SEQ ID NO: 1808 - RNA, 22 nt, Human
aaaggcucaacagcuguacuuu

SEQ ID NO: 1809 - RNA, 22 nt, Human
aaaggcucagaaucggcagacc

SEQ ID NO: 1810 - RNA, 22 nt, Human
aaaggcuccuucucccaugacc

SEQ ID NO: 1811 - RNA, 22 nt, Human
aaaggcugccagguaaaauauu

SEQ ID NO: 1812 - RNA, 22 nt, Human
aaaggcuuaauguuguuguaau

SEQ ID NO: 1813 - RNA, 22 nt, Human
aaaggcuucacuuauuuauuuu

SEQ ID NO: 1814 - RNA, 22 nt, Human
aaaggcuucagugaguggguau

SEQ ID NO: 1815 - RNA, 22 nt, Human
aaaggcuucggaucagaaggua

SEQ ID NO: 1816 - RNA, 22 nt, Human
aaaggcuucuauuggacguugc

SEQ ID NO: 1817 - RNA, 22 nt, Human
aaaggcuucucagaaaggccuu

SEQ ID NO: 1818 - RNA, 22 nt, Human
aaaggcuugacuagaagggaga

SEQ ID NO: 1819 - RNA, 22 nt, Human
aaaggcuugcgauuccuuguaa

SEQ ID NO: 1820 - RNA, 22 nt, Human
aaaggcuugguauuuuggaguu

SEQ ID NO: 1821 - RNA, 22 nt, Human
aaaggcuuguccaguaagggga

SEQ ID NO: 1822 - RNA, 22 nt, Human
aaaggcuuguuugaggacuggu

SEQ ID NO: 1823 - RNA, 22 nt, Human
aaaggcuuuaaagaaccagaac

SEQ ID NO: 1824 - RNA, 22 nt, Human
aaaggcuuuugguauauaggag

SEQ ID NO: 1825 - RNA, 22 nt, Human
aaacagcuccuuaguuuccauc

SEQ ID NO: 1826 - RNA, 22 nt, Human
aaacagcugcaguacacggccu

SEQ ID NO: 1827 - RNA, 22 nt, Human
aaacagcugggagguagaggcg

SEQ ID NO: 1828 - RNA, 22 nt, Human
aaacagcuuucagaaucucuca

SEQ ID NO: 1829 - RNA, 22 nt, Human
aaacaggcuugcaacauguuuu

SEQ ID NO: 1830 - RNA, 22 nt, Human
aaacaggcuuuuaagucaauag

SEQ ID NO: 1831 - RNA, 22 nt, Human
aaacaguacucgauuuuuguag

SEQ ID NO: 1832 - RNA, 22 nt, Human
aaacagugccaggcagaugcca

SEQ ID NO: 1833 - RNA, 22 nt, Human
aaacagugccuggcauggagga

SEQ ID NO: 1834 - RNA, 22 nt, Human
aaacaguguuuuuaugauuuau

SEQ ID NO: 1835 - RNA, 22 nt, Human
aaacaguuaauugcuuucaguu

SEQ ID NO: 1836 - RNA, 22 nt, Human
aaacaguuguuauuuuuauaug

SEQ ID NO: 1837 - RNA, 22 nt, Human
aaacauagauaauagauagaug

SEQ ID NO: 1838 - RNA, 22 nt, Human
aaacaucuacuguaggcuggag

SEQ ID NO: 1839 - RNA, 22 nt, Human
aaacaucuauuaugugcugagc

SEQ ID NO: 1840 - RNA, 22 nt, Human
aaacaucuggaggccccguuug

SEQ ID NO: 1841 - RNA, 22 nt, Human
aaacaucugguuaccuaggguc

SEQ ID NO: 1842 - RNA, 22 nt, Human
aaacaucuugcucugauuggua

SEQ ID NO: 1843 - RNA, 22 nt, Human
aaacaucuuucuauugcaaguu

SEQ ID NO: 1844 - RNA, 22 nt, Human
aaacaugaguuaaaaguaacug

SEQ ID NO: 1845 - RNA, 18 nt, Human
aaacauggcuuaaaggcu

SEQ ID NO: 1846 - RNA, 22 nt, Human
aaacauguaauucugcuuaaga

SEQ ID NO: 1847 - RNA, 22 nt, Human
aaacauguuuucugaauauuuu

SEQ ID NO: 1848 - RNA, 22 nt, Human
aaacauucaaagcaggaugugu

SEQ ID NO: 1849 - RNA, 22 nt, Human
aaacauucacauuugcuaguaa

SEQ ID NO: 1850 - RNA, 20 nt, Human
aaacauucauguacaaguga

SEQ ID NO: 1851 - RNA, 22 nt, Human
aaacauuccauuucuauguaag

SEQ ID NO: 1852 - RNA, 22 nt, Human
aaacauucucagcccugcuugc

SEQ ID NO: 1853 - RNA, 22 nt, Human
aaacauugaccucauccuggca

SEQ ID NO: 1854 - RNA, 22 nt, Human
aaacauugagcacuugcuauuu

SEQ ID NO: 1855 - RNA, 22 nt, Human
aaacauuguacauucuguagcu

SEQ ID NO: 1856 - RNA, 22 nt, Human
aaacauuguuaugauaaauuac

SEQ ID NO: 1857 - RNA, 22 nt, Human
aaacauuugcaacucgguuugg

SEQ ID NO: 1858 - RNA, 22 nt, Human
aaaccacuuauaucgugauuug

SEQ ID NO: 1859 - RNA, 22 nt, Human
aaaccaucagauaauucauacu

SEQ ID NO: 1860 - RNA, 22 nt, Human
aaaccauggaguaaguucacau

SEQ ID NO: 1861 - RNA, 22 nt, Human
aaaccauuagguuuuaucuacu

SEQ ID NO: 1862 - RNA, 22 nt, Human
aaaccauugcaucuuucuuaau

SEQ ID NO: 1863 - RNA, 22 nt, Human
aaaccauuugaauuauuacuga

SEQ ID NO: 1864 - RNA, 22 nt, Human
aaacccagagacuagaaagacc

SEQ ID NO: 1865 - RNA, 22 nt, Human
aaacccugcucuuauggaacuu

SEQ ID NO: 1866 - RNA, 22 nt, Human
aaaccuagguuuccucauucag

SEQ ID NO: 1867 - RNA, 22 nt, Human
aaaccucugugcuaugacaccc

SEQ ID NO: 1868 - RNA, 22 nt, Human
aaaccucuucucaagauuucug

SEQ ID NO: 1869 - RNA, 22 nt, Human
aaaccugaaguacguuacauaa

SEQ ID NO: 1870 - RNA, 22 nt, Human
aaaccuguggccacuaaauuug

SEQ ID NO: 1871 - RNA, 22 nt, Human
aaaccuguuaauagagcgaugc

SEQ ID NO: 1872 - RNA, 22 nt, Human
aaaccuucacaucuacucuaca

SEQ ID NO: 1873 - RNA, 22 nt, Human
aaaccuuuaccagacuagcaag

SEQ ID NO: 1874 - RNA, 22 nt, Human
aaaccuuugugugucugugccu

SEQ ID NO: 1875 - RNA, 22 nt, Human
aaaccuuuucagcugaauggag

SEQ ID NO: 1876 - RNA, 22 nt, Human
aaacuaaaccuggcuuaguaag

SEQ ID NO: 1877 - RNA, 23 nt, Human
aaacuacaacgccaggcacugag

SEQ ID NO: 1878 - RNA, 22 nt, Human
aaacuacaucucauggaugagg

SEQ ID NO: 1879 - RNA, 22 nt, Human
aaacuacugaugccugggcccu

SEQ ID NO: 1880 - RNA, 22 nt, Human
aaacuagaugauuaugaagcau

SEQ ID NO: 1881 - RNA, 22 nt, Human
aaacuaucaaguguugggggag

SEQ ID NO: 1882 - RNA, 22 nt, Human
aaacucaaguuucuuaauguca

SEQ ID NO: 1883 - RNA, 22 nt, Human
aaacucagauguggugaagacc

SEQ ID NO: 1884 - RNA, 22 nt, Human
aaacuccagugaauacuagaau

SEQ ID NO: 1885 - RNA, 22 nt, Human
aaacucuaguaaaauguauuca

SEQ ID NO: 1886 - RNA, 22 nt, Human
aaauuauuuucagaauggagaa

SEQ ID NO: 1887 - RNA, 22 nt, Human
aaauucacucuguuccucaugg

SEQ ID NO: 1888 - RNA, 22 nt, Human
aaauucaguguucuucccguaa

SEQ ID NO: 1889 - RNA, 22 nt, Human
aaauucaguuucuguccuggga

SEQ ID NO: 1890 - RNA, 22 nt, Human
aaauucaguuuuaauaaucacu

SEQ ID NO: 1891 - RNA, 22 nt, Human
aaauucauauguugaaaugcua

SEQ ID NO: 1892 - RNA, 22 nt, Human
aaauuccagcaacaccuuuuua

SEQ ID NO: 1893 - RNA, 22 nt, Human
aaauucuaaggucacaauguug

SEQ ID NO: 1894 - RNA, 22 nt, Human
aaauucugcaauuugacaagau

SEQ ID NO: 1895 - RNA, 22 nt, Human
aaauucuggccuaucacaguga

SEQ ID NO: 1896 - RNA, 22 nt, Human
aaauucuguccugaaugccauu

SEQ ID NO: 1897 - RNA, 22 nt, Human
aaauugcaaccaggucucuguc

SEQ ID NO: 1898 - RNA, 22 nt, Human
aaauugcagguaggugggugau

SEQ ID NO: 1899 - RNA, 22 nt, Human
aaauugcauuuuaaagguagau

SEQ ID NO: 1900 - RNA, 22 nt, Human
aaauugcgcacauuucuccguu

SEQ ID NO: 1901 - RNA, 22 nt, Human
aaauuggcaguucagggaauua

SEQ ID NO: 1902 - RNA, 19 nt, Human
aaauuggcaugcugaccuc

SEQ ID NO: 1903 - RNA, 22 nt, Human
aaauuguauauuccauuuguau

SEQ ID NO: 1904 - RNA, 22 nt, Human
aaauugucucuauuuugauucg

SEQ ID NO: 1905 - RNA, 20 nt, Human
aaauuuaggaaauuuuacgc

SEQ ID NO: 1906 - RNA, 22 nt, Human
aaauuucuaagucaagaagaac

SEQ ID NO: 1907 - RNA, 22 nt, Human
aaauuucuugaggcucucuagc

SEQ ID NO: 1908 - RNA, 22 nt, Human
aaauuugucaacuucauauguu

SEQ ID NO: 1909 - RNA, 22 nt, Human
aaauuuuccugguaaagaugga

SEQ ID NO: 1910 - RNA, 21 nt, Human
aaauuuucuuggcuguagugu

SEQ ID NO: 1911 - RNA, 22 nt, Human
aacaaacauuaccuggugcugg

SEQ ID NO: 1912 - RNA, 22 nt, Human
aacaaagaugggugggaaagag

SEQ ID NO: 1913 - RNA, 22 nt, Human
aacaaaguagcugcuguucuua

SEQ ID NO: 1914 - RNA, 22 nt, Human
aacaaaugauaccaguucucaa

SEQ ID NO: 1915 - RNA, 22 nt, Human
aacaaaugauuguugguuggag

SEQ ID NO: 1916 - RNA, 22 nt, Human
aacaaauguaaaaugcagaugc

SEQ ID NO: 1917 - RNA, 22 nt, Human
aacaaauguguuuuguaauuaa

SEQ ID NO: 1918 - RNA, 22 nt, Human
aacaagauagagcucuugccuu

SEQ ID NO: 1919 - RNA, 22 nt, Human
aacaagaugggagaaggaccuc

SEQ ID NO: 1920 - RNA, 22 nt, Human
aacaaguaaguuuauauauauu

SEQ ID NO: 1921 - RNA, 22 nt, Human
aacaagucuuugguuuuggcua

SEQ ID NO: 1922 - RNA, 17 nt, Human
aacaauaggauguguau

SEQ ID NO: 1923 - RNA, 22 nt, Human
aacaaucuccaagaccaaugug

SEQ ID NO: 1924 - RNA, 22 nt, Human
aacaaugaccacacaauguacu

SEQ ID NO: 1925 - RNA, 22 nt, Human
aacaaugcacuaucguaagugg

SEQ ID NO: 1926 - RNA, 22 nt, Human
aacaaugccaacagcaugcugg

SEQ ID NO: 1927 - RNA, 22 nt, Human
aacaauguucuuuuagcuugaa

SEQ ID NO: 1928 - RNA, 22 nt, Human
aacaauuagacugacgguauua

SEQ ID NO: 1929 - RNA, 22 nt, Human
aacaauugacacuucauuguga

SEQ ID NO: 1930 - RNA, 22 nt, Human
aacacaaaaauucucaggggca

SEQ ID NO: 1931 - RNA, 22 nt, Human
aacacagaagugccaagagcca

SEQ ID NO: 1932 - RNA, 22 nt, Human
aacacagaguauuugaagcauu

SEQ ID NO: 1933 - RNA, 22 nt, Human
aacacaggaggcuauguuuucu

SEQ ID NO: 1934 - RNA, 22 nt, Human
aacacagggcagcugcugggaa

SEQ ID NO: 1935 - RNA, 22 nt, Human
aacacaggggcguggcucuuac

SEQ ID NO: 1936 - RNA, 22 nt, Human
aacacagguucauucugugagg

SEQ ID NO: 1937 - RNA, 22 nt, Human
aacacaguuaguaagggaaaua

SEQ ID NO: 1938 - RNA, 22 nt, Human
aacacaguuucucuaugagagu

SEQ ID NO: 1939 - RNA, 22 nt, Human
aacacauagacguuugauauca

SEQ ID NO: 1940 - RNA, 22 nt, Human
aacacauauuuauauaugcaca

SEQ ID NO: 1941 - RNA, 21 nt, Human
aacacauccagaguauuugac

SEQ ID NO: 1942 - RNA, 22 nt, Human
aacacauugccagagaucagca

SEQ ID NO: 1943 - RNA, 23 nt, Human
aacacauugcuaauuacauucaa

SEQ ID NO: 1944 - RNA, 22 nt, Human
aacacauuuugccuaggcaaua

SEQ ID NO: 1945 - RNA, 22 nt, Human
aacaccuugcagggauuaugac

SEQ ID NO: 1946 - RNA, 22 nt, Human
aacacuaaaggucaguuagaag

SEQ ID NO: 1947 - RNA, 22 nt, Human
aacacucaauuuacaaacucug

SEQ ID NO: 1948 - RNA, 22 nt, Human
aacacuccguggaggcaugcag

SEQ ID NO: 1949 - RNA, 22 nt, Human
aacacugaaaugucuuaagauu

SEQ ID NO: 1950 - RNA, 22 nt, Human
aacacugagaacaauacagagu

SEQ ID NO: 1951 - RNA, 22 nt, Human
aacacugagaggggaguggcac

SEQ ID NO: 1952 - RNA, 22 nt, Human
aacacugaguaucagaguuggg

SEQ ID NO: 1953 - RNA, 22 nt, Human
aacacugauggaaaguauguuu

SEQ ID NO: 1954 - RNA, 22 nt, Human
aacacugcugcuggguucugug

SEQ ID NO: 1955 - RNA, 22 nt, Human
aacacugguuuggcauuagaug

SEQ ID NO: 1956 - RNA, 22 nt, Human
aacacuguacuggaagauggac

SEQ ID NO: 1957 - RNA, 22 nt, Human
aacacugugcaguguaaugcug

SEQ ID NO: 1958 - RNA, 22 nt, Human
aacacugugcuccccaggcugu

SEQ ID NO: 1959 - RNA, 22 nt, Human
aacacuucaagcagaagguugg

SEQ ID NO: 1960 - RNA, 22 nt, Human
aacacuucucaucacugcaagc

SEQ ID NO: 1961 - RNA, 22 nt, Human
aacacuucuguugauaauaagc

SEQ ID NO: 1962 - RNA, 23 nt, Human
aacacuugcaugaacagcuacac

SEQ ID NO: 1963 - RNA, 22 nt, Human
aacacuuuggaauagagauagg

SEQ ID NO: 1964 - RNA, 22 nt, Human
aacacuuuuuccuccugucugg

SEQ ID NO: 1965 - RNA, 22 nt, Human
aacagaaaucauuuagggcucu

SEQ ID NO: 1966 - RNA, 22 nt, Human
aacagaaggggguauuuacauu

SEQ ID NO: 1967 - RNA, 22 nt, Human
aacagacagaaaaaugugaucu

SEQ ID NO: 1968 - RNA, 22 nt, Human
aacagagcugaccagugagggc

SEQ ID NO: 1969 - RNA, 22 nt, Human
aacagaggauguuugaaauuca

SEQ ID NO: 1970 - RNA, 22 nt, Human
aacagauuugugaagcuacuca

SEQ ID NO: 1971 - RNA, 22 nt, Human
aacagcagaaacugcaagcuac

SEQ ID NO: 1972 - RNA, 22 nt, Human
aacagcagggaaauuccaaguc

SEQ ID NO: 1973 - RNA, 22 nt, Human
aacagcagggaugacauggcca

SEQ ID NO: 1974 - RNA, 22 nt, Human
aacagcagggggaccugcuggu

SEQ ID NO: 1975 - RNA, 22 nt, Human
aagaaaugcagaaaugugcugg

SEQ ID NO: 1976 - RNA, 22 nt, Human
aagaaauuaaggaaugcaacga

SEQ ID NO: 1977 - RNA, 17 nt, Human
aagaacacucaauagca

SEQ ID NO: 1978 - RNA, 22 nt, Human
aagaacauaacagaagcugugu

SEQ ID NO: 1979 - RNA, 22 nt, Human
aagaacaugaaccucuucuaac

SEQ ID NO: 1980 - RNA, 22 nt, Human
aagaacaugggugugggcauuc

SEQ ID NO: 1981 - RNA, 22 nt, Human
aagaacauugauauugucuaug

SEQ ID NO: 1982 - RNA, 22 nt, Human
aagaaccaaaaugaagcuaggu

SEQ ID NO: 1983 - RNA, 22 nt, Human
aagaacugugcuccaggcucca

SEQ ID NO: 1984 - RNA, 21 nt, Human
aagaagcaauuuauuggaagg

SEQ ID NO: 1985 - RNA, 22 nt, Human
aagaagcauucuuucauugguu

SEQ ID NO: 1986 - RNA, 22 nt, Human
aagaagcugcgugguaugugaa

SEQ ID NO: 1987 - RNA, 22 nt, Human
aagaaggccucugcccuggcuu

SEQ ID NO: 1988 - RNA, 22 nt, Human
aagaaggccugguagacgucuu

SEQ ID NO: 1989 - RNA, 22 nt, Human
aagaaguuaaauaaauggacca

SEQ ID NO: 1990 - RNA, 18 nt, Human
aagaaguuggccaaagag

SEQ ID NO: 1991 - RNA, 22 nt, Human
aagaauaaguagaugggagaag

SEQ ID NO: 1992 - RNA, 22 nt, Human
aagaauacguaucaacaauggu

SEQ ID NO: 1993 - RNA, 22 nt, Human
aagaauaucuguuuuauuuagg

SEQ ID NO: 1994 - RNA, 22 nt, Human
aagaauauuuccugcacuuggg

SEQ ID NO: 1995 - RNA, 22 nt, Human
aacauugcaaauaagcuugcag

SEQ ID NO: 1996 - RNA, 22 nt, Human
aacauugcagcuuaauugcagg

SEQ ID NO: 1997 - RNA, 22 nt, Human
aacauugcauucucuaugagau

SEQ ID NO: 1998 - RNA, 22 nt, Human
aacauuggauauuuauuaaaag

SEQ ID NO: 1999 - RNA, 22 nt, Human
aacauuuauauggguucaugaa

SEQ ID NO: 2000 - RNA, 22 nt, Human
aacauuuauucuaauucuggga

SEQ ID NO: 2001 - RNA, 22 nt, Human
aacauuucagcaaauaagaaca

SEQ ID NO: 2002 - RNA, 22 nt, Human
aacauuucagcaccugauuccu

SEQ ID NO: 2003 - RNA, 22 nt, Human
aacauuugagaaaaauacucuu

SEQ ID NO: 2004 - RNA, 22 nt, Human
aacauuuguacuaaagaaguuc

SEQ ID NO: 2005 - RNA, 22 nt, Human
aaccacuggucugagguacaag

SEQ ID NO: 2006 - RNA, 22 nt, Human
aaccagacucuccaaaggcaaa

SEQ ID NO: 2007 - RNA, 23 nt, Human
aaccagauaaauggcuccagggc

SEQ ID NO: 2008 - RNA, 22 nt, Human
aaccagcacugcuggggccugc

SEQ ID NO: 2009 - RNA, 22 nt, Human
aaccagcuccucaccccauugu

SEQ ID NO: 2010 - RNA, 19 nt, Human
aaccaggaacuaaagcaga

SEQ ID NO: 2011 - RNA, 19 nt, Human
aaccaggacaaggggcugg

SEQ ID NO: 2012 - RNA, 22 nt, Human
aaccaggagauuaaagaaaggu

SEQ ID NO: 2013 - RNA, 22 nt, Human
aaccaggauuuaagauucuaga

SEQ ID NO: 2014 - RNA, 22 nt, Human
aaccaggugacucauggugagc

SEQ ID NO: 2015 - RNA, 22 nt, Human
aaccagucccagugagaugaac

SEQ ID NO: 2016 - RNA, 22 nt, Human
aaccaguuggcaaccagcaguu

SEQ ID NO: 2017 - RNA, 22 nt, Human
aaccauggauuucaguucaccu

SEQ ID NO: 2018 - RNA, 22 nt, Human
aaccauugauacaugcaacaau

SEQ ID NO: 2019 - RNA, 22 nt, Human
aacccacucuaccuggcuccau

SEQ ID NO: 2020 - RNA, 22 nt, Human
aacccaggaggcagaggcugca

SEQ ID NO: 2021 - RNA, 22 nt, Human
aacccaggaguuggaggcugug

SEQ ID NO: 2022 - RNA, 22 nt, Human
aacccaggguggagguugcagu

SEQ ID NO: 2023 - RNA, 22 nt, Human
aacccauguuggaagcuuauca

SEQ ID NO: 2024 - RNA, 22 nt, Human
aaccccaaaaccucugaagugg

SEQ ID NO: 2025 - RNA, 22 nt, Human
aaccccgcucaggcugggugag

SEQ ID NO: 2026 - RNA, 22 nt, Human
aacccuggagaaggcuuuggau

SEQ ID NO: 2027 - RNA, 22 nt, Human
aaccuaggacuauagauaucau

SEQ ID NO: 2028 - RNA, 22 nt, Human
aaccucaggcucucuggacaau

SEQ ID NO: 2029 - RNA, 22 nt, Human
aaccucuacauccaggaaagga

SEQ ID NO: 2030 - RNA, 22 nt, Human
aaccucucccuuugugucccug

SEQ ID NO: 2031 - RNA, 22 nt, Human
aaccugaaacuacauucuugau

SEQ ID NO: 2032 - RNA, 22 nt, Human
aaccugaaaguaguaaaagcug

SEQ ID NO: 2033 - RNA, 22 nt, Human
aaccugagauaauaggagagua

SEQ ID NO: 2034 - RNA, 20 nt, Human
aaccugaggcaguguuccag

SEQ ID NO: 2035 - RNA, 22 nt, Human
aaccugcauguuucuaaaagca

SEQ ID NO: 2036 - RNA, 22 nt, Human
aaccugcuuucucagagaaggg

SEQ ID NO: 2037 - RNA, 22 nt, Human
aaccuggaggacugcaauccau

SEQ ID NO: 2038 - RNA, 19 nt, Human
aaccuuuagaucauucucc

SEQ ID NO: 2039 - RNA, 22 nt, Human
aaccuuuugcaagugccuugac

SEQ ID NO: 2040 - RNA, 22 nt, Human
aacgaagcuuaacuuuucugag

SEQ ID NO: 2041 - RNA, 22 nt, Human
aacgaauagggauuuuucuaac

SEQ ID NO: 2042 - RNA, 23 nt, Human
aacgacagcuacaggcaucccac

SEQ ID NO: 2043 - RNA, 22 nt, Human
aacgagcucuccuucuuucauu

SEQ ID NO: 2044 - RNA, 22 nt, Human
aacgugcaccaggaggucauga

SEQ ID NO: 2045 - RNA, 22 nt, Human
aacgugcauuaggaccucucca

SEQ ID NO: 2046 - RNA, 22 nt, Human
aacuaaaacugguuuguucucu

SEQ ID NO: 2047 - RNA, 22 nt, Human
aacuaaaagugugucucuugua

SEQ ID NO: 2048 - RNA, 22 nt, Human
aacuaaaccaugacauuauauu

SEQ ID NO: 2049 - RNA, 22 nt, Human
aacuaaaggcuguugcagggaa

SEQ ID NO: 2050 - RNA, 22 nt, Human
aacuaacagucauuaaaagaac

SEQ ID NO: 2051 - RNA, 22 nt, Human
aacuacagcucuugucuuucug

SEQ ID NO: 2052 - RNA, 22 nt, Human
aacuacaguauguccaaagaau

SEQ ID NO: 2053 - RNA, 22 nt, Human
aacuacagugggcagaggcaau

SEQ ID NO: 2054 - RNA, 22 nt, Human
aacuacaucacccuauuucugu

SEQ ID NO: 2055 - RNA, 20 nt, Human
aacuagaaagcacccaugga

SEQ ID NO: 2056 - RNA, 19 nt, Human
aacuagaaagguuuugaga

SEQ ID NO: 2057 - RNA, 22 nt, Human
aacuagagcuuccagcuucuug

SEQ ID NO: 2058 - RNA, 22 nt, Human
aacuaguaaaagcaacaguaua

SEQ ID NO: 2059 - RNA, 22 nt, Human
aacuauaaugggguuaggaaau

SEQ ID NO: 2060 - RNA, 22 nt, Human
aacuauacauauuuacauagac

SEQ ID NO: 2061 - RNA, 22 nt, Human
aacuauauaaucugaaagugaa

SEQ ID NO: 2062 - RNA, 20 nt, Human
aacuaugaauagaagagauu

SEQ ID NO: 2063 - RNA, 22 nt, Human
aacuauuuuuggagcuaacucu

SEQ ID NO: 2064 - RNA, 22 nt, Human
aacucacuuuguggcuucugaa

SEQ ID NO: 2065 - RNA, 20 nt, Human
aacucagagaugaaaaagac

SEQ ID NO: 2066 - RNA, 22 nt, Human
aacucaguucuuuccacaaugc

SEQ ID NO: 2067 - RNA, 22 nt, Human
aacuccagugucagcugcaaug

SEQ ID NO: 2068 - RNA, 22 nt, Human
aacuccauuucccugccuccug

SEQ ID NO: 2069 - RNA, 22 nt, Human
aacuccucacugccucuggcac

SEQ ID NO: 2070 - RNA, 23 nt, Human
aacuccugaaucgugagccaucu

SEQ ID NO: 2071 - RNA, 22 nt, Human
aacuccuguucuaugacaagag

SEQ ID NO: 2072 - RNA, 22 nt, Human
aacucugcaaccuauguagacc

SEQ ID NO: 2073 - RNA, 23 nt, Human
aacucuggcuagcauagaauaga

SEQ ID NO: 2074 - RNA, 22 nt, Human
aacucugguuucagacucacuu

SEQ ID NO: 2075 - RNA, 22 nt, Human
aacucuugggcugcaugcuguu

SEQ ID NO: 2076 - RNA, 22 nt, Human
aacucuuugaacagugaggcua

SEQ ID NO: 2077 - RNA, 22 nt, Human
aacucuuuguggacauuaaauu

SEQ ID NO: 2078 - RNA, 22 nt, Human
aacugaaacguauuuuugagau

SEQ ID NO: 2079 - RNA, 22 nt, Human
aacugaaaguuucaccugaggu

SEQ ID NO: 2080 - RNA, 22 nt, Human
aacugaacauaaugaaagccaa

SEQ ID NO: 2081 - RNA, 22 nt, Human
aacugagacacgaacuaugauu

SEQ ID NO: 2082 - RNA, 23 nt, Human
aacugagauaauguauguaaagc

SEQ ID NO: 2083 - RNA, 22 nt, Human
aacugagauuacaagagacauu

SEQ ID NO: 2084 - RNA, 22 nt, Human
aacugaggaauaacugaguugc

SEQ ID NO: 2085 - RNA, 22 nt, Human
aacugaggccaagugaggaaag

SEQ ID NO: 2086 - RNA, 22 nt, Human
aacugagguaucugcuguguuu

SEQ ID NO: 2087 - RNA, 22 nt, Human
aacugauaauggacacauaaaa

SEQ ID NO: 2088 - RNA, 22 nt, Human
aacugaugcuagaagagacguu

SEQ ID NO: 2089 - RNA, 22 nt, Human
aacugcaaaaaugguagucuua

SEQ ID NO: 2090 - RNA, 21 nt, Human
aacugcaaaugaugcuggaga

SEQ ID NO: 2091 - RNA, 22 nt, Human
aacugcaauuacuuuugcacca

SEQ ID NO: 2092 - RNA, 22 nt, Human
aacagcagguccuggcaugggu

SEQ ID NO: 2093 - RNA, 22 nt, Human
aacagcaguggcaggagaaggc

SEQ ID NO: 2094 - RNA, 22 nt, Human
aacagcuaguaccaauccacua

SEQ ID NO: 2095 - RNA, 22 nt, Human
aacagcugcaaaagguugccug

SEQ ID NO: 2096 - RNA, 22 nt, Human
aacagcuguucgcagauguagg

SEQ ID NO: 2097 - RNA, 22 nt, Human
aacagcuuugugcucagauuug

SEQ ID NO: 2098 - RNA, 22 nt, Human
aacaggaaauacuuaugaggua

SEQ ID NO: 2099 - RNA, 22 nt, Human
aacaggaacuauuuguauucca

SEQ ID NO: 2100 - RNA, 22 nt, Human
aacaggaaugaggagaaaaggu

SEQ ID NO: 2101 - RNA, 22 nt, Human
aacaggacacugggauggcuac

SEQ ID NO: 2102 - RNA, 22 nt, Human
aacaggagucauugucauuauu

SEQ ID NO: 2103 - RNA, 22 nt, Human
aacaggcaaacugugggauccc

SEQ ID NO: 2104 - RNA, 22 nt, Human
aaguaugacauuuaagacaauu

SEQ ID NO: 2105 - RNA, 22 nt, Human
aaguaugcuaauuaacuagcac

SEQ ID NO: 2106 - RNA, 22 nt, Human
aaguaugucuuuggguauuauu

SEQ ID NO: 2107 - RNA, 22 nt, Human
aaguauuauuuaacaaauuugu

SEQ ID NO: 2108 - RNA, 19 nt, Human
aaguauucuuuguuagcag

SEQ ID NO: 2109 - RNA, 22 nt, Human
aaguauuuggaauggcauuuuu

SEQ ID NO: 2110 - RNA, 22 nt, Human
aagucacaagcauauaugcauu

SEQ ID NO: 2111 - RNA, 22 nt, Human
aagucacacuagacaacugagg

SEQ ID NO: 2112 - RNA, 22 nt, Human
aagucacagaguuggaagucag

SEQ ID NO: 2113 - RNA, 23 nt, Human
aagucaccaagaggaaggcggag

SEQ ID NO: 2114 - RNA, 22 nt, Human
aagucaccccacacucuuggga

SEQ ID NO: 2115 - RNA, 18 nt, Human
aagucaccccugcucccu

SEQ ID NO: 2116 - RNA, 22 nt, Human
aagucacuaagugaaccacugg

SEQ ID NO: 2117 - RNA, 22 nt, Human
aagucacuggaggaacucuacu

SEQ ID NO: 2118 - RNA, 22 nt, Human
aagucagaaaucaucuagugua

SEQ ID NO: 2119 - RNA, 22 nt, Human
aagucagcacuccaggaagcca

SEQ ID NO: 2120 - RNA, 22 nt, Human
aagucaggaagugcaaaaguug

SEQ ID NO: 2121 - RNA, 22 nt, Human
aagucaggugagacucucuggg

SEQ ID NO: 2122 - RNA, 22 nt, Human
aagucauagucuaacccagcca

SEQ ID NO: 2123 - RNA, 22 nt, Human
aagucauuccugcuuguugccc

SEQ ID NO: 2124 - RNA, 22 nt, Human
aaguccaaggcugggugcagug

SEQ ID NO: 2125 - RNA, 22 nt, Human
aaguccaaggucaccauucaca

SEQ ID NO: 2126 - RNA, 22 nt, Human
aaguccagaacuccugugauag

SEQ ID NO: 2127 - RNA, 17 nt, Human
aaguccagaguugagca

SEQ ID NO: 2128 - RNA, 22 nt, Human
aaguccagugauacuggcagga

SEQ ID NO: 2129 - RNA, 22 nt, Human
aaguccauaguuugcauuacag

SEQ ID NO: 2130 - RNA, 22 nt, Human
aaguccauuaggccccugccug

SEQ ID NO: 2131 - RNA, 22 nt, Human
aaggcaccauaggcaaauccag

SEQ ID NO: 2132 - RNA, 22 nt, Human
aaggcaccaugagaugcugguu

SEQ ID NO: 2133 - RNA, 22 nt, Human
aaggcacucagccuugggacag

SEQ ID NO: 2134 - RNA, 21 nt, Human
aaggcagaagcauggaaugag

SEQ ID NO: 2135 - RNA, 22 nt, Human
aaggcagagauuagcagaauga

SEQ ID NO: 2136 - RNA, 22 nt, Human
aaggcagauauaaagacuagag

SEQ ID NO: 2137 - RNA, 22 nt, Human
aaggcagcaagaauuccagguu

SEQ ID NO: 2138 - RNA, 22 nt, Human
aaggcagcaugaaucccuguac

SEQ ID NO: 2139 - RNA, 22 nt, Human
aaggcagccgugugacugcaug

SEQ ID NO: 2140 - RNA, 22 nt, Human
aaggcagccuuuguuugauuga

SEQ ID NO: 2141 - RNA, 22 nt, Human
aaggcagcucagcucauggcag

SEQ ID NO: 2142 - RNA, 22 nt, Human
aaggcaggaugcggacccaucu

SEQ ID NO: 2143 - RNA, 22 nt, Human
aaggcagguauugaugccacag

SEQ ID NO: 2144 - RNA, 22 nt, Human
aaggcaguaggaucuuccacag

SEQ ID NO: 2145 - RNA, 22 nt, Human
aaggcagugguuggguggagga

SEQ ID NO: 2146 - RNA, 22 nt, Human
aaggcaguuaccgcaauggagg

SEQ ID NO: 2147 - RNA, 22 nt, Human
aaggcauagucuuuaaguucug

SEQ ID NO: 2148 - RNA, 22 nt, Human
aaggcaugauguaaucaaugau

SEQ ID NO: 2149 - RNA, 22 nt, Human
aaggcauggcaggguuuacaca

SEQ ID NO: 2150 - RNA, 22 nt, Human
aaggcauuaugauuugaguacc

SEQ ID NO: 2151 - RNA, 22 nt, Human
aaggcauugagcaguuacagua

SEQ ID NO: 2152 - RNA, 22 nt, Human
aaggcauugcugauccucaggu

SEQ ID NO: 2153 - RNA, 22 nt, Human
aaggccaaaguuuucaggcuaa

SEQ ID NO: 2154 - RNA, 22 nt, Human
aaggccacgucuccuuccagag

SEQ ID NO: 2155 - RNA, 22 nt, Human
aaggccagacaggaccacaucu

SEQ ID NO: 2156 - RNA, 22 nt, Human
aaggccagacucuggaaugaca

SEQ ID NO: 2157 - RNA, 22 nt, Human
aaggccagagcagacuggaguu

SEQ ID NO: 2158 - RNA, 22 nt, Human
aaggccagagcguguccugccu

SEQ ID NO: 2159 - RNA, 22 nt, Human
aaggccagaguugaacugcucc

SEQ ID NO: 2160 - RNA, 22 nt, Human
aaggccagcaguuugagaccag

SEQ ID NO: 2161 - RNA, 22 nt, Human
aaggccagcccuaaugaugcuc

SEQ ID NO: 2162 - RNA, 22 nt, Human
aaggccagccuuggaacccuga

SEQ ID NO: 2163 - RNA, 22 nt, Human
aaggccagcuggagggaugagg

SEQ ID NO: 2164 - RNA, 22 nt, Human
aaggccaggaaauuaucccuau

SEQ ID NO: 2165 - RNA, 22 nt, Human
aaggccaggacaccaggggacu

SEQ ID NO: 2166 - RNA, 22 nt, Human
aaggccaggcagggagcuguga

SEQ ID NO: 2167 - RNA, 22 nt, Human
aaggccaggccagaugacaguc

SEQ ID NO: 2168 - RNA, 22 nt, Human
aaggccaguggauaaaaccucu

SEQ ID NO: 2169 - RNA, 22 nt, Human
aaggccauuguaauguaaauau

SEQ ID NO: 2170 - RNA, 22 nt, Human
aaggcccuaauagagcacauau

SEQ ID NO: 2171 - RNA, 22 nt, Human
aaggcccugucuccaaauacag

SEQ ID NO: 2172 - RNA, 22 nt, Human
aaggcccuuccaccaguccucg

SEQ ID NO: 2173 - RNA, 22 nt, Human
aaggccucccugugugcaggug

SEQ ID NO: 2174 - RNA, 21 nt, Human
aaggccugcuuacugcuaguu

SEQ ID NO: 2175 - RNA, 22 nt, Human
aaggccuggauuuagguuguga

SEQ ID NO: 2176 - RNA, 22 nt, Human
aaggccugggaggccucucuuc

SEQ ID NO: 2177 - RNA, 22 nt, Human
aaggccuuucuuaucaguagau

SEQ ID NO: 2178 - RNA, 22 nt, Human
aaggcucaauuaacuaagaagu

SEQ ID NO: 2179 - RNA, 22 nt, Human
aaggcucccucuucucgagugu

SEQ ID NO: 2180 - RNA, 21 nt, Human
aaggcuccuccucuaggccuc

SEQ ID NO: 2181 - RNA, 22 nt, Human
aaggcuccuuuguaguucuuuu

SEQ ID NO: 2182 - RNA, 22 nt, Human
aaggcucucugauggcagcagu

SEQ ID NO: 2183 - RNA, 22 nt, Human
aaggcucugcaaaaccuccaag

SEQ ID NO: 2184 - RNA, 22 nt, Human
aaggcugaauucaaggguaggc

SEQ ID NO: 2185 - RNA, 22 nt, Human
aaggcugacucaacagggggcc

SEQ ID NO: 2186 - RNA, 21 nt, Human
aaggcugagacaacucaggag

SEQ ID NO: 2187 - RNA, 22 nt, Human
aaggcugagccagggccccuau

SEQ ID NO: 2188 - RNA, 22 nt, Human
aaggcugaggcagugaggcaga

SEQ ID NO: 2189 - RNA, 19 nt, Human
aaggcuggagaaggccucu

SEQ ID NO: 2190 - RNA, 21 nt, Human
aaggcuggagaugcaggucug

SEQ ID NO: 2191 - RNA, 22 nt, Human
aaggcuggagaugguuggaaug

SEQ ID NO: 2192 - RNA, 22 nt, Human
aaggcuggaguacagugcagug

SEQ ID NO: 2193 - RNA, 22 nt, Human
aaggcuggggugcagacggccu

SEQ ID NO: 2194 - RNA, 22 nt, Human
aaggcuggucagauguggugaa

SEQ ID NO: 2195 - RNA, 22 nt, Human
aaggcugguuccaucccuggug

SEQ ID NO: 2196 - RNA, 22 nt, Human
aaggcuuccuggaggagguguc

SEQ ID NO: 2197 - RNA, 22 nt, Human
aaggcuucuuugcaggcuuuag

SEQ ID NO: 2198 - RNA, 22 nt, Human
aaggcuuuaaauaaccguaaag

SEQ ID NO: 2199 - RNA, 22 nt, Human
aaggcuuuaugugaccaaaaga

SEQ ID NO: 2200 - RNA, 22 nt, Human
aaggcuuucagcuaacuugauu

SEQ ID NO: 2201 - RNA, 22 nt, Human
aaggcuuuugacgguugccucu

SEQ ID NO: 2202 - RNA, 22 nt, Human
aagggacccuggaucaaaugga

SEQ ID NO: 2203 - RNA, 22 nt, Human
aagggagacaguugugugagga

SEQ ID NO: 2204 - RNA, 22 nt, Human
aagggagcggggagacccuaug

SEQ ID NO: 2205 - RNA, 22 nt, Human
aagggaggaggauuuauuguac

SEQ ID NO: 2206 - RNA, 22 nt, Human
aagggaggccagagguuuugca

SEQ ID NO: 2207 - RNA, 22 nt, Human
aagggaggggauguaagccugg

SEQ ID NO: 2208 - RNA, 22 nt, Human
aagggcagcugacagaugcuua

SEQ ID NO: 2209 - RNA, 22 nt, Human
aagggcaggcacccacccucac

SEQ ID NO: 2210 - RNA, 22 nt, Human
aagggcauugaggcugagagac

SEQ ID NO: 2211 - RNA, 22 nt, Human
aagggccaucccagaacagaaa

SEQ ID NO: 2212 - RNA, 22 nt, Human
aagggccauugcugagagcagu

SEQ ID NO: 2213 - RNA, 22 nt, Human
aaguggacuaauacaaggacua

SEQ ID NO: 2214 - RNA, 21 nt, Human
aaguggagaagaaaagcugga

SEQ ID NO: 2215 - RNA, 22 nt, Human
aaguggagucccuacaaccagc

SEQ ID NO: 2216 - RNA, 18 nt, Human
aaguggcacaggagugca

SEQ ID NO: 2217 - RNA, 22 nt, Human
aaguggcccuaggccaagggga

SEQ ID NO: 2218 - RNA, 18 nt, Human
aagugggaaaagcaagca

SEQ ID NO: 2219 - RNA, 22 nt, Human
aagugggaauagaaaugaaggu

SEQ ID NO: 2220 - RNA, 22 nt, Human
aaguggugguaugaaccgaggg

SEQ ID NO: 2221 - RNA, 22 nt, Human
aagugguuauuuugaucuagaa

SEQ ID NO: 2222 - RNA, 21 nt, Human
aagugguuuacauccagcugu

SEQ ID NO: 2223 - RNA, 22 nt, Human
aagugguuugagcacagugcug

SEQ ID NO: 2224 - RNA, 22 nt, Human
aaguguauaacgaccuacagga

SEQ ID NO: 2225 - RNA, 22 nt, Human
aaguguauauaugacuuauaaa

SEQ ID NO: 2226 - RNA, 22 nt, Human
aagugucuaacugguuacuucu

SEQ ID NO: 2227 - RNA, 22 nt, Human
aagugucugcuggcucuacccu

SEQ ID NO: 2228 - RNA, 22 nt, Human
aagugugacacuguguuaauua

SEQ ID NO: 2229 - RNA, 22 nt, Human
aagugugagccagcccuuugca

SEQ ID NO: 2230 - RNA, 22 nt, Human
aaguguguauuuuucuucagug

SEQ ID NO: 2231 - RNA, 19 nt, Human
aaguguguugagccaggau

SEQ ID NO: 2232 - RNA, 22 nt, Human
aaguguuauguaggauuucaga

SEQ ID NO: 2233 - RNA, 22 nt, Human
aaguguuuauugauuggucuag

SEQ ID NO: 2234 - RNA, 22 nt, Human
aaguguuucaauaauuuggacc

SEQ ID NO: 2235 - RNA, 22 nt, Human
aaguuaacccaguauuucuuuu

SEQ ID NO: 2236 - RNA, 22 nt, Human
aaguuaagggucccagucuguu

SEQ ID NO: 2237 - RNA, 22 nt, Human
aaguuacagucagagguuaaca

SEQ ID NO: 2238 - RNA, 22 nt, Human
aaguuacagucugcuugcugac

SEQ ID NO: 2239 - RNA, 22 nt, Human
aaguuacaguuauuauuuaaaa

SEQ ID NO: 2240 - RNA, 22 nt, Human
aaguuacaguuggaacugugaa

SEQ ID NO: 2241 - RNA, 22 nt, Human
aaguuacauaaauguccucuag

SEQ ID NO: 2242 - RNA, 22 nt, Human
aaguuacuuuaccucuuuagcu

SEQ ID NO: 2243 - RNA, 22 nt, Human
aaguuaggagaguaaaguggua

SEQ ID NO: 2244 - RNA, 22 nt, Human
aaguuaggcuuaguugagauuu

SEQ ID NO: 2245 - RNA, 22 nt, Human
aaguuagugccuccuuaaauuu

SEQ ID NO: 2246 - RNA, 22 nt, Human
aaguuauugguggagagcacug

SEQ ID NO: 2247 - RNA, 22 nt, Human
aaguucaagcucugccuaaaau

SEQ ID NO: 2248 - RNA, 22 nt, Human
aagguauuguucccuaguuucu

SEQ ID NO: 2249 - RNA, 23 nt, Human
aagguauuuauuuuaaagguaag

SEQ ID NO: 2250 - RNA, 22 nt, Human
aaggucaaagacaguaacuuuu

SEQ ID NO: 2251 - RNA, 22 nt, Human
aaggucaacacugauuuuaguc

SEQ ID NO: 2252 - RNA, 23 nt, Human
aaggucacagaacuuagcaagcc

SEQ ID NO: 2253 - RNA, 22 nt, Human
aaggucagagcaggaaggaguc

SEQ ID NO: 2254 - RNA, 22 nt, Human
aaggucauggcaaauuacuuuu

SEQ ID NO: 2255 - RNA, 22 nt, Human
aaggucauuguugcauguucuc

SEQ ID NO: 2256 - RNA, 22 nt, Human
aagguccaguuugaauuacugu

SEQ ID NO: 2257 - RNA, 22 nt, Human
aagguccuuuugcagugugauc

SEQ ID NO: 2258 - RNA, 22 nt, Human
aaggucuaaagcuacugaguug

SEQ ID NO: 2259 - RNA, 22 nt, Human
aaggucucaaguuuuccaaagu

SEQ ID NO: 2260 - RNA, 22 nt, Human
aaggucugcuuguuuucuugag

SEQ ID NO: 2261 - RNA, 22 nt, Human
aaggucuggaugaugggugugc

SEQ ID NO: 2262 - RNA, 21 nt, Human
aaggucuguaaagugacagga

SEQ ID NO: 2263 - RNA, 22 nt, Human
aaggucugugaggcuguuuguc

SEQ ID NO: 2264 - RNA, 22 nt, Human
aaggugaaacuggaagcuggcc

SEQ ID NO: 2265 - RNA, 22 nt, Human
aaggugacucacaaagccaguu

SEQ ID NO: 2266 - RNA, 22 nt, Human
aaggugccacuucccucagacu

SEQ ID NO: 2267 - RNA, 22 nt, Human
aaggugcuguggacuugggagc

SEQ ID NO: 2268 - RNA, 19 nt, Human
aagguggcagcagguauua

SEQ ID NO: 2269 - RNA, 22 nt, Human
aagguggcggcugccagguccu

SEQ ID NO: 2270 - RNA, 22 nt, Human
aagguggucuuacugaugguau

SEQ ID NO: 2271 - RNA, 22 nt, Human
aagguggugaucaucuugaagg

SEQ ID NO: 2272 - RNA, 22 nt, Human
aagguggugcuucugcuccucu

SEQ ID NO: 2273 - RNA, 22 nt, Human
aaggugguucgcugguacccag

SEQ ID NO: 2274 - RNA, 22 nt, Human
aaggugucauccaggauggugg

SEQ ID NO: 2275 - RNA, 23 nt, Human
aaggugucauugaugggauucua

SEQ ID NO: 2276 - RNA, 22 nt, Human
aaggugucauuguuuauggaga

SEQ ID NO: 2277 - RNA, 22 nt, Human
aaggugucggcagagccgcuuc

SEQ ID NO: 2278 - RNA, 22 nt, Human
aaggugugaagagaugggaaga

SEQ ID NO: 2279 - RNA, 23 nt, Human
aagguguucuguauuuaacucag

SEQ ID NO: 2280 - RNA, 22 nt, Human
aagguuaguaaguaucuuaugu

SEQ ID NO: 2281 - RNA, 22 nt, Human
aagguucuaagggaagccaugc

SEQ ID NO: 2282 - RNA, 22 nt, Human
aagguugcagcaguguugauga

SEQ ID NO: 2283 - RNA, 22 nt, Human
aagguugcuguuuugcuucaaa

SEQ ID NO: 2284 - RNA, 22 nt, Human
aagguuucgggagcgggucugg

SEQ ID NO: 2285 - RNA, 22 nt, Human
aaguaaaauguuuccuuuauua

SEQ ID NO: 2286 - RNA, 22 nt, Human
aaguaaacagauaagaaaucug

SEQ ID NO: 2287 - RNA, 22 nt, Human
aaguaacaaugcuguugaauug

SEQ ID NO: 2288 - RNA, 21 nt, Human
aaguaacaccacuccuggagu

SEQ ID NO: 2289 - RNA, 22 nt, Human
aaguaacacggaacuugaagca

SEQ ID NO: 2290 - RNA, 23 nt, Human
aaguaacagggauaauagcaguu

SEQ ID NO: 2291 - RNA, 22 nt, Human
aaguaacuaaagauauccauuu

SEQ ID NO: 2292 - RNA, 22 nt, Human
aaguacauauauuuaugauucu

SEQ ID NO: 2293 - RNA, 22 nt, Human
aaguacauccuagucucuuuca

SEQ ID NO: 2294 - RNA, 22 nt, Human
aaguacaugcuuuauucagagu

SEQ ID NO: 2295 - RNA, 22 nt, Human
aaguacauuauaugagcagaau

SEQ ID NO: 2296 - RNA, 22 nt, Human
aaguaccuagaaauauuuuuga

SEQ ID NO: 2297 - RNA, 22 nt, Human
aaguagaaaaccgcacuggacu

SEQ ID NO: 2298 - RNA, 22 nt, Human
aaguagaaucucagguaggcua

SEQ ID NO: 2299 - RNA, 22 nt, Human
aaguagauagugcuacggaguu

SEQ ID NO: 2300 - RNA, 21 nt, Human
aaguagaucacuguucucuug

SEQ ID NO: 2301 - RNA, 19 nt, Human
aaguagucaucccauucuu

SEQ ID NO: 2302 - RNA, 22 nt, Human
aaguauaagcuauucuucauga

SEQ ID NO: 2303 - RNA, 22 nt, Human
aaguauauacuaaauguuaauc

SEQ ID NO: 2304 - RNA, 22 nt, Human
aaguauauuuagcugagcuugu

SEQ ID NO: 2305 - RNA, 22 nt, Human
aaguaucuuucuagcaacuaaa

SEQ ID NO: 2306 - RNA, 18 nt, Human
aaguaugccuauguuauu

SEQ ID NO: 2307 - RNA, 22 nt, Human
aaguaugucaaucauacuucaa

SEQ ID NO: 2308 - RNA, 22 nt, Human
aaguaugugugggaugcuggga

SEQ ID NO: 2309 - RNA, 22 nt, Human
aaguauugugggaaagcagaaa

SEQ ID NO: 2310 - RNA, 22 nt, Human
aaguauuucguucugaaaaagu

SEQ ID NO: 2311 - RNA, 22 nt, Human
aagucaaaccuugcucacagga

SEQ ID NO: 2312 - RNA, 21 nt, Human
aagucaauacagauaagucuu

SEQ ID NO: 2313 - RNA, 22 nt, Human
aagucaauuaguaaacuuggaa

SEQ ID NO: 2314 - RNA, 22 nt, Human
aagucacacaguuaacaugagg

SEQ ID NO: 2315 - RNA, 22 nt, Human
aagucacacugcugggaacucu

SEQ ID NO: 2316 - RNA, 22 nt, Human
aagucacagaacccauuguaac

SEQ ID NO: 2317 - RNA, 22 nt, Human
aagucacagcuaaauagcuaag

SEQ ID NO: 2318 - RNA, 22 nt, Human
aagucacccacaggcagcagaa

SEQ ID NO: 2319 - RNA, 19 nt, Human
aagucacuugagggcagga

SEQ ID NO: 2320 - RNA, 22 nt, Human
aagucagaaaacagagcaauua

SEQ ID NO: 2321 - RNA, 22 nt, Human
aagucagaaauaucugccauca

SEQ ID NO: 2322 - RNA, 22 nt, Human
aaucuucuacuugacaguucuc

SEQ ID NO: 2323 - RNA, 22 nt, Human
aaucuuggcaaauguagcuucc

SEQ ID NO: 2324 - RNA, 22 nt, Human
aaucuuucaaauuucuuugggu

SEQ ID NO: 2325 - RNA, 22 nt, Human
aaucuuucguuucuccugucug

SEQ ID NO: 2326 - RNA, 22 nt, Human
aaucuuuugauucuagggcugu

SEQ ID NO: 2327 - RNA, 22 nt, Human
aaugaaagaaugaaacagccca

SEQ ID NO: 2328 - RNA, 22 nt, Human
aaugaaaugaagauaugaucag

SEQ ID NO: 2329 - RNA, 22 nt, Human
aaugaacaacacugaaggaaga

SEQ ID NO: 2330 - RNA, 22 nt, Human
aaugaacacgcugguggugcaa

SEQ ID NO: 2331 - RNA, 22 nt, Human
aaugaacaggugaaugucagau

SEQ ID NO: 2332 - RNA, 22 nt, Human
aaugaacagugggugagguacc

SEQ ID NO: 2333 - RNA, 22 nt, Human
aaugaacauauaaagagaucuu

SEQ ID NO: 2334 - RNA, 22 nt, Human
aaugaacauggacaaguuaaua

SEQ ID NO: 2335 - RNA, 22 nt, Human
aaugaacccuucaagcucugau

SEQ ID NO: 2336 - RNA, 22 nt, Human
aaugaacgguguccaucuguuu

SEQ ID NO: 2337 - RNA, 22 nt, Human
aaugaagcaagcugcuguguuu

SEQ ID NO: 2338 - RNA, 21 nt, Human
aaugaaguggcuauuuugagg

SEQ ID NO: 2339 - RNA, 20 nt, Human
aaugaaguuauuaaugaugu

SEQ ID NO: 2340 - RNA, 22 nt, Human
aaugaauaccguuucacucagu

SEQ ID NO: 2341 - RNA, 22 nt, Human
aaugaaugaaccacauauaaca

SEQ ID NO: 2342 - RNA, 22 nt, Human
aaugaauugcaguacugacuug

SEQ ID NO: 2343 - RNA, 22 nt, Human
aaugacaauaaucauuaacuuu

SEQ ID NO: 2344 - RNA, 22 nt, Human
aaugacauaagugcagaugcua

SEQ ID NO: 2345 - RNA, 22 nt, Human
aaugacuaauaaguuuuacugu

SEQ ID NO: 2346 - RNA, 22 nt, Human
aaugacuaguccacauuuguaa

SEQ ID NO: 2347 - RNA, 19 nt, Human
aaugacugaguacauuguc

SEQ ID NO: 2348 - RNA, 22 nt, Human
aaugagaaccuugaaaggaacu

SEQ ID NO: 2349 - RNA, 22 nt, Human
aaugagacacgugaagcagaug

SEQ ID NO: 2350 - RNA, 22 nt, Human
aaugagaucagagauaacucaa

SEQ ID NO: 2351 - RNA, 22 nt, Human
aaugagauggaggacucuuaau

SEQ ID NO: 2352 - RNA, 22 nt, Human
aaugagauguugaauuauuguu

SEQ ID NO: 2353 - RNA, 22 nt, Human
aaugagauuccaauagcuccug

SEQ ID NO: 2354 - RNA, 22 nt, Human
aaugagcuagaccugcuuccuc

SEQ ID NO: 2355 - RNA, 22 nt, Human
aaugagcugcugcuguuccacc

SEQ ID NO: 2356 - RNA, 22 nt, Human
aaugaggcuugcauugugaacu

SEQ ID NO: 2357 - RNA, 22 nt, Human
aaugaguuauuagguguaagug

SEQ ID NO: 2358 - RNA, 22 nt, Human
aaugaguuauuuaauagaaagg

SEQ ID NO: 2359 - RNA, 20 nt, Human
aaugaguuauuuuguauaug

SEQ ID NO: 2360 - RNA, 22 nt, Human
aaugaguucugguucauuuuau

SEQ ID NO: 2361 - RNA, 23 nt, Human
aaugaguugggcagcauacaggc

SEQ ID NO: 2362 - RNA, 22 nt, Human
aaugauaccgccaauauuacca

SEQ ID NO: 2363 - RNA, 22 nt, Human
aaugauauagcagacauagccu

SEQ ID NO: 2364 - RNA, 22 nt, Human
aaugauauuuauugaauagaug

SEQ ID NO: 2365 - RNA, 22 nt, Human
aaugaucaccugguaaagagag

SEQ ID NO: 2366 - RNA, 22 nt, Human
aaugaucacugcaguugaugag

SEQ ID NO: 2367 - RNA, 22 nt, Human
aaugauguauuaguacaacaca

SEQ ID NO: 2368 - RNA, 23 nt, Human
aaugaugucagaagaugaagucu

SEQ ID NO: 2369 - RNA, 22 nt, Human
aaugaugugaguuuuuauucuc

SEQ ID NO: 2370 - RNA, 22 nt, Human
aaugauguuuuuaaagaacaua

SEQ ID NO: 2371 - RNA, 22 nt, Human
aaugauugucauuccaaaaagu

SEQ ID NO: 2372 - RNA, 23 nt, Human
aaugauuucaugaugauagcagc

SEQ ID NO: 2373 - RNA, 22 nt, Human
aaugcaaagcaagcagagauuu

SEQ ID NO: 2374 - RNA, 22 nt, Human
aaugcaaagcucuuuaauccuu

SEQ ID NO: 2375 - RNA, 22 nt, Human
aaugcaaagugaggugaguggc

SEQ ID NO: 2376 - RNA, 22 nt, Human
aaugcaaccugcugaucugaca

SEQ ID NO: 2377 - RNA, 22 nt, Human
aaugcaagaucaaaucuaacac

SEQ ID NO: 2378 - RNA, 22 nt, Human
aaugcaaggccuguaucugauu

SEQ ID NO: 2379 - RNA, 22 nt, Human
aaugcacauauauguguauaca

SEQ ID NO: 2380 - RNA, 22 nt, Human
aaugcaccuaccuugauucugc

SEQ ID NO: 2381 - RNA, 22 nt, Human
aaugcaguuucauuuguagaau

SEQ ID NO: 2382 - RNA, 22 nt, Human
aaugcauaaugguuugugacaa

SEQ ID NO: 2383 - RNA, 22 nt, Human
aaugcauacguguuuguggcaa

SEQ ID NO: 2384 - RNA, 19 nt, Human
aaugcauggaaguuggaga

SEQ ID NO: 2385 - RNA, 22 nt, Human
aaugcauguauucauuguggaa

SEQ ID NO: 2386 - RNA, 23 nt, Human
aaugcauuaauuugggagaguac

SEQ ID NO: 2387 - RNA, 22 nt, Human
aaugcauucuuucauggaccug

SEQ ID NO: 2388 - RNA, 22 nt, Human
aaugccguagacuuuuacuuau

SEQ ID NO: 2389 - RNA, 22 nt, Human
aaugccucuuggaagaagacuu

SEQ ID NO: 2390 - RNA, 22 nt, Human
aaugccuuauaggcugaaaauu

SEQ ID NO: 2391 - RNA, 22 nt, Human
aaugccuuuccacuggguauca

SEQ ID NO: 2392 - RNA, 22 nt, Human
aaugcuaacauugguuuauauc

SEQ ID NO: 2393 - RNA, 22 nt, Human
aaugcuagugugauauguaagg

SEQ ID NO: 2394 - RNA, 22 nt, Human
aaugcucaaaauguuucaucua

SEQ ID NO: 2395 - RNA, 22 nt, Human
aaugcucugucucugacagugg

SEQ ID NO: 2396 - RNA, 22 nt, Human
aaugcuggaagccucaguagau

SEQ ID NO: 2397 - RNA, 22 nt, Human
aaugcuucaaccucccacaugu

SEQ ID NO: 2398 - RNA, 22 nt, Human
acagaaaugauguuuggcaaua

SEQ ID NO: 2399 - RNA, 19 nt, Human
acagaaauguaagugagac

SEQ ID NO: 2400 - RNA, 22 nt, Human
acagaaauucaaacuggaauuu

SEQ ID NO: 2401 - RNA, 22 nt, Human
acagaacauauugcuucucuca

SEQ ID NO: 2402 - RNA, 22 nt, Human
acagaacauggauuuuugaagu

SEQ ID NO: 2403 - RNA, 20 nt, Human
acagaacugagaacagucuc

SEQ ID NO: 2404 - RNA, 22 nt, Human
acagaacuggaauuggaacuca

SEQ ID NO: 2405 - RNA, 22 nt, Human
acagaagaccaagaaagcuucc

SEQ ID NO: 2406 - RNA, 22 nt, Human
acagaagagcuggcucugugcu

SEQ ID NO: 2407 - RNA, 22 nt, Human
acagaagauaaugcugccuugg

SEQ ID NO: 2408 - RNA, 21 nt, Human
acagaagcggcgaguggcccc

SEQ ID NO: 2409 - RNA, 22 nt, Human
acagaaguccccaugaagaagc

SEQ ID NO: 2410 - RNA, 22 nt, Human
acagaagugacaauuucuuggg

SEQ ID NO: 2411 - RNA, 22 nt, Human
acagaauacuacagacugguua

SEQ ID NO: 2412 - RNA, 22 nt, Human
acagaauauugguuacuguugc

SEQ ID NO: 2413 - RNA, 22 nt, Human
acagaauauuguaagugccacu

SEQ ID NO: 2414 - RNA, 22 nt, Human
acagaaugcguagugcauguug

SEQ ID NO: 2415 - RNA, 22 nt, Human
acagaaugggauuugaauauuu

SEQ ID NO: 2416 - RNA, 22 nt, Human
acagaauuaggagauccucuug

SEQ ID NO: 2417 - RNA, 22 nt, Human
acagaauuaucaggaaauguua

SEQ ID NO: 2418 - RNA, 22 nt, Human
acagaauucuaguauguggcuu

SEQ ID NO: 2419 - RNA, 18 nt, Human
acagacaaaauggaaaug

SEQ ID NO: 2420 - RNA, 22 nt, Human
acagacaguaaauaguguggcu

SEQ ID NO: 2421 - RNA, 22 nt, Human
acagacaguaugguggggcuga

SEQ ID NO: 2422 - RNA, 22 nt, Human
acagacaucaucaacaucuucc

SEQ ID NO: 2423 - RNA, 22 nt, Human
acagacaucuauccauuuaauu

SEQ ID NO: 2424 - RNA, 22 nt, Human
acagacaugcuguuuggguggu

SEQ ID NO: 2425 - RNA, 22 nt, Human
acagacaugggccgcucuugag

SEQ ID NO: 2426 - RNA, 23 nt, Human
acagacauuccauaauguacacc

SEQ ID NO: 2427 - RNA, 22 nt, Human
acagacauuuucuguauugccu

SEQ ID NO: 2428 - RNA, 22 nt, Human
acagaccaaguuuccagcaggu

SEQ ID NO: 2429 - RNA, 22 nt, Human
acagaccucuagauuacauuug

SEQ ID NO: 2430 - RNA, 22 nt, Human
acagacuaaaauugcacagugg

SEQ ID NO: 2431 - RNA, 22 nt, Human
acacugagauuuuccugacacc

SEQ ID NO: 2432 - RNA, 22 nt, Human
acacugagcaucucuagaggca

SEQ ID NO: 2433 - RNA, 22 nt, Human
acacugaguauugaguagggua

SEQ ID NO: 2434 - RNA, 22 nt, Human
acacugaguuuuaccaggcaca

SEQ ID NO: 2435 - RNA, 18 nt, Human
acacugcagcagucugcu

SEQ ID NO: 2436 - RNA, 22 nt, Human
acacuggacucagaggccagaa

SEQ ID NO: 2437 - RNA, 22 nt, Human
acacugggcuuguuacguugca

SEQ ID NO: 2438 - RNA, 22 nt, Human
acacuggguuaccuguacuauu

SEQ ID NO: 2439 - RNA, 22 nt, Human
acacugguucucuuaacccuau

SEQ ID NO: 2440 - RNA, 22 nt, Human
acacugguugaauuguauaacu

SEQ ID NO: 2441 - RNA, 22 nt, Human
acacuguaaagugaugcuuaaa

SEQ ID NO: 2442 - RNA, 22 nt, Human
acacuguaggagaaaggaguuu

SEQ ID NO: 2443 - RNA, 22 nt, Human
acacugucucauaugaggggac

SEQ ID NO: 2444 - RNA, 22 nt, Human
acacugugacaagaaagagcug

SEQ ID NO: 2445 - RNA, 22 nt, Human
acacugugacggaaauaaagaa

SEQ ID NO: 2446 - RNA, 22 nt, Human
acacugugucuagcauuuuaca

SEQ ID NO: 2447 - RNA, 20 nt, Human
acacuguucuucacacauuu

SEQ ID NO: 2448 - RNA, 22 nt, Human
acacuuauuuuuguccacuucc

SEQ ID NO: 2449 - RNA, 22 nt, Human
acacuucaaaugguuggaaaau

SEQ ID NO: 2450 - RNA, 22 nt, Human
acacuucaggacucuggggcaa

SEQ ID NO: 2451 - RNA, 22 nt, Human
acacuucauuuacauuauaggc

SEQ ID NO: 2452 - RNA, 22 nt, Human
acacuucucccaucuccuguug

SEQ ID NO: 2453 - RNA, 22 nt, Human
acacuugaggaauguggugauu

SEQ ID NO: 2454 - RNA, 22 nt, Human
acacuugagguuuuuaggugcg

SEQ ID NO: 2455 - RNA, 22 nt, Human
acacuuggcucugagucacuac

SEQ ID NO: 2456 - RNA, 22 nt, Human
acacuuguggccuuucuaguaa

SEQ ID NO: 2457 - RNA, 22 nt, Human
acacuuuaagcauuucacacug

SEQ ID NO: 2458 - RNA, 22 nt, Human
acacuuuacagcuuccuuugca

SEQ ID NO: 2459 - RNA, 22 nt, Human
acacuuuagaaaaaagaauggu

SEQ ID NO: 2460 - RNA, 22 nt, Human
acacuuuaucaauauucaaaaa

SEQ ID NO: 2461 - RNA, 22 nt, Human
acacuuugcuacauuucauauu

SEQ ID NO: 2462 - RNA, 22 nt, Human
acacuuugggcuggauaauuau

SEQ ID NO: 2463 - RNA, 22 nt, Human
acacuuuguuguggcauauacg

SEQ ID NO: 2464 - RNA, 22 nt, Human
acacuuuuaagacuuuaaugaa

SEQ ID NO: 2465 - RNA, 22 nt, Human
acacuuuuguguauauccaguu

SEQ ID NO: 2466 - RNA, 22 nt, Human
acagaaaaugccagaagggugg

SEQ ID NO: 2467 - RNA, 22 nt, Human
acagaaagaccuuguaacacuu

SEQ ID NO: 2468 - RNA, 20 nt, Human
acagaaagagagaaugucag

SEQ ID NO: 2469 - RNA, 18 nt, Human
acagaaauagcugugccu

SEQ ID NO: 2470 - RNA, 22 nt, Human
acagaacugcagacagugccaa

SEQ ID NO: 2471 - RNA, 22 nt, Human
acagaacugggggcacagauag

SEQ ID NO: 2472 - RNA, 21 nt, Human
acagaacuguauagugauaaa

SEQ ID NO: 2473 - RNA, 22 nt, Human
acagaacuuccugcuggagugg

SEQ ID NO: 2474 - RNA, 22 nt, Human
acagaagaccagagagcuaacu

SEQ ID NO: 2475 - RNA, 22 nt, Human
acagaagagcacauuuaguaug

SEQ ID NO: 2476 - RNA, 22 nt, Human
acagaagauaacugggaccaga

SEQ ID NO: 2477 - RNA, 22 nt, Human
acagaagcagcgcggcucuucu

SEQ ID NO: 2478 - RNA, 22 nt, Human
acagaagccuuuggccauuuga

SEQ ID NO: 2479 - RNA, 22 nt, Human
acagaaguuggaauuagauacu

SEQ ID NO: 2480 - RNA, 22 nt, Human
acagaauacucauaagaagggg

SEQ ID NO: 2481 - RNA, 22 nt, Human
acagaauuaaaguguuugugga

SEQ ID NO: 2482 - RNA, 22 nt, Human
acagaauuaaugaaaauuacaa

SEQ ID NO: 2483 - RNA, 22 nt, Human
acagaauugaagcugaguaaau

SEQ ID NO: 2484 - RNA, 22 nt, Human
acagaauugggguucuugggga

SEQ ID NO: 2485 - RNA, 22 nt, Human
acagaauuuuuacacaggguaa

SEQ ID NO: 2486 - RNA, 22 nt, Human
acagacacaggcguggagucgc

SEQ ID NO: 2487 - RNA, 22 nt, Human
acagacagacagagaacuauuc

SEQ ID NO: 2488 - RNA, 22 nt, Human
acagacagaggcuccaugagga

SEQ ID NO: 2489 - RNA, 21 nt, Human
acagacagggccagugucccc

SEQ ID NO: 2490 - RNA, 21 nt, Human
acagacaguccagagaaaaga

SEQ ID NO: 2491 - RNA, 22 nt, Human
acagacauucagcuaagucuau

SEQ ID NO: 2492 - RNA, 22 nt, Human
acagacauuuaauaaaugcuga

SEQ ID NO: 2493 - RNA, 19 nt, Human
acagacauuugcaauuagc

SEQ ID NO: 2494 - RNA, 22 nt, Human
acagacauuuuaagacacuuua

SEQ ID NO: 2495 - RNA, 22 nt, Human
acagaccuauggcagcugccau

SEQ ID NO: 2496 - RNA, 22 nt, Human
acagacuccccagguuaucuca

SEQ ID NO: 2497 - RNA, 22 nt, Human
acagacugagucaucuucuuaa

SEQ ID NO: 2498 - RNA, 22 nt, Human
acagacuggccugucucgcacc

SEQ ID NO: 2499 - RNA, 22 nt, Human
acagacuguuggccuacugagc

SEQ ID NO: 2500 - RNA, 21 nt, Human
acagagaaagagcagccuccu

SEQ ID NO: 2501 - RNA, 22 nt, Human
acagagaaaguuccucucaggc

SEQ ID NO: 2502 - RNA, 22 nt, Human
acagagaccagcaucuucugcc

SEQ ID NO: 2503 - RNA, 22 nt, Human
acagagaccaguuacagcgucc

SEQ ID NO: 2504 - RNA, 23 nt, Human
acagagacugccaagauauucuc

SEQ ID NO: 2505 - RNA, 22 nt, Human
acagagagaauuggguuuacag

SEQ ID NO: 2506 - RNA, 22 nt, Human
acagagauggcuuuucagaggc

SEQ ID NO: 2507 - RNA, 22 nt, Human
acagagcauaaugucuagcaca

SEQ ID NO: 2508 - RNA, 22 nt, Human
acagagcaucagaugaaaucaa

SEQ ID NO: 2509 - RNA, 22 nt, Human
acagagcaugcucaguguguga

SEQ ID NO: 2510 - RNA, 22 nt, Human
acagagcauuugggacagagag

SEQ ID NO: 2511 - RNA, 22 nt, Human
acagagccaaaaggacauagua

SEQ ID NO: 2512 - RNA, 22 nt, Human
acagagcuaauguugcauaggc

SEQ ID NO: 2513 - RNA, 19 nt, Human
acagagcucucugcuucug

SEQ ID NO: 2514 - RNA, 22 nt, Human
acagagcugggaucugaaccca

SEQ ID NO: 2515 - RNA, 22 nt, Human
aauuagggaggacaaagguaca

SEQ ID NO: 2516 - RNA, 22 nt, Human
aauuauacauugaacaaucuag

SEQ ID NO: 2517 - RNA, 20 nt, Human
aauuauauaacuccaacauu

SEQ ID NO: 2518 - RNA, 22 nt, Human
aauuauauugaaguugaauguc

SEQ ID NO: 2519 - RNA, 22 nt, Human
aauuaucagauauaaaacugca

SEQ ID NO: 2520 - RNA, 22 nt, Human
aauuauccuuaaugcaguaagc

SEQ ID NO: 2521 - RNA, 22 nt, Human
aauuaugagguagauaucacau

SEQ ID NO: 2522 - RNA, 22 nt, Human
aauuaugauuggucuaaaccag

SEQ ID NO: 2523 - RNA, 22 nt, Human
aauuaugcaaccaaugaccacg

SEQ ID NO: 2524 - RNA, 22 nt, Human
aauuaugguauguucaacaacu

SEQ ID NO: 2525 - RNA, 22 nt, Human
aauuaugguggaucccaguggg

SEQ ID NO: 2526 - RNA, 22 nt, Human
aauuauguggaagaggauuaaa

SEQ ID NO: 2527 - RNA, 22 nt, Human
aauuauguuugcuuuagaugga

SEQ ID NO: 2528 - RNA, 22 nt, Human
aauuauugagcaucuacugugu

SEQ ID NO: 2529 - RNA, 22 nt, Human
aauucaaagacuagaauuuugc

SEQ ID NO: 2530 - RNA, 22 nt, Human
aauucaaucuaagaaaugauca

SEQ ID NO: 2531 - RNA, 22 nt, Human
aauucacaaaaccagauugcuu

SEQ ID NO: 2532 - RNA, 22 nt, Human
aauucacaguucugcaccuuac

SEQ ID NO: 2533 - RNA, 22 nt, Human
aauucacaugcaugucugugca

SEQ ID NO: 2534 - RNA, 22 nt, Human
aauucacugaacuucucugaga

SEQ ID NO: 2535 - RNA, 22 nt, Human
aauucagagacaugaagugaca

SEQ ID NO: 2536 - RNA, 22 nt, Human
aauucagaguccuggccccacg

SEQ ID NO: 2537 - RNA, 22 nt, Human
aauucaguaaucauuaaugaug

SEQ ID NO: 2538 - RNA, 22 nt, Human
aauucagugucuggcacugcug

SEQ ID NO: 2539 - RNA, 22 nt, Human
aauucaguuauauguccacuuc

SEQ ID NO: 2540 - RNA, 22 nt, Human
acagccccccgcucaguuucca

SEQ ID NO: 2541 - RNA, 22 nt, Human
acagccugacuuuuguugucac

SEQ ID NO: 2542 - RNA, 22 nt, Human
acagccugauuuauggagcagu

SEQ ID NO: 2543 - RNA, 22 nt, Human
acagccuggacuggcucucugc

SEQ ID NO: 2544 - RNA, 21 nt, Human
acagccugucaucucaugguc

SEQ ID NO: 2545 - RNA, 22 nt, Human
acagccuguuugaucuggugcu

SEQ ID NO: 2546 - RNA, 22 nt, Human
acagccuucucuucacuguguc

SEQ ID NO: 2547 - RNA, 23 nt, Human
acagccuucuggggcuucugggc

SEQ ID NO: 2548 - RNA, 22 nt, Human
acagccuuggguucucuggggg

SEQ ID NO: 2549 - RNA, 21 nt, Human
acagcuaagcaacaacuacug

SEQ ID NO: 2550 - RNA, 22 nt, Human
acagcuaagcucccacaaccug

SEQ ID NO: 2551 - RNA, 22 nt, Human
acagcuaaucccccuagauucu

SEQ ID NO: 2552 - RNA, 22 nt, Human
acagcuacaucaaacucagaag

SEQ ID NO: 2553 - RNA, 22 nt, Human
acagcuaucugacuuugacuca

SEQ ID NO: 2554 - RNA, 22 nt, Human
acagcucauuuguaaaacggag

SEQ ID NO: 2555 - RNA, 22 nt, Human
acagcucugcauuuuggguuaa

SEQ ID NO: 2556 - RNA, 22 nt, Human
acagcucugggugcaggaggug

SEQ ID NO: 2557 - RNA, 22 nt, Human
acagcucuguguauugucaucu

SEQ ID NO: 2558 - RNA, 22 nt, Human
acagcugaaaccagggaucugg

SEQ ID NO: 2559 - RNA, 22 nt, Human
acagcugacauuggcagcuauu

SEQ ID NO: 2560 - RNA, 22 nt, Human
acagcugauaguuaccucuguc

SEQ ID NO: 2561 - RNA, 22 nt, Human
acagcugcucaccugugagccc

SEQ ID NO: 2562 - RNA, 21 nt, Human
acagcuggaaauuacuugccc

SEQ ID NO: 2563 - RNA, 22 nt, Human
acagcuggacaggggagaguuu

SEQ ID NO: 2564 - RNA, 22 nt, Human
acagcuggagugaggauggagu

SEQ ID NO: 2565 - RNA, 22 nt, Human
acagcuguauccccagagcuca

SEQ ID NO: 2566 - RNA, 22 nt, Human
acagcuguauucaaguugcaag

SEQ ID NO: 2567 - RNA, 21 nt, Human
acagcugucuuagcuugggcu

SEQ ID NO: 2568 - RNA, 22 nt, Human
acagcugugaagcaagcacucu

SEQ ID NO: 2569 - RNA, 23 nt, Human
acagcuguugaaauuucaguggg

SEQ ID NO: 2570 - RNA, 22 nt, Human
acagcuuccaguauucuugaaa

SEQ ID NO: 2571 - RNA, 22 nt, Human
acagcuucgaggaucucauccc

SEQ ID NO: 2572 - RNA, 22 nt, Human
acagcuugucugguuucagguc

SEQ ID NO: 2573 - RNA, 22 nt, Human
acagcuuuaguguggguggugc

SEQ ID NO: 2574 - RNA, 22 nt, Human
acagcuuuguuuucccugcuga

SEQ ID NO: 2575 - RNA, 22 nt, Human
acagcuuuucaauucugcugag

SEQ ID NO: 2576 - RNA, 22 nt, Human
acaggaacuguuaucucagaug

SEQ ID NO: 2577 - RNA, 22 nt, Human
acaggaagugggaagaaacagg

SEQ ID NO: 2578 - RNA, 22 nt, Human
acaggaaguuuggaaagccuca

SEQ ID NO: 2579 - RNA, 22 nt, Human
acaggacugugauccaguaacc

SEQ ID NO: 2580 - RNA, 22 nt, Human
acaggacuuaagucauuuauaa

SEQ ID NO: 2581 - RNA, 22 nt, Human
acaggagcaacagacuaagaca

SEQ ID NO: 2582 - RNA, 22 nt, Human
acaggagccaaacacaugccag

SEQ ID NO: 2583 - RNA, 22 nt, Human
acaggagcccaggaugggcgga

SEQ ID NO: 2584 - RNA, 22 nt, Human
acaggaguggagaggugccucu

SEQ ID NO: 2585 - RNA, 22 nt, Human
acaggaguucagaggacacccc

SEQ ID NO: 2586 - RNA, 22 nt, Human
acaggauaguuuuuaaucuucc

SEQ ID NO: 2587 - RNA, 22 nt, Human
acaggaucgcccuguugcccag

SEQ ID NO: 2588 - RNA, 22 nt, Human
acaggaugagaauaucauauuu

SEQ ID NO: 2589 - RNA, 22 nt, Human
acaggauuacuggauuaugaca

SEQ ID NO: 2590 - RNA, 22 nt, Human
acaggauuagcaaguaaucagg

SEQ ID NO: 2591 - RNA, 22 nt, Human
acaggauuucaccauguuggcc

SEQ ID NO: 2592 - RNA, 21 nt, Human
acaggcaaauuuuagacaaug

SEQ ID NO: 2593 - RNA, 22 nt, Human
acaggcaagaggaaagcaagua

SEQ ID NO: 2594 - RNA, 23 nt, Human
acaggcaauaaagggagucucca

SEQ ID NO: 2595 - RNA, 22 nt, Human
acaggcaauauauaaauuauga

SEQ ID NO: 2596 - RNA, 22 nt, Human
acaggcaauuagcaagcuguua

SEQ ID NO: 2597 - RNA, 22 nt, Human
acaggcacaccuuccugcaggc

SEQ ID NO: 2598 - RNA, 22 nt, Human
acaggcacuuugacaugccauc

SEQ ID NO: 2599 - RNA, 22 nt, Human
acaggcagcgucauugcugcuc

SEQ ID NO: 2600 - RNA, 23 nt, Human
acaggcaggcauggccaaaugug

SEQ ID NO: 2601 - RNA, 22 nt, Human
acaggcaggcgggacagcccga

SEQ ID NO: 2602 - RNA, 22 nt, Human
acaggcagggaccucuugaguu

SEQ ID NO: 2603 - RNA, 22 nt, Human
acaggcagguccugucccagcu

SEQ ID NO: 2604 - RNA, 22 nt, Human
acaggcaguugagguuugugug

SEQ ID NO: 2605 - RNA, 22 nt, Human
acaggccagccugggguaaggu

SEQ ID NO: 2606 - RNA, 22 nt, Human
acaggccuacgaagucaggugc

SEQ ID NO: 2607 - RNA, 22 nt, Human
acaggccuagcuaaugcuuucc

SEQ ID NO: 2608 - RNA, 22 nt, Human
acaggccuggguucaaauuugg

SEQ ID NO: 2609 - RNA, 22 nt, Human
acaggccugugugcacacgagg

SEQ ID NO: 2610 - RNA, 22 nt, Human
acaggccuuggcaggcauguga

SEQ ID NO: 2611 - RNA, 22 nt, Human
acaggccuugguccugaccuaa

SEQ ID NO: 2612 - RNA, 22 nt, Human
acaggcgcacaugagggccgug

SEQ ID NO: 2613 - RNA, 21 nt, Human
acaggcuacaugcaggagcug

SEQ ID NO: 2614 - RNA, 18 nt, Human
acaggcuauugcaggaga

SEQ ID NO: 2615 - RNA, 22 nt, Human
acaggcugacuuccugccaugu

SEQ ID NO: 2616 - RNA, 22 nt, Human
acaggcuguugggguccagggu

SEQ ID NO: 2617 - RNA, 22 nt, Human
acaggcuuacaggcugcaagua

SEQ ID NO: 2618 - RNA, 22 nt, Human
acaggcuuuaaauuuaaaacca

SEQ ID NO: 2619 - RNA, 22 nt, Human
acaggcuuuauuauugguuagu

SEQ ID NO: 2620 - RNA, 22 nt, Human
acaggcuuuuuugcucucgaau

SEQ ID NO: 2621 - RNA, 22 nt, Human
acagggaaggauuuagugggaa

SEQ ID NO: 2622 - RNA, 19 nt, Human
acagggaauuuccacagaa

SEQ ID NO: 2623 - RNA, 22 nt, Human
acagggagauaucuucaauauc

SEQ ID NO: 2624 - RNA, 22 nt, Human
acagggagucugaggggauagu

SEQ ID NO: 2625 - RNA, 18 nt, Human
acagggaugggguaagug

SEQ ID NO: 2626 - RNA, 17 nt, Human
acagggcagaaacagcu

SEQ ID NO: 2627 - RNA, 22 nt, Human
acagggcagagugaaaugcuau

SEQ ID NO: 2628 - RNA, 22 nt, Human
acaauguucugucugacuuguc

SEQ ID NO: 2629 - RNA, 22 nt, Human
acaauguuuugaaacaucuagg

SEQ ID NO: 2630 - RNA, 22 nt, Human
acaauguuuuuguucaaagagu

SEQ ID NO: 2631 - RNA, 22 nt, Human
acaauuagugaucagugaugcc

SEQ ID NO: 2632 - RNA, 22 nt, Human
acaauucugugguugucugugg

SEQ ID NO: 2633 - RNA, 22 nt, Human
acaauuguggcaauuuguaugu

SEQ ID NO: 2634 - RNA, 20 nt, Human
acaauuuccucacuauaugc

SEQ ID NO: 2635 - RNA, 22 nt, Human
acaauuucuuauaguucaauuc

SEQ ID NO: 2636 - RNA, 22 nt, Human
acacaaagcuauugagugucau

SEQ ID NO: 2637 - RNA, 22 nt, Human
acacaacagaagagcaauugca

SEQ ID NO: 2638 - RNA, 22 nt, Human
acacaagaaguuaaugggcaaa

SEQ ID NO: 2639 - RNA, 21 nt, Human
acacaagcacucguacauacg

SEQ ID NO: 2640 - RNA, 23 nt, Human
acacaaggguaacugccagccau

SEQ ID NO: 2641 - RNA, 22 nt, Human
acacaagugaauauuuuaagga

SEQ ID NO: 2642 - RNA, 22 nt, Human
acacaauaaauuuauccuuuga

SEQ ID NO: 2643 - RNA, 23 nt, Human
acacaauagaguacuauucagcc

SEQ ID NO: 2644 - RNA, 19 nt, Human
acacaaugacacauauaua

SEQ ID NO: 2645 - RNA, 22 nt, Human
acacaaugaggaggggcuuuuc

SEQ ID NO: 2646 - RNA, 22 nt, Human
acacaauggcgugugccacaga

SEQ ID NO: 2647 - RNA, 22 nt, Human
acacaauguaccauaucuccaa

SEQ ID NO: 2648 - RNA, 22 nt, Human
acacaaugugcaggacaccugu

SEQ ID NO: 2649 - RNA, 22 nt, Human
accuucaacucaaaguguccca

SEQ ID NO: 2650 - RNA, 22 nt, Human
accuucaagauugugggucaau

SEQ ID NO: 2651 - RNA, 21 nt, Human
accuucaagccagaggugguc

SEQ ID NO: 2652 - RNA, 22 nt, Human
accuucaaugaaaauaauaguc

SEQ ID NO: 2653 - RNA, 22 nt, Human
accuucugaccaguuaucuuga

SEQ ID NO: 2654 - RNA, 22 nt, Human
accuucuggucugccugacagc

SEQ ID NO: 2655 - RNA, 22 nt, Human
accuugaugccuuuccaagaug

SEQ ID NO: 2656 - RNA, 22 nt, Human
accuuggaacugaaguguuuuu

SEQ ID NO: 2657 - RNA, 22 nt, Human
accuuggggugaugcugaaaga

SEQ ID NO: 2658 - RNA, 21 nt, Human
accuuuaauucaagcaucagg

SEQ ID NO: 2659 - RNA, 22 nt, Human
accuuuauaugaaagaugacau

SEQ ID NO: 2660 - RNA, 22 nt, Human
accuuuauguuugauuacaauu

SEQ ID NO: 2661 - RNA, 22 nt, Human
accuuucacgguaucagacauc

SEQ ID NO: 2662 - RNA, 19 nt, Human
accuuuccuuucucagaug

SEQ ID NO: 2663 - RNA, 22 nt, Human
accuuuggaggacuagggucau

SEQ ID NO: 2664 - RNA, 22 nt, Human
accuuuggauaauuugaguuug

SEQ ID NO: 2665 - RNA, 21 nt, Human
accuuuggguguuuauaauag

SEQ ID NO: 2666 - RNA, 22 nt, Human
accuuugguaaguuuccaaaac

SEQ ID NO: 2667 - RNA, 22 nt, Human
accuuuuccagcuucuagaggc

SEQ ID NO: 2668 - RNA, 22 nt, Human
acccggagucggagguugcagu

SEQ ID NO: 2669 - RNA, 22 nt, Human
acccuaauaaucacagacuagu

SEQ ID NO: 2670 - RNA, 19 nt, Human
acccuaggaggucugguga

SEQ ID NO: 2671 - RNA, 22 nt, Human
acccucaacaaauucacucuau

SEQ ID NO: 2672 - RNA, 22 nt, Human
acccucagacauauuccaucau

SEQ ID NO: 2673 - RNA, 22 nt, Human
acccucaggcagaauguauucu

SEQ ID NO: 2674 - RNA, 22 nt, Human
acccuccacaccagucuuauuu

SEQ ID NO: 2675 - RNA, 20 nt, Human
acccuccacuguucacugug

SEQ ID NO: 2676 - RNA, 22 nt, Human
acccucccauuuccauguagca

SEQ ID NO: 2677 - RNA, 22 nt, Human
acccucugccuugagcagugcc

SEQ ID NO: 2678 - RNA, 22 nt, Human
acccucuggcucauuuccuagu

SEQ ID NO: 2679 - RNA, 20 nt, Human
acccugaggcuccccagccu

SEQ ID NO: 2680 - RNA, 22 nt, Human
acccugagggguauagcagaag

SEQ ID NO: 2681 - RNA, 22 nt, Human
acccugagggugcuggguuucu

SEQ ID NO: 2682 - RNA, 22 nt, Human
acccugagucagacagccugac

SEQ ID NO: 2683 - RNA, 22 nt, Human
acccugagugcaacggugagga

SEQ ID NO: 2684 - RNA, 22 nt, Human
acccugccgugggcugcuugug

SEQ ID NO: 2685 - RNA, 22 nt, Human
acccugccucugcuuccuguag

SEQ ID NO: 2686 - RNA, 21 nt, Human
acccugcuuuaugccguccuc

SEQ ID NO: 2687 - RNA, 22 nt, Human
acccuggagcaauaaucccugg

SEQ ID NO: 2688 - RNA, 22 nt, Human
acccuggagcuuuucuggcccu

SEQ ID NO: 2689 - RNA, 22 nt, Human
acccuggagguggaggugcagu

SEQ ID NO: 2690 - RNA, 22 nt, Human
acccuggcagccuucuguccug

SEQ ID NO: 2691 - RNA, 18 nt, Human
acccuggcaugcucuucc

SEQ ID NO: 2692 - RNA, 22 nt, Human
acccuggccugguucaugugau

SEQ ID NO: 2693 - RNA, 22 nt, Human
acccugggacuuccgaguugag

SEQ ID NO: 2694 - RNA, 23 nt, Human
acccugggcaagucaccuaaccu

SEQ ID NO: 2695 - RNA, 22 nt, Human
acccugggucauauacagugug

SEQ ID NO: 2696 - RNA, 21 nt, Human
acccuggguucuccauacccu

SEQ ID NO: 2697 - RNA, 22 nt, Human
acccuguaugcuauaucccuaa

SEQ ID NO: 2698 - RNA, 22 nt, Human
acccugugucacaguggccugu

SEQ ID NO: 2699 - RNA, 22 nt, Human
acccuuccaaaugagcuuauua

SEQ ID NO: 2700 - RNA, 22 nt, Human
acccuuuguccaauagaaauga

SEQ ID NO: 2701 - RNA, 22 nt, Human
acccuuuugccuuuaauucaug

SEQ ID NO: 2702 - RNA, 22 nt, Human
accgugucugacacuuugggcg

SEQ ID NO: 2703 - RNA, 22 nt, Human
accuaacuuaccuagguccaca

SEQ ID NO: 2704 - RNA, 22 nt, Human
accuaagagaucuucuggucca

SEQ ID NO: 2705 - RNA, 22 nt, Human
accuacuaauugagauaauagg

SEQ ID NO: 2706 - RNA, 22 nt, Human
accuagaaacugacagaauauu

SEQ ID NO: 2707 - RNA, 22 nt, Human
accuagaauccaucugcuuauu

SEQ ID NO: 2708 - RNA, 22 nt, Human
accuagaauuuaaaacauugcu

SEQ ID NO: 2709 - RNA, 20 nt, Human
accuaguacaaucuguuucu

SEQ ID NO: 2710 - RNA, 22 nt, Human
accuauuuaugcaauuaugaaa

SEQ ID NO: 2711 - RNA, 22 nt, Human
accucaagugauccacucaccu

SEQ ID NO: 2712 - RNA, 22 nt, Human
accucagaacggcguucuugaa

SEQ ID NO: 2713 - RNA, 22 nt, Human
accucagagauacaaaccaugg

SEQ ID NO: 2714 - RNA, 22 nt, Human
accucagauuguggcuccgcug

SEQ ID NO: 2715 - RNA, 22 nt, Human
accucccagcucugagcuuggg

SEQ ID NO: 2716 - RNA, 22 nt, Human
accuccccauuaggucacccac

SEQ ID NO: 2717 - RNA, 22 nt, Human
accucccuccaucuggacacua

SEQ ID NO: 2718 - RNA, 22 nt, Human
accucccuugcuaaagacugug

SEQ ID NO: 2719 - RNA, 22 nt, Human
accuccuggugcccaaguguuu

SEQ ID NO: 2720 - RNA, 22 nt, Human
accucgaguucuuucaauucac

SEQ ID NO: 2721 - RNA, 22 nt, Human
accucugcaaugcaaugucaug

SEQ ID NO: 2722 - RNA, 22 nt, Human
accucugcaguagggcugugcc

SEQ ID NO: 2723 - RNA, 22 nt, Human
accucugcuucccggguucaag

SEQ ID NO: 2724 - RNA, 22 nt, Human
accucuuaauauugcaccuucu

SEQ ID NO: 2725 - RNA, 22 nt, Human
accugaaaccaacuuguguacu

SEQ ID NO: 2726 - RNA, 22 nt, Human
accugaauugauuugaccugua

SEQ ID NO: 2727 - RNA, 22 nt, Human
accugaggaagggcgagaagcu

SEQ ID NO: 2728 - RNA, 22 nt, Human
accugauauguuugaucacccu

SEQ ID NO: 2729 - RNA, 22 nt, Human
accugauguauagauucuagau

SEQ ID NO: 2730 - RNA, 22 nt, Human
accugcagcugagaaaaugacu

SEQ ID NO: 2731 - RNA, 22 nt, Human
accugccagcugagaagggugu

SEQ ID NO: 2732 - RNA, 19 nt, Human
accugccaugacagccuga

SEQ ID NO: 2733 - RNA, 22 nt, Human
accugcccggggacauuccuuu

SEQ ID NO: 2734 - RNA, 20 nt, Human
accuggagacagcacucugg

SEQ ID NO: 2735 - RNA, 20 nt, Human
accuggagagauuauuacca

SEQ ID NO: 2736 - RNA, 22 nt, Human
accuggaugcuggccuugccuu

SEQ ID NO: 2737 - RNA, 22 nt, Human
accuggauuuugcuuagacaug

SEQ ID NO: 2738 - RNA, 22 nt, Human
accuggcaugaagcaugccuua

SEQ ID NO: 2739 - RNA, 22 nt, Human
accuggcugagaacgugcagcu

SEQ ID NO: 2740 - RNA, 20 nt, Human
accuggcuuccucuuggcau

SEQ ID NO: 2741 - RNA, 22 nt, Human
accuggcuuuggggauaggcuu

SEQ ID NO: 2742 - RNA, 22 nt, Human
accugggaagaucuuugaagcu

SEQ ID NO: 2743 - RNA, 22 nt, Human
accugggaggcggagguugcag

SEQ ID NO: 2744 - RNA, 22 nt, Human
accugggauggggccagguuua

SEQ ID NO: 2745 - RNA, 22 nt, Human
accugggcauuuuggaugauua

SEQ ID NO: 2746 - RNA, 20 nt, Human
accugggguugccugugcuc

SEQ ID NO: 2747 - RNA, 22 nt, Human
accugucuauaaaagugaauac

SEQ ID NO: 2748 - RNA, 22 nt, Human
accugucugcaugaucuaaaac

SEQ ID NO: 2749 - RNA, 21 nt, Human
accugugaauagccacugcac

SEQ ID NO: 2750 - RNA, 22 nt, Human
accugugcaaagacuggucagg

SEQ ID NO: 2751 - RNA, 22 nt, Human
accugugcacagucagcccugg

SEQ ID NO: 2752 - RNA, 22 nt, Human
accuguuuacccugggcucccc

SEQ ID NO: 2753 - RNA, 22 nt, Human
accuguuucucucugaguuacu

SEQ ID NO: 2754 - RNA, 22 nt, Human
accuguuuggaggagguguuag

SEQ ID NO: 2755 - RNA, 19 nt, Human
accuuacagaaacaggcau

SEQ ID NO: 2756 - RNA, 22 nt, Human
accuuagaccagcaagauauuu

SEQ ID NO: 2757 - RNA, 22 nt, Human
accuucaccuccacaccuuggg

SEQ ID NO: 2758 - RNA, 22 nt, Human
acucauuuaaacauuuacugaa

SEQ ID NO: 2759 - RNA, 22 nt, Human
acucauuugacacuuuaaacug

SEQ ID NO: 2760 - RNA, 22 nt, Human
acuccagacacagacacuauga

SEQ ID NO: 2761 - RNA, 22 nt, Human
acuccaggauguagaaucagag

SEQ ID NO: 2762 - RNA, 22 nt, Human
acuccagggcuccaccccagau

SEQ ID NO: 2763 - RNA, 22 nt, Human
acuccagggcugaacgaggccc

SEQ ID NO: 2764 - RNA, 22 nt, Human
acuccaggguuuugcaccugga

SEQ ID NO: 2765 - RNA, 22 nt, Human
acuccagguuuucucucaaguu

SEQ ID NO: 2766 - RNA, 22 nt, Human
acuccagguuuuuucacugaag

SEQ ID NO: 2767 - RNA, 22 nt, Human
acuccaguucucuuguuuauaa

SEQ ID NO: 2768 - RNA, 22 nt, Human
acucccacuccagaguagaagc

SEQ ID NO: 2769 - RNA, 22 nt, Human
acucccagaacaugcucuucuu

SEQ ID NO: 2770 - RNA, 22 nt, Human
acucccucucuaguccuugcaa

SEQ ID NO: 2771 - RNA, 22 nt, Human
acucccuggcaggucuuuaucu

SEQ ID NO: 2772 - RNA, 22 nt, Human
acucccuugguggagaaugcaa

SEQ ID NO: 2773 - RNA, 22 nt, Human
acucccuuuccaggaaacacaa

SEQ ID NO: 2774 - RNA, 22 nt, Human
acuccuggaaaagaacgcaggg

SEQ ID NO: 2775 - RNA, 22 nt, Human
acuccugggugcauuucugauu

SEQ ID NO: 2776 - RNA, 22 nt, Human
acucuaaaaugcuaugagaucu

SEQ ID NO: 2777 - RNA, 22 nt, Human
acucuaaauagccucuuaaaca

SEQ ID NO: 2778 - RNA, 22 nt, Human
acucucacugcuuggcuccugc

SEQ ID NO: 2779 - RNA, 22 nt, Human
acucucagaggguggcagcaau

SEQ ID NO: 2780 - RNA, 22 nt, Human
acucucccugagagggaggcau

SEQ ID NO: 2781 - RNA, 22 nt, Human
acucuccuuuugaucuucagaa

SEQ ID NO: 2782 - RNA, 22 nt, Human
acucucugggcaugccccacca

SEQ ID NO: 2783 - RNA, 21 nt, Human
acucugaaaauuaauaguuau

SEQ ID NO: 2784 - RNA, 22 nt, Human
acucugaaauagaggcuggugg

SEQ ID NO: 2785 - RNA, 22 nt, Human
accuuuuuguucuguucucagc

SEQ ID NO: 2786 - RNA, 22 nt, Human
accuuuuuucagaacucuaaag

SEQ ID NO: 2787 - RNA, 22 nt, Human
acgaaauacuuugcacaguuuu

SEQ ID NO: 2788 - RNA, 22 nt, Human
acgaagacgccguucuugccga

SEQ ID NO: 2789 - RNA, 22 nt, Human
acgagucugcucuugaaaaagu

SEQ ID NO: 2790 - RNA, 22 nt, Human
acgcagaagggccuggcgugcc

SEQ ID NO: 2791 - RNA, 22 nt, Human
acgccaguagacugaaccuuuc

SEQ ID NO: 2792 - RNA, 22 nt, Human
acgcuucugguucuggcuuuag

SEQ ID NO: 2793 - RNA, 22 nt, Human
acggccuggugcagcaggucgc

SEQ ID NO: 2794 - RNA, 22 nt, Human
acgggcagacagagcuacucgc

SEQ ID NO: 2795 - RNA, 22 nt, Human
acggguggcugaggaggccucu

SEQ ID NO: 2796 - RNA, 22 nt, Human
acgguaacagauaccacagacu

SEQ ID NO: 2797 - RNA, 22 nt, Human
acggugccgguggugaugagcc

SEQ ID NO: 2798 - RNA, 22 nt, Human
acguagcacugagagaugcagg

SEQ ID NO: 2799 - RNA, 22 nt, Human
acguaguguguuguggaaagag

SEQ ID NO: 2800 - RNA, 22 nt, Human
acgugcauauguauacacacau

SEQ ID NO: 2801 - RNA, 22 nt, Human
acgugcaucuuuccauaugugg

SEQ ID NO: 2802 - RNA, 22 nt, Human
acgugcgugugcgcacacauac

SEQ ID NO: 2803 - RNA, 20 nt, Human
acguggccaccaguggcuua

SEQ ID NO: 2804 - RNA, 22 nt, Human
acguguucaauuuccaucugac

SEQ ID NO: 2805 - RNA, 22 nt, Human
acguuaaacauuuagcauagua

SEQ ID NO: 2806 - RNA, 22 nt, Human
acguugaaugguuaauuuguau

SEQ ID NO: 2807 - RNA, 22 nt, Human
acguugaauguccauuugagau

SEQ ID NO: 2808 - RNA, 22 nt, Human
acguuugcuuucuuuggccugg

SEQ ID NO: 2809 - RNA, 22 nt, Human
acguuuucagccuuaauguaga

SEQ ID NO: 2810 - RNA, 22 nt, Human
acuaaacauucuugucucucaa

SEQ ID NO: 2811 - RNA, 22 nt, Human
acuaaaguccuguuguagcaua

SEQ ID NO: 2812 - RNA, 22 nt, Human
acuaaagugcaccccuuugaga

SEQ ID NO: 2813 - RNA, 22 nt, Human
acuaaaguguuggagaaugagg

SEQ ID NO: 2814 - RNA, 22 nt, Human
acuaaaugagauacugucuuca

SEQ ID NO: 2815 - RNA, 22 nt, Human
acuaaaugcauugguaucuauu

SEQ ID NO: 2816 - RNA, 22 nt, Human
acuaaauggaaugauuacuaua

SEQ ID NO: 2817 - RNA, 23 nt, Human
acuaaauggggcuuugcuuaaag

SEQ ID NO: 2818 - RNA, 20 nt, Human
acuaacauuugcaaggggcu

SEQ ID NO: 2819 - RNA, 20 nt, Human
acuaaggugguagcagcagg

SEQ ID NO: 2820 - RNA, 22 nt, Human
acuaaguaguuucacauauaau

SEQ ID NO: 2821 - RNA, 20 nt, Human
acuaaucauccagucacagu

SEQ ID NO: 2822 - RNA, 22 nt, Human
acuaaugauuauugucauugug

SEQ ID NO: 2823 - RNA, 22 nt, Human
acuaauugaaaugagacuggug

SEQ ID NO: 2824 - RNA, 22 nt, Human
acuacacuccaauuuucuaggu

SEQ ID NO: 2825 - RNA, 22 nt, Human
acuacacugcccuggggaucaa

SEQ ID NO: 2826 - RNA, 22 nt, Human
acuacaguacuauaucuauagg

SEQ ID NO: 2827 - RNA, 22 nt, Human
acuaccuuauacaaaauguagg

SEQ ID NO: 2828 - RNA, 22 nt, Human
acuacuacaagugaguacaaag

SEQ ID NO: 2829 - RNA, 23 nt, Human
acuagaaaaugacuuucucccug

SEQ ID NO: 2830 - RNA, 22 nt, Human
acuagaaagaaguuuuuugaga

SEQ ID NO: 2831 - RNA, 22 nt, Human
acuagaaagcacuaagcuaggc

SEQ ID NO: 2832 - RNA, 20 nt, Human
acuagaaagucacugggggg

SEQ ID NO: 2833 - RNA, 22 nt, Human
acuagaaugcaagcuccacaag

SEQ ID NO: 2834 - RNA, 22 nt, Human
acuagacaucgagcuacagagu

SEQ ID NO: 2835 - RNA, 22 nt, Human
acuagcagggauauuauauaag

SEQ ID NO: 2836 - RNA, 22 nt, Human
acuagcagucagcgguuggcaa

SEQ ID NO: 2837 - RNA, 22 nt, Human
acuaggaauucaaguagacaga

SEQ ID NO: 2838 - RNA, 22 nt, Human
acuaggagaaaacuuacacuga

SEQ ID NO: 2839 - RNA, 22 nt, Human
acuaguauuagacuaaaaguca

SEQ ID NO: 2840 - RNA, 22 nt, Human
acuaguguccuuauauaagagg

SEQ ID NO: 2841 - RNA, 22 nt, Human
acuaguuuauuacaguuccacu

SEQ ID NO: 2842 - RNA, 22 nt, Human
acuauaaaaggauaaaccagaa

SEQ ID NO: 2843 - RNA, 22 nt, Human
acuauaaccuguuagaauagau

SEQ ID NO: 2844 - RNA, 22 nt, Human
acuauacaguauguacgugcac

SEQ ID NO: 2845 - RNA, 22 nt, Human
acuauacugucucuuauagaua

SEQ ID NO: 2846 - RNA, 22 nt, Human
acuauagcucggguuauaaugu

SEQ ID NO: 2847 - RNA, 22 nt, Human
acuaugaaaguauaauauugaa

SEQ ID NO: 2848 - RNA, 22 nt, Human
acuaugauguauuuugcaucua

SEQ ID NO: 2849 - RNA, 22 nt, Human
acuaugcucauuguuaauauuu

SEQ ID NO: 2850 - RNA, 22 nt, Human
acuauugcaauacgugucagca

SEQ ID NO: 2851 - RNA, 23 nt, Human
acucaaaauuuggcauuugagga

SEQ ID NO: 2852 - RNA, 22 nt, Human
acucaaguagauauuaacaaaa

SEQ ID NO: 2853 - RNA, 19 nt, Human
acucaagucuaaugaaauc

SEQ ID NO: 2854 - RNA, 21 nt, Human
acucaaguggagaugccaggu

SEQ ID NO: 2855 - RNA, 21 nt, Human
acucaagugggcaugcgcaga

SEQ ID NO: 2856 - RNA, 22 nt, Human
acucacagacugcagguuuauu

SEQ ID NO: 2857 - RNA, 18 nt, Human
acucacagcagaagaagg

SEQ ID NO: 2858 - RNA, 22 nt, Human
acucacagcaugagcuuggcag

SEQ ID NO: 2859 - RNA, 22 nt, Human
acucacagucccuguaggagug

SEQ ID NO: 2860 - RNA, 22 nt, Human
acucagaaccauuuacucugag

SEQ ID NO: 2861 - RNA, 23 nt, Human
acucagagaccccgggaagugac

SEQ ID NO: 2862 - RNA, 22 nt, Human
acucagagccucgagggacugc

SEQ ID NO: 2863 - RNA, 22 nt, Human
acucagcucaggagcuggcugg

SEQ ID NO: 2864 - RNA, 22 nt, Human
acucaggaaaugagaggcucuc

SEQ ID NO: 2865 - RNA, 21 nt, Human
acucaggagacuaacuauguc

SEQ ID NO: 2866 - RNA, 22 nt, Human
acucaggcacucagcccucgcc

SEQ ID NO: 2867 - RNA, 22 nt, Human
agacauauggugaaacauuuua

SEQ ID NO: 2868 - RNA, 22 nt, Human
agacaucauguuacagauuaag

SEQ ID NO: 2869 - RNA, 22 nt, Human
agacaucucccaugcauuuuua

SEQ ID NO: 2870 - RNA, 22 nt, Human
agacaucuugcacacauauacu

SEQ ID NO: 2871 - RNA, 23 nt, Human
agacauggcaggaauacagcuuc

SEQ ID NO: 2872 - RNA, 21 nt, Human
agacaugugaacuaaagguga

SEQ ID NO: 2873 - RNA, 22 nt, Human
agacaugugguauaaucagggg

SEQ ID NO: 2874 - RNA, 22 nt, Human
agacauuggcuaaaaguagugu

SEQ ID NO: 2875 - RNA, 22 nt, Human
agacauuuauguuucucuagga

SEQ ID NO: 2876 - RNA, 22 nt, Human
agacauuuccuagacaucaaug

SEQ ID NO: 2877 - RNA, 22 nt, Human
agacauuuggaagauacacaua

SEQ ID NO: 2878 - RNA, 22 nt, Human
agaccaaagaaaacacaucugg

SEQ ID NO: 2879 - RNA, 22 nt, Human
agaccaagugcaggugccacua

SEQ ID NO: 2880 - RNA, 22 nt, Human
agaccacuaaaacuuucucuau

SEQ ID NO: 2881 - RNA, 22 nt, Human
agaccacuuggauaagaaacag

SEQ ID NO: 2882 - RNA, 22 nt, Human
agacccacacuuugaguagcaa

SEQ ID NO: 2883 - RNA, 22 nt, Human
agaccccauaccucagcaggua

SEQ ID NO: 2884 - RNA, 22 nt, Human
agacccugcaccucucgugggc

SEQ ID NO: 2885 - RNA, 20 nt, Human
agacccuguguccuguggcc

SEQ ID NO: 2886 - RNA, 22 nt, Human
agacccuguuaguuccagucuu

SEQ ID NO: 2887 - RNA, 22 nt, Human
agaccucaauaccaggcaccac

SEQ ID NO: 2888 - RNA, 22 nt, Human
agaccucugcucccuucauggu

SEQ ID NO: 2889 - RNA, 21 nt, Human
agaccucuucccuucaugcac

SEQ ID NO: 2890 - RNA, 23 nt, Human
agaccugcaucugauaggcccug

SEQ ID NO: 2891 - RNA, 22 nt, Human
agaccuggagugaagaguuccc

SEQ ID NO: 2892 - RNA, 22 nt, Human
agaccuggaguggggccucagg

SEQ ID NO: 2893 - RNA, 22 nt, Human
agaccuggguucgaguccuaac

SEQ ID NO: 2894 - RNA, 22 nt, Human
agaccugguuuaucaccagcau

SEQ ID NO: 2895 - RNA, 22 nt, Human
agaccuguuggguucauuggcu

SEQ ID NO: 2896 - RNA, 22 nt, Human
agacgcgguggugcaugccugu

SEQ ID NO: 2897 - RNA, 22 nt, Human
agacuaaauaaugauuuacugg

SEQ ID NO: 2898 - RNA, 22 nt, Human
agacuaaauugggauguguugu

SEQ ID NO: 2899 - RNA, 22 nt, Human
agacuaagcgguucuuuucaau

SEQ ID NO: 2900 - RNA, 20 nt, Human
agacucaguuucuaugcucu

SEQ ID NO: 2901 - RNA, 22 nt, Human
agacucaugacacuuccuauga

SEQ ID NO: 2902 - RNA, 22 nt, Human
agacuccucggaccaaucagcg

SEQ ID NO: 2903 - RNA, 22 nt, Human
agacucugaaaucuaggugcaa

SEQ ID NO: 2904 - RNA, 22 nt, Human
agacucugagacaugaaccauc

SEQ ID NO: 2905 - RNA, 23 nt, Human
agacucugagagugugcuuugca

SEQ ID NO: 2906 - RNA, 22 nt, Human
agacucugaggagcccugagac

SEQ ID NO: 2907 - RNA, 22 nt, Human
agacucugauucccucauguca

SEQ ID NO: 2908 - RNA, 21 nt, Human
agacucuggggaucucugucc

SEQ ID NO: 2909 - RNA, 22 nt, Human
agacugaacccucugcugcacu

SEQ ID NO: 2910 - RNA, 22 nt, Human
agacugaaguaagaaugcagcu

SEQ ID NO: 2911 - RNA, 22 nt, Human
agacugaauaacaagcaaauaa

SEQ ID NO: 2912 - RNA, 22 nt, Human
agacugaauaggaaagagggaa

SEQ ID NO: 2913 - RNA, 22 nt, Human
agacuggauagcuuuggacuug

SEQ ID NO: 2914 - RNA, 22 nt, Human
agacuguaauuuguggccuccu

SEQ ID NO: 2915 - RNA, 21 nt, Human
agacuucuagaagugagauag

SEQ ID NO: 2916 - RNA, 22 nt, Human
agacuuuaacaauggguaugaa

SEQ ID NO: 2917 - RNA, 22 nt, Human
agacuuuaaugugcaaaugaaa

SEQ ID NO: 2918 - RNA, 22 nt, Human
agacuuuagaaucagauagccu

SEQ ID NO: 2919 - RNA, 22 nt, Human
agacuuuagggccaugguaggu

SEQ ID NO: 2920 - RNA, 22 nt, Human
agacuuucuugaccuaguuaau

SEQ ID NO: 2921 - RNA, 23 nt, Human
agagaaaaauaucugggcacauu

SEQ ID NO: 2922 - RNA, 22 nt, Human
agagaaaacucauugagguguc

SEQ ID NO: 2923 - RNA, 22 nt, Human
agagaaaagaguucaggcuuug

SEQ ID NO: 2924 - RNA, 22 nt, Human
agagaaaguaaagauucuaccu

SEQ ID NO: 2925 - RNA, 22 nt, Human
agagaaauauuuaggaaaggag

SEQ ID NO: 2926 - RNA, 22 nt, Human
agagaacauuagcaaaaacagc

SEQ ID NO: 2927 - RNA, 22 nt, Human
agagaacuucuccuaaaucuca

SEQ ID NO: 2928 - RNA, 22 nt, Human
agagaagcauucuucucagggc

SEQ ID NO: 2929 - RNA, 22 nt, Human
agagaaggaaagcugacauggg

SEQ ID NO: 2930 - RNA, 22 nt, Human
agagaagggguaaagaguccug

SEQ ID NO: 2931 - RNA, 22 nt, Human
agagaaggguguagccugggcc

SEQ ID NO: 2932 - RNA, 22 nt, Human
agagaaucuagaauguuuauac

SEQ ID NO: 2933 - RNA, 22 nt, Human
agagaaucugggaagauguuaa

SEQ ID NO: 2934 - RNA, 20 nt, Human
agagaauucccuuuggagau

SEQ ID NO: 2935 - RNA, 22 nt, Human
acugagguugaaauagugaugu

SEQ ID NO: 2936 - RNA, 22 nt, Human
acugagguuguaguaggaauuc

SEQ ID NO: 2937 - RNA, 22 nt, Human
acugagguuuuuaguguuaaau

SEQ ID NO: 2938 - RNA, 22 nt, Human
acugaguuauggguaugccuug

SEQ ID NO: 2939 - RNA, 22 nt, Human
acugauaaguugcuugcucuca

SEQ ID NO: 2940 - RNA, 22 nt, Human
acugaucaaggguuuaauuuua

SEQ ID NO: 2941 - RNA, 22 nt, Human
acugaucugccuguauguagcu

SEQ ID NO: 2942 - RNA, 22 nt, Human
acugaugaguaggcagacaagg

SEQ ID NO: 2943 - RNA, 22 nt, Human
acugaugaucugggaguagagu

SEQ ID NO: 2944 - RNA, 22 nt, Human
acugauguucagccauguucug

SEQ ID NO: 2945 - RNA, 23 nt, Human
acugauuaacaugugugauauuc

SEQ ID NO: 2946 - RNA, 23 nt, Human
acugauucuugaaguugacaagu

SEQ ID NO: 2947 - RNA, 22 nt, Human
acugcaaucuggauccuagaag

SEQ ID NO: 2948 - RNA, 22 nt, Human
acugcaauuauuuguucaccaa

SEQ ID NO: 2949 - RNA, 22 nt, Human
acugcacaccuccagggcacua

SEQ ID NO: 2950 - RNA, 22 nt, Human
acugcacagauuaaguuagauu

SEQ ID NO: 2951 - RNA, 22 nt, Human
acugcaccuugcgguccugugg

SEQ ID NO: 2952 - RNA, 22 nt, Human
acugcacugauuuaucauccca

SEQ ID NO: 2953 - RNA, 22 nt, Human
acugcagagcuuuucaguugag

SEQ ID NO: 2954 - RNA, 22 nt, Human
acugcagagguggggugcagag

SEQ ID NO: 2955 - RNA, 22 nt, Human
acugcagccuagggaccacagu

SEQ ID NO: 2956 - RNA, 22 nt, Human
acugcagcuggugguggcucug

SEQ ID NO: 2957 - RNA, 22 nt, Human
acugcaggagacacagcugcug

SEQ ID NO: 2958 - RNA, 18 nt, Human
acugcaggagaggugagg

SEQ ID NO: 2959 - RNA, 22 nt, Human
acugcaucugaaacauggguca

SEQ ID NO: 2960 - RNA, 22 nt, Human
acugcauucuuuaucccacaac

SEQ ID NO: 2961 - RNA, 22 nt, Human
acugccaccuggugguccugga

SEQ ID NO: 2962 - RNA, 22 nt, Human
acugccagaagacagcuuuuca

SEQ ID NO: 2963 - RNA, 22 nt, Human
acugccauuggucaaaugagug

SEQ ID NO: 2964 - RNA, 22 nt, Human
acugcccacagugaaugguugg

SEQ ID NO: 2965 - RNA, 22 nt, Human
acugcccacaucucuuuccgcu

SEQ ID NO: 2966 - RNA, 21 nt, Human
acugcccaccaguuaacgcug

SEQ ID NO: 2967 - RNA, 22 nt, Human
acugcccaggaaucucaaagaa

SEQ ID NO: 2968 - RNA, 22 nt, Human
acugccucuuggugcugagaga

SEQ ID NO: 2969 - RNA, 22 nt, Human
acugccugagcuauuggaaaag

SEQ ID NO: 2970 - RNA, 22 nt, Human
acugccugaugugguucuaaau

SEQ ID NO: 2971 - RNA, 22 nt, Human
acugccugcauccuuaggguag

SEQ ID NO: 2972 - RNA, 23 nt, Human
acugccugcuacuaugcccacgg

SEQ ID NO: 2973 - RNA, 18 nt, Human
acugccuggcgaagauag

SEQ ID NO: 2974 - RNA, 21 nt, Human
acugccuggggugcuggccaa

SEQ ID NO: 2975 - RNA, 22 nt, Human
acugccuguagcucuucaucuc

SEQ ID NO: 2976 - RNA, 22 nt, Human
agaacauaauuaucauaaacug

SEQ ID NO: 2977 - RNA, 22 nt, Human
agaacaucuaaauaucugagac

SEQ ID NO: 2978 - RNA, 20 nt, Human
agaaccuaaguuaaaacaca

SEQ ID NO: 2979 - RNA, 22 nt, Human
agaaccuuccaucacucccuac

SEQ ID NO: 2980 - RNA, 21 nt, Human
agaaccuuggaugccauugca

SEQ ID NO: 2981 - RNA, 22 nt, Human
agaaccuuggugagucuaaccu

SEQ ID NO: 2982 - RNA, 22 nt, Human
agaaccuuucuuuagaaauuca

SEQ ID NO: 2983 - RNA, 22 nt, Human
agaacgcuauucagaacacugg

SEQ ID NO: 2984 - RNA, 22 nt, Human
agaacguggaauguggcuccuu

SEQ ID NO: 2985 - RNA, 22 nt, Human
agaacugugccaaaaauuuugu

SEQ ID NO: 2986 - RNA, 22 nt, Human
agaacuuuuggagacuuuuagu

SEQ ID NO: 2987 - RNA, 22 nt, Human
agaagaaaugaggccguucugc

SEQ ID NO: 2988 - RNA, 22 nt, Human
agaagaaaugugaaggccacug

SEQ ID NO: 2989 - RNA, 22 nt, Human
agaagaauacuugauguucaug

SEQ ID NO: 2990 - RNA, 21 nt, Human
agaagagaagcaggacccucu

SEQ ID NO: 2991 - RNA, 22 nt, Human
agaagagccacuguugacggca

SEQ ID NO: 2992 - RNA, 22 nt, Human
agaagauuuagguugacgcuau

SEQ ID NO: 2993 - RNA, 22 nt, Human
agaagcacaccaguagacaggg

SEQ ID NO: 2994 - RNA, 22 nt, Human
agaagcacagguaaagugauuu

SEQ ID NO: 2995 - RNA, 22 nt, Human
agaagcacuagaggguauggaa

SEQ ID NO: 2996 - RNA, 22 nt, Human
agaagcagaaacugggcuugug

SEQ ID NO: 2997 - RNA, 22 nt, Human
agaagcagggcagggaaaagca

SEQ ID NO: 2998 - RNA, 18 nt, Human
agaagcagguaaaauucu

SEQ ID NO: 2999 - RNA, 22 nt, Human
agaagcaguuauuuuuugcaca

SEQ ID NO: 3000 - RNA, 22 nt, Human
agaagcauuauaacaugcaagg

SEQ ID NO: 3001 - RNA, 22 nt, Human
agaagccaaaugccagugaccu

SEQ ID NO: 3002 - RNA, 22 nt, Human
agaagccacaggaaagcagcuu

SEQ ID NO: 3003 - RNA, 22 nt, Human
agaagccagcuucagcugcccg

SEQ ID NO: 3004 - RNA, 21 nt, Human
agaagccaugugguggagaac

SEQ ID NO: 3005 - RNA, 22 nt, Human
agaagccauucccuguaggcuc

SEQ ID NO: 3006 - RNA, 21 nt, Human
agaagccauuuguuaggacuu

SEQ ID NO: 3007 - RNA, 22 nt, Human
agaagcccagcauggaaccagc

SEQ ID NO: 3008 - RNA, 22 nt, Human
agaagccucauccucucuagug

SEQ ID NO: 3009 - RNA, 21 nt, Human
agaagccugaugaggucugcu

SEQ ID NO: 3010 - RNA, 21 nt, Human
agaagccuggguggagguggg

SEQ ID NO: 3011 - RNA, 22 nt, Human
agaagccuguugagagggccgu

SEQ ID NO: 3012 - RNA, 22 nt, Human
agaagcuaauucaugucuuaug

SEQ ID NO: 3013 - RNA, 22 nt, Human
agaagcuauaacaacaauuaua

SEQ ID NO: 3014 - RNA, 22 nt, Human
agaagcugccuacaugaccagc

SEQ ID NO: 3015 - RNA, 22 nt, Human
agaagcugcguuuauuuaaauc

SEQ ID NO: 3016 - RNA, 19 nt, Human
agaagcugugaaaugaagg

SEQ ID NO: 3017 - RNA, 22 nt, Human
agaagcuuccuacauuguucuu

SEQ ID NO: 3018 - RNA, 22 nt, Human
agaagcuugaaggagcagugac

SEQ ID NO: 3019 - RNA, 22 nt, Human
agaaggaaaaccugucuuaugu

SEQ ID NO: 3020 - RNA, 22 nt, Human
agaaggaguguacaggucaugc

SEQ ID NO: 3021 - RNA, 21 nt, Human
agaaggcaccagcaaggacug

SEQ ID NO: 3022 - RNA, 22 nt, Human
agaaggcacucacacuggcacg

SEQ ID NO: 3023 - RNA, 22 nt, Human
agaaggcagguuuuaaaauguc

SEQ ID NO: 3024 - RNA, 22 nt, Human
agaaggcauagaccggauuaug

SEQ ID NO: 3025 - RNA, 22 nt, Human
agaaggccaugucuugguacuu

SEQ ID NO: 3026 - RNA, 22 nt, Human
agaaggcuaaaguaacuuagua

SEQ ID NO: 3027 - RNA, 22 nt, Human
agaaggcucacuaagagugacu

SEQ ID NO: 3028 - RNA, 22 nt, Human
agaaggcucaucccucacccca

SEQ ID NO: 3029 - RNA, 22 nt, Human
agaaggcucauuugacugcauu

SEQ ID NO: 3030 - RNA, 22 nt, Human
agaaggcuccaaguagaguuug

SEQ ID NO: 3031 - RNA, 19 nt, Human
agaaggcuccuguuggaga

SEQ ID NO: 3032 - RNA, 20 nt, Human
agaaggcuccuuuugccaag

SEQ ID NO: 3033 - RNA, 21 nt, Human
agaagggauugugguaaagau

SEQ ID NO: 3034 - RNA, 22 nt, Human
agaaggggcccaaggaugucag

SEQ ID NO: 3035 - RNA, 22 nt, Human
agaaggguguauacauuuccug

SEQ ID NO: 3036 - RNA, 22 nt, Human
agaaggguucaggaauauguua

SEQ ID NO: 3037 - RNA, 22 nt, Human
agaaguauuuggcuaaaagaca

SEQ ID NO: 3038 - RNA, 22 nt, Human
agaagucaaguggucuaugaaa

SEQ ID NO: 3039 - RNA, 22 nt, Human
agaagucaauaguuguuugaug

SEQ ID NO: 3040 - RNA, 22 nt, Human
agaagucagccacagugggaga

SEQ ID NO: 3041 - RNA, 22 nt, Human
agaaguccccccagcaucguag

SEQ ID NO: 3042 - RNA, 22 nt, Human
agaagugccgaaaggaagacag

SEQ ID NO: 3043 - RNA, 20 nt, Human
agaaguggcugcagacacua

SEQ ID NO: 3044 - RNA, 22 nt, Human
agaaguguuuauuucagcaaca

SEQ ID NO: 3045 - RNA, 22 nt, Human
agaaguuauccaccuuagaugc

SEQ ID NO: 3046 - RNA, 23 nt, Human
agaaguucaagaccagccugccc

SEQ ID NO: 3047 - RNA, 22 nt, Human
agaaguucuggagacggaagug

SEQ ID NO: 3048 - RNA, 22 nt, Human
agaaguuuccagucuaguaagg

SEQ ID NO: 3049 - RNA, 22 nt, Human
agaaguuucucugaacguguag

SEQ ID NO: 3050 - RNA, 22 nt, Human
agaaguuugcucacuugggaca

SEQ ID NO: 3051 - RNA, 22 nt, Human
acuguaaaacugcuuuggaaac

SEQ ID NO: 3052 - RNA, 22 nt, Human
acuguaaagguuuguagcccag

SEQ ID NO: 3053 - RNA, 22 nt, Human
acuguaacgccagcuuuaaaug

SEQ ID NO: 3054 - RNA, 22 nt, Human
acuguaagguaaggauaaaacc

SEQ ID NO: 3055 - RNA, 22 nt, Human
acuguacaaauauugcaaaaua

SEQ ID NO: 3056 - RNA, 22 nt, Human
acuguacacagugguguacugu

SEQ ID NO: 3057 - RNA, 22 nt, Human
acuguacacauucgucaagacu

SEQ ID NO: 3058 - RNA, 22 nt, Human
acuguacacgugucauuuacag

SEQ ID NO: 3059 - RNA, 22 nt, Human
acuguacauauggauucuaaga

SEQ ID NO: 3060 - RNA, 22 nt, Human
acuguacaugcaucuugucuau

SEQ ID NO: 3061 - RNA, 22 nt, Human
acuguagaauggaaccaauugu

SEQ ID NO: 3062 - RNA, 19 nt, Human
acuguagcacugcaguaua

SEQ ID NO: 3063 - RNA, 22 nt, Human
acuguagugaugauaauuaagu

SEQ ID NO: 3064 - RNA, 22 nt, Human
acuguauauuggacaaggaaaa

SEQ ID NO: 3065 - RNA, 22 nt, Human
acuguauugguuuucuauugcu

SEQ ID NO: 3066 - RNA, 22 nt, Human
acuguauuuccaacagacaaau

SEQ ID NO: 3067 - RNA, 22 nt, Human
acuguauuuuugaaucauugug

SEQ ID NO: 3068 - RNA, 22 nt, Human
acugucaaaagagauuauauua

SEQ ID NO: 3069 - RNA, 22 nt, Human
acugucacuccaacugagucgu

SEQ ID NO: 3070 - RNA, 22 nt, Human
acugucacugugauguuagaga

SEQ ID NO: 3071 - RNA, 22 nt, Human
acugucaucagaagaugaaaau

SEQ ID NO: 3072 - RNA, 22 nt, Human
acugucaucugguagaugaugg

SEQ ID NO: 3073 - RNA, 22 nt, Human
acugucaucuuguaagcaaugu

SEQ ID NO: 3074 - RNA, 22 nt, Human
acugucaugcauuauggcaugu

SEQ ID NO: 3075 - RNA, 22 nt, Human
acugucccauuuauguagacau

SEQ ID NO: 3076 - RNA, 22 nt, Human
acuguccucgaaguaccugugc

SEQ ID NO: 3077 - RNA, 22 nt, Human
acugucgauuaugaugagucag

SEQ ID NO: 3078 - RNA, 23 nt, Human
acugucugauauguuuuccauca

SEQ ID NO: 3079 - RNA, 22 nt, Human
acugucugugccagaugcuggg

SEQ ID NO: 3080 - RNA, 22 nt, Human
acugucuucaaaugaauauauu

SEQ ID NO: 3081 - RNA, 22 nt, Human
acugucuuguuccaagacuaaa

SEQ ID NO: 3082 - RNA, 17 nt, Human
acugucuuuuacacccu

SEQ ID NO: 3083 - RNA, 21 nt, Human
acugugacuggguguaugggu

SEQ ID NO: 3084 - RNA, 22 nt, Human
acugugaguuuauuuaucugau

SEQ ID NO: 3085 - RNA, 22 nt, Human
agcucuuaucucuaagcacagc

SEQ ID NO: 3086 - RNA, 22 nt, Human
agcucuuccaccucaugauggg

SEQ ID NO: 3087 - RNA, 15 nt, Human
agcucuuucagcuac

SEQ ID NO: 3088 - RNA, 22 nt, Human
agcucuuuugugagcauuuggc

SEQ ID NO: 3089 - RNA, 20 nt, Human
agcucuuuuuagcuaaggua

SEQ ID NO: 3090 - RNA, 22 nt, Human
agcugaaagcuugacuggggcu

SEQ ID NO: 3091 - RNA, 23 nt, Human
agcugaaagcuugcaacgaggca

SEQ ID NO: 3092 - RNA, 22 nt, Human
agcugaaaggguguuggagugu

SEQ ID NO: 3093 - RNA, 22 nt, Human
agcugaaauucuuuguccucag

SEQ ID NO: 3094 - RNA, 17 nt, Human
agacugaggacacagga

SEQ ID NO: 3095 - RNA, 21 nt, Human
agacugccaucuuugggccac

SEQ ID NO: 3096 - RNA, 23 nt, Human
agacuggggcauaagaagauggc

SEQ ID NO: 3097 - RNA, 22 nt, Human
agacuggguuugagacuuagca

SEQ ID NO: 3098 - RNA, 22 nt, Human
agacuguaaagggccagaaagu

SEQ ID NO: 3099 - RNA, 22 nt, Human
agacuguaauugacaugucagc

SEQ ID NO: 3100 - RNA, 22 nt, Human
agacuguacuuucugcagcucu

SEQ ID NO: 3101 - RNA, 22 nt, Human
agacuguagcuucugucuugag

SEQ ID NO: 3102 - RNA, 22 nt, Human
agacugugccacacaugggagu

SEQ ID NO: 3103 - RNA, 22 nt, Human
agacuguuaauuucaauuaaaa

SEQ ID NO: 3104 - RNA, 22 nt, Human
agacuuaauagaagcaugacau

SEQ ID NO: 3105 - RNA, 22 nt, Human
agacuucacucccagagauucu

SEQ ID NO: 3106 - RNA, 22 nt, Human
agacuucucuccuugacuugca

SEQ ID NO: 3107 - RNA, 22 nt, Human
agacuucucuuggcuauauuau

SEQ ID NO: 3108 - RNA, 22 nt, Human
agacuucuugagcuggcacuuc

SEQ ID NO: 3109 - RNA, 22 nt, Human
agacuugggaccuaggaaugga

SEQ ID NO: 3110 - RNA, 22 nt, Human
agacuuugagcucuuagagaag

SEQ ID NO: 3111 - RNA, 18 nt, Human
agacuuugaguuagaggg

SEQ ID NO: 3112 - RNA, 22 nt, Human
agagaaacugauguccuuugaa

SEQ ID NO: 3113 - RNA, 19 nt, Human
agagaaagaauugagucua

SEQ ID NO: 3114 - RNA, 22 nt, Human
agagaaaugauuccugggcaga

SEQ ID NO: 3115 - RNA, 22 nt, Human
agagaaaugggguaaucuuuca

SEQ ID NO: 3116 - RNA, 22 nt, Human
agagaaauucucaguggaagau

SEQ ID NO: 3117 - RNA, 22 nt, Human
agagaacaaauuaaaggugguu

SEQ ID NO: 3118 - RNA, 22 nt, Human
agagaacacgugcaucugcaau

SEQ ID NO: 3119 - RNA, 22 nt, Human
agagaacagacagaugcaauga

SEQ ID NO: 3120 - RNA, 22 nt, Human
agagaagagcaaugauaaauuu

SEQ ID NO: 3121 - RNA, 21 nt, Human
agagaagaggacuuucucaca

SEQ ID NO: 3122 - RNA, 22 nt, Human
agagaagagucuugucaaauua

SEQ ID NO: 3123 - RNA, 19 nt, Human
agagaaggauccuaugguu

SEQ ID NO: 3124 - RNA, 21 nt, Human
agagaagggacucuuccaguc

SEQ ID NO: 3125 - RNA, 22 nt, Human
agagaaggguagcccauucucc

SEQ ID NO: 3126 - RNA, 22 nt, Human
agagaagugagcuuguucacuc

SEQ ID NO: 3127 - RNA, 22 nt, Human
agagaauacaggguaacaggaa

SEQ ID NO: 3128 - RNA, 23 nt, Human
agagaaucauggaaacucuuucu

SEQ ID NO: 3129 - RNA, 22 nt, Human
agagaauccucuacauguuuuu

SEQ ID NO: 3130 - RNA, 21 nt, Human
agagacagagaaaguaacauu

SEQ ID NO: 3131 - RNA, 22 nt, Human
agagacagaggcaauauagcuu

SEQ ID NO: 3132 - RNA, 22 nt, Human
agagacagaucugagggaccuc

SEQ ID NO: 3133 - RNA, 22 nt, Human
agagacaggaguucuguuucca

SEQ ID NO: 3134 - RNA, 22 nt, Human
agagaccagaauccagcugccu

SEQ ID NO: 3135 - RNA, 20 nt, Human
agagacccuguagcuugcag

SEQ ID NO: 3136 - RNA, 22 nt, Human
agagaccuuuguuauucuagga

SEQ ID NO: 3137 - RNA, 22 nt, Human
agagaccuuuugccuucuaguu

SEQ ID NO: 3138 - RNA, 22 nt, Human
agagacugauggagcucacucu

SEQ ID NO: 3139 - RNA, 22 nt, Human
agagacuggagaugggcagugu

SEQ ID NO: 3140 - RNA, 22 nt, Human
agagacuggaguuacgaguuca

SEQ ID NO: 3141 - RNA, 22 nt, Human
agagacugucacauaacagagg

SEQ ID NO: 3142 - RNA, 22 nt, Human
agagacuguggcucuuugaagg

SEQ ID NO: 3143 - RNA, 21 nt, Human
agagagaaggccauauggucc

SEQ ID NO: 3144 - RNA, 18 nt, Human
agagagaauuccaguagg

SEQ ID NO: 3145 - RNA, 22 nt, Human
agagagagaaaugaaaugugcu

SEQ ID NO: 3146 - RNA, 22 nt, Human
agagagaggggcgagcaaacac

SEQ ID NO: 3147 - RNA, 22 nt, Human
agagagcauggcacagaggggu

SEQ ID NO: 3148 - RNA, 22 nt, Human
agagagcauugaggaaaucuuc

SEQ ID NO: 3149 - RNA, 22 nt, Human
agagagcccgggccagggcaca

SEQ ID NO: 3150 - RNA, 22 nt, Human
agagagcuguccugggacaccc

SEQ ID NO: 3151 - RNA, 22 nt, Human
agagaggcauucggugauccca

SEQ ID NO: 3152 - RNA, 22 nt, Human
agagagggcauagaaaaaggga

SEQ ID NO: 3153 - RNA, 22 nt, Human
agagaggucucaggagaaacca

SEQ ID NO: 3154 - RNA, 22 nt, Human
agagagguuaaggagcucuugu

SEQ ID NO: 3155 - RNA, 22 nt, Human
agagagguuggcuaggauguuu

SEQ ID NO: 3156 - RNA, 22 nt, Human
agagauacuuuucuuuggaugc

SEQ ID NO: 3157 - RNA, 21 nt, Human
agagauagacuagaauugaug

SEQ ID NO: 3158 - RNA, 22 nt, Human
agagaucccuucugccugggga

SEQ ID NO: 3159 - RNA, 22 nt, Human
agagaucuagcaccugcugguc

SEQ ID NO: 3160 - RNA, 22 nt, Human
agagaucugucuacuauuuaag

SEQ ID NO: 3161 - RNA, 22 nt, Human
agagaugacugauggcugauua

SEQ ID NO: 3162 - RNA, 22 nt, Human
agagaugcugacguuuacauuu

SEQ ID NO: 3163 - RNA, 22 nt, Human
agagauggccuuaggugggaau

SEQ ID NO: 3164 - RNA, 18 nt, Human
agagaugggaguuggaaa

SEQ ID NO: 3165 - RNA, 18 nt, Human
agagaugguguagaguuu

SEQ ID NO: 3166 - RNA, 22 nt, Human
agagauuaagucacuuggucag

SEQ ID NO: 3167 - RNA, 22 nt, Human
agagauucauguuuacuguagg

SEQ ID NO: 3168 - RNA, 22 nt, Human
agagauuggggaugaaucuuuc

SEQ ID NO: 3169 - RNA, 22 nt, Human
agagauuugucaaugauuucca

SEQ ID NO: 3170 - RNA, 22 nt, Human
agagcaccccgggaagagcaag

SEQ ID NO: 3171 - RNA, 22 nt, Human
agagcacugagugagcaaggcc

SEQ ID NO: 3172 - RNA, 20 nt, Human
agagcagcaguuggugaggu

SEQ ID NO: 3173 - RNA, 22 nt, Human
agagcagccucagcucccugug

SEQ ID NO: 3174 - RNA, 22 nt, Human
agagcagccugugaugaugcac

SEQ ID NO: 3175 - RNA, 22 nt, Human
agagcagcuggggcagagacca

SEQ ID NO: 3176 - RNA, 22 nt, Human
agagcagcugugacauggacag

SEQ ID NO: 3177 - RNA, 22 nt, Human
agagcagcuuuucggaaccacu

SEQ ID NO: 3178 - RNA, 22 nt, Human
agagcaggcauaaagcuuugaa

SEQ ID NO: 3179 - RNA, 22 nt, Human
agagcauccauuuuugucacau

SEQ ID NO: 3180 - RNA, 22 nt, Human
agagccagagaccuggguucac

SEQ ID NO: 3181 - RNA, 22 nt, Human
agagccaggaugucuucugggg

SEQ ID NO: 3182 - RNA, 22 nt, Human
agagccaggcaggcaauguuga

SEQ ID NO: 3183 - RNA, 22 nt, Human
agagccaggccaggccggggca

SEQ ID NO: 3184 - RNA, 22 nt, Human
agagccaguuacaacuguggag

SEQ ID NO: 3185 - RNA, 22 nt, Human
agagccaguuguuaagcacuua

SEQ ID NO: 3186 - RNA, 22 nt, Human
agagcccagaaaguaugucaua

SEQ ID NO: 3187 - RNA, 22 nt, Human
agagcccaggcaggcauccagg

SEQ ID NO: 3188 - RNA, 22 nt, Human
agagcccagucuuugugugaag

SEQ ID NO: 3189 - RNA, 22 nt, Human
agagccccugguggagugagaa

SEQ ID NO: 3190 - RNA, 22 nt, Human
agagcccucucauuggcuuauu

SEQ ID NO: 3191 - RNA, 22 nt, Human
agagcccucuucacugccccuu

SEQ ID NO: 3192 - RNA, 22 nt, Human
agagcccugacggggacagaug

SEQ ID NO: 3193 - RNA, 22 nt, Human
agagcccuuucuccaggcaccu

SEQ ID NO: 3194 - RNA, 22 nt, Human
agaggucacuccaccuucuucu

SEQ ID NO: 3195 - RNA, 22 nt, Human
agaggucagaacaggaaagugu

SEQ ID NO: 3196 - RNA, 22 nt, Human
agaggucagaggucgccagguc

SEQ ID NO: 3197 - RNA, 21 nt, Human
agaggucuaagauucuagcuu

SEQ ID NO: 3198 - RNA, 22 nt, Human
agaggucucaguuauguuuaaa

SEQ ID NO: 3199 - RNA, 22 nt, Human
agaggucuuaaguuccuugaug

SEQ ID NO: 3200 - RNA, 22 nt, Human
agaggucuuuuggucugcagaa

SEQ ID NO: 3201 - RNA, 22 nt, Human
agaggugacauaggagaggcuc

SEQ ID NO: 3202 - RNA, 22 nt, Human
agagguggagcucuuggcauca

SEQ ID NO: 3203 - RNA, 22 nt, Human
agagguggccaugggcgcugga

SEQ ID NO: 3204 - RNA, 22 nt, Human
agagguucaaacuucauaauuu

SEQ ID NO: 3205 - RNA, 22 nt, Human
agagguuguuagaauaguggag

SEQ ID NO: 3206 - RNA, 22 nt, Human
agagguuucuuaggggcuuccu

SEQ ID NO: 3207 - RNA, 22 nt, Human
agaguaaauaggagaugacagc

SEQ ID NO: 3208 - RNA, 22 nt, Human
agaguacauucagagcuaccua

SEQ ID NO: 3209 - RNA, 22 nt, Human
agaguacugccucaguuaugaa

SEQ ID NO: 3210 - RNA, 20 nt, Human
agaguagagguagauuuaug

SEQ ID NO: 3211 - RNA, 22 nt, Human
agaguaugcuacaaagccagcc

SEQ ID NO: 3212 - RNA, 22 nt, Human
agagucaacaucgagccacugg

SEQ ID NO: 3213 - RNA, 22 nt, Human
agagucaccuuuuccucaggau

SEQ ID NO: 3214 - RNA, 22 nt, Human
agagucagaaagcagacagggg

SEQ ID NO: 3215 - RNA, 22 nt, Human
agcaagaaaaucucuguccaau

SEQ ID NO: 3216 - RNA, 22 nt, Human
agcaagaaaucuucaguguucu

SEQ ID NO: 3217 - RNA, 18 nt, Human
agcaagacagugguguga

SEQ ID NO: 3218 - RNA, 22 nt, Human
agcaagauuuuucagguuagua

SEQ ID NO: 3219 - RNA, 22 nt, Human
agcaagcagaauucuguccucu

SEQ ID NO: 3220 - RNA, 22 nt, Human
agcaagcaggauggucaaacua

SEQ ID NO: 3221 - RNA, 18 nt, Human
agcaagcaguuuucaugu

SEQ ID NO: 3222 - RNA, 22 nt, Human
agcaaggaaaguaggcacggaa

SEQ ID NO: 3223 - RNA, 22 nt, Human
agcaaggcagucagcuggcugg

SEQ ID NO: 3224 - RNA, 22 nt, Human
agcaaggccuacagagaggggc

SEQ ID NO: 3225 - RNA, 22 nt, Human
agcaaggcuaaauuucaguuau

SEQ ID NO: 3226 - RNA, 22 nt, Human
agcaaggcucggucagggugau

SEQ ID NO: 3227 - RNA, 22 nt, Human
agcaaggggcagugaaagugug

SEQ ID NO: 3228 - RNA, 22 nt, Human
agcaauaaccacucuaauuuau

SEQ ID NO: 3229 - RNA, 23 nt, Human
agcaauaagaagggauacaugug

SEQ ID NO: 3230 - RNA, 22 nt, Human
agcaauaagggauccucuauaa

SEQ ID NO: 3231 - RNA, 22 nt, Human
agcaauagacacaagauggaua

SEQ ID NO: 3232 - RNA, 22 nt, Human
agcaauauaaauguuggguaga

SEQ ID NO: 3233 - RNA, 22 nt, Human
agcaaugacuaaggcacuuugg

SEQ ID NO: 3234 - RNA, 22 nt, Human
agcaaugacuggcuauaugauu

SEQ ID NO: 3235 - RNA, 22 nt, Human
agcaaugcuuauugcugacuau

SEQ ID NO: 3236 - RNA, 22 nt, Human
agcaauuauuguauaagaacaa

SEQ ID NO: 3237 - RNA, 21 nt, Human
agcaauuucauuugguuuaac

SEQ ID NO: 3238 - RNA, 23 nt, Human
agcacaaaguguuuuccuuguag

SEQ ID NO: 3239 - RNA, 22 nt, Human
agcacaauagagcaguuaaaaa

SEQ ID NO: 3240 - RNA, 22 nt, Human
agcacaauauggguuuuauagu

SEQ ID NO: 3241 - RNA, 22 nt, Human
agcacacaggacuugauucaug

SEQ ID NO: 3242 - RNA, 22 nt, Human
agcacacaguauuagccauugu

SEQ ID NO: 3243 - RNA, 22 nt, Human
agcacacagucuuccuuccucc

SEQ ID NO: 3244 - RNA, 22 nt, Human
agcacacaucacuucugcucau

SEQ ID NO: 3245 - RNA, 22 nt, Human
agcacagaaagcacauuugaaa

SEQ ID NO: 3246 - RNA, 22 nt, Human
agcacagaaugagguggaagug

SEQ ID NO: 3247 - RNA, 22 nt, Human
agcacagaauggcuuggaagcc

SEQ ID NO: 3248 - RNA, 22 nt, Human
agcacagacuggucccaggucu

SEQ ID NO: 3249 - RNA, 22 nt, Human
agcacagagaagauuucaauua

SEQ ID NO: 3250 - RNA, 22 nt, Human
agcacagagcucggggaaugga

SEQ ID NO: 3251 - RNA, 22 nt, Human
agcacagauaacauggagugga

SEQ ID NO: 3252 - RNA, 22 nt, Human
agcacagaugcaugaucaccag

SEQ ID NO: 3253 - RNA, 22 nt, Human
agcacagauggauguauucauu

SEQ ID NO: 3254 - RNA, 21 nt, Human
agcacagcauauccaauguca

SEQ ID NO: 3255 - RNA, 22 nt, Human
agcacagccucugguuucugac

SEQ ID NO: 3256 - RNA, 22 nt, Human
agcacaggcuuuggugugaggg

SEQ ID NO: 3257 - RNA, 22 nt, Human
agcacagguaauacagaguaac

SEQ ID NO: 3258 - RNA, 22 nt, Human
agcacagugcucuggacagagu

SEQ ID NO: 3259 - RNA, 22 nt, Human
agcacaguggcuucuaugucua

SEQ ID NO: 3260 - RNA, 22 nt, Human
agcacaguugguaaaauuguua

SEQ ID NO: 3261 - RNA, 19 nt, Human
agcacaguuuccacaugca

SEQ ID NO: 3262 - RNA, 22 nt, Human
agcacaguuuucauugcagggu

SEQ ID NO: 3263 - RNA, 22 nt, Human
agcacauauucaguucauacaa

SEQ ID NO: 3264 - RNA, 22 nt, Human
agcacaugagcugauggugggc

SEQ ID NO: 3265 - RNA, 22 nt, Human
agcacauucccaccuguacuuc

SEQ ID NO: 3266 - RNA, 22 nt, Human
agcacauucuugccuuaaccuc

SEQ ID NO: 3267 - RNA, 22 nt, Human
agcacauugauuuauuuuggag

SEQ ID NO: 3268 - RNA, 22 nt, Human
agcacauuuaaguaugaaauau

SEQ ID NO: 3269 - RNA, 22 nt, Human
agcacauuuuauuuaagaaaau

SEQ ID NO: 3270 - RNA, 22 nt, Human
agcaccagcaacuaugggcugc

SEQ ID NO: 3271 - RNA, 22 nt, Human
agcaccagcgugggggccguug

SEQ ID NO: 3272 - RNA, 20 nt, Human
agcaccagugggggcagccc

SEQ ID NO: 3273 - RNA, 21 nt, Human
agcaccaguuuuaugccaggc

SEQ ID NO: 3274 - RNA, 22 nt, Human
agcaccaugaccuugccauuga

SEQ ID NO: 3275 - RNA, 22 nt, Human
agcaccauugcaaauauggcag

SEQ ID NO: 3276 - RNA, 22 nt, Human
agcaccugcacaguggaggaaa

SEQ ID NO: 3277 - RNA, 22 nt, Human
agcaccugcuaugugucaggga

SEQ ID NO: 3278 - RNA, 22 nt, Human
agcaccugcuugugacuaggga

SEQ ID NO: 3279 - RNA, 22 nt, Human
agcaccugucacaagcagaagg

SEQ ID NO: 3280 - RNA, 22 nt, Human
agcaccuguggcucaugcucgu

SEQ ID NO: 3281 - RNA, 22 nt, Human
agcaccuguugcacuucauaau

SEQ ID NO: 3282 - RNA, 21 nt, Human
agcaccuucaauucuauuguc

SEQ ID NO: 3283 - RNA, 22 nt, Human
agcaccuugaucuuggacuucc

SEQ ID NO: 3284 - RNA, 22 nt, Human
agcacucuucugugauaguugu

SEQ ID NO: 3285 - RNA, 22 nt, Human
agcacugugauuuauaacauuu

SEQ ID NO: 3286 - RNA, 22 nt, Human
agcacuguuaugggaugacuua

SEQ ID NO: 3287 - RNA, 22 nt, Human
agcacuuaacugacaguacuau

SEQ ID NO: 3288 - RNA, 22 nt, Human
agcacuuuagaauuuagaguug

SEQ ID NO: 3289 - RNA, 22 nt, Human
agcagaaacagccagucuggac

SEQ ID NO: 3290 - RNA, 22 nt, Human
agcagaaaugaugguaugggac

SEQ ID NO: 3291 - RNA, 21 nt, Human
agcagaacagucgagcacugc

SEQ ID NO: 3292 - RNA, 22 nt, Human
agcagaacagucuucuaguucu

SEQ ID NO: 3293 - RNA, 22 nt, Human
agcagaaccacagcacuguuga

SEQ ID NO: 3294 - RNA, 22 nt, Human
agcagaagaggucuuguugcug

SEQ ID NO: 3295 - RNA, 17 nt, Human
agcagaagucagaggga

SEQ ID NO: 3296 - RNA, 22 nt, Human
agcagacaacccagaugaccca

SEQ ID NO: 3297 - RNA, 21 nt, Human
agcagacacuugugaccuucc

SEQ ID NO: 3298 - RNA, 22 nt, Human
agcagagaccauauagcccaga

SEQ ID NO: 3299 - RNA, 22 nt, Human
agcagagcagauaguauuaucu

SEQ ID NO: 3300 - RNA, 22 nt, Human
agcagagcauggugggaagggc

SEQ ID NO: 3301 - RNA, 22 nt, Human
agcagagcgccugcucagaggg

SEQ ID NO: 3302 - RNA, 22 nt, Human
agcagagcugggauccuggguc

SEQ ID NO: 3303 - RNA, 22 nt, Human
agggaggaaggaacuccuucua

SEQ ID NO: 3304 - RNA, 22 nt, Human
agggaggaguccucaaagucau

SEQ ID NO: 3305 - RNA, 22 nt, Human
agggaggaucugcuccuugucu

SEQ ID NO: 3306 - RNA, 22 nt, Human
agggaggugguuccccagugga

SEQ ID NO: 3307 - RNA, 21 nt, Human
agggagucuggaggaagcguu

SEQ ID NO: 3308 - RNA, 22 nt, Human
agggaguuccgaucugugcacc

SEQ ID NO: 3309 - RNA, 22 nt, Human
agggaucaaaaaauguacaugc

SEQ ID NO: 3310 - RNA, 22 nt, Human
agggaugagugaguaaacaaua

SEQ ID NO: 3311 - RNA, 22 nt, Human
agggaugaucaggguagaggcu

SEQ ID NO: 3312 - RNA, 22 nt, Human
agggaugauggaaagaagcagg

SEQ ID NO: 3313 - RNA, 22 nt, Human
agggaugauuucagugucugcc

SEQ ID NO: 3314 - RNA, 22 nt, Human
agggaugcaguaaaaacuguag

SEQ ID NO: 3315 - RNA, 22 nt, Human
agggauggaagacuugaagacc

SEQ ID NO: 3316 - RNA, 22 nt, Human
agggauggagcccagcuguucu

SEQ ID NO: 3317 - RNA, 22 nt, Human
agggauggcaaguuaaccugag

SEQ ID NO: 3318 - RNA, 22 nt, Human
agggaugugggaacugcagguu

SEQ ID NO: 3319 - RNA, 22 nt, Human
agggcaaggguugaagauaaga

SEQ ID NO: 3320 - RNA, 22 nt, Human
agggcacaggcuggcaggaucu

SEQ ID NO: 3321 - RNA, 22 nt, Human
agggcacucugcagggaccacc

SEQ ID NO: 3322 - RNA, 22 nt, Human
agggcagaaguacagacacuua

SEQ ID NO: 3323 - RNA, 22 nt, Human
agggcagacuaggauggaagug

SEQ ID NO: 3324 - RNA, 22 nt, Human
agggcagagaucugagugggca

SEQ ID NO: 3325 - RNA, 22 nt, Human
agggcagaggcggacacggaag

SEQ ID NO: 3326 - RNA, 22 nt, Human
agggcagccugagugcuggccc

SEQ ID NO: 3327 - RNA, 20 nt, Human
agggcagcuugaggagccgg

SEQ ID NO: 3328 - RNA, 22 nt, Human
agggcagugggaaagccugcuc

SEQ ID NO: 3329 - RNA, 22 nt, Human
agggcaguucagccacaggcuc

SEQ ID NO: 3330 - RNA, 22 nt, Human
agggcaugaaaugggcagaagc

SEQ ID NO: 3331 - RNA, 22 nt, Human
agggcaugaagcaguggacagc

SEQ ID NO: 3332 - RNA, 22 nt, Human
agggcaugcuggaggagagaca

SEQ ID NO: 3333 - RNA, 22 nt, Human
agggccacaguaaugcugagua

SEQ ID NO: 3334 - RNA, 22 nt, Human
agggccagaguacaucagggcu

SEQ ID NO: 3335 - RNA, 22 nt, Human
agggccagagucuguguagaua

SEQ ID NO: 3336 - RNA, 22 nt, Human
agggccagaguggcaaaagccu

SEQ ID NO: 3337 - RNA, 22 nt, Human
agggccagaugaagccacaagc

SEQ ID NO: 3338 - RNA, 22 nt, Human
agggccagcacuccuggcagga

SEQ ID NO: 3339 - RNA, 22 nt, Human
agggccagccaggcccuacaaa

SEQ ID NO: 3340 - RNA, 22 nt, Human
agggccagccccacccucucug

SEQ ID NO: 3341 - RNA, 22 nt, Human
agggccagccgacuuccagccu

SEQ ID NO: 3342 - RNA, 22 nt, Human
agggccaggaucacagccaaga

SEQ ID NO: 3343 - RNA, 22 nt, Human
agggccagggaagcuguauuuu

SEQ ID NO: 3344 - RNA, 22 nt, Human
agggccaguaaauguuuccuca

SEQ ID NO: 3345 - RNA, 22 nt, Human
agggccagucguguauuacugu

SEQ ID NO: 3346 - RNA, 22 nt, Human
agggcccuaaggaaggcacaca

SEQ ID NO: 3347 - RNA, 22 nt, Human
agggcccuagggaaugagacau

SEQ ID NO: 3348 - RNA, 22 nt, Human
agggcccucugggcacuguggc

SEQ ID NO: 3349 - RNA, 22 nt, Human
agggcccugaguugcagcccug

SEQ ID NO: 3350 - RNA, 22 nt, Human
agggccuccagggcagcagugg

SEQ ID NO: 3351 - RNA, 22 nt, Human
agggccucgaaggcagagggau

SEQ ID NO: 3352 - RNA, 22 nt, Human
agggccucugacgcccccagcc

SEQ ID NO: 3353 - RNA, 22 nt, Human
agggccucugagccaguucugg

SEQ ID NO: 3354 - RNA, 22 nt, Human
agggccugacacccuugccagc

SEQ ID NO: 3355 - RNA, 22 nt, Human
agggccugaggcugacggggag

SEQ ID NO: 3356 - RNA, 20 nt, Human
agggccuggaguacagcagg

SEQ ID NO: 3357 - RNA, 23 nt, Human
agggccuggcguggagugugugc

SEQ ID NO: 3358 - RNA, 22 nt, Human
agggccugggaagaggaacccu

SEQ ID NO: 3359 - RNA, 22 nt, Human
agggccugggauguccuccuag

SEQ ID NO: 3360 - RNA, 21 nt, Human
agggccugugcucuccagguc

SEQ ID NO: 3361 - RNA, 19 nt, Human
agggcggggcccaggcaca

SEQ ID NO: 3362 - RNA, 22 nt, Human
agggcucaccacugugcacucc

SEQ ID NO: 3363 - RNA, 22 nt, Human
agggcucagaaaugucuacggg

SEQ ID NO: 3364 - RNA, 22 nt, Human
agggcucagggcacgucaucca

SEQ ID NO: 3365 - RNA, 22 nt, Human
agcucccaggcagucaugagga

SEQ ID NO: 3366 - RNA, 22 nt, Human
agcucccugagaugccacagca

SEQ ID NO: 3367 - RNA, 22 nt, Human
agcuccuacucuaugccagaca

SEQ ID NO: 3368 - RNA, 22 nt, Human
agcuccugaaaauccagacugg

SEQ ID NO: 3369 - RNA, 18 nt, Human
agcuccugaacucugugg

SEQ ID NO: 3370 - RNA, 22 nt, Human
agcuccugauacaugcaggaau

SEQ ID NO: 3371 - RNA, 22 nt, Human
agcuccugauucucagagauag

SEQ ID NO: 3372 - RNA, 22 nt, Human
agcuccugcaccaggggccccu

SEQ ID NO: 3373 - RNA, 20 nt, Human
agcuccuggacuagagagug

SEQ ID NO: 3374 - RNA, 22 nt, Human
agcuccugggccaucacaacca

SEQ ID NO: 3375 - RNA, 20 nt, Human
agcuccugguauaggugccu

SEQ ID NO: 3376 - RNA, 23 nt, Human
agcuccuguaagguggucgucac

SEQ ID NO: 3377 - RNA, 22 nt, Human
agcuccugugugaagccucccu

SEQ ID NO: 3378 - RNA, 22 nt, Human
agcuccuugaaggcaguagcug

SEQ ID NO: 3379 - RNA, 22 nt, Human
agcuccuugcagguugccuugg

SEQ ID NO: 3380 - RNA, 20 nt, Human
agcuccuuuguguccaggau

SEQ ID NO: 3381 - RNA, 21 nt, Human
agcucuaugacuuggccaggu

SEQ ID NO: 3382 - RNA, 22 nt, Human
agcucucauuacuuuacagaug

SEQ ID NO: 3383 - RNA, 22 nt, Human
agcucuccaucuaucugugaug

SEQ ID NO: 3384 - RNA, 22 nt, Human
agcucucccaccuucuucuuac

SEQ ID NO: 3385 - RNA, 22 nt, Human
agcucucccauagggcaagauc

SEQ ID NO: 3386 - RNA, 23 nt, Human
agcucugaaauagggaaagagga

SEQ ID NO: 3387 - RNA, 22 nt, Human
agcucugacaaggauuuucugc

SEQ ID NO: 3388 - RNA, 22 nt, Human
agcucugcuucuugggaagaug

SEQ ID NO: 3389 - RNA, 22 nt, Human
agcucuggaauaaugaugugau

SEQ ID NO: 3390 - RNA, 22 nt, Human
agcucuggagccggaggauuuc

SEQ ID NO: 3391 - RNA, 23 nt, Human
agcucuggcguuggggagguagu

SEQ ID NO: 3392 - RNA, 22 nt, Human
agcucugggaguaguuccaccu

SEQ ID NO: 3393 - RNA, 22 nt, Human
agcucugggccaggaacccuaa

SEQ ID NO: 3394 - RNA, 22 nt, Human
agcucugguauuucuuuaaucc

SEQ ID NO: 3395 - RNA, 20 nt, Human
agcucuuaagaagaagauga

SEQ ID NO: 3396 - RNA, 20 nt, Human
agcucuuacuuugcagcagc

SEQ ID NO: 3397 - RNA, 22 nt, Human
agcucuuccugcaccuguggcu

SEQ ID NO: 3398 - RNA, 22 nt, Human
agcucuuugagcaaggcagcuc

SEQ ID NO: 3399 - RNA, 19 nt, Human
agcucuuugcugcauucca

SEQ ID NO: 3400 - RNA, 22 nt, Human
agcucuuuuaucaugaggagag

SEQ ID NO: 3401 - RNA, 22 nt, Human
agcugaaaauuagugauaguuu

SEQ ID NO: 3402 - RNA, 22 nt, Human
agcugaaagugcuuugaggacu

SEQ ID NO: 3403 - RNA, 22 nt, Human
agcugaaauucacaaggaucca

SEQ ID NO: 3404 - RNA, 22 nt, Human
agcugaaauuuuacugaguaua

SEQ ID NO: 3405 - RNA, 22 nt, Human
agcugaaucuugacuaggaaga

SEQ ID NO: 3406 - RNA, 22 nt, Human
agcugacucuggccucuggucc

SEQ ID NO: 3407 - RNA, 23 nt, Human
agcugagaauaaggagccguuug

SEQ ID NO: 3408 - RNA, 22 nt, Human
agcugagauuguuuccauuucu

SEQ ID NO: 3409 - RNA, 22 nt, Human
agcugagcauuugauccaccuc

SEQ ID NO: 3410 - RNA, 22 nt, Human
agcugagccagcagcaacagga

SEQ ID NO: 3411 - RNA, 22 nt, Human
agcugagcuaguaguuccagug

SEQ ID NO: 3412 - RNA, 22 nt, Human
uucacaggauagcuauugcacg

SEQ ID NO: 3413 - RNA, 22 nt, Human
uucacaggugagcauuaggccg

SEQ ID NO: 3414 - RNA, 22 nt, Human
uucacagugccagggggcaggc

SEQ ID NO: 3415 - RNA, 22 nt, Human
uucacagugcucacaguucagu

SEQ ID NO: 3416 - RNA, 22 nt, Human
uucacagugcugcaccuggcuu

SEQ ID NO: 3417 - RNA, 22 nt, Human
uucacaguggcccucucugagu

SEQ ID NO: 3418 - RNA, 22 nt, Human
uucacagugguaaggguuguga

SEQ ID NO: 3419 - RNA, 22 nt, Human
uucacagugguagugcauuuag

SEQ ID NO: 3420 - RNA, 22 nt, Human
uucacauaauccuccaguggca

SEQ ID NO: 3421 - RNA, 22 nt, Human
uucacauaaugauacaaagcuu

SEQ ID NO: 3422 - RNA, 22 nt, Human
uucacaugaaaguaggaaagga

SEQ ID NO: 3423 - RNA, 22 nt, Human
uucacaugacagggugaagcau

SEQ ID NO: 3424 - RNA, 22 nt, Human
uucacauggcaauagagaggga

SEQ ID NO: 3425 - RNA, 22 nt, Human
uucacauuaagccuccuccuac

SEQ ID NO: 3426 - RNA, 22 nt, Human
uucacauuagugguucuauaua

SEQ ID NO: 3427 - RNA, 22 nt, Human
uucacauucagaaaaagcccgu

SEQ ID NO: 3428 - RNA, 19 nt, Human
uucacauuggaagaaguag

SEQ ID NO: 3429 - RNA, 22 nt, Human
uucacauuggugauauguuucu

SEQ ID NO: 3430 - RNA, 22 nt, Human
uucacauuguuuuaaugugaau

SEQ ID NO: 3431 - RNA, 22 nt, Human
uucacauuucauaccacagcuu

SEQ ID NO: 3432 - RNA, 22 nt, Human
uucacauuugcccuuaugugug

SEQ ID NO: 3433 - RNA, 22 nt, Human
uucaccacagucucaucuacgc

SEQ ID NO: 3434 - RNA, 22 nt, Human
uucaccacuuugcaccaggccu

SEQ ID NO: 3435 - RNA, 22 nt, Human
uucaccagguguacaguuaguu

SEQ ID NO: 3436 - RNA, 22 nt, Human
uucacccugagccccaccucug

SEQ ID NO: 3437 - RNA, 22 nt, Human
uucaccuugaauaugucuuaaa

SEQ ID NO: 3438 - RNA, 22 nt, Human
uucacugaauuaaaaagaguau

SEQ ID NO: 3439 - RNA, 22 nt, Human
uucacugcagcccaugaaggga

SEQ ID NO: 3440 - RNA, 22 nt, Human
uucacuguacugacugucuuau

SEQ ID NO: 3441 - RNA, 22 nt, Human
uucacugugaacucauauucag

SEQ ID NO: 3442 - RNA, 22 nt, Human
uucacuguuguuagcagaggcg

SEQ ID NO: 3443 - RNA, 22 nt, Human
uucacuuaacaucauaucauga

SEQ ID NO: 3444 - RNA, 22 nt, Human
uucacuuauuucuugaguagca

SEQ ID NO: 3445 - RNA, 22 nt, Human
uucagaaacagagugagugagu

SEQ ID NO: 3446 - RNA, 22 nt, Human
uucagaaacaucaguggaugga

SEQ ID NO: 3447 - RNA, 22 nt, Human
uucagaaaggcugugccagcca

SEQ ID NO: 3448 - RNA, 22 nt, Human
uucagaaagguaaauggauuuc

SEQ ID NO: 3449 - RNA, 23 nt, Human
uucagaagaaaugaguacaggag

SEQ ID NO: 3450 - RNA, 17 nt, Human
uucagaagcauuuuggc

SEQ ID NO: 3451 - RNA, 22 nt, Human
uucagaaggauuuuaacacaug

SEQ ID NO: 3452 - RNA, 22 nt, Human
uucagaagugcuuucacacucu

SEQ ID NO: 3453 - RNA, 22 nt, Human
uucagaauaacuuuuuauugaa

SEQ ID NO: 3454 - RNA, 22 nt, Human
uucagaauauuuguuuuacaug

SEQ ID NO: 3455 - RNA, 22 nt, Human
uucagaaugacuuauguaaggc

SEQ ID NO: 3456 - RNA, 16 nt, Human
uucagaauuuguagaa

SEQ ID NO: 3457 - RNA, 22 nt, Human
uucagacaauaagagucaucuc

SEQ ID NO: 3458 - RNA, 22 nt, Human
uucagacugcuggugcuucccu

SEQ ID NO: 3459 - RNA, 22 nt, Human
uucagagaacuucauggaagag

SEQ ID NO: 3460 - RNA, 22 nt, Human
uucagagaagcaaaggcagauu

SEQ ID NO: 3461 - RNA, 22 nt, Human
uucagagaagugcacaaaauca

SEQ ID NO: 3462 - RNA, 22 nt, Human
uucagagaauuggauaauucgu

SEQ ID NO: 3463 - RNA, 22 nt, Human
uucagagacauguucuagauca

SEQ ID NO: 3464 - RNA, 22 nt, Human
uucagagcucagaaaagugucu

SEQ ID NO: 3465 - RNA, 22 nt, Human
uucagaguaggauacuagcuua

SEQ ID NO: 3466 - RNA, 22 nt, Human
uucagaguuagacgaaaagcaa

SEQ ID NO: 3467 - RNA, 22 nt, Human
uucagauaagucaaguuaguau

SEQ ID NO: 3468 - RNA, 22 nt, Human
uucagauguggcuuugucaggc

SEQ ID NO: 3469 - RNA, 22 nt, Human
uucagauuuuuuaauagguaau

SEQ ID NO: 3470 - RNA, 22 nt, Human
uucagcaacucaaaccuauuag

SEQ ID NO: 3471 - RNA, 22 nt, Human
uucagcaaugacagccuauaua

SEQ ID NO: 3472 - RNA, 22 nt, Human
uucagcaauuuuuuaagcuaau

SEQ ID NO: 3473 - RNA, 22 nt, Human
uucagcacugacugagugguua

SEQ ID NO: 3474 - RNA, 22 nt, Human
uucagcacuggacagcgagucu

SEQ ID NO: 3475 - RNA, 18 nt, Human
uucagcagcagacacacu

SEQ ID NO: 3476 - RNA, 22 nt, Human
uucagcagcuuuuaguacauug

SEQ ID NO: 3477 - RNA, 21 nt, Human
uucagcaguccucuagagaua

SEQ ID NO: 3478 - RNA, 17 nt, Human
uucagcaguguuucucc

SEQ ID NO: 3479 - RNA, 22 nt, Human
uucagcauagcagcuucaggac

SEQ ID NO: 3480 - RNA, 22 nt, Human
uucagcauugguaugaaaaccc

SEQ ID NO: 3481 - RNA, 22 nt, Human
uucagcgauauuauucaugagc

SEQ ID NO: 3482 - RNA, 22 nt, Human
uucagcuaaaaaugcccacuug

SEQ ID NO: 3483 - RNA, 22 nt, Human
uucagcuaaaggaaacucagau

SEQ ID NO: 3484 - RNA, 22 nt, Human
uucagcuacccuuggcuuaaua

SEQ ID NO: 3485 - RNA, 22 nt, Human
uucagcuagcaucucacuuggu

SEQ ID NO: 3486 - RNA, 22 nt, Human
uucagcuucauuugucuuuaug

SEQ ID NO: 3487 - RNA, 22 nt, Human
uucaggaaauuggaguccuucu

SEQ ID NO: 3488 - RNA, 22 nt, Human
uucaggaauauaggcauugaca

SEQ ID NO: 3489 - RNA, 22 nt, Human
uucaggacuaggggcuucaagg

SEQ ID NO: 3490 - RNA, 15 nt, Human
uucaggauaugacuc

SEQ ID NO: 3491 - RNA, 22 nt, Human
uucaggaugcucagaguagucu

SEQ ID NO: 3492 - RNA, 22 nt, Human
uucaggauggcggauguugggg

SEQ ID NO: 3493 - RNA, 22 nt, Human
uucaggcaucccuacaguuagg

SEQ ID NO: 3494 - RNA, 22 nt, Human
uucaggcuauagaccaauuugg

SEQ ID NO: 3495 - RNA, 22 nt, Human
uucagggacuuugauguaucag

SEQ ID NO: 3496 - RNA, 23 nt, Human
uucagggccucagaggugaagcu

SEQ ID NO: 3497 - RNA, 22 nt, Human
uucagggcugacaagccuauug

SEQ ID NO: 3498 - RNA, 22 nt, Human
uucaguagggcccucacacagu

SEQ ID NO: 3499 - RNA, 22 nt, Human
uucaguauacauuaucuaauug

SEQ ID NO: 3500 - RNA, 22 nt, Human
uucaguaugcugaaugauuuuu

SEQ ID NO: 3501 - RNA, 22 nt, Human
uucaguauguguaaacuacuuu

SEQ ID NO: 3502 - RNA, 22 nt, Human
uucaguauuucaugacuuucuu

SEQ ID NO: 3503 - RNA, 22 nt, Human
uucaguauuugaaaccauaggc

SEQ ID NO: 3504 - RNA, 22 nt, Human
uucagugagugaaugaaugaau

SEQ ID NO: 3505 - RNA, 22 nt, Human
uucagugcagucggaacuacug

SEQ ID NO: 3506 - RNA, 22 nt, Human
uucaguguauauuuuuugagua

SEQ ID NO: 3507 - RNA, 22 nt, Human
uucagugugaagcuucugaaag

SEQ ID NO: 3508 - RNA, 19 nt, Human
uucagugugcuggcuccug

SEQ ID NO: 3509 - RNA, 22 nt, Human
uucagugugucaguuucagcag

SEQ ID NO: 3510 - RNA, 22 nt, Human
uucaguguucuuuucuguuagc

SEQ ID NO: 3511 - RNA, 22 nt, Human
uucaguuccuuaucauaggguu

SEQ ID NO: 3512 - RNA, 22 nt, Human
uucaguuuccacuuacauuuaa

SEQ ID NO: 3513 - RNA, 22 nt, Human
uucaguuucccuaaagccaauu

SEQ ID NO: 3514 - RNA, 22 nt, Human
uucaguuucuaaagauguuccu

SEQ ID NO: 3515 - RNA, 22 nt, Human
uucaguuugaauucuguagaac

SEQ ID NO: 3516 - RNA, 22 nt, Human
uucauaaacaacugaugguaau

SEQ ID NO: 3517 - RNA, 22 nt, Human
uucauacaguggcugcacucca

SEQ ID NO: 3518 - RNA, 22 nt, Human
uucauagaaagugcuuagauug

SEQ ID NO: 3519 - RNA, 22 nt, Human
uucauagagcagcucacugaau

SEQ ID NO: 3520 - RNA, 22 nt, Human
uguguauagaaaguaggaaagg

SEQ ID NO: 3521 - RNA, 22 nt, Human
uuagcauucucugugugcauaa

SEQ ID NO: 3522 - RNA, 22 nt, Human
uuagcauuguacauuugugcuu

SEQ ID NO: 3523 - RNA, 22 nt, Human
uuagcuaaacuguaacuagaau

SEQ ID NO: 3524 - RNA, 22 nt, Human
uuagcugaguggugcuggcuca

SEQ ID NO: 3525 - RNA, 22 nt, Human
uuagcuguggaagcuucagcca

SEQ ID NO: 3526 - RNA, 22 nt, Human
uuagcuuaauuaaauaaucagu

SEQ ID NO: 3527 - RNA, 22 nt, Human
uuagcuuuucacuugcauuauc

SEQ ID NO: 3528 - RNA, 22 nt, Human
uuaggaaaaucaugagagauga

SEQ ID NO: 3529 - RNA, 22 nt, Human
uuaggaaacaucauuuuugcug

SEQ ID NO: 3530 - RNA, 22 nt, Human
uuaggaaagucucuuggcuggg

SEQ ID NO: 3531 - RNA, 22 nt, Human
uuaggaagaugcuuuuucuggg

SEQ ID NO: 3532 - RNA, 22 nt, Human
uuaggaaggcacugggugccaa

SEQ ID NO: 3533 - RNA, 22 nt, Human
uuaggaaguuauaguggaaaug

SEQ ID NO: 3534 - RNA, 22 nt, Human
uuaggaaguuucagaaaaugca

SEQ ID NO: 3535 - RNA, 18 nt, Human
uuaggaaguuucuccguc

SEQ ID NO: 3536 - RNA, 22 nt, Human
uuaggaauuuauuccauuguug

SEQ ID NO: 3537 - RNA, 22 nt, Human
uuaggagaugguccucuaggga

SEQ ID NO: 3538 - RNA, 22 nt, Human
uuagggaaauauuuauauacuu

SEQ ID NO: 3539 - RNA, 22 nt, Human
uuagggcaaaguuucaacaguu

SEQ ID NO: 3540 - RNA, 22 nt, Human
uuagguauucauuuacauguuc

SEQ ID NO: 3541 - RNA, 22 nt, Human
uuaguaauguguuaauaugaau

SEQ ID NO: 3542 - RNA, 22 nt, Human
uuaguacagaaucaaaagcaau

SEQ ID NO: 3543 - RNA, 22 nt, Human
uuaguagagagucauguuuuua

SEQ ID NO: 3544 - RNA, 18 nt, Human
uuaguauaacugccugug

SEQ ID NO: 3545 - RNA, 22 nt, Human
uuagucaauagugaauauagag

SEQ ID NO: 3546 - RNA, 22 nt, Human
uuagucccauuauaugacuucu

SEQ ID NO: 3547 - RNA, 22 nt, Human
uuagugaucaaaaucaaaauug

SEQ ID NO: 3548 - RNA, 22 nt, Human
uuagugaugacuagacuuuugu

SEQ ID NO: 3549 - RNA, 22 nt, Human
uuagugcaaaccucagagacac

SEQ ID NO: 3550 - RNA, 22 nt, Human
uuagugcuaaauacucccacag

SEQ ID NO: 3551 - RNA, 22 nt, Human
uuagugcucauccagauggggg

SEQ ID NO: 3552 - RNA, 22 nt, Human
uuagugcuucuguccaaauaua

SEQ ID NO: 3553 - RNA, 22 nt, Human
uuagugucuuucaaaagguuua

SEQ ID NO: 3554 - RNA, 22 nt, Human
uuagugugcauggaucugugga

SEQ ID NO: 3555 - RNA, 22 nt, Human
uuaguuacuuauaggugauaga

SEQ ID NO: 3556 - RNA, 22 nt, Human
uuaguuagucccugguaccuuu

SEQ ID NO: 3557 - RNA, 22 nt, Human
uuaguuaguggggcugucaguc

SEQ ID NO: 3558 - RNA, 21 nt, Human
uuaguucuaccacuugcauuc

SEQ ID NO: 3559 - RNA, 22 nt, Human
uuaguugacccccaguccuggc

SEQ ID NO: 3560 - RNA, 20 nt, Human
uuaguugaguagcuccugaa

SEQ ID NO: 3561 - RNA, 22 nt, Human
uuaguugauguucuggagguag

SEQ ID NO: 3562 - RNA, 22 nt, Human
uuaguuguaaaauggaauuugu

SEQ ID NO: 3563 - RNA, 22 nt, Human
uuaguuuauaauucauuucugu

SEQ ID NO: 3564 - RNA, 22 nt, Human
uuaguuuccaccacacauguuc

SEQ ID NO: 3565 - RNA, 22 nt, Human
uuauaaagauuguuauguaucu

SEQ ID NO: 3566 - RNA, 22 nt, Human
uuauaaagguuugugcauauuu

SEQ ID NO: 3567 - RNA, 22 nt, Human
uuauaagacuguagugaguauu

SEQ ID NO: 3568 - RNA, 22 nt, Human
uuauaagaguauauaguguacu

SEQ ID NO: 3569 - RNA, 22 nt, Human
uuauacagggaguuucccugca

SEQ ID NO: 3570 - RNA, 21 nt, Human
uuauacauauguucucugccu

SEQ ID NO: 3571 - RNA, 22 nt, Human
uuauacauguuuauaagguuga

SEQ ID NO: 3572 - RNA, 22 nt, Human
uuauacccuccauaccuggccu

SEQ ID NO: 3573 - RNA, 22 nt, Human
uuauacgcucaauccuaucauc

SEQ ID NO: 3574 - RNA, 22 nt, Human
uuauagaacagccuccucuaga

SEQ ID NO: 3575 - RNA, 22 nt, Human
uuauagaaggagcauucacuua

SEQ ID NO: 3576 - RNA, 22 nt, Human
uuauaggaaaaguucuagaaaa

SEQ ID NO: 3577 - RNA, 22 nt, Human
uuauaggaaauaguucaugcga

SEQ ID NO: 3578 - RNA, 22 nt, Human
uuauagugcauaauuaacaugg

SEQ ID NO: 3579 - RNA, 22 nt, Human
uuauaucagaaggugagauuga

SEQ ID NO: 3580 - RNA, 20 nt, Human
uuauaucauaaugugccaau

SEQ ID NO: 3581 - RNA, 22 nt, Human
uuauaugaacuggacuuuagga

SEQ ID NO: 3582 - RNA, 22 nt, Human
uuauaugauugaagugcauaag

SEQ ID NO: 3583 - RNA, 22 nt, Human
uuauauuguguaauaagugaag

SEQ ID NO: 3584 - RNA, 22 nt, Human
uuauauuucugguagccuucag

SEQ ID NO: 3585 - RNA, 22 nt, Human
uuaucacuuaugagcuuuuugc

SEQ ID NO: 3586 - RNA, 22 nt, Human
uuauccaagcagaagcugcaca

SEQ ID NO: 3587 - RNA, 22 nt, Human
uuaucguaucucuuggucuuca

SEQ ID NO: 3588 - RNA, 22 nt, Human
uuaucugguauaguggggaaga

SEQ ID NO: 3589 - RNA, 22 nt, Human
uuaucugucaucaggcagacag

SEQ ID NO: 3590 - RNA, 22 nt, Human
uuaucuguuuaacaaaguaucu

SEQ ID NO: 3591 - RNA, 22 nt, Human
uuaucuuagaggugauuguauu

SEQ ID NO: 3592 - RNA, 22 nt, Human
uuaucuuggguaacuuugugca

SEQ ID NO: 3593 - RNA, 22 nt, Human
uuaugaacaauuucuaggaaug

SEQ ID NO: 3594 - RNA, 19 nt, Human
uuaugaauagcuucaucca

SEQ ID NO: 3595 - RNA, 22 nt, Human
uuaugcagauggcaugaggagg

SEQ ID NO: 3596 - RNA, 22 nt, Human
uuaugcagucgacaucugauca

SEQ ID NO: 3597 - RNA, 22 nt, Human
uuaugcaugagauaaaaauugg

SEQ ID NO: 3598 - RNA, 22 nt, Human
uuaugccuccgaaaccuggagu

SEQ ID NO: 3599 - RNA, 22 nt, Human
uuaugcuaaaugaaucaaguca

SEQ ID NO: 3600 - RNA, 22 nt, Human
uuaugcuaagugcaacaagcca

SEQ ID NO: 3601 - RNA, 22 nt, Human
uuaugcuaguauaguccuuaga

SEQ ID NO: 3602 - RNA, 22 nt, Human
uuaugcuaguugaaauaacaca

SEQ ID NO: 3603 - RNA, 22 nt, Human
uuaugcuucccugaggaucuua

SEQ ID NO: 3604 - RNA, 18 nt, Human
uugaggaguucacugucu

SEQ ID NO: 3605 - RNA, 22 nt, Human
uugaggaguugugacagauacu

SEQ ID NO: 3606 - RNA, 22 nt, Human
uugaggauucaugucagaauuc

SEQ ID NO: 3607 - RNA, 22 nt, Human
uugaggcaaaaucaacgggaag

SEQ ID NO: 3608 - RNA, 22 nt, Human
uugaggcacacacagguugcau

SEQ ID NO: 3609 - RNA, 22 nt, Human
uugaggcagguccggguccuuc

SEQ ID NO: 3610 - RNA, 22 nt, Human
uugaggccccauggaugagaac

SEQ ID NO: 3611 - RNA, 22 nt, Human
uugaggcccggcaggccgagcg

SEQ ID NO: 3612 - RNA, 22 nt, Human
uugagggagaaagccgaggugu

SEQ ID NO: 3613 - RNA, 22 nt, Human
uugagggagcacagauucuuau

SEQ ID NO: 3614 - RNA, 22 nt, Human
uugagggagccugggagccaug

SEQ ID NO: 3615 - RNA, 22 nt, Human
uugagggauugcaccagaagag

SEQ ID NO: 3616 - RNA, 22 nt, Human
uugagguaguucuauugugagu

SEQ ID NO: 3617 - RNA, 22 nt, Human
uugaggucaaagaagugagugg

SEQ ID NO: 3618 - RNA, 22 nt, Human
uugaggucaaguaaccacugga

SEQ ID NO: 3619 - RNA, 22 nt, Human
uugaggucaauucuguuuccug

SEQ ID NO: 3620 - RNA, 22 nt, Human
uugaggucugagacugugcagg

SEQ ID NO: 3621 - RNA, 22 nt, Human
uugaggucuguguaggcagcaa

SEQ ID NO: 3622 - RNA, 22 nt, Human
uugaggucuucaggaucaggcu

SEQ ID NO: 3623 - RNA, 22 nt, Human
uugaggucuucauucuugggca

SEQ ID NO: 3624 - RNA, 22 nt, Human
uugaggucuuugagcaaacgca

SEQ ID NO: 3625 - RNA, 22 nt, Human
uugagucuccucagcagggcua

SEQ ID NO: 3626 - RNA, 22 nt, Human
uugagucugcaauacauaacac

SEQ ID NO: 3627 - RNA, 17 nt, Human
uugagucuggggucuac

SEQ ID NO: 3628 - RNA, 22 nt, Human
uugaguguaaggaauguggggc

SEQ ID NO: 3629 - RNA, 22 nt, Human
uugauacagcagccugugaucc

SEQ ID NO: 3630 - RNA, 22 nt, Human
uuauguucccuuaagagaacag

SEQ ID NO: 3631 - RNA, 22 nt, Human
uuauuaaaaugcggauuuggcu

SEQ ID NO: 3632 - RNA, 22 nt, Human
uuauuaagugccuacaauaaag

SEQ ID NO: 3633 - RNA, 22 nt, Human
uuauuaauaaaguggcauagcc

SEQ ID NO: 3634 - RNA, 22 nt, Human
uuauuacagucccagggaguag

SEQ ID NO: 3635 - RNA, 22 nt, Human
uuauuacuguauuaauccagag

SEQ ID NO: 3636 - RNA, 22 nt, Human
uuauuagagauauuugguuagg

SEQ ID NO: 3637 - RNA, 22 nt, Human
uuauuagagugcuuugagaaag

SEQ ID NO: 3638 - RNA, 22 nt, Human
uuauuaggaaaaggucagaugu

SEQ ID NO: 3639 - RNA, 22 nt, Human
uuauuagggugguuuauguucu

SEQ ID NO: 3640 - RNA, 22 nt, Human
uuauuauugugaccugagaaug

SEQ ID NO: 3641 - RNA, 22 nt, Human
uuauucagauuggcuacaggau

SEQ ID NO: 3642 - RNA, 22 nt, Human
uuauucauuaacagggaccaaa

SEQ ID NO: 3643 - RNA, 22 nt, Human
uuauuccaauuucuccuacaaa

SEQ ID NO: 3644 - RNA, 22 nt, Human
uuauuccaccuccauuuuccua

SEQ ID NO: 3645 - RNA, 22 nt, Human
uuauuccaguaaucucuguaau

SEQ ID NO: 3646 - RNA, 22 nt, Human
uuauuccauuauuucacuuagg

SEQ ID NO: 3647 - RNA, 22 nt, Human
uuauuccauucaguucaacaag

SEQ ID NO: 3648 - RNA, 22 nt, Human
uuauucugagaguugaaguaau

SEQ ID NO: 3649 - RNA, 22 nt, Human
uuauucugcacuuuuaaaauau

SEQ ID NO: 3650 - RNA, 22 nt, Human
uuauucuggaggaagcaaaugg

SEQ ID NO: 3651 - RNA, 17 nt, Human
uuauucuggcauaugug

SEQ ID NO: 3652 - RNA, 22 nt, Human
uuauucuguauuucagguaugu

SEQ ID NO: 3653 - RNA, 19 nt, Human
uuauucugucagagcacac

SEQ ID NO: 3654 - RNA, 22 nt, Human
uuauucugucuuuggucucaau

SEQ ID NO: 3655 - RNA, 22 nt, Human
uuauucuguugcuuuuacagua

SEQ ID NO: 3656 - RNA, 22 nt, Human
uuauucuguuugccgaccagua

SEQ ID NO: 3657 - RNA, 22 nt, Human
uuauucuuggaucugagucucu

SEQ ID NO: 3658 - RNA, 22 nt, Human
uuauugaaauggaagcuauaac

SEQ ID NO: 3659 - RNA, 22 nt, Human
uuauugaagcaagcuuuucuga

SEQ ID NO: 3660 - RNA, 22 nt, Human
uuauugagaccguaagucaggu

SEQ ID NO: 3661 - RNA, 22 nt, Human
uuauugagcacauaguaugugg

SEQ ID NO: 3662 - RNA, 22 nt, Human
uuauugagcaccuacuaugugu

SEQ ID NO: 3663 - RNA, 23 nt, Human
uuauugaggguguagauuggugu

SEQ ID NO: 3664 - RNA, 22 nt, Human
uuauugcaaccuuuucuggugu

SEQ ID NO: 3665 - RNA, 22 nt, Human
uuauugcaacuuuagggauaga

SEQ ID NO: 3666 - RNA, 22 nt, Human
uuauugcacuauugauuuucua

SEQ ID NO: 3667 - RNA, 22 nt, Human
uuauugcagauggugugagaga

SEQ ID NO: 3668 - RNA, 23 nt, Human
uuauugcauccaaaugcauuccu

SEQ ID NO: 3669 - RNA, 22 nt, Human
uuauugcugauaguguuuauaa

SEQ ID NO: 3670 - RNA, 22 nt, Human
uuauugcuggcaccuucaauuc

SEQ ID NO: 3671 - RNA, 23 nt, Human
uuauugcuuucccugccuuccug

SEQ ID NO: 3672 - RNA, 22 nt, Human
uuauuguagcacuuuggcagug

SEQ ID NO: 3673 - RNA, 22 nt, Human
uuauuguaggccuauuguagaa

SEQ ID NO: 3674 - RNA, 22 nt, Human
uuauugugaggaauaagugaga

SEQ ID NO: 3675 - RNA, 22 nt, Human
uuauuguuaggcuuuuggaauu

SEQ ID NO: 3676 - RNA, 22 nt, Human
uuauuuaauuuucucacucaga

SEQ ID NO: 3677 - RNA, 22 nt, Human
uuauuuacuggauggccuuggg

SEQ ID NO: 3678 - RNA, 22 nt, Human
uuauuuaggaggaaacugaggu

SEQ ID NO: 3679 - RNA, 22 nt, Human
uuauuuagucuagaugaauuuu

SEQ ID NO: 3680 - RNA, 22 nt, Human
uuauuuauggcccucaccugau

SEQ ID NO: 3681 - RNA, 22 nt, Human
uuauuuauucauucugucuguc

SEQ ID NO: 3682 - RNA, 22 nt, Human
uuauuuccaaacuggauauacc

SEQ ID NO: 3683 - RNA, 22 nt, Human
uuauuuccacaaugugguaggg

SEQ ID NO: 3684 - RNA, 22 nt, Human
uuauuuccaguccagaaauuua

SEQ ID NO: 3685 - RNA, 22 nt, Human
uuauuuccuaaaucucuuuguu

SEQ ID NO: 3686 - RNA, 22 nt, Human
uuauuugaaugauggcacaauu

SEQ ID NO: 3687 - RNA, 20 nt, Human
uuauuugcucuuuaucugca

SEQ ID NO: 3688 - RNA, 22 nt, Human
uuauuugcugauuucaguuuca

SEQ ID NO: 3689 - RNA, 22 nt, Human
uuauuuggaaauauggcuucug

SEQ ID NO: 3690 - RNA, 22 nt, Human
uuauuuggguuugaguguggca

SEQ ID NO: 3691 - RNA, 22 nt, Human
uuauuugguugcugacuuggaa

SEQ ID NO: 3692 - RNA, 22 nt, Human
uuauuugugaaucauuuaucua

SEQ ID NO: 3693 - RNA, 18 nt, Human
uuauuuguuacagcacau

SEQ ID NO: 3694 - RNA, 20 nt, Human
uuauuuguuuacuuuggucc

SEQ ID NO: 3695 - RNA, 22 nt, Human
uuauuuguuuucugagaaguau

SEQ ID NO: 3696 - RNA, 22 nt, Human
uuauuuugguaaauguuugccu

SEQ ID NO: 3697 - RNA, 23 nt, Human
uuauuuugucagaagggacuuuu

SEQ ID NO: 3698 - RNA, 22 nt, Human
uuauuuuuaaaaguucacacag

SEQ ID NO: 3699 - RNA, 22 nt, Human
uucaaaacaaucuguuugcauu

SEQ ID NO: 3700 - RNA, 22 nt, Human
uucaaaacagcuagauauugga

SEQ ID NO: 3701 - RNA, 22 nt, Human
uucaaaaguaaucaguauuaga

SEQ ID NO: 3702 - RNA, 22 nt, Human
uucaaacacuggcuuagccaau

SEQ ID NO: 3703 - RNA, 22 nt, Human
uucaaacacuguuggcacuggg

SEQ ID NO: 3704 - RNA, 22 nt, Human
uucaaacaggggucagggagau

SEQ ID NO: 3705 - RNA, 22 nt, Human
uucaaaccuucacuugcagagu

SEQ ID NO: 3706 - RNA, 22 nt, Human
uucaaagaauuuugagaccuga

SEQ ID NO: 3707 - RNA, 22 nt, Human
uucaaagaccuuacuuggcaaa

SEQ ID NO: 3708 - RNA, 21 nt, Human
uucaaagacuugaugcugacc

SEQ ID NO: 3709 - RNA, 22 nt, Human
uucaaagagaaauuguauuuuc

SEQ ID NO: 3710 - RNA, 22 nt, Human
uucaaagaguugggugucuggg

SEQ ID NO: 3711 - RNA, 22 nt, Human
uucaaagcaauagaaagaguga

SEQ ID NO: 3712 - RNA, 22 nt, Human
uucaaaguaccguacuuaaugg

SEQ ID NO: 3713 - RNA, 22 nt, Human
uucaaagugcuguucaaaguag

SEQ ID NO: 3714 - RNA, 20 nt, Human
uucaaaguguaugauaugca

SEQ ID NO: 3715 - RNA, 22 nt, Human
uucaaaguugcaugacagcuua

SEQ ID NO: 3716 - RNA, 22 nt, Human
uucaaaucacuuuggagcuuaa

SEQ ID NO: 3717 - RNA, 22 nt, Human
uucaaaucucuccuaauccacu

SEQ ID NO: 3718 - RNA, 22 nt, Human
uucaacaaacuguucacgaaug

SEQ ID NO: 3719 - RNA, 22 nt, Human
uugcauguacguacagagagag

SEQ ID NO: 3720 - RNA, 22 nt, Human
uugcauguaugugaucuguuca

SEQ ID NO: 3721 - RNA, 22 nt, Human
uugcauguccaggguauugugg

SEQ ID NO: 3722 - RNA, 22 nt, Human
uugcauguccuacaucuguguc

SEQ ID NO: 3723 - RNA, 22 nt, Human
uugcaugugacucuauuuaugc

SEQ ID NO: 3724 - RNA, 22 nt, Human
uugcauguguauaaaaguugga

SEQ ID NO: 3725 - RNA, 22 nt, Human
uugcauuagugucauaaggugg

SEQ ID NO: 3726 - RNA, 22 nt, Human
uugcauuccaugguuuuccuuc

SEQ ID NO: 3727 - RNA, 22 nt, Human
uugcauucccagccaaguuagu

SEQ ID NO: 3728 - RNA, 21 nt, Human
uugcauuccuguuaguauaag

SEQ ID NO: 3729 - RNA, 22 nt, Human
uugcauucuguuaaaauguauu

SEQ ID NO: 3730 - RNA, 22 nt, Human
uugcauugaaugcacauuuuua

SEQ ID NO: 3731 - RNA, 20 nt, Human
uugcauuggaugugcaggug

SEQ ID NO: 3732 - RNA, 22 nt, Human
uugcauugugauuacagaggug

SEQ ID NO: 3733 - RNA, 22 nt, Human
uugcauuuauagacugccauuu

SEQ ID NO: 3734 - RNA, 22 nt, Human
uugcauuucccauugaguaaug

SEQ ID NO: 3735 - RNA, 22 nt, Human
uugcauuugcucauuugauaug

SEQ ID NO: 3736 - RNA, 22 nt, Human
uugcauuuguuugaguagaaug

SEQ ID NO: 3737 - RNA, 22 nt, Human
uugcauuuuuacaaguagccag

SEQ ID NO: 3738 - RNA, 22 nt, Human
uugcauuuuugagcacgaaguu

SEQ ID NO: 3739 - RNA, 22 nt, Human
uucuguuagcauucugaucucc

SEQ ID NO: 3740 - RNA, 22 nt, Human
uucuguuuauaauuugcaguug

SEQ ID NO: 3741 - RNA, 22 nt, Human
uucuguuugugaacuggcugag

SEQ ID NO: 3742 - RNA, 22 nt, Human
uucuguuuuagaaauaaguagu

SEQ ID NO: 3743 - RNA, 22 nt, Human
uucuuaagcaccuaaaaagugg

SEQ ID NO: 3744 - RNA, 22 nt, Human
uucuuaagcaguuuggcauguu

SEQ ID NO: 3745 - RNA, 22 nt, Human
uucuuaaguaugaucuuaacgg

SEQ ID NO: 3746 - RNA, 22 nt, Human
uucuuaauggcaaaggauuuua

SEQ ID NO: 3747 - RNA, 19 nt, Human
uucuuacaacacccuggga

SEQ ID NO: 3748 - RNA, 22 nt, Human
uucuuacuaguauguuucagca

SEQ ID NO: 3749 - RNA, 22 nt, Human
uucuuagagaugguuaaaaaua

SEQ ID NO: 3750 - RNA, 22 nt, Human
uucuuaggacuaguauagcaug

SEQ ID NO: 3751 - RNA, 22 nt, Human
uucuuauauugggucauggaua

SEQ ID NO: 3752 - RNA, 22 nt, Human
uucuuauguucacauaauucca

SEQ ID NO: 3753 - RNA, 23 nt, Human
uucuuauuuacuuuggaaucucc

SEQ ID NO: 3754 - RNA, 22 nt, Human
uucuucaaaguccuuauuccuu

SEQ ID NO: 3755 - RNA, 22 nt, Human
uucuucaaccaucuacauaaac

SEQ ID NO: 3756 - RNA, 22 nt, Human
uucuucaaggguaaaggcaacg

SEQ ID NO: 3757 - RNA, 22 nt, Human
uucuucaauaaauucccauaag

SEQ ID NO: 3758 - RNA, 22 nt, Human
uuucauauuguccagucagcgc

SEQ ID NO: 3759 - RNA, 22 nt, Human
uuucaucaucaaaauagugagg

SEQ ID NO: 3760 - RNA, 22 nt, Human
uuucaucuaacacuacauaggg

SEQ ID NO: 3761 - RNA, 17 nt, Human
uuucaucugggaccacc

SEQ ID NO: 3762 - RNA, 22 nt, Human
uuucaucuucccagagaccuug

SEQ ID NO: 3763 - RNA, 22 nt, Human
uuucaucuuccuuggcauaggu

SEQ ID NO: 3764 - RNA, 22 nt, Human
uuucaugaggcugcauaaggag

SEQ ID NO: 3765 - RNA, 22 nt, Human
uuucauggcuaggacuagagug

SEQ ID NO: 3766 - RNA, 22 nt, Human
uuucauguacugucgaaguuga

SEQ ID NO: 3767 - RNA, 22 nt, Human
uuucaugucauuccauuucaga

SEQ ID NO: 3768 - RNA, 22 nt, Human
uuucauuaguaugacagcacgc

SEQ ID NO: 3769 - RNA, 18 nt, Human
uuucauuauaaagcaggc

SEQ ID NO: 3770 - RNA, 22 nt, Human
uuucauuauacagcuucauaaa

SEQ ID NO: 3771 - RNA, 22 nt, Human
uuucauuauguuccuggaagag

SEQ ID NO: 3772 - RNA, 22 nt, Human
uuucauucauguguuaaaggug

SEQ ID NO: 3773 - RNA, 21 nt, Human
uuucauugaaugagauaaggu

SEQ ID NO: 3774 - RNA, 22 nt, Human
uuucauugagaauauaagauuu

SEQ ID NO: 3775 - RNA, 18 nt, Human
uuucauugagugugauau

SEQ ID NO: 3776 - RNA, 22 nt, Human
uuucauugcagagucugugugc

SEQ ID NO: 3777 - RNA, 22 nt, Human
uuucauugucaauaaacuguau

SEQ ID NO: 3778 - RNA, 22 nt, Human
uuucauugucagagcuuugaau

SEQ ID NO: 3779 - RNA, 22 nt, Human
uuucauuucauagaauuguguu

SEQ ID NO: 3780 - RNA, 22 nt, Human
uuucauuuugguuaugccauaa

SEQ ID NO: 3781 - RNA, 22 nt, Human
uuuccaaaggaggaaccaguuu

SEQ ID NO: 3782 - RNA, 22 nt, Human
uuuccaaauaaggucacauucu

SEQ ID NO: 3783 - RNA, 22 nt, Human
uuuccaacuguaccccaguguu

SEQ ID NO: 3784 - RNA, 22 nt, Human
uuuccaagacuccaguucuccc

SEQ ID NO: 3785 - RNA, 22 nt, Human
uuuccaaguacugagcugucaa

SEQ ID NO: 3786 - RNA, 22 nt, Human
uuuccaaguuguuaccuucuac

SEQ ID NO: 3787 - RNA, 22 nt, Human
uuuccaauguagaugucucugg

SEQ ID NO: 3788 - RNA, 22 nt, Human
uuuccacacaggcucuacuacu

SEQ ID NO: 3789 - RNA, 22 nt, Human
uuuccacacucacugcacucau

SEQ ID NO: 3790 - RNA, 22 nt, Human
uuuccagaugcuagguugaaag

SEQ ID NO: 3791 - RNA, 22 nt, Human
uuuccagggaggaauguggggu

SEQ ID NO: 3792 - RNA, 22 nt, Human
uuuccagguaucaagcuucagg

SEQ ID NO: 3793 - RNA, 22 nt, Human
uuuccagugaaauuuugaaugu

SEQ ID NO: 3794 - RNA, 22 nt, Human
uuuccaugaucguuauagaacu

SEQ ID NO: 3795 - RNA, 22 nt, Human
uuuccauguuaucuugcagacu

SEQ ID NO: 3796 - RNA, 22 nt, Human
uuucccaacagucucucucaaa

SEQ ID NO: 3797 - RNA, 22 nt, Human
uuucccaagaaaaauaauugga

SEQ ID NO: 3798 - RNA, 22 nt, Human
uuucccaagugaagugaagcca

SEQ ID NO: 3799 - RNA, 22 nt, Human
uuucccaggcuggaaugcagug

SEQ ID NO: 3800 - RNA, 22 nt, Human
uuucccaguuagugaagacaug

SEQ ID NO: 3801 - RNA, 22 nt, Human
uuucccaguucccugcucuaua

SEQ ID NO: 3802 - RNA, 22 nt, Human
uuucccuugaauaaagauaucu

SEQ ID NO: 3803 - RNA, 22 nt, Human
uuuccuaagauagauacuucag

SEQ ID NO: 3804 - RNA, 22 nt, Human
uuuccuaaucccaaugacauuu

SEQ ID NO: 3805 - RNA, 22 nt, Human
uuuccuacccuuccaggcagag

SEQ ID NO: 3806 - RNA, 22 nt, Human
uuuccucuaaacgcauuugcuu

SEQ ID NO: 3807 - RNA, 22 nt, Human
uuuccucuccaccaggaggucu

SEQ ID NO: 3808 - RNA, 22 nt, Human
uuuccucugaugcugacuugga

SEQ ID NO: 3809 - RNA, 22 nt, Human
uuuccucugggcccugccaccc

SEQ ID NO: 3810 - RNA, 22 nt, Human
uuuccucuucgauuaaguuugg

SEQ ID NO: 3811 - RNA, 22 nt, Human
uuuccucuucuucccaugucau

SEQ ID NO: 3812 - RNA, 22 nt, Human
uuuccucuuugugacacagcug

SEQ ID NO: 3813 - RNA, 22 nt, Human
uuuccugagccagaguuucauu

SEQ ID NO: 3814 - RNA, 21 nt, Human
uuuccugcccuuugucaucac

SEQ ID NO: 3815 - RNA, 22 nt, Human
uuuccugccuggaccucugcuu

SEQ ID NO: 3816 - RNA, 22 nt, Human
uuuccuggaccaacugagauug

SEQ ID NO: 3817 - RNA, 22 nt, Human
uuuccuggaggguccccagcag

SEQ ID NO: 3818 - RNA, 22 nt, Human
uuuccuggcucuguggccuugu

SEQ ID NO: 3819 - RNA, 22 nt, Human
uuuccuuccagguuccuaaggc

SEQ ID NO: 3820 - RNA, 22 nt, Human
uuuccuuccuaaggugaagcaa

SEQ ID NO: 3821 - RNA, 18 nt, Human
uuuccuuguaugaacaua

SEQ ID NO: 3822 - RNA, 22 nt, Human
uuuccuuguucauuugcccuau

SEQ ID NO: 3823 - RNA, 22 nt, Human
uuuccuuuaugacaucaccacu

SEQ ID NO: 3824 - RNA, 20 nt, Human
uuuccuuucauuuuaguacc

SEQ ID NO: 3825 - RNA, 22 nt, Human
uuuccuuucuagaagccuaaau

SEQ ID NO: 3826 - RNA, 22 nt, Human
uuuccuuugaggguccuacacu

SEQ ID NO: 3827 - RNA, 22 nt, Human
uuucuaaacaaagggaguuugg

SEQ ID NO: 3828 - RNA, 22 nt, Human
uuucuaagaaaguaaugguuau

SEQ ID NO: 3829 - RNA, 22 nt, Human
uuucuaagacauuugucaucuu

SEQ ID NO: 3830 - RNA, 22 nt, Human
uuucuaagcuuaguaugaggca

SEQ ID NO: 3831 - RNA, 22 nt, Human
uuucuaaggaaaguaccuggga

SEQ ID NO: 3832 - RNA, 22 nt, Human
uuucuaaggcuaggucuuaagg

SEQ ID NO: 3833 - RNA, 22 nt, Human
uuucuaaggugauccuuucuua

SEQ ID NO: 3834 - RNA, 22 nt, Human
uuucuaaguaaacacagcauac

SEQ ID NO: 3835 - RNA, 22 nt, Human
uuucuaaguaucuugcaguuuu

SEQ ID NO: 3836 - RNA, 22 nt, Human
uuucuaagucugagggaguaua

SEQ ID NO: 3837 - RNA, 22 nt, Human
uuucuaagugaacauucaaguu

SEQ ID NO: 3838 - RNA, 22 nt, Human
uuucuaaguguauugagcuugg

SEQ ID NO: 3839 - RNA, 22 nt, Human
uuucuaaucuuuaguuacaaaa

SEQ ID NO: 3840 - RNA, 22 nt, Human
uuucuacaauuuuuggcaugag

SEQ ID NO: 3841 - RNA, 22 nt, Human
uuucuacagcuggugcaacuuu

SEQ ID NO: 3842 - RNA, 22 nt, Human
uuucuacauuuguaaccagauu

SEQ ID NO: 3843 - RNA, 22 nt, Human
uuucuagaaauagagauagagu

SEQ ID NO: 3844 - RNA, 22 nt, Human
uuucuagcuguaggaagcugag

SEQ ID NO: 3845 - RNA, 22 nt, Human
uuucuaggucuuccauacugcc

SEQ ID NO: 3846 - RNA, 22 nt, Human
uuucuagguguucacagagcau

SEQ ID NO: 3847 - RNA, 22 nt, Human
uuucuaguaaaagcuaauuacc

SEQ ID NO: 3848 - RNA, 22 nt, Human
uugaagcaugguacuuguucaa

SEQ ID NO: 3849 - RNA, 22 nt, Human
uugaagguuuaacugagaggca

SEQ ID NO: 3850 - RNA, 18 nt, Human
uugaaguuauuuacauuc

SEQ ID NO: 3851 - RNA, 22 nt, Human
uugaaguuuaaugguagauucc

SEQ ID NO: 3852 - RNA, 22 nt, Human
uugaauaguguuuucaguauac

SEQ ID NO: 3853 - RNA, 19 nt, Human
uugaauaugcaaacugaag

SEQ ID NO: 3854 - RNA, 22 nt, Human
uugaaucucucugagauucagu

SEQ ID NO: 3855 - RNA, 22 nt, Human
uugaaugaaauugcuguguuau

SEQ ID NO: 3856 - RNA, 22 nt, Human
uugaaugaauaaaagaguaagg

SEQ ID NO: 3857 - RNA, 22 nt, Human
uugaaugaauuugagcagagau

SEQ ID NO: 3858 - RNA, 22 nt, Human
uugaaugaccaugaugcaaggg

SEQ ID NO: 3859 - RNA, 22 nt, Human
uugaaugaguguuuuacucaug

SEQ ID NO: 3860 - RNA, 22 nt, Human
uugaaugcaugguucacucugu

SEQ ID NO: 3861 - RNA, 22 nt, Human
uugaauucauuucucauugagu

SEQ ID NO: 3862 - RNA, 19 nt, Human
uugaauuguuuugaguagg

SEQ ID NO: 3863 - RNA, 22 nt, Human
uugacaaaguuuaguaauaauc

SEQ ID NO: 3864 - RNA, 22 nt, Human
uugacaaauacccauuagacca

SEQ ID NO: 3865 - RNA, 22 nt, Human
uugacaagaacaccgguuugag

SEQ ID NO: 3866 - RNA, 22 nt, Human
uugacaagaaucguugccuugg

SEQ ID NO: 3867 - RNA, 22 nt, Human
uugacaaggagccauugcaucu

SEQ ID NO: 3868 - RNA, 22 nt, Human
uugacaaugcacugugcuaagu

SEQ ID NO: 3869 - RNA, 22 nt, Human
uugacaauguccuuugaauuuc

SEQ ID NO: 3870 - RNA, 22 nt, Human
uugacacaggaaaguuguaacu

SEQ ID NO: 3871 - RNA, 22 nt, Human
uugacaggagccaaaauaggau

SEQ ID NO: 3872 - RNA, 22 nt, Human
uugaccauaccuccaggcaguu

SEQ ID NO: 3873 - RNA, 22 nt, Human
uugggaagaggccccuggauuc

SEQ ID NO: 3874 - RNA, 22 nt, Human
uugggacagcaaccaucugcua

SEQ ID NO: 3875 - RNA, 22 nt, Human
uugggacauguaagcuggaagu

SEQ ID NO: 3876 - RNA, 22 nt, Human
uugggagaaauaguugauccgc

SEQ ID NO: 3877 - RNA, 22 nt, Human
uugggagauggggagauaauau

SEQ ID NO: 3878 - RNA, 22 nt, Human
uugggagcaaauaggaaagagg

SEQ ID NO: 3879 - RNA, 22 nt, Human
uugggagguaauggagccaagu

SEQ ID NO: 3880 - RNA, 22 nt, Human
uugggaguuccuacugcgguuu

SEQ ID NO: 3881 - RNA, 21 nt, Human
uugggaucugagaagugaaaa

SEQ ID NO: 3882 - RNA, 22 nt, Human
uugggcaaaguguuucuggagc

SEQ ID NO: 3883 - RNA, 23 nt, Human
uugggcaaaucacuaacgucucc

SEQ ID NO: 3884 - RNA, 22 nt, Human
uugggcagaggcugugcagagg

SEQ ID NO: 3885 - RNA, 22 nt, Human
uugggcaggcacauagaguuua

SEQ ID NO: 3886 - RNA, 22 nt, Human
uugggcaggcuggcagacugcu

SEQ ID NO: 3887 - RNA, 22 nt, Human
uugggcagugauuaguucauga

SEQ ID NO: 3888 - RNA, 20 nt, Human
uugggccacacugauucagc

SEQ ID NO: 3889 - RNA, 22 nt, Human
uugggcccauggggcuaagcua

SEQ ID NO: 3890 - RNA, 23 nt, Human
uugggcucaguggcaggaagagu

SEQ ID NO: 3891 - RNA, 22 nt, Human
uugggcuccuguugauccuguc

SEQ ID NO: 3892 - RNA, 22 nt, Human
uugggcugaacccugcagcuga

SEQ ID NO: 3893 - RNA, 22 nt, Human
uugggcuuggucgguuugaggc

SEQ ID NO: 3894 - RNA, 22 nt, Human
uuggggaagaguugacuuugga

SEQ ID NO: 3895 - RNA, 22 nt, Human
uuggggaaggcuucccuguacc

SEQ ID NO: 3896 - RNA, 23 nt, Human
uuggggacaaacaugcuacuuuc

SEQ ID NO: 3897 - RNA, 22 nt, Human
uuggggcaccuccccagcauuu

SEQ ID NO: 3898 - RNA, 22 nt, Human
uuggggcagagaggauacggca

SEQ ID NO: 3899 - RNA, 22 nt, Human
uuggggccgggauaagguuguu

SEQ ID NO: 3900 - RNA, 22 nt, Human
uugggggaagaggauagacagu

SEQ ID NO: 3901 - RNA, 22 nt, Human
uugggguaaaaugucguaagag

SEQ ID NO: 3902 - RNA, 22 nt, Human
uugggguacgcaggucugggag

SEQ ID NO: 3903 - RNA, 18 nt, Human
uuggggugaggccaggaa

SEQ ID NO: 3904 - RNA, 22 nt, Human
uugggucaugggaucccagcau

SEQ ID NO: 3905 - RNA, 22 nt, Human
uugggucuacguagaaagaaca

SEQ ID NO: 3906 - RNA, 22 nt, Human
uugguaaacuugacagagaauc

SEQ ID NO: 3907 - RNA, 22 nt, Human
uugguaaauacucuuuggagac

SEQ ID NO: 3908 - RNA, 22 nt, Human
uugguaaauccccuuacacaaa

SEQ ID NO: 3909 - RNA, 22 nt, Human
uugguaaauuauuucuuccaau

SEQ ID NO: 3910 - RNA, 22 nt, Human
uugguaauuguguuuauuaaau

SEQ ID NO: 3911 - RNA, 22 nt, Human
uugguacauuacaguuugauug

SEQ ID NO: 3912 - RNA, 22 nt, Human
uuggucaagucuuaaagaaaaa

SEQ ID NO: 3913 - RNA, 20 nt, Human
uuggucagugguucaguuug

SEQ ID NO: 3914 - RNA, 22 nt, Human
uugguccugggcacugauuaac

SEQ ID NO: 3915 - RNA, 22 nt, Human
uuggucuucauccgucacagca

SEQ ID NO: 3916 - RNA, 22 nt, Human
uuggugggagaagacucugguu

SEQ ID NO: 3917 - RNA, 22 nt, Human
uuggugggcacaggggagaagu

SEQ ID NO: 3918 - RNA, 22 nt, Human
uugguggguuaaugagugacug

SEQ ID NO: 3919 - RNA, 22 nt, Human
uugguguugaacaaaacuaaau

SEQ ID NO: 3920 - RNA, 22 nt, Human
uugguuaccuucagaaaugagu

SEQ ID NO: 3921 - RNA, 22 nt, Human
uugguuaugcaauuucuuugcu

SEQ ID NO: 3922 - RNA, 22 nt, Human
uugguucaauacuaacuugaac

SEQ ID NO: 3923 - RNA, 22 nt, Human
uugguucauugcaggcgccggg

SEQ ID NO: 3924 - RNA, 20 nt, Human
uugguugagccagggccugg

SEQ ID NO: 3925 - RNA, 22 nt, Human
uugguuuacucuggggauaucu

SEQ ID NO: 3926 - RNA, 22 nt, Human
uugguuuaggaacuggcuugga

SEQ ID NO: 3927 - RNA, 22 nt, Human
uugguuuaguaccugccagcgu

SEQ ID NO: 3928 - RNA, 22 nt, Human
uugguuuguucaccaucaagca

SEQ ID NO: 3929 - RNA, 21 nt, Human
uugguuuucugagucuguaca

SEQ ID NO: 3930 - RNA, 22 nt, Human
uuguaaacuggauagaccuauu

SEQ ID NO: 3931 - RNA, 22 nt, Human
uuguaaacuuguuugaagguau

SEQ ID NO: 3932 - RNA, 22 nt, Human
uuguaaaggcuguuauugacuu

SEQ ID NO: 3933 - RNA, 22 nt, Human
uuguaaaguacuuagcacagca

SEQ ID NO: 3934 - RNA, 22 nt, Human
uuguaacacucccacucuucuu

SEQ ID NO: 3935 - RNA, 22 nt, Human
uuguaacacuuuucuauuaaua

SEQ ID NO: 3936 - RNA, 22 nt, Human
uuguaacuguggguugauuaga

SEQ ID NO: 3937 - RNA, 22 nt, Human
uuguaacuugugauuauaaucu

SEQ ID NO: 3938 - RNA, 22 nt, Human
uuguaagagagaauugcaaauu

SEQ ID NO: 3939 - RNA, 22 nt, Human
uuguaagucacaccagggcagg

SEQ ID NO: 3940 - RNA, 21 nt, Human
uuguacacccacagaucagcc

SEQ ID NO: 3941 - RNA, 19 nt, Human
uuguacagcaaccaacccu

SEQ ID NO: 3942 - RNA, 22 nt, Human
uuguacuaucaccaugucaugu

SEQ ID NO: 3943 - RNA, 22 nt, Human
uuguacuaugucuaagucacug

SEQ ID NO: 3944 - RNA, 22 nt, Human
uuguagcagggaucagaauaca

SEQ ID NO: 3945 - RNA, 22 nt, Human
uuguagcaucaaucaguacuuu

SEQ ID NO: 3946 - RNA, 22 nt, Human
uuguagcuagguuuuuguagaa

SEQ ID NO: 3947 - RNA, 22 nt, Human
uuguaguggccaaagaacucuu

SEQ ID NO: 3948 - RNA, 22 nt, Human
uuguauacaggucuuguccauu

SEQ ID NO: 3949 - RNA, 22 nt, Human
uuguaugaccacaaucugacgu

SEQ ID NO: 3950 - RNA, 22 nt, Human
uuguaugagcuccaggaacuca

SEQ ID NO: 3951 - RNA, 22 nt, Human
uuguaugaucaaaagaaaugua

SEQ ID NO: 3952 - RNA, 22 nt, Human
uuguaugcugaucaaaagcuuc

SEQ ID NO: 3953 - RNA, 22 nt, Human
uuguaugcugaugacaccaccu

SEQ ID NO: 3954 - RNA, 22 nt, Human
uuguauguuucugugcacauga

SEQ ID NO: 3955 - RNA, 22 nt, Human
uuguauuaauugaaaugaaugc

SEQ ID NO: 3956 - RNA, 22 nt, Human
uuguauuccagccaccacaggc

SEQ ID NO: 3957 - RNA, 22 nt, Human
gaagcuucgaaagagugauuuc

SEQ ID NO: 3958 - RNA, 22 nt, Human
gaagcuucguggcucuucaaau

SEQ ID NO: 3959 - RNA, 22 nt, Human
gaagcuucuggcauuucucaaa

SEQ ID NO: 3960 - RNA, 22 nt, Human
gaagcuugagaacuacuguccu

SEQ ID NO: 3961 - RNA, 22 nt, Human
gaagcuuugagagcagaagccc

SEQ ID NO: 3962 - RNA, 22 nt, Human
gaaggaaaacagaucugccuga

SEQ ID NO: 3963 - RNA, 21 nt, Human
gaaggagaaagcaagugcugc

SEQ ID NO: 3964 - RNA, 22 nt, Human
gaaggagcuaaagggagcccug

SEQ ID NO: 3965 - RNA, 22 nt, Human
gaaggauuugagauuauccuag

SEQ ID NO: 3966 - RNA, 22 nt, Human
gaaggcaaggagggaagccacc

SEQ ID NO: 3967 - RNA, 22 nt, Human
gaaggcacccggcgugcggcgg

SEQ ID NO: 3968 - RNA, 22 nt, Human
gaaggcacccuccaucacucac

SEQ ID NO: 3969 - RNA, 22 nt, Human
gaaggcacugaacuccuucugg

SEQ ID NO: 3970 - RNA, 22 nt, Human
gaaggcagggaauguggugcua

SEQ ID NO: 3971 - RNA, 22 nt, Human
gaaggcauaaaaccaauuuugu

SEQ ID NO: 3972 - RNA, 22 nt, Human
gaaggcaucucuggacuuauuu

SEQ ID NO: 3973 - RNA, 18 nt, Human
gaaggcauucaguggcuu

SEQ ID NO: 3974 - RNA, 22 nt, Human
gaaggccacggaauggagcugg

SEQ ID NO: 3975 - RNA, 22 nt, Human
gaaggccaguuuugagauaggu

SEQ ID NO: 3976 - RNA, 22 nt, Human
gaaggccauugcguccugggau

SEQ ID NO: 3977 - RNA, 22 nt, Human
gaaggcccagucaaggggcuag

SEQ ID NO: 3978 - RNA, 22 nt, Human
gaaggcccugguauucuugagg

SEQ ID NO: 3979 - RNA, 17 nt, Human
gaaggccugcacaggcc

SEQ ID NO: 3980 - RNA, 22 nt, Human
gaaggcuccuugagggaaggac

SEQ ID NO: 3981 - RNA, 22 nt, Human
gaaggcucuggggauugagaua

SEQ ID NO: 3982 - RNA, 22 nt, Human
gaaggcucuugaggccagguaa

SEQ ID NO: 3983 - RNA, 19 nt, Human
gaaggcugaaaugaagcac

SEQ ID NO: 3984 - RNA, 22 nt, Human
gaaggcuggaaggcaaguagga

SEQ ID NO: 3985 - RNA, 22 nt, Human
gaaggcuggcucagcuuuccag

SEQ ID NO: 3986 - RNA, 22 nt, Human
gaaggcuggcuuucugagagca

SEQ ID NO: 3987 - RNA, 22 nt, Human
gaaggcugucagagaggagggc

SEQ ID NO: 3988 - RNA, 21 nt, Human
cccaggcugaauuaaaaauau

SEQ ID NO: 3989 - RNA, 22 nt, Human
cccaggcugauguucagcgggu

SEQ ID NO: 3990 - RNA, 22 nt, Human
cccaggcugcaugaguccaugg

SEQ ID NO: 3991 - RNA, 22 nt, Human
cccaggcugcguauccacaaua

SEQ ID NO: 3992 - RNA, 22 nt, Human
cccaggcuggagugcaauggca

SEQ ID NO: 3993 - RNA, 22 nt, Human
cccaggcuggcacugcugaagu

SEQ ID NO: 3994 - RNA, 22 nt, Human
cccaggcugguccugaacuccu

SEQ ID NO: 3995 - RNA, 22 nt, Human
cccaggcuucccaaucagaagg

SEQ ID NO: 3996 - RNA, 21 nt, Human
cccagggaagccgcagucacc

SEQ ID NO: 3997 - RNA, 17 nt, Human
cccagggaccacugcuu

SEQ ID NO: 3998 - RNA, 22 nt, Human
cccagggagguagcaggagaaa

SEQ ID NO: 3999 - RNA, 22 nt, Human
cccagggcugcagauggaggcu

SEQ ID NO: 4000 - RNA, 22 nt, Human
cccaggggagguccucagggaa

SEQ ID NO: 4001 - RNA, 22 nt, Human
cccaggguggaugcaagcagca

SEQ ID NO: 4002 - RNA, 22 nt, Human
cccaggguugccugccucugcu

SEQ ID NO: 4003 - RNA, 23 nt, Human
cccaggucaaaauucacaggccu

SEQ ID NO: 4004 - RNA, 22 nt, Human
cccaggucccggggccagcugc

SEQ ID NO: 4005 - RNA, 22 nt, Human
cccaggucgucagcaguguggu

SEQ ID NO: 4006 - RNA, 22 nt, Human
cccaggucucccugcagcccug

SEQ ID NO: 4007 - RNA, 22 nt, Human
cccaggucugccagccuguggg

SEQ ID NO: 4008 - RNA, 22 nt, Human
cccaggugcugaaggaggccgc

SEQ ID NO: 4009 - RNA, 21 nt, Human
cccaggugggaugguugccuc

SEQ ID NO: 4010 - RNA, 22 nt, Human
cccaggugggcaccucgaggaa

SEQ ID NO: 4011 - RNA, 22 nt, Human
cccagguggguuggccucuguc

SEQ ID NO: 4012 - RNA, 19 nt, Human
cccagguguuugaggcugc

SEQ ID NO: 4013 - RNA, 22 nt, Human
cccaguccagaccaugaccuca

SEQ ID NO: 4014 - RNA, 22 nt, Human
cccagugccaggcacaggcagc

SEQ ID NO: 4015 - RNA, 22 nt, Human
cccaguggggagcugagguuca

SEQ ID NO: 4016 - RNA, 22 nt, Human
cccagugggucacugcaucuca

SEQ ID NO: 4017 - RNA, 22 nt, Human
cccaguggugcuggcaucugug

SEQ ID NO: 4018 - RNA, 22 nt, Human
cccagugucauucuaagggagg

SEQ ID NO: 4019 - RNA, 22 nt, Human
cccaguuguugccggcucugga

SEQ ID NO: 4020 - RNA, 22 nt, Human
cccaugagaccugguuuaaggc

SEQ ID NO: 4021 - RNA, 22 nt, Human
cccaugagauucugaauuuggc

SEQ ID NO: 4022 - RNA, 22 nt, Human
cccaugcaucccucuccugggc

SEQ ID NO: 4023 - RNA, 22 nt, Human
cccauucuucaugguuuccugu

SEQ ID NO: 4024 - RNA, 22 nt, Human
cccauugugguuguugaggaua

SEQ ID NO: 4025 - RNA, 22 nt, Human
cccauuuaaguaaugauaaacu

SEQ ID NO: 4026 - RNA, 22 nt, Human
cccauuuauuuaaguaggucuu

SEQ ID NO: 4027 - RNA, 22 nt, Human
cccauuuuggaacgaguagcca

SEQ ID NO: 4028 - RNA, 18 nt, Human
ccccaaaagucacccugg

SEQ ID NO: 4029 - RNA, 22 nt, Human
ccccaaagccucagccugccug

SEQ ID NO: 4030 - RNA, 22 nt, Human
ccccaaaguguuggauaauuga

SEQ ID NO: 4031 - RNA, 22 nt, Human
ccccaacccugguuccguggcg

SEQ ID NO: 4032 - RNA, 22 nt, Human
ccccacaccugccgggcagcag

SEQ ID NO: 4033 - RNA, 22 nt, Human
ccccacacucuuuacauucaua

SEQ ID NO: 4034 - RNA, 22 nt, Human
ccccacaguccgugaggagcca

SEQ ID NO: 4035 - RNA, 22 nt, Human
ccccaccaccaaggcucaguuu

SEQ ID NO: 4036 - RNA, 22 nt, Human
ccccagaaagccuggcacuagg

SEQ ID NO: 4037 - RNA, 22 nt, Human
ccccagaaggggacagagggua

SEQ ID NO: 4038 - RNA, 22 nt, Human
ccccagcacuaccagaagccag

SEQ ID NO: 4039 - RNA, 22 nt, Human
ccccagcagacucagggcaggu

SEQ ID NO: 4040 - RNA, 22 nt, Human
ccccagccagcaggaccucuga

SEQ ID NO: 4041 - RNA, 22 nt, Human
ccccagcucagugcagggacau

SEQ ID NO: 4042 - RNA, 22 nt, Human
ccccagcugcauacuugccaag

SEQ ID NO: 4043 - RNA, 22 nt, Human
ccccaggaagccucagauuugc

SEQ ID NO: 4044 - RNA, 22 nt, Human
ccccagggaagcuuugcuuacu

SEQ ID NO: 4045 - RNA, 22 nt, Human
ccccagggacugguuucaugga

SEQ ID NO: 4046 - RNA, 22 nt, Human
ccccagguggauggcucgcaua

SEQ ID NO: 4047 - RNA, 22 nt, Human
ccccaucuucccugagggauuu

SEQ ID NO: 4048 - RNA, 21 nt, Human
ccccauggaguacaguugggc

SEQ ID NO: 4049 - RNA, 22 nt, Human
ccccauggcaacugcugggggu

SEQ ID NO: 4050 - RNA, 18 nt, Human
cccccagccaaauucucu

SEQ ID NO: 4051 - RNA, 22 nt, Human
cccccagccagcagugcucagc

SEQ ID NO: 4052 - RNA, 22 nt, Human
cccccauccaugucaggagagg

SEQ ID NO: 4053 - RNA, 22 nt, Human
cccccucugccgggguccuuca

SEQ ID NO: 4054 - RNA, 22 nt, Human
ccccggaggcggagguugcagu

SEQ ID NO: 4055 - RNA, 17 nt, Human
ccccuaccuccguuuga

SEQ ID NO: 4056 - RNA, 16 nt, Human
ccccucaggaaguaca

SEQ ID NO: 4057 - RNA, 22 nt, Human
ccccucauuacaggcggggagc

SEQ ID NO: 4058 - RNA, 22 nt, Human
ccccucauucucugagcuaguu

SEQ ID NO: 4059 - RNA, 22 nt, Human
ccccuccuggccacacugucag

SEQ ID NO: 4060 - RNA, 22 nt, Human
ccccugccagcuaucccugaac

SEQ ID NO: 4061 - RNA, 22 nt, Human
ccccugcuggccugcugguuuc

SEQ ID NO: 4062 - RNA, 21 nt, Human
ccccugggagcccugucagua

SEQ ID NO: 4063 - RNA, 22 nt, Human
ccccuggggaucagcuggaauu

SEQ ID NO: 4064 - RNA, 22 nt, Human
ccccuggguccaggcuucucug

SEQ ID NO: 4065 - RNA, 22 nt, Human
ccccuguguuguucaaggguca

SEQ ID NO: 4066 - RNA, 22 nt, Human
gacagcaaagcagagccaaggc

SEQ ID NO: 4067 - RNA, 22 nt, Human
gacagcaacacucaauucugca

SEQ ID NO: 4068 - RNA, 21 nt, Human
gacagcaacuguaguccucuu

SEQ ID NO: 4069 - RNA, 22 nt, Human
gacagcagacaaaccauguuuu

SEQ ID NO: 4070 - RNA, 22 nt, Human
gacagcagacagccuggccccu

SEQ ID NO: 4071 - RNA, 22 nt, Human
gacagcagauaagaccucauca

SEQ ID NO: 4072 - RNA, 22 nt, Human
gacagcagcauguuuacaggcc

SEQ ID NO: 4073 - RNA, 22 nt, Human
gacagcaggagaucaugauaga

SEQ ID NO: 4074 - RNA, 22 nt, Human
gacagcaguuuuucucuagggu

SEQ ID NO: 4075 - RNA, 22 nt, Human
gacagcauggugucuguucagg

SEQ ID NO: 4076 - RNA, 22 nt, Human
gacagccaacuggggagggcau

SEQ ID NO: 4077 - RNA, 22 nt, Human
gacagcugcauccucagacaca

SEQ ID NO: 4078 - RNA, 22 nt, Human
gacagcugccucuguguagauc

SEQ ID NO: 4079 - RNA, 22 nt, Human
gacagcugcucccguuucugcu

SEQ ID NO: 4080 - RNA, 22 nt, Human
gacagcugcuuaugaaccaacg

SEQ ID NO: 4081 - RNA, 22 nt, Human
gacagcugggaggaugacauaa

SEQ ID NO: 4082 - RNA, 22 nt, Human
gacagcuuagugaaaauguaaa

SEQ ID NO: 4083 - RNA, 22 nt, Human
gacagcuucuagaaauggucac

SEQ ID NO: 4084 - RNA, 22 nt, Human
gacagcuucuagaggaauuggu

SEQ ID NO: 4085 - RNA, 22 nt, Human
gacagcuucuaugugacgagca

SEQ ID NO: 4086 - RNA, 22 nt, Human
gacagcuugccugguacugcaa

SEQ ID NO: 4087 - RNA, 20 nt, Human
gacagcuuggggugucaccu

SEQ ID NO: 4088 - RNA, 22 nt, Human
gacaggaaacaagaaggcagga

SEQ ID NO: 4089 - RNA, 22 nt, Human
gacaggaagucugaaggaggga

SEQ ID NO: 4090 - RNA, 19 nt, Human
gacaggacgaagggaaguu

SEQ ID NO: 4091 - RNA, 22 nt, Human
gacaggacuucacuguguugcc

SEQ ID NO: 4092 - RNA, 20 nt, Human
gacaggagaguuagguaggu

SEQ ID NO: 4093 - RNA, 22 nt, Human
gacaggcaccuugucugucuug

SEQ ID NO: 4094 - RNA, 22 nt, Human
gacaggcagaccugugcccugg

SEQ ID NO: 4095 - RNA, 22 nt, Human
gacaggcaugcuuucaggacua

SEQ ID NO: 4096 - RNA, 22 nt, Human
gacaggccagacaggagacuga

SEQ ID NO: 4097 - RNA, 22 nt, Human
gacaggccaggggcugaggugg

SEQ ID NO: 4098 - RNA, 22 nt, Human
gacaggcccccucaggacugau

SEQ ID NO: 4099 - RNA, 22 nt, Human
gacaggcccgaguagcugauga

SEQ ID NO: 4100 - RNA, 17 nt, Human
gacaggcucagugacga

SEQ ID NO: 4101 - RNA, 22 nt, Human
gacaggcugugauggccgggag

SEQ ID NO: 4102 - RNA, 22 nt, Human
gacaggcuucauccucagaguu

SEQ ID NO: 4103 - RNA, 22 nt, Human
gacagggacucccugguuagaa

SEQ ID NO: 4104 - RNA, 22 nt, Human
gacagggaggagcagagcuucu

SEQ ID NO: 4105 - RNA, 22 nt, Human
gacagggcaagacucugucuaa

SEQ ID NO: 4106 - RNA, 22 nt, Human
gacaggggucccucugggcugu

SEQ ID NO: 4107 - RNA, 22 nt, Human
gacaggguccaaaggcagggga

SEQ ID NO: 4108 - RNA, 22 nt, Human
cccugaaaguacacugggacgg

SEQ ID NO: 4109 - RNA, 22 nt, Human
cccugaaauccugugcucugug

SEQ ID NO: 4110 - RNA, 18 nt, Human
cccugaagggcaagauaa

SEQ ID NO: 4111 - RNA, 22 nt, Human
cccugacucggcgcgcucccgu

SEQ ID NO: 4112 - RNA, 22 nt, Human
cccugacuugaucuuugacuug

SEQ ID NO: 4113 - RNA, 22 nt, Human
cccugagaagaucauugccacg

SEQ ID NO: 4114 - RNA, 22 nt, Human
cccugagagugagugccaccuu

SEQ ID NO: 4115 - RNA, 22 nt, Human
cccugagcaacaaacugaauac

SEQ ID NO: 4116 - RNA, 22 nt, Human
cccugagccacacagagcaggu

SEQ ID NO: 4117 - RNA, 22 nt, Human
cccugagccgcugcuccaaccu

SEQ ID NO: 4118 - RNA, 22 nt, Human
cccugagcucaggcccuugggg

SEQ ID NO: 4119 - RNA, 22 nt, Human
cccugaggaaaggguggagggc

SEQ ID NO: 4120 - RNA, 19 nt, Human
cccugaggcaaaagccuuu

SEQ ID NO: 4121 - RNA, 22 nt, Human
cccugaggggcuuacuuugccc

SEQ ID NO: 4122 - RNA, 22 nt, Human
cccugaguuaguacaguugagu

SEQ ID NO: 4123 - RNA, 22 nt, Human
cccugauguuuucucugccuuu

SEQ ID NO: 4124 - RNA, 22 nt, Human
cccugcacagccuggcucucuu

SEQ ID NO: 4125 - RNA, 22 nt, Human
cccugcagagccagcccugacc

SEQ ID NO: 4126 - RNA, 22 nt, Human
cccugcagccggccagcucauu

SEQ ID NO: 4127 - RNA, 22 nt, Human
cccugcagccuugcaugccuuc

SEQ ID NO: 4128 - RNA, 21 nt, Human
cccugcaggccagggcugagc

SEQ ID NO: 4129 - RNA, 22 nt, Human
cccugcagggaggauucugaag

SEQ ID NO: 4130 - RNA, 22 nt, Human
cccugcaggggaccugcagccu

SEQ ID NO: 4131 - RNA, 23 nt, Human
cccugcagucagggugagauggu

SEQ ID NO: 4132 - RNA, 22 nt, Human
cccugcagugugaccucaccua

SEQ ID NO: 4133 - RNA, 22 nt, Human
cccugccagaugugcuucaguu

SEQ ID NO: 4134 - RNA, 22 nt, Human
cccugcccaucggggcggccug

SEQ ID NO: 4135 - RNA, 19 nt, Human
cccugcccuggugacuggg

SEQ ID NO: 4136 - RNA, 22 nt, Human
cccugccuucuuggccuuuaaa

SEQ ID NO: 4137 - RNA, 22 nt, Human
cccugccuugggguccacaccg

SEQ ID NO: 4138 - RNA, 22 nt, Human
cccugcugacaacuugauuuug

SEQ ID NO: 4139 - RNA, 22 nt, Human
cccugcugaugccuugauuuug

SEQ ID NO: 4140 - RNA, 22 nt, Human
cccugcugccuucacccaggac

SEQ ID NO: 4141 - RNA, 22 nt, Human
cccugcuucccugggagaggcg

SEQ ID NO: 4142 - RNA, 21 nt, Human
cccugcuuggggcagaacaac

SEQ ID NO: 4143 - RNA, 22 nt, Human
cccuggacggggaauaugacuu

SEQ ID NO: 4144 - RNA, 19 nt, Human
cccuggagaauacccugga

SEQ ID NO: 4145 - RNA, 22 nt, Human
cccuggagcaucucugcugucu

SEQ ID NO: 4146 - RNA, 22 nt, Human
cccuggaggaaaaucugaggcu

SEQ ID NO: 4147 - RNA, 22 nt, Human
cccuggaggaagaaacaauggc

SEQ ID NO: 4148 - RNA, 22 nt, Human
cccuggagucagguuggccugg

SEQ ID NO: 4149 - RNA, 22 nt, Human
cccuggcaagugcuguguagcu

SEQ ID NO: 4150 - RNA, 22 nt, Human
cccuggcacuagcgacggccau

SEQ ID NO: 4151 - RNA, 23 nt, Human
cccuggccuuggggcacaggcug

SEQ ID NO: 4152 - RNA, 22 nt, Human
cccuggcucugccucagagccc

SEQ ID NO: 4153 - RNA, 22 nt, Human
cccuggcugcuuguagucuggc

SEQ ID NO: 4154 - RNA, 22 nt, Human
cccugggagaaguugagggcug

SEQ ID NO: 4155 - RNA, 22 nt, Human
cccugggucuagguuaugugcu

SEQ ID NO: 4156 - RNA, 17 nt, Human
cccugggugaguucuca

SEQ ID NO: 4157 - RNA, 22 nt, Human
cccuggucagggaaggcgccug

SEQ ID NO: 4158 - RNA, 22 nt, Human
cccuggugguacggcacuggca

SEQ ID NO: 4159 - RNA, 22 nt, Human
cccugguguccacuggaggaag

SEQ ID NO: 4160 - RNA, 22 nt, Human
cccugguguggaugugauuggc

SEQ ID NO: 4161 - RNA, 22 nt, Human
cccuguccugcuaggcccuggu

SEQ ID NO: 4162 - RNA, 22 nt, Human
cccugugacgagcacggccagu

SEQ ID NO: 4163 - RNA, 22 nt, Human
cccugugcagauggcagcuggg

SEQ ID NO: 4164 - RNA, 22 nt, Human
cccugugccagagaggcaggag

SEQ ID NO: 4165 - RNA, 22 nt, Human
cccugugccuaguuggccuaaa

SEQ ID NO: 4166 - RNA, 22 nt, Human
cccugugcugucaugcugggcg

SEQ ID NO: 4167 - RNA, 22 nt, Human
cccugugggccaugugucuaca

SEQ ID NO: 4168 - RNA, 22 nt, Human
cccugugguugcuagggcacag

SEQ ID NO: 4169 - RNA, 22 nt, Human
cccuuagcucaauuucuugccc

SEQ ID NO: 4170 - RNA, 22 nt, Human
cccuuagcucacaagcuaaagc

SEQ ID NO: 4171 - RNA, 23 nt, Human
cccuucagcgagggcauuaaggu

SEQ ID NO: 4172 - RNA, 22 nt, Human
cccuucagcugagugggacagc

SEQ ID NO: 4173 - RNA, 22 nt, Human
cccuucccuucugggagaucca

SEQ ID NO: 4174 - RNA, 22 nt, Human
cccuuccucccaggcuucugug

SEQ ID NO: 4175 - RNA, 22 nt, Human
gaccauuugcuaguaaauugca

SEQ ID NO: 4176 - RNA, 22 nt, Human
gaccauuuguugaaaagauuau

SEQ ID NO: 4177 - RNA, 22 nt, Human
gacccagaggccugacagugug

SEQ ID NO: 4178 - RNA, 22 nt, Human
gacccaggagugcagagagugg

SEQ ID NO: 4179 - RNA, 22 nt, Human
gacccaggcucgugggacggcu

SEQ ID NO: 4180 - RNA, 22 nt, Human
gacccucaaacaauuacacugc

SEQ ID NO: 4181 - RNA, 22 nt, Human
gacccuccacucacugcugugu

SEQ ID NO: 4182 - RNA, 22 nt, Human
gacccugaggaugcaccagcag

SEQ ID NO: 4183 - RNA, 22 nt, Human
gacccugccaugagugacaggg

SEQ ID NO: 4184 - RNA, 22 nt, Human
gacccuggcuagggcuuaaccu

SEQ ID NO: 4185 - RNA, 22 nt, Human
gacccuggcuggagcuggccug

SEQ ID NO: 4186 - RNA, 22 nt, Human
gacccuuagaaugugaucuuau

SEQ ID NO: 4187 - RNA, 22 nt, Human
gacccuuucagacccuuuagua

SEQ ID NO: 4188 - RNA, 22 nt, Human
gaccugaaaugggggccugucc

SEQ ID NO: 4189 - RNA, 22 nt, Human
gaccugagauuuugaggcucau

SEQ ID NO: 4190 - RNA, 22 nt, Human
gaccugccugagcugccucugc

SEQ ID NO: 4191 - RNA, 22 nt, Human
gaccuggaagaacugaggccuu

SEQ ID NO: 4192 - RNA, 22 nt, Human
gaccuggaauuuguguguguuc

SEQ ID NO: 4193 - RNA, 22 nt, Human
gaccuggacugaguuagauggc

SEQ ID NO: 4194 - RNA, 22 nt, Human
gaccuggauucaaauucagacu

SEQ ID NO: 4195 - RNA, 22 nt, Human
gaccuggcuuugggccccggca

SEQ ID NO: 4196 - RNA, 22 nt, Human
gaccuggugcuagcuggugugu

SEQ ID NO: 4197 - RNA, 22 nt, Human
gaccugugcagugacugguggc

SEQ ID NO: 4198 - RNA, 22 nt, Human
gaccuuccuucuuugcuccggg

SEQ ID NO: 4199 - RNA, 22 nt, Human
gaccuuuagugucauguuauau

SEQ ID NO: 4200 - RNA, 22 nt, Human
gacgcacugaaggcugguuacc

SEQ ID NO: 4201 - RNA, 22 nt, Human
gacuaaauuccuguucgcgaug

SEQ ID NO: 4202 - RNA, 22 nt, Human
gacuacaacucccagaagacuu

SEQ ID NO: 4203 - RNA, 22 nt, Human
gacuacaggccggcaucagaga

SEQ ID NO: 4204 - RNA, 22 nt, Human
gacuaggggcagcgugggagcu

SEQ ID NO: 4205 - RNA, 22 nt, Human
gacuauuuaaaaagaacuacug

SEQ ID NO: 4206 - RNA, 22 nt, Human
gacuauuuuauaaacuagugaa

SEQ ID NO: 4207 - RNA, 22 nt, Human
gacuauuuugcacaaaacaauu

SEQ ID NO: 4208 - RNA, 19 nt, Human
gacuccaacuuuaagcaug

SEQ ID NO: 4209 - RNA, 22 nt, Human
gacuccagaaucuggacggucc

SEQ ID NO: 4210 - RNA, 22 nt, Human
gacuccagggauuggaagaugu

SEQ ID NO: 4211 - RNA, 22 nt, Human
gacuccaggugcaggaggagcc

SEQ ID NO: 4212 - RNA, 22 nt, Human
gacuccccacguuaaggaaugu

SEQ ID NO: 4213 - RNA, 21 nt, Human
gacucucuagugcuguccagu

SEQ ID NO: 4214 - RNA, 22 nt, Human
gacugaggagguaagguuugaa

SEQ ID NO: 4215 - RNA, 22 nt, Human
gacugaggccuuuauugagaca

SEQ ID NO: 4216 - RNA, 22 nt, Human
gacugcauucauuugguuggca

SEQ ID NO: 4217 - RNA, 22 nt, Human
gacugccagaaugugaggccug

SEQ ID NO: 4218 - RNA, 22 nt, Human
gacugccuuuuugagcaaaaug

SEQ ID NO: 4219 - RNA, 22 nt, Human
gacugcuuugacaaaugauacc

SEQ ID NO: 4220 - RNA, 22 nt, Human
gacugcuuugguuuguaaaugu

SEQ ID NO: 4221 - RNA, 22 nt, Human
ccccucuuguacuagacaguuu

SEQ ID NO: 4222 - RNA, 22 nt, Human
ccccugccauagucaaaucuaa

SEQ ID NO: 4223 - RNA, 22 nt, Human
ccccuucucugcaagccugcuc

SEQ ID NO: 4224 - RNA, 22 nt, Human
cccggacagaggggcagagugu

SEQ ID NO: 4225 - RNA, 22 nt, Human
cccgggaacauaaagcagugag

SEQ ID NO: 4226 - RNA, 22 nt, Human
cccguguggacagcgugccagu

SEQ ID NO: 4227 - RNA, 22 nt, Human
cccguguggaugcgcuggugcu

SEQ ID NO: 4228 - RNA, 22 nt, Human
cccuaaggacaccugcugucca

SEQ ID NO: 4229 - RNA, 22 nt, Human
cccuagggcuaagcaggacugc

SEQ ID NO: 4230 - RNA, 22 nt, Human
cccuauuagugaccacaucaua

SEQ ID NO: 4231 - RNA, 22 nt, Human
cccucagcucaagccccugugc

SEQ ID NO: 4232 - RNA, 22 nt, Human
cccucagcuccacccucagcag

SEQ ID NO: 4233 - RNA, 22 nt, Human
cccucaggagaugucagcugga

SEQ ID NO: 4234 - RNA, 22 nt, Human
cccucaugccagacagcaugca

SEQ ID NO: 4235 - RNA, 22 nt, Human
cccuccagggagccaugcuggg

SEQ ID NO: 4236 - RNA, 22 nt, Human
cccuccauuaaaacagaccuau

SEQ ID NO: 4237 - RNA, 22 nt, Human
cccucccuuccaaguugaggac

SEQ ID NO: 4238 - RNA, 22 nt, Human
cccuccucaacucuggcuucca

SEQ ID NO: 4239 - RNA, 22 nt, Human
cccuccucucccuaagagucac

SEQ ID NO: 4240 - RNA, 22 nt, Human
cccuccugugccugaggccagc

SEQ ID NO: 4241 - RNA, 22 nt, Human
cccucgcucuaggcagcccugu

SEQ ID NO: 4242 - RNA, 22 nt, Human
cccucgggucgcggacugcgcu

SEQ ID NO: 4243 - RNA, 22 nt, Human
cccucucagucagagccagaua

SEQ ID NO: 4244 - RNA, 22 nt, Human
cccucuccuggcugcauggagc

SEQ ID NO: 4245 - RNA, 22 nt, Human
cccucucugcugcauagaggaa

SEQ ID NO: 4246 - RNA, 22 nt, Human
cccucugaaccugguagcagaa

SEQ ID NO: 4247 - RNA, 22 nt, Human
cccucugaccuccugccacagu

SEQ ID NO: 4248 - RNA, 22 nt, Human
cccucugcaggcuggaccugcc

SEQ ID NO: 4249 - RNA, 22 nt, Human
cccucuggcucuucucaggccg

SEQ ID NO: 4250 - RNA, 18 nt, Human
cccucuugcacaaagcaa

SEQ ID NO: 4251 - RNA, 22 nt, Human
cccugacagauggcaggggagc

SEQ ID NO: 4252 - RNA, 22 nt, Human
cccugaccccacggcuggagaa

SEQ ID NO: 4253 - RNA, 22 nt, Human
cccugacccuaucagagggcca

SEQ ID NO: 4254 - RNA, 22 nt, Human
cccugagaacaacuuagggguc

SEQ ID NO: 4255 - RNA, 22 nt, Human
cccugagcuaccuauguaagca

SEQ ID NO: 4256 - RNA, 23 nt, Human
cccugagcugguccaggcucaac

SEQ ID NO: 4257 - RNA, 22 nt, Human
cccugaggaccaggaaggaggg

SEQ ID NO: 4258 - RNA, 22 nt, Human
cccugaggauagggcaggaccc

SEQ ID NO: 4259 - RNA, 22 nt, Human
cccugaggaugucuccuuccug

SEQ ID NO: 4260 - RNA, 22 nt, Human
cccugaggcacaggccacguau

SEQ ID NO: 4261 - RNA, 22 nt, Human
cccugagucaucauugcggaag

SEQ ID NO: 4262 - RNA, 22 nt, Human
cccugaugacacgggcaucagg

SEQ ID NO: 4263 - RNA, 22 nt, Human
cccugauggcacaguggcaggc

SEQ ID NO: 4264 - RNA, 22 nt, Human
cccugauggccuaucuggcagu

SEQ ID NO: 4265 - RNA, 22 nt, Human
cccugcacacucgugucuugac

SEQ ID NO: 4266 - RNA, 17 nt, Human
cccugcacccuacucuc

SEQ ID NO: 4267 - RNA, 22 nt, Human
cccugcagagaccacugaccuu

SEQ ID NO: 4268 - RNA, 22 nt, Human
cccugcagaucagugagaacuu

SEQ ID NO: 4269 - RNA, 22 nt, Human
cccugcagaucuaggguccuuc

SEQ ID NO: 4270 - RNA, 23 nt, Human
cccugcaucugucccucaccagu

SEQ ID NO: 4271 - RNA, 17 nt, Human
cccugccaccaggaagc

SEQ ID NO: 4272 - RNA, 22 nt, Human
cccugccccaggcggcuucacu

SEQ ID NO: 4273 - RNA, 22 nt, Human
cccugcccuggagacacuuaaa

SEQ ID NO: 4274 - RNA, 22 nt, Human
cccugccuuguuggagccuaug

SEQ ID NO: 4275 - RNA, 22 nt, Human
cccugcuagaaccuccaacaug

SEQ ID NO: 4276 - RNA, 22 nt, Human
cccugcuaguccuuccuuggcu

SEQ ID NO: 4277 - RNA, 22 nt, Human
cccugcucuuagugccugugug

SEQ ID NO: 4278 - RNA, 22 nt, Human
cccugcugaaucccauggaguc

SEQ ID NO: 4279 - RNA, 22 nt, Human
cccugcugugucccaccuggaa

SEQ ID NO: 4280 - RNA, 22 nt, Human
cccugcuuagcacccuugcacc

SEQ ID NO: 4281 - RNA, 22 nt, Human
cccugcuuugcacccaggcugg

SEQ ID NO: 4282 - RNA, 22 nt, Human
cccuggaaaugaggcaugugcg

SEQ ID NO: 4283 - RNA, 22 nt, Human
cccuggaacuccuaggcaagca

SEQ ID NO: 4284 - RNA, 22 nt, Human
ccugccuggcacauaguacucu

SEQ ID NO: 4285 - RNA, 20 nt, Human
ccugccuggccauuccuugg

SEQ ID NO: 4286 - RNA, 22 nt, Human
ccugccuguacuagagacccag

SEQ ID NO: 4287 - RNA, 23 nt, Human
ccugccuguucuaacuccauuuc

SEQ ID NO: 4288 - RNA, 22 nt, Human
ccugccuucccagcuuggcuuu

SEQ ID NO: 4289 - RNA, 22 nt, Human
ccugccuuucucaguaaucuuu

SEQ ID NO: 4290 - RNA, 22 nt, Human
ccugcgcgucugggucugucuc

SEQ ID NO: 4291 - RNA, 22 nt, Human
ccugcgggcugugcugaagccu

SEQ ID NO: 4292 - RNA, 22 nt, Human
ccugcucaccugauguggcaac

SEQ ID NO: 4293 - RNA, 22 nt, Human
ccugcucagagcgucuugugug

SEQ ID NO: 4294 - RNA, 22 nt, Human
ccugcucugccaaguccucuuu

SEQ ID NO: 4295 - RNA, 22 nt, Human
ccugcucuuauagcuguuucca

SEQ ID NO: 4296 - RNA, 22 nt, Human
ccugcugcuuaggccauauuuc

SEQ ID NO: 4297 - RNA, 22 nt, Human
ccugcuggacagggguguucau

SEQ ID NO: 4298 - RNA, 22 nt, Human
ccugcuggaccucaacacauuu

SEQ ID NO: 4299 - RNA, 22 nt, Human
ccugcuggcagaggggguuacu

SEQ ID NO: 4300 - RNA, 22 nt, Human
ccugcuggcauucuugcucccu

SEQ ID NO: 4301 - RNA, 22 nt, Human
ccugcuguagggccccuggggc

SEQ ID NO: 4302 - RNA, 22 nt, Human
ccugcugucagcauccucgcga

SEQ ID NO: 4303 - RNA, 22 nt, Human
ccugcuguucuguuuagugaac

SEQ ID NO: 4304 - RNA, 22 nt, Human
ccugcuuaacauugccaugaca

SEQ ID NO: 4305 - RNA, 22 nt, Human
ccugcuuugcugguaccaucag

SEQ ID NO: 4306 - RNA, 22 nt, Human
ccuggaaagcugcccugugaca

SEQ ID NO: 4307 - RNA, 22 nt, Human
ccuggaaaugcaaaagccauga

SEQ ID NO: 4308 - RNA, 22 nt, Human
ccuggaagucauuccucguucc

SEQ ID NO: 4309 - RNA, 22 nt, Human
ccuggaaguuggagguugcagu

SEQ ID NO: 4310 - RNA, 22 nt, Human
ccuggaaucuggaguuggaauc

SEQ ID NO: 4311 - RNA, 22 nt, Human
ccuggacagggccaggccaugc

SEQ ID NO: 4312 - RNA, 22 nt, Human
ccuggaccaaacacuggccugg

SEQ ID NO: 4313 - RNA, 22 nt, Human
ccuggacucaggcugugggcac

SEQ ID NO: 4314 - RNA, 22 nt, Human
ccuggagacgaggcuggaccau

SEQ ID NO: 4315 - RNA, 22 nt, Human
ccuggagcacagcccaguccca

SEQ ID NO: 4316 - RNA, 22 nt, Human
ccuggagcgcgggucaagcugg

SEQ ID NO: 4317 - RNA, 18 nt, Human
ccuggagcuccacagcaa

SEQ ID NO: 4318 - RNA, 22 nt, Human
ccuggagggacccuggcccugu

SEQ ID NO: 4319 - RNA, 22 nt, Human
ccuggagggcgccgcacagucc

SEQ ID NO: 4320 - RNA, 19 nt, Human
ccuggaggugaagguucuc

SEQ ID NO: 4321 - RNA, 22 nt, Human
ccuggaguugaaggaagguggg

SEQ ID NO: 4322 - RNA, 22 nt, Human
ccuggauagcuacuggccaggc

SEQ ID NO: 4323 - RNA, 22 nt, Human
ccuggaucagucacuguugcug

SEQ ID NO: 4324 - RNA, 22 nt, Human
ccuggauccaugaaaaggcuac

SEQ ID NO: 4325 - RNA, 22 nt, Human
ccuggaucccgauggcugugag

SEQ ID NO: 4326 - RNA, 22 nt, Human
ccuggauucaagucuuucuuuc

SEQ ID NO: 4327 - RNA, 22 nt, Human
ccuggauucucacuggacucca

SEQ ID NO: 4328 - RNA, 22 nt, Human
ccuggcaacauuucaaggucuu

SEQ ID NO: 4329 - RNA, 22 nt, Human
ccuggcaagugggcucccagau

SEQ ID NO: 4330 - RNA, 23 nt, Human
ccuggcacacaaggggugcugca

SEQ ID NO: 4331 - RNA, 22 nt, Human
ccuggcacacgguggcauucaa

SEQ ID NO: 4332 - RNA, 22 nt, Human
ccuggcacagagcgguggucac

SEQ ID NO: 4333 - RNA, 22 nt, Human
ccuggcacauaauaguggcuca

SEQ ID NO: 4334 - RNA, 22 nt, Human
ccuggcacauagugggcaugca

SEQ ID NO: 4335 - RNA, 22 nt, Human
ccuggcacaugcaguacucaag

SEQ ID NO: 4336 - RNA, 21 nt, Human
ccuggcagaagccugauaugc

SEQ ID NO: 4337 - RNA, 22 nt, Human
ccuggcagacugugagggcagg

SEQ ID NO: 4338 - RNA, 22 nt, Human
ccuggcagcccagagcgccgcu

SEQ ID NO: 4339 - RNA, 22 nt, Human
ccuggcagcgccgaagcuggcc

SEQ ID NO: 4340 - RNA, 22 nt, Human
ccuggcagguagcauugaggag

SEQ ID NO: 4341 - RNA, 22 nt, Human
ccuggcaguuuugcccaggauu

SEQ ID NO: 4342 - RNA, 20 nt, Human
ccuggccaaugagauaggaa

SEQ ID NO: 4343 - RNA, 22 nt, Human
ccuggccagccagggcuggggu

SEQ ID NO: 4344 - RNA, 22 nt, Human
ccuggccauagggcccaggaaa

SEQ ID NO: 4345 - RNA, 22 nt, Human
ccuggccauuugaacuucagac

SEQ ID NO: 4346 - RNA, 22 nt, Human
ccuggcccagggacuuucgccu

SEQ ID NO: 4347 - RNA, 22 nt, Human
ccuggcccuggaauagggcagg

SEQ ID NO: 4348 - RNA, 22 nt, Human
ccuggccgguaucccaccuccu

SEQ ID NO: 4349 - RNA, 22 nt, Human
ccuggccuccuggccuucucau

SEQ ID NO: 4350 - RNA, 22 nt, Human
ccuggccuggcacucccucugc

SEQ ID NO: 4351 - RNA, 22 nt, Human
ccuggccuuaagggcagggagc

SEQ ID NO: 4352 - RNA, 22 nt, Human
ccuggcuaggagagcugggcuc

SEQ ID NO: 4353 - RNA, 22 nt, Human
ccuggcucaaggcgaggacucc

SEQ ID NO: 4354 - RNA, 22 nt, Human
ccuggcucagaccccaguucug

SEQ ID NO: 4355 - RNA, 22 nt, Human
ccuggcucaggcacgcauggcu

SEQ ID NO: 4356 - RNA, 22 nt, Human
ccuuggcuuaccuucugugugg

SEQ ID NO: 4357 - RNA, 22 nt, Human
ccuuggcuuccuucccucuaga

SEQ ID NO: 4358 - RNA, 22 nt, Human
ccuugggacccugcuggagguu

SEQ ID NO: 4359 - RNA, 22 nt, Human
ccuugggcuugggcauagcuuu

SEQ ID NO: 4360 - RNA, 22 nt, Human
ccuuggguuccaagucacugaa

SEQ ID NO: 4361 - RNA, 22 nt, Human
ccuuggugcucugcugggaugg

SEQ ID NO: 4362 - RNA, 22 nt, Human
ccuugguuuccaggaugaggcu

SEQ ID NO: 4363 - RNA, 23 nt, Human
ccuugucuggcuggcuggacuuu

SEQ ID NO: 4364 - RNA, 22 nt, Human
ccuuguuucucucccagauaag

SEQ ID NO: 4365 - RNA, 22 nt, Human
ccuuuaauuuacaauguuaauu

SEQ ID NO: 4366 - RNA, 22 nt, Human
ccuuuacaguaugguuguauca

SEQ ID NO: 4367 - RNA, 20 nt, Human
ccuuuagaaacucauaugua

SEQ ID NO: 4368 - RNA, 22 nt, Human
ccuuuagaaagucaguaguugc

SEQ ID NO: 4369 - RNA, 20 nt, Human
ccuuuauuauuuguaugaug

SEQ ID NO: 4370 - RNA, 22 nt, Human
ccuuucagguacaccagggaug

SEQ ID NO: 4371 - RNA, 22 nt, Human
ccuuuccccgcgggaggugcca

SEQ ID NO: 4372 - RNA, 18 nt, Human
ccuuuccuccccucagcu

SEQ ID NO: 4373 - RNA, 22 nt, Human
ccuuucuaagauacugcaacuu

SEQ ID NO: 4374 - RNA, 22 nt, Human
ccuuucucauuuuaagcauuag

SEQ ID NO: 4375 - RNA, 22 nt, Human
ccuuucucuggcagcaggacag

SEQ ID NO: 4376 - RNA, 22 nt, Human
ccuuucuguguugcccuauuug

SEQ ID NO: 4377 - RNA, 22 nt, Human
ccuuucuuuuauccaccagcca

SEQ ID NO: 4378 - RNA, 22 nt, Human
ccuuugagccugggcgcggacc

SEQ ID NO: 4379 - RNA, 22 nt, Human
ccuuugcauucuagauguuuag

SEQ ID NO: 4380 - RNA, 22 nt, Human
ccuuugccaugacauggcacaa

SEQ ID NO: 4381 - RNA, 22 nt, Human
ccuuugggguccugccugggcu

SEQ ID NO: 4382 - RNA, 22 nt, Human
ccuuuggugguuuucagagauc

SEQ ID NO: 4383 - RNA, 22 nt, Human
ccuuuguaagaugugaagacug

SEQ ID NO: 4384 - RNA, 22 nt, Human
ccuuuguauuuaccuagucuca

SEQ ID NO: 4385 - RNA, 22 nt, Human
ccuuugugagguccuguggggg

SEQ ID NO: 4386 - RNA, 22 nt, Human
ccuuuuauaaaguuguauugaa

SEQ ID NO: 4387 - RNA, 22 nt, Human
ccuuuucuaaucuuaagaaugu

SEQ ID NO: 4388 - RNA, 22 nt, Human
ccuuuucugaaccacuuaaaua

SEQ ID NO: 4389 - RNA, 22 nt, Human
ccuuuugaggcuugggcucaga

SEQ ID NO: 4390 - RNA, 22 nt, Human
ccuuuugcucucccauccagaa

SEQ ID NO: 4391 - RNA, 22 nt, Human
ccuuuuucugaguuguagcuuc

SEQ ID NO: 4392 - RNA, 22 nt, Human
ccuuuuuucuaugccaacucug

SEQ ID NO: 4393 - RNA, 17 nt, Human
cguggcugagccauaga

SEQ ID NO: 4394 - RNA, 22 nt, Human
cguggcuggggaggucagccag

SEQ ID NO: 4395 - RNA, 22 nt, Human
cguggcugguggaccugagggc

SEQ ID NO: 4396 - RNA, 22 nt, Human
cgugggaggaaaaaugggcuuc

SEQ ID NO: 4397 - RNA, 22 nt, Human
cguguaaccccugaacucgcau

SEQ ID NO: 4398 - RNA, 22 nt, Human
cgugugcgugcauaugcacaag

SEQ ID NO: 4399 - RNA, 22 nt, Human
cguguuucagccagggccaccu

SEQ ID NO: 4400 - RNA, 17 nt, Human
cguuagugauuccugcc

SEQ ID NO: 4401 - RNA, 22 nt, Human
cguucucucaugaucuucccga

SEQ ID NO: 4402 - RNA, 22 nt, Human
cguuuacuguguaccaggcacu

SEQ ID NO: 4403 - RNA, 22 nt, Human
cguuuucauggguagagguucu

SEQ ID NO: 4404 - RNA, 22 nt, Human
cuaaaaacucuacgaugcacag

SEQ ID NO: 4405 - RNA, 22 nt, Human
cuaaaauuaucaagauaauucc

SEQ ID NO: 4406 - RNA, 22 nt, Human
cuaaacaagauacuaaugaggu

SEQ ID NO: 4407 - RNA, 22 nt, Human
cuaaacaaugaacaaagcacug

SEQ ID NO: 4408 - RNA, 22 nt, Human
cuaaacaggaaggagcaccuga

SEQ ID NO: 4409 - RNA, 22 nt, Human
cuaaacaugcaagagcuucugg

SEQ ID NO: 4410 - RNA, 22 nt, Human
cuaaaggcuaggucugaacuca

SEQ ID NO: 4411 - RNA, 22 nt, Human
cuaaagugccaggaauacaggu

SEQ ID NO: 4412 - RNA, 17 nt, Human
cuaaauacuugcguuuc

SEQ ID NO: 4413 - RNA, 22 nt, Human
cuaaaucaucauuuauguuugu

SEQ ID NO: 4414 - RNA, 22 nt, Human
cuaaaugauggauuuaaacuuu

SEQ ID NO: 4415 - RNA, 22 nt, Human
cuaaaugucagaguagcuugca

SEQ ID NO: 4416 - RNA, 22 nt, Human
cuaaaugugacucaccaucuca

SEQ ID NO: 4417 - RNA, 22 nt, Human
cuaaccugcauggcagcuagaa

SEQ ID NO: 4418 - RNA, 22 nt, Human
cuaacgaauauguaugcauguu

SEQ ID NO: 4419 - RNA, 20 nt, Human
cuaacuaaccacuuucugau

SEQ ID NO: 4420 - RNA, 22 nt, Human
cuaacuacaagcggggcauccu

SEQ ID NO: 4421 - RNA, 22 nt, Human
cuaagaaauguugugaaugcca

SEQ ID NO: 4422 - RNA, 22 nt, Human
cuaagaaggaggaaaagugcca

SEQ ID NO: 4423 - RNA, 22 nt, Human
cuaagcaagaaugagugcaaca

SEQ ID NO: 4424 - RNA, 22 nt, Human
cuaagcuuuucaaaaacauguu

SEQ ID NO: 4425 - RNA, 22 nt, Human
cuaaggaaaggaaauacaguaa

SEQ ID NO: 4426 - RNA, 22 nt, Human
cuaaggaauucaaauaguuagu

SEQ ID NO: 4427 - RNA, 19 nt, Human
cuaaggcaagaaacuggac

SEQ ID NO: 4428 - RNA, 22 nt, Human
cuaaggcagacagaauauuugg

SEQ ID NO: 4429 - RNA, 22 nt, Human
cuaaggguugaaacagcaagaa

SEQ ID NO: 4430 - RNA, 22 nt, Human
cuaauagauaccacauuggaca

SEQ ID NO: 4431 - RNA, 20 nt, Human
cuaauauucuacucuaagga

SEQ ID NO: 4432 - RNA, 22 nt, Human
cuaauauuuuuagaaaucacga

SEQ ID NO: 4433 - RNA, 22 nt, Human
cuaaucaucuuucucuuaaagc

SEQ ID NO: 4434 - RNA, 22 nt, Human
cuaauguaaaacagacuugcau

SEQ ID NO: 4435 - RNA, 22 nt, Human
cuaauguaucauggcucucagc

SEQ ID NO: 4436 - RNA, 22 nt, Human
cuacaaagaaagcugaggggaa

SEQ ID NO: 4437 - RNA, 22 nt, Human
cuacaaauccacaaggcacuuu

SEQ ID NO: 4438 - RNA, 22 nt, Human
cuacaacauagucuucuacaga

SEQ ID NO: 4439 - RNA, 22 nt, Human
cuacaacauuaugcuuucuguc

SEQ ID NO: 4440 - RNA, 22 nt, Human
cuacacuagaguugcaauggaa

SEQ ID NO: 4441 - RNA, 22 nt, Human
cuacagaagaaacuaucacuau

SEQ ID NO: 4442 - RNA, 22 nt, Human
cuacagaaggagaaauggguaa

SEQ ID NO: 4443 - RNA, 22 nt, Human
cuacagaauucaacaaaugguu

SEQ ID NO: 4444 - RNA, 22 nt, Human
cuacagacccaccuuggaagaa

SEQ ID NO: 4445 - RNA, 22 nt, Human
cuacagagaacucagcugcccu

SEQ ID NO: 4446 - RNA, 22 nt, Human
cuacagagaauugugugauuuu

SEQ ID NO: 4447 - RNA, 22 nt, Human
cuacagaggacacaaagaucuu

SEQ ID NO: 4448 - RNA, 21 nt, Human
cuacagaggagagggaaaggc

SEQ ID NO: 4449 - RNA, 22 nt, Human
cuacagaguaucuaaagaggua

SEQ ID NO: 4450 - RNA, 22 nt, Human
cuacagcagagaccagccacau

SEQ ID NO: 4451 - RNA, 22 nt, Human
cuacagcagagcuacacuaacu

SEQ ID NO: 4452 - RNA, 22 nt, Human
cuacagccagaugcagaaaguu

SEQ ID NO: 4453 - RNA, 22 nt, Human
cuacagcuguaaaaggaauguc

SEQ ID NO: 4454 - RNA, 22 nt, Human
cuacagcuguguguuuaugugc

SEQ ID NO: 4455 - RNA, 22 nt, Human
cuacaggucaguaagaccuaga

SEQ ID NO: 4456 - RNA, 22 nt, Human
cuacagugaagacuagcuauag

SEQ ID NO: 4457 - RNA, 22 nt, Human
cuacauacuguguguaaagaau

SEQ ID NO: 4458 - RNA, 22 nt, Human
cuacaucucaccuuccaggaca

SEQ ID NO: 4459 - RNA, 22 nt, Human
cuacauucugggaaaucagaug

SEQ ID NO: 4460 - RNA, 22 nt, Human
cuacauuuacacaguuaggcuu

SEQ ID NO: 4461 - RNA, 22 nt, Human
cuacauuuugugauuaugaaau

SEQ ID NO: 4462 - RNA, 22 nt, Human
cuacccagagugaaucucuuaa

SEQ ID NO: 4463 - RNA, 21 nt, Human
cuacccucuccugcucauauc

SEQ ID NO: 4464 - RNA, 22 nt, Human
cuaccuaauaauuugauauuca

SEQ ID NO: 4465 - RNA, 22 nt, Human
cuaccuucaaguuccucccucu

SEQ ID NO: 4466 - RNA, 22 nt, Human
cuaccuuucugacucuugggau

SEQ ID NO: 4467 - RNA, 22 nt, Human
cuacuagaucaguaugccucaa

SEQ ID NO: 4468 - RNA, 22 nt, Human
cuacugaaacucagaaauucaa

SEQ ID NO: 4469 - RNA, 22 nt, Human
cuacugaugauguugguugugg

SEQ ID NO: 4470 - RNA, 23 nt, Human
cuacugccuugcacaggcuagau

SEQ ID NO: 4471 - RNA, 22 nt, Human
cuacuguaguuaaaguuuugua

SEQ ID NO: 4472 - RNA, 22 nt, Human
cuacugucucaucaguguuauu

SEQ ID NO: 4473 - RNA, 22 nt, Human
cuacugucuuccuugguaacaa

SEQ ID NO: 4474 - RNA, 22 nt, Human
ccuggcucaguguugaaggggu

SEQ ID NO: 4475 - RNA, 22 nt, Human
ccuggcuccaaagcugugacuc

SEQ ID NO: 4476 - RNA, 22 nt, Human
ccuggcuccgugucacgugccc

SEQ ID NO: 4477 - RNA, 22 nt, Human
ccuggcuccugcacagaucuuu

SEQ ID NO: 4478 - RNA, 22 nt, Human
ccuggcucugggaucuucgcuu

SEQ ID NO: 4479 - RNA, 22 nt, Human
ccuggcucuguccucgcgcaaa

SEQ ID NO: 4480 - RNA, 22 nt, Human
ccuggcugacagcuuaauucca

SEQ ID NO: 4481 - RNA, 23 nt, Human
ccuggcugaccugaagguguagu

SEQ ID NO: 4482 - RNA, 22 nt, Human
ccuggcugcaguuuuugcagaa

SEQ ID NO: 4483 - RNA, 22 nt, Human
ccuggcugccgagugugcagcg

SEQ ID NO: 4484 - RNA, 22 nt, Human
ccuggcugcuauagcagcaugu

SEQ ID NO: 4485 - RNA, 22 nt, Human
ccuggcuggacuggaccguggc

SEQ ID NO: 4486 - RNA, 17 nt, Human
ccuggcugggaaucuga

SEQ ID NO: 4487 - RNA, 22 nt, Human
ccuggcugggccugauuucuca

SEQ ID NO: 4488 - RNA, 22 nt, Human
ccuggcugugcauguuucuaug

SEQ ID NO: 4489 - RNA, 22 nt, Human
ccuggcuguuuauuucggggcu

SEQ ID NO: 4490 - RNA, 22 nt, Human
ccuggcuucagcauugcccucu

SEQ ID NO: 4491 - RNA, 21 nt, Human
ccuggcuucagggugcacugg

SEQ ID NO: 4492 - RNA, 23 nt, Human
ccuggcuucauucucuuagggug

SEQ ID NO: 4493 - RNA, 22 nt, Human
ccuggcuuccuucaugaccugg

SEQ ID NO: 4494 - RNA, 22 nt, Human
ccuggcuucugggucugugaga

SEQ ID NO: 4495 - RNA, 22 nt, Human
ccuggcuuuagcugccuucccu

SEQ ID NO: 4496 - RNA, 22 nt, Human
ccuggcuuucucauuuacaggc

SEQ ID NO: 4497 - RNA, 20 nt, Human
ccuggcuuugcagcaugaga

SEQ ID NO: 4498 - RNA, 22 nt, Human
ccuggcuuuuguuuauaaauuc

SEQ ID NO: 4499 - RNA, 22 nt, Human
ccugggaaagugaggucauuau

SEQ ID NO: 4500 - RNA, 22 nt, Human
ccugggaaggucuuagcaucua

SEQ ID NO: 4501 - RNA, 22 nt, Human
ccugggaaucugcauugucagc

SEQ ID NO: 4502 - RNA, 19 nt, Human
gaggggaggaauugacaag

SEQ ID NO: 4503 - RNA, 22 nt, Human
gaggggaguguccuccgggccc

SEQ ID NO: 4504 - RNA, 22 nt, Human
gaggggauuggaaggaacaccc

SEQ ID NO: 4505 - RNA, 22 nt, Human
gaggggcaagaaguuggccucu

SEQ ID NO: 4506 - RNA, 21 nt, Human
gaggggcagcucuuagcauua

SEQ ID NO: 4507 - RNA, 22 nt, Human
gaggggcaguugauugugcuau

SEQ ID NO: 4508 - RNA, 22 nt, Human
gaggggccuggcgaggacaugu

SEQ ID NO: 4509 - RNA, 22 nt, Human
gaggggcguccugagugggccu

SEQ ID NO: 4510 - RNA, 22 nt, Human
gaggggcugggcagucccugga

SEQ ID NO: 4511 - RNA, 22 nt, Human
gaggggcugggguugacuccaa

SEQ ID NO: 4512 - RNA, 22 nt, Human
gagggggcuagcgcagugccca

SEQ ID NO: 4513 - RNA, 22 nt, Human
gaggggucacaugggcuggcuu

SEQ ID NO: 4514 - RNA, 22 nt, Human
gagggugcaggaggaugguagu

SEQ ID NO: 4515 - RNA, 22 nt, Human
gagggugcugugccaagaugac

SEQ ID NO: 4516 - RNA, 22 nt, Human
gagggugguggcuuaaggugcu

SEQ ID NO: 4517 - RNA, 22 nt, Human
gagggugucugcguaacuggca

SEQ ID NO: 4518 - RNA, 22 nt, Human
gagguaagggcaggagagugaa

SEQ ID NO: 4519 - RNA, 22 nt, Human
gagguagguguaggaggccugc

SEQ ID NO: 4520 - RNA, 22 nt, Human
gagguauguaugcuacauucuu

SEQ ID NO: 4521 - RNA, 22 nt, Human
gagguauuugauccucugcagu

SEQ ID NO: 4522 - RNA, 22 nt, Human
gagguauuuuugcaugccugau

SEQ ID NO: 4523 - RNA, 19 nt, Human
gaggucagcaagaaguauu

SEQ ID NO: 4524 - RNA, 22 nt, Human
gaggucaggcuugcagcagggu

SEQ ID NO: 4525 - RNA, 22 nt, Human
gaggucaugcaaaauugaauca

SEQ ID NO: 4526 - RNA, 22 nt, Human
gagguccagccaagcggcaagg

SEQ ID NO: 4527 - RNA, 18 nt, Human
gagguccugcucuagccc

SEQ ID NO: 4528 - RNA, 22 nt, Human
gaggucugagugcggaaagccu

SEQ ID NO: 4529 - RNA, 22 nt, Human
gaggucugggauggggccugaa

SEQ ID NO: 4530 - RNA, 22 nt, Human
gaggugaugguugcacaaugcu

SEQ ID NO: 4531 - RNA, 22 nt, Human
gagguggaggggaaaaauagau

SEQ ID NO: 4532 - RNA, 22 nt, Human
gagguggcaauuuaaugcaguc

SEQ ID NO: 4533 - RNA, 22 nt, Human
gagguggcacugugaggagcac

SEQ ID NO: 4534 - RNA, 22 nt, Human
gagguggcauuaagauucuggu

SEQ ID NO: 4535 - RNA, 18 nt, Human
gagguggcugggccaucu

SEQ ID NO: 4536 - RNA, 22 nt, Human
gagguggguguaucacagguca

SEQ ID NO: 4537 - RNA, 22 nt, Human
gagguggucgaggagggguacc

SEQ ID NO: 4538 - RNA, 22 nt, Human
gaggugguuuguggugacucau

SEQ ID NO: 4539 - RNA, 22 nt, Human
gaggugucaggguagucaugau

SEQ ID NO: 4540 - RNA, 22 nt, Human
gagguguccucagccaacucug

SEQ ID NO: 4541 - RNA, 22 nt, Human
gaggugugaggaaugaaugggg

SEQ ID NO: 4542 - RNA, 22 nt, Human
gaggugugcacagcgugcugac

SEQ ID NO: 4543 - RNA, 22 nt, Human
gaggugugguccucagccccca

SEQ ID NO: 4544 - RNA, 19 nt, Human
gagguucacgcgcuggaug

SEQ ID NO: 4545 - RNA, 22 nt, Human
gagguucaguaaggaauacuga

SEQ ID NO: 4546 - RNA, 22 nt, Human
gagguucaguccugcucuguca

SEQ ID NO: 4547 - RNA, 22 nt, Human
gagguucauucagcucugucac

SEQ ID NO: 4548 - RNA, 22 nt, Human
gagguuccagacagcuuaggga

SEQ ID NO: 4549 - RNA, 22 nt, Human
gagguuccccauuguacuggcu

SEQ ID NO: 4550 - RNA, 22 nt, Human
gagguucugggggucugccugg

SEQ ID NO: 4551 - RNA, 22 nt, Human
gagguugggaugagggauacag

SEQ ID NO: 4552 - RNA, 22 nt, Human
gagguuguuucaacaguagucu

SEQ ID NO: 4553 - RNA, 22 nt, Human
gagguuuuaaguugaaggggga

SEQ ID NO: 4554 - RNA, 22 nt, Human
gaguaaaauaggugagaaucaa

SEQ ID NO: 4555 - RNA, 22 nt, Human
gaguaacaaauacuucaguagu

SEQ ID NO: 4556 - RNA, 22 nt, Human
gaguaacaucuggaaccgacac

SEQ ID NO: 4557 - RNA, 22 nt, Human
gaguaauauucuguacuggagg

SEQ ID NO: 4558 - RNA, 22 nt, Human
gaguaauuagagcaaugacuuu

SEQ ID NO: 4559 - RNA, 22 nt, Human
gaguaauucugguaaaucauug

SEQ ID NO: 4560 - RNA, 22 nt, Human
gaguaauuuucuugauuucuua

SEQ ID NO: 4561 - RNA, 22 nt, Human
gaguacaucuuaauuugacuaa

SEQ ID NO: 4562 - RNA, 22 nt, Human
gaguacauguauagagauuaac

SEQ ID NO: 4563 - RNA, 22 nt, Human
gaguagaaaguaaaguacgaau

SEQ ID NO: 4564 - RNA, 22 nt, Human
gaguagaacuagaauucuucaa

SEQ ID NO: 4565 - RNA, 22 nt, Human
gaguagacauuaaauuacacug

SEQ ID NO: 4566 - RNA, 22 nt, Human
gaguagcagccacagaggaccc

SEQ ID NO: 4567 - RNA, 22 nt, Human
gaguaggguuuccagguuagag

SEQ ID NO: 4568 - RNA, 22 nt, Human
gaguaguugcugcagagaauac

SEQ ID NO: 4569 - RNA, 22 nt, Human
gaguauauauagacaugucaca

SEQ ID NO: 4570 - RNA, 20 nt, Human
gaguauauuucuuccuuugc

SEQ ID NO: 4571 - RNA, 22 nt, Human
gaguauuccucagucauuuugu

SEQ ID NO: 4572 - RNA, 22 nt, Human
gaguauuuauauguaaguaccu

SEQ ID NO: 4573 - RNA, 22 nt, Human
gagucacauacuauguaauaga

SEQ ID NO: 4574 - RNA, 22 nt, Human
gagucaccuuggccgcuguccc

SEQ ID NO: 4575 - RNA, 22 nt, Human
gagucagaaaguagugugccua

SEQ ID NO: 4576 - RNA, 22 nt, Human
gagucaggaguuaugcuccacc

SEQ ID NO: 4577 - RNA, 22 nt, Human
gagucagguccguggacaguua

SEQ ID NO: 4578 - RNA, 22 nt, Human
gagucauuguuggucccucccc

SEQ ID NO: 4579 - RNA, 22 nt, Human
gaguccaggcuguugcucaucu

SEQ ID NO: 4580 - RNA, 20 nt, Human
gaguccaggggccuguagca

SEQ ID NO: 4581 - RNA, 22 nt, Human
gaguccaguaguuaggacagag

SEQ ID NO: 4582 - RNA, 22 nt, Human
gaguccaguucuuuccagcagu

SEQ ID NO: 4583 - RNA, 22 nt, Human
gagucccaggaaugagcauagu

SEQ ID NO: 4584 - RNA, 22 nt, Human
gagucccaggauaugugcuguu

SEQ ID NO: 4585 - RNA, 22 nt, Human
gaguccucaacggggagaggcg

SEQ ID NO: 4586 - RNA, 22 nt, Human
gaguccugcccuuguguagucc

SEQ ID NO: 4587 - RNA, 22 nt, Human
ccuguucuguagugaguuugag

SEQ ID NO: 4588 - RNA, 22 nt, Human
ccuguuguuuagcacuuagaac

SEQ ID NO: 4589 - RNA, 22 nt, Human
ccuguuuauccaugccaauccu

SEQ ID NO: 4590 - RNA, 22 nt, Human
ccuguuuaucuaucuagagaug

SEQ ID NO: 4591 - RNA, 22 nt, Human
ccuguuugguacaaucugccaa

SEQ ID NO: 4592 - RNA, 22 nt, Human
ccuuaaauucuccauuugaaag

SEQ ID NO: 4593 - RNA, 22 nt, Human
ccuuacaccuaaaaugagaguu

SEQ ID NO: 4594 - RNA, 22 nt, Human
ccuuagagaguacugggcugcc

SEQ ID NO: 4595 - RNA, 22 nt, Human
ccuuagcaaauuggcaucuucu

SEQ ID NO: 4596 - RNA, 22 nt, Human
ccuuagcaacugucauagagca

SEQ ID NO: 4597 - RNA, 17 nt, Human
ccuuagggcaguguggu

SEQ ID NO: 4598 - RNA, 22 nt, Human
ccuuagugaaacagaggcaauu

SEQ ID NO: 4599 - RNA, 22 nt, Human
ccuucaaauucucuuagcugaa

SEQ ID NO: 4600 - RNA, 22 nt, Human
ccuucaaauuuagaacaaguga

SEQ ID NO: 4601 - RNA, 22 nt, Human
ccuucaaucagcagucuagcuu

SEQ ID NO: 4602 - RNA, 22 nt, Human
ccuucagaaugaaauucuaaug

SEQ ID NO: 4603 - RNA, 22 nt, Human
ccuucagucccauguuucucuu

SEQ ID NO: 4604 - RNA, 22 nt, Human
ccuucaugucauuggacaccuu

SEQ ID NO: 4605 - RNA, 22 nt, Human
ccuucauugcaucuuuaagaga

SEQ ID NO: 4606 - RNA, 22 nt, Human
ccuuccaaaggagccacaucug

SEQ ID NO: 4607 - RNA, 22 nt, Human
ccuuccaagugcugcuuuuucc

SEQ ID NO: 4608 - RNA, 22 nt, Human
ccuuccagauguaagagcugau

SEQ ID NO: 4609 - RNA, 22 nt, Human
ccuuccagggagcaggcagugu

SEQ ID NO: 4610 - RNA, 22 nt, Human
ccuuccaguauguuaagauggu

SEQ ID NO: 4611 - RNA, 21 nt, Human
ccugugugucugacugggcua

SEQ ID NO: 4612 - RNA, 22 nt, Human
ccuguguuuagauaugaugcug

SEQ ID NO: 4613 - RNA, 22 nt, Human
ccuguucacugcacaguuuccg

SEQ ID NO: 4614 - RNA, 22 nt, Human
ccuguucagagcuaagcaucau

SEQ ID NO: 4615 - RNA, 22 nt, Human
ccuguucauuuuuugacucugc

SEQ ID NO: 4616 - RNA, 22 nt, Human
ccuguucuguggcucucaaagg

SEQ ID NO: 4617 - RNA, 22 nt, Human
ccuguucuguuaauuaaacuuu

SEQ ID NO: 4618 - RNA, 19 nt, Human
ccuguucuuggcugaggcu

SEQ ID NO: 4619 - RNA, 23 nt, Human
ccuguugggacagcuuuaccaga

SEQ ID NO: 4620 - RNA, 22 nt, Human
ccuguugucucuuccuguugac

SEQ ID NO: 4621 - RNA, 22 nt, Human
ccuguuuacaucaucaaggacu

SEQ ID NO: 4622 - RNA, 22 nt, Human
ccuguuuauugugaagaaccca

SEQ ID NO: 4623 - RNA, 23 nt, Human
ccuuaaauaucuacccuguggca

SEQ ID NO: 4624 - RNA, 22 nt, Human
ccuuacacugccuggggccacg

SEQ ID NO: 4625 - RNA, 22 nt, Human
ccuuaccugauugcuggcaucc

SEQ ID NO: 4626 - RNA, 22 nt, Human
ccuuagacuggagcuaugccgu

SEQ ID NO: 4627 - RNA, 22 nt, Human
ccuuagaggcaggaagaauugc

SEQ ID NO: 4628 - RNA, 22 nt, Human
ccuuagaucaggcugucuaggg

SEQ ID NO: 4629 - RNA, 22 nt, Human
ccuuagcaacacuuagcaacug

SEQ ID NO: 4630 - RNA, 22 nt, Human
ccuuaggggugacagaaauacc

SEQ ID NO: 4631 - RNA, 21 nt, Human
ccuuagucuuccacauagucc

SEQ ID NO: 4632 - RNA, 22 nt, Human
ccuuagugugaggggauacccc

SEQ ID NO: 4633 - RNA, 22 nt, Human
ccuuagugugccugaggcagau

SEQ ID NO: 4634 - RNA, 22 nt, Human
ccuuaucacaauggagugucac

SEQ ID NO: 4635 - RNA, 22 nt, Human
ccuucaaaacacuaguuuuuga

SEQ ID NO: 4636 - RNA, 22 nt, Human
ccuucaaacuuucauuaaccag

SEQ ID NO: 4637 - RNA, 22 nt, Human
ccuucaaagaguauuuccugag

SEQ ID NO: 4638 - RNA, 22 nt, Human
ccuucaaaguacacaucuuuau

SEQ ID NO: 4639 - RNA, 22 nt, Human
ccuucaaggcaaggagggcugg

SEQ ID NO: 4640 - RNA, 22 nt, Human
ccuucacacagguagaagcaga

SEQ ID NO: 4641 - RNA, 22 nt, Human
ccuucagaccuagacaggaauc

SEQ ID NO: 4642 - RNA, 22 nt, Human
ccuucagagguguagauugcgu

SEQ ID NO: 4643 - RNA, 22 nt, Human
ccuucagccaguuuucuuuguu

SEQ ID NO: 4644 - RNA, 22 nt, Human
ccuucauucauuaauuuagccc

SEQ ID NO: 4645 - RNA, 22 nt, Human
ccuuccaagugcuugccgcuuu

SEQ ID NO: 4646 - RNA, 22 nt, Human
ccuuccagaggcgugacacccu

SEQ ID NO: 4647 - RNA, 19 nt, Human
ccuuccagcuccuuuucag

SEQ ID NO: 4648 - RNA, 22 nt, Human
ccuuccaggugcaggcaagccu

SEQ ID NO: 4649 - RNA, 22 nt, Human
ccuuccagguuuuggcuccauu

SEQ ID NO: 4650 - RNA, 22 nt, Human
ccuuccucauccauuucucuug

SEQ ID NO: 4651 - RNA, 17 nt, Human
ccuuccucaucuccuuc

SEQ ID NO: 4652 - RNA, 19 nt, Human
ccuuccuccccagggccau

SEQ ID NO: 4653 - RNA, 22 nt, Human
ccuuccuggcuguccgccugau

SEQ ID NO: 4654 - RNA, 21 nt, Human
ccuucuccacagggucuccgg

SEQ ID NO: 4655 - RNA, 22 nt, Human
ccuucucccucugagaggaacc

SEQ ID NO: 4656 - RNA, 22 nt, Human
ccuucucucugaagaccccaaa

SEQ ID NO: 4657 - RNA, 22 nt, Human
ccuucucugcagguaguuggcu

SEQ ID NO: 4658 - RNA, 22 nt, Human
ccuucugauacugacaucauuu

SEQ ID NO: 4659 - RNA, 22 nt, Human
ccuucuuaaacaucauuuuggc

SEQ ID NO: 4660 - RNA, 22 nt, Human
ccuugaaagccaggcagaggaa

SEQ ID NO: 4661 - RNA, 22 nt, Human
ccuugcaggggaacaggcagug

SEQ ID NO: 4662 - RNA, 22 nt, Human
ccuugcauauauuauaucuuug

SEQ ID NO: 4663 - RNA, 20 nt, Human
ccuugccaguagggcuggga

SEQ ID NO: 4664 - RNA, 22 nt, Human
ccuugcucaagcuagugacggg

SEQ ID NO: 4665 - RNA, 22 nt, Human
ccuugcucaucccccagugccu

SEQ ID NO: 4666 - RNA, 22 nt, Human
ccuuggagaagacagugccagg

SEQ ID NO: 4667 - RNA, 22 nt, Human
ccuuggaggacugcugcuucuu

SEQ ID NO: 4668 - RNA, 19 nt, Human
ccuuggaguuccaggugga

SEQ ID NO: 4669 - RNA, 22 nt, Human
ccuuggcaggcacguccugcgg

SEQ ID NO: 4670 - RNA, 22 nt, Human
ccuuggcccuagccucaggcaa

SEQ ID NO: 4671 - RNA, 22 nt, Human
ccuuggcuggaauuacucuggg

SEQ ID NO: 4672 - RNA, 21 nt, Human
ccuuggcuggcaucuagcacc

SEQ ID NO: 4673 - RNA, 22 nt, Human
ccuuggcuguguugccugcccu

SEQ ID NO: 4674 - RNA, 22 nt, Human
ccuuggcuugcacacggccacc

SEQ ID NO: 4675 - RNA, 21 nt, Human
ccuugggaugcaagugagacu

SEQ ID NO: 4676 - RNA, 22 nt, Human
ccuugggauuucucaugccaau

SEQ ID NO: 4677 - RNA, 22 nt, Human
ccuuggggaacuggacgugcug

SEQ ID NO: 4678 - RNA, 22 nt, Human
ccuuggggaauauccauucuuc

SEQ ID NO: 4679 - RNA, 22 nt, Human
ccuuguccucugguuuccuguu

SEQ ID NO: 4680 - RNA, 22 nt, Human
ccuugugcagguucaugauggg

SEQ ID NO: 4681 - RNA, 22 nt, Human
ccuuguguuuacaccugucuuu

SEQ ID NO: 4682 - RNA, 22 nt, Human
ccuuuacaguagcccuuuugaa

SEQ ID NO: 4683 - RNA, 22 nt, Human
ccuuuagaauucugccccuccu

SEQ ID NO: 4684 - RNA, 22 nt, Human
ccuuuagagcaaacgccaccua

SEQ ID NO: 4685 - RNA, 22 nt, Human
ccuuuagaugaucucuuggaca

SEQ ID NO: 4686 - RNA, 22 nt, Human
ccuuucaaaacagaacacuagc

SEQ ID NO: 4687 - RNA, 22 nt, Human
ccuuucaaauuacaugacugcu

SEQ ID NO: 4688 - RNA, 22 nt, Human
ccuuucccgcuuugagggcaag

SEQ ID NO: 4689 - RNA, 22 nt, Human
ccuuuccuguguccuuuuaagg

SEQ ID NO: 4690 - RNA, 22 nt, Human
ccuuuccuuuuuagugugggag

SEQ ID NO: 4691 - RNA, 22 nt, Human
ccuuucuacagaugccucuugc

SEQ ID NO: 4692 - RNA, 16 nt, Human
ccuuucucugccuucc

SEQ ID NO: 4693 - RNA, 22 nt, Human
ccuuucucuuugcugaucaugu

SEQ ID NO: 4694 - RNA, 20 nt, Human
ccuuucuggagugcuguuca

SEQ ID NO: 4695 - RNA, 21 nt, Human
ccuuugaguguguuugaagua

SEQ ID NO: 4696 - RNA, 22 nt, Human
ccuuugcauuauccuugauuga

SEQ ID NO: 4697 - RNA, 22 nt, Human
ccuuugcauuuauguguccauu

SEQ ID NO: 4698 - RNA, 22 nt, Human
ccuuuggagaguuuguuagggg

SEQ ID NO: 4699 - RNA, 22 nt, Human
ccuuuggcauuuugaggaugcg

SEQ ID NO: 4700 - RNA, 22 nt, Human
ccuuugggugaauuccucucuu

SEQ ID NO: 4701 - RNA, 22 nt, Human
ccuuuggguucaaucucggucu

SEQ ID NO: 4702 - RNA, 22 nt, Human
ccuuuggucaccuccacucuua

SEQ ID NO: 4703 - RNA, 19 nt, Human
ccuuugguuuccaugacau

SEQ ID NO: 4704 - RNA, 22 nt, Human
ccuuuguauacaguucuuguga

SEQ ID NO: 4705 - RNA, 19 nt, Human
cgcacagccugccaggcgc

SEQ ID NO: 4706 - RNA, 22 nt, Human
cgcacuggagcuggaacgaguc

SEQ ID NO: 4707 - RNA, 22 nt, Human
cgcagaagagguugucuagucc

SEQ ID NO: 4708 - RNA, 21 nt, Human
cgcagagcgaacuugcggcgc

SEQ ID NO: 4709 - RNA, 19 nt, Human
cgcagagggcuucugagag

SEQ ID NO: 4710 - RNA, 22 nt, Human
cgcagcugcacggggcugagcc

SEQ ID NO: 4711 - RNA, 22 nt, Human
cgcagcugcugcucugaaacag

SEQ ID NO: 4712 - RNA, 22 nt, Human
cgcagcuguccauguguggggg

SEQ ID NO: 4713 - RNA, 22 nt, Human
cgcaggaagacaaggguggaaa

SEQ ID NO: 4714 - RNA, 22 nt, Human
cgcaggcaagagaguacaguua

SEQ ID NO: 4715 - RNA, 22 nt, Human
cgcagggauuucaaggggccuu

SEQ ID NO: 4716 - RNA, 22 nt, Human
cgcaggugaacuguucugcagu

SEQ ID NO: 4717 - RNA, 19 nt, Human
cgcagguggaaggagccgc

SEQ ID NO: 4718 - RNA, 22 nt, Human
cgcaggugggcccuucauugau

SEQ ID NO: 4719 - RNA, 22 nt, Human
cgccaguauguggcugucuuug

SEQ ID NO: 4720 - RNA, 22 nt, Human
cucagcuacgcuuucaccagcu

SEQ ID NO: 4721 - RNA, 22 nt, Human
cucagcucacucuuuugugcuu

SEQ ID NO: 4722 - RNA, 22 nt, Human
cucagcucugacaggaggcauc

SEQ ID NO: 4723 - RNA, 22 nt, Human
cucagcucuuuauacuagcugu

SEQ ID NO: 4724 - RNA, 22 nt, Human
cucagcugucucaugggucugu

SEQ ID NO: 4725 - RNA, 22 nt, Human
cucaggaaaauauugaagaagu

SEQ ID NO: 4726 - RNA, 22 nt, Human
cucaggaaaggccaugcaaggg

SEQ ID NO: 4727 - RNA, 22 nt, Human
cucaggacagauuccagagaaa

SEQ ID NO: 4728 - RNA, 22 nt, Human
cucaggacccaccuuauuagga

SEQ ID NO: 4729 - RNA, 22 nt, Human
cuccuuaaguaugggcugugca

SEQ ID NO: 4730 - RNA, 22 nt, Human
cuccuucaaaagucauaguaaa

SEQ ID NO: 4731 - RNA, 22 nt, Human
cuccuucagcugaaucccugcu

SEQ ID NO: 4732 - RNA, 22 nt, Human
cuccuuccaacaagagaaagag

SEQ ID NO: 4733 - RNA, 22 nt, Human
cuccuucuccucgggaggccag

SEQ ID NO: 4734 - RNA, 22 nt, Human
cuccuucugaggcucuggguuc

SEQ ID NO: 4735 - RNA, 22 nt, Human
cuccuuugaucccaaaugaccc

SEQ ID NO: 4736 - RNA, 22 nt, Human
cucgcaagucgcuccgguuacu

SEQ ID NO: 4737 - RNA, 22 nt, Human
cucgccccggcacaguguccgu

SEQ ID NO: 4738 - RNA, 22 nt, Human
cucuaauacugaccaagucacc

SEQ ID NO: 4739 - RNA, 21 nt, Human
cucuacauucccagcaacucu

SEQ ID NO: 4740 - RNA, 22 nt, Human
cucuacucuuaacacagcuagg

SEQ ID NO: 4741 - RNA, 22 nt, Human
cucuagaaagauuguugaccaa

SEQ ID NO: 4742 - RNA, 22 nt, Human
cucuagaguacgggcuggcaug

SEQ ID NO: 4743 - RNA, 22 nt, Human
cucuaggggcuggucagcgucu

SEQ ID NO: 4744 - RNA, 22 nt, Human
cucucaaauguaauuugagguu

SEQ ID NO: 4745 - RNA, 19 nt, Human
cucucacucgccacauccu

SEQ ID NO: 4746 - RNA, 22 nt, Human
cucucagaaguuuaugucagaa

SEQ ID NO: 4747 - RNA, 19 nt, Human
cucucagccugucuccuug

SEQ ID NO: 4748 - RNA, 22 nt, Human
cucucaggcuugggucguggca

SEQ ID NO: 4749 - RNA, 22 nt, Human
cucucagggacccagccagccu

SEQ ID NO: 4750 - RNA, 22 nt, Human
cucucagggucccugcggagga

SEQ ID NO: 4751 - RNA, 22 nt, Human
cucucaugagcauuccuaaggg

SEQ ID NO: 4752 - RNA, 19 nt, Human
cucuccaccuaacagguau

SEQ ID NO: 4753 - RNA, 22 nt, Human
cucuccacucagcgucaugucc

SEQ ID NO: 4754 - RNA, 22 nt, Human
cucuccacuguccuuugcuggu

SEQ ID NO: 4755 - RNA, 22 nt, Human
cucuccaggacuuuggcccaau

SEQ ID NO: 4756 - RNA, 22 nt, Human
cucuccaggggaacauuguucc

SEQ ID NO: 4757 - RNA, 21 nt, Human
cucuccagugguuccugauuc

SEQ ID NO: 4758 - RNA, 22 nt, Human
cucuccauucccuacaguuuuc

SEQ ID NO: 4759 - RNA, 20 nt, Human
cucucccagcacagcuuccu

SEQ ID NO: 4760 - RNA, 22 nt, Human
cucuccccacacccucugcaug

SEQ ID NO: 4761 - RNA, 22 nt, Human
cucucccuagguuagcggucag

SEQ ID NO: 4762 - RNA, 22 nt, Human
cucucccucauuggguuccauu

SEQ ID NO: 4763 - RNA, 22 nt, Human
cucuccuccaacagcccugccg

SEQ ID NO: 4764 - RNA, 22 nt, Human
cucuccugggcugaccguccga

SEQ ID NO: 4765 - RNA, 22 nt, Human
cucuccuuucacuaaauauucu

SEQ ID NO: 4766 - RNA, 22 nt, Human
cucucuccuuagcugcagacca

SEQ ID NO: 4767 - RNA, 20 nt, Human
cucucucuccauucccaggg

SEQ ID NO: 4768 - RNA, 22 nt, Human
cucucugaugucaggucgcuga

SEQ ID NO: 4769 - RNA, 22 nt, Human
cucucuggcacuucauugcugu

SEQ ID NO: 4770 - RNA, 22 nt, Human
cucucugggggccaugccaaga

SEQ ID NO: 4771 - RNA, 22 nt, Human
cucucugggguuccagacgugg

SEQ ID NO: 4772 - RNA, 22 nt, Human
cucucugguuucagcgaagggg

SEQ ID NO: 4773 - RNA, 22 nt, Human
cucucugugguggcugucccau

SEQ ID NO: 4774 - RNA, 22 nt, Human
cucucuuucugaaugaggacua

SEQ ID NO: 4775 - RNA, 22 nt, Human
cucucuuugauguauaaauaau

SEQ ID NO: 4776 - RNA, 22 nt, Human
cucugaaagacaagcucucauu

SEQ ID NO: 4777 - RNA, 22 nt, Human
cucugaagguuucuguuacugu

SEQ ID NO: 4778 - RNA, 22 nt, Human
cucugacagccacauagaggcu

SEQ ID NO: 4779 - RNA, 22 nt, Human
cucugacagccuucauuaugca

SEQ ID NO: 4780 - RNA, 22 nt, Human
cucugaccauucccuugauuuu

SEQ ID NO: 4781 - RNA, 22 nt, Human
cucugagacuuagcaucuacau

SEQ ID NO: 4782 - RNA, 22 nt, Human
cucugagaggauccugcccggg

SEQ ID NO: 4783 - RNA, 22 nt, Human
cucugagaggcugcccugccau

SEQ ID NO: 4784 - RNA, 22 nt, Human
cucugagaugauaccuucugga

SEQ ID NO: 4785 - RNA, 22 nt, Human
cucugagcagcggugccgaagu

SEQ ID NO: 4786 - RNA, 22 nt, Human
cucugaggaagucaaguagcca

SEQ ID NO: 4787 - RNA, 22 nt, Human
cucugaggcuuguucuauguau

SEQ ID NO: 4788 - RNA, 22 nt, Human
cucugagggcucgagggacgcg

SEQ ID NO: 4789 - RNA, 20 nt, Human
cucugagguaucuguaaagu

SEQ ID NO: 4790 - RNA, 22 nt, Human
cucugagguccuacagugaccc

SEQ ID NO: 4791 - RNA, 22 nt, Human
cucugagguucccuggguccca

SEQ ID NO: 4792 - RNA, 22 nt, Human
cucugauuuccuuauucuguca

SEQ ID NO: 4793 - RNA, 22 nt, Human
cucugcaaucugagcacuugua

SEQ ID NO: 4794 - RNA, 22 nt, Human
cucugcacacaaguaauuucau

SEQ ID NO: 4795 - RNA, 23 nt, Human
cucugcaccaggugguuuucagc

SEQ ID NO: 4796 - RNA, 22 nt, Human
cucugcaccuacacaacaggaa

SEQ ID NO: 4797 - RNA, 22 nt, Human
cucugcaggccugugaagggug

SEQ ID NO: 4798 - RNA, 22 nt, Human
cucugcaucagcuucauucugu

SEQ ID NO: 4799 - RNA, 22 nt, Human
cucugcauuuuaacagaugauu

SEQ ID NO: 4800 - RNA, 22 nt, Human
cucugccacucgaagucaagga

SEQ ID NO: 4801 - RNA, 22 nt, Human
cucugccaucuuggagcucaag

SEQ ID NO: 4802 - RNA, 22 nt, Human
cucugccauuuaucagaacugu

SEQ ID NO: 4803 - RNA, 22 nt, Human
cucugccucagugauuucuuua

SEQ ID NO: 4804 - RNA, 22 nt, Human
cucugccugugucgccaccaca

SEQ ID NO: 4805 - RNA, 22 nt, Human
cucugcguggcugggcccaggg

SEQ ID NO: 4806 - RNA, 22 nt, Human
cucugcugagccagagucccca

SEQ ID NO: 4807 - RNA, 21 nt, Human
cucugcugagcuccauuuuca

SEQ ID NO: 4808 - RNA, 22 nt, Human
cucugcugccaccagaaccacu

SEQ ID NO: 4809 - RNA, 20 nt, Human
cucugcugcccgccggcugc

SEQ ID NO: 4810 - RNA, 22 nt, Human
cucugcuggccaugaagagaga

SEQ ID NO: 4811 - RNA, 22 nt, Human
cucugcugggauguaaagucuu

SEQ ID NO: 4812 - RNA, 22 nt, Human
cucugcuggugaccacugggcc

SEQ ID NO: 4813 - RNA, 22 nt, Human
cucugcugucucagaugggcca

SEQ ID NO: 4814 - RNA, 22 nt, Human
cucugcuuggaacuggacagaa

SEQ ID NO: 4815 - RNA, 19 nt, Human
cucugcuugguccauaugc

SEQ ID NO: 4816 - RNA, 22 nt, Human
cucugcuuguaucacauuugcu

SEQ ID NO: 4817 - RNA, 20 nt, Human
cucugcuuuaggagagucag

SEQ ID NO: 4818 - RNA, 22 nt, Human
cucugcuuucucaaacccugug

SEQ ID NO: 4819 - RNA, 22 nt, Human
cucugcuuuguaaguugugagg

SEQ ID NO: 4820 - RNA, 22 nt, Human
cucugcuuuuaugugccggcgc

SEQ ID NO: 4821 - RNA, 22 nt, Human
cucuggaccucagcuacagacu

SEQ ID NO: 4822 - RNA, 19 nt, Human
cucuggagaacaauagugc

SEQ ID NO: 4823 - RNA, 22 nt, Human
cucuggagaacuccuugugucu

SEQ ID NO: 4824 - RNA, 22 nt, Human
cucuggagagguucccauggga

SEQ ID NO: 4825 - RNA, 23 nt, Human
cucuggagauccucugccugggu

SEQ ID NO: 4826 - RNA, 22 nt, Human
cucuggagaugguucucaauug

SEQ ID NO: 4827 - RNA, 22 nt, Human
cucuggagcgcugcuucccgcg

SEQ ID NO: 4828 - RNA, 22 nt, Human
cucuggaggccuaaggaagugg

SEQ ID NO: 4829 - RNA, 22 nt, Human
cuccaguaucuguaggaaaagg

SEQ ID NO: 4830 - RNA, 22 nt, Human
cuccagucauagucugucuugu

SEQ ID NO: 4831 - RNA, 22 nt, Human
cuccagucauguuuacugugca

SEQ ID NO: 4832 - RNA, 22 nt, Human
cuccagucuuucagaugucccu

SEQ ID NO: 4833 - RNA, 22 nt, Human
cuccagugcacuggucuuuuca

SEQ ID NO: 4834 - RNA, 22 nt, Human
cuccagugcucaugccguugac

SEQ ID NO: 4835 - RNA, 22 nt, Human
cuccagugucucagagcagaug

SEQ ID NO: 4836 - RNA, 22 nt, Human
cuccauauggcccugggaccug

SEQ ID NO: 4837 - RNA, 22 nt, Human
cuccaucagcuguugguugagg

SEQ ID NO: 4838 - RNA, 15 nt, Human
cuccaugauuuugca

SEQ ID NO: 4839 - RNA, 22 nt, Human
cuccauugaacauccucucaga

SEQ ID NO: 4840 - RNA, 22 nt, Human
cucccacauggaauagcaggga

SEQ ID NO: 4841 - RNA, 22 nt, Human
cucccagccuucgccagucuga

SEQ ID NO: 4842 - RNA, 22 nt, Human
cucccaggccaugcucuagcca

SEQ ID NO: 4843 - RNA, 22 nt, Human
cucccaggguagggagagacua

SEQ ID NO: 4844 - RNA, 22 nt, Human
cucccaggugucccuucugcca

SEQ ID NO: 4845 - RNA, 22 nt, Human
cuccccaagccuuggcuucucc

SEQ ID NO: 4846 - RNA, 22 nt, Human
cucugggacaucccuuggccua

SEQ ID NO: 4847 - RNA, 22 nt, Human
cucugggagaggacacuuggag

SEQ ID NO: 4848 - RNA, 18 nt, Human
cucugggagaggcauaca

SEQ ID NO: 4849 - RNA, 22 nt, Human
cucugggaugaggccuaggcac

SEQ ID NO: 4850 - RNA, 22 nt, Human
cucugggcaaguaugauagaaa

SEQ ID NO: 4851 - RNA, 22 nt, Human
cucugggcacauuuuccaggac

SEQ ID NO: 4852 - RNA, 22 nt, Human
cucugggccaugcuacugcucu

SEQ ID NO: 4853 - RNA, 21 nt, Human
cucugggccauuuucuuccac

SEQ ID NO: 4854 - RNA, 22 nt, Human
cucugggcggcccaggccaacc

SEQ ID NO: 4855 - RNA, 23 nt, Human
cucugggcgggcaggucagccuc

SEQ ID NO: 4856 - RNA, 22 nt, Human
cucugggcugccuuuuagcucu

SEQ ID NO: 4857 - RNA, 22 nt, Human
cucugggguggaggaggcugac

SEQ ID NO: 4858 - RNA, 22 nt, Human
cucugggucccacgucauugcu

SEQ ID NO: 4859 - RNA, 20 nt, Human
cucugggucgagacagacuu

SEQ ID NO: 4860 - RNA, 17 nt, Human
cucugggucuccugcuu

SEQ ID NO: 4861 - RNA, 22 nt, Human
cucugggugagacagaccuggu

SEQ ID NO: 4862 - RNA, 22 nt, Human
cucugggugggcagcagaugga

SEQ ID NO: 4863 - RNA, 22 nt, Human
cucuggguggucucacugagug

SEQ ID NO: 4864 - RNA, 22 nt, Human
cucugggugugacagcaccugg

SEQ ID NO: 4865 - RNA, 22 nt, Human
cucuggucuucaaggccaccuc

SEQ ID NO: 4866 - RNA, 22 nt, Human
cucugguugcagcugaaguucc

SEQ ID NO: 4867 - RNA, 22 nt, Human
cucuguagccauggguauauuc

SEQ ID NO: 4868 - RNA, 22 nt, Human
cucuguaugaaucauauggagu

SEQ ID NO: 4869 - RNA, 22 nt, Human
cucugucacuucuccagcugag

SEQ ID NO: 4870 - RNA, 22 nt, Human
cucugucagaguguugucccca

SEQ ID NO: 4871 - RNA, 18 nt, Human
cucugucauaagugucau

SEQ ID NO: 4872 - RNA, 22 nt, Human
cucugucuaucccauucugugc

SEQ ID NO: 4873 - RNA, 22 nt, Human
cucuguggaagaagaaagaagg

SEQ ID NO: 4874 - RNA, 17 nt, Human
cucuguggagguguuua

SEQ ID NO: 4875 - RNA, 22 nt, Human
cucuguggcuacacaaaccucc

SEQ ID NO: 4876 - RNA, 22 nt, Human
cucugugggggagaggcagcug

SEQ ID NO: 4877 - RNA, 22 nt, Human
cucuguggguauuuauauguau

SEQ ID NO: 4878 - RNA, 22 nt, Human
cucugugguuagacuauggcug

SEQ ID NO: 4879 - RNA, 22 nt, Human
cucugugugcuggugggguccu

SEQ ID NO: 4880 - RNA, 22 nt, Human
cucugugugguaugauugucau

SEQ ID NO: 4881 - RNA, 22 nt, Human
cucuguguuaaauuggguuuuu

SEQ ID NO: 4882 - RNA, 22 nt, Human
cucuguuuggcgcugcuccuuc

SEQ ID NO: 4883 - RNA, 22 nt, Human
cucuuaaauaacaucauugcuu

SEQ ID NO: 4884 - RNA, 19 nt, Human
cucuuaaauugucucuugc

SEQ ID NO: 4885 - RNA, 22 nt, Human
cucuuaaugaccuuaauucaag

SEQ ID NO: 4886 - RNA, 22 nt, Human
cucuuaauguuuuauagauuga

SEQ ID NO: 4887 - RNA, 22 nt, Human
cucuuagaaagaaacacacugg

SEQ ID NO: 4888 - RNA, 22 nt, Human
cucuuagauauggagaauuacc

SEQ ID NO: 4889 - RNA, 22 nt, Human
cucuuauuccuacaguaacagg

SEQ ID NO: 4890 - RNA, 22 nt, Human
cucuucaaaugauuuccuuagg

SEQ ID NO: 4891 - RNA, 22 nt, Human
cucuucagauaaaagggauauu

SEQ ID NO: 4892 - RNA, 22 nt, Human
cucuucagauauacaguacucu

SEQ ID NO: 4893 - RNA, 22 nt, Human
cucuucagcaaugcuuuagucc

SEQ ID NO: 4894 - RNA, 22 nt, Human
cucuucagccuauuugagugca

SEQ ID NO: 4895 - RNA, 22 nt, Human
cucuucaggaauaugucaguca

SEQ ID NO: 4896 - RNA, 22 nt, Human
cucuucaguaaaugacacuguu

SEQ ID NO: 4897 - RNA, 22 nt, Human
cucuuccauauuacucagggua

SEQ ID NO: 4898 - RNA, 22 nt, Human
cucuuccauuucuacuucacag

SEQ ID NO: 4899 - RNA, 22 nt, Human
cucuuccuuaagacuauaaaga

SEQ ID NO: 4900 - RNA, 22 nt, Human
cucuucucugcagccuuugaag

SEQ ID NO: 4901 - RNA, 22 nt, Human
cucuucuguaccucggccucca

SEQ ID NO: 4902 - RNA, 22 nt, Human
cucuucuuuccaucccuagcca

SEQ ID NO: 4903 - RNA, 22 nt, Human
cucuugaaaauuggaacacaga

SEQ ID NO: 4904 - RNA, 22 nt, Human
cucuugaacuuucuaguuucau

SEQ ID NO: 4905 - RNA, 22 nt, Human
cucuugcaugagauccaggagu

SEQ ID NO: 4906 - RNA, 22 nt, Human
cucuugccagagaugagacucu

SEQ ID NO: 4907 - RNA, 22 nt, Human
cucuugggugggcagugggccu

SEQ ID NO: 4908 - RNA, 22 nt, Human
cucuuuaacucccauucugucc

SEQ ID NO: 4909 - RNA, 22 nt, Human
cucuuuaguuugaaauccacau

SEQ ID NO: 4910 - RNA, 22 nt, Human
cucuuucugauucgcugggacc

SEQ ID NO: 4911 - RNA, 22 nt, Human
cucuuucuggaaggcagagugg

SEQ ID NO: 4912 - RNA, 22 nt, Human
cucuuugaaauccaucacugcu

SEQ ID NO: 4913 - RNA, 22 nt, Human
cucuuuggagaagcacguauua

SEQ ID NO: 4914 - RNA, 22 nt, Human
cucuuuggccagaaaauguuuu

SEQ ID NO: 4915 - RNA, 22 nt, Human
cucuuuggcuuugacucccauu

SEQ ID NO: 4916 - RNA, 21 nt, Human
cucuuugggaucuuuggaaag

SEQ ID NO: 4917 - RNA, 22 nt, Human
cucuuugggaugggcucugcug

SEQ ID NO: 4918 - RNA, 22 nt, Human
cucuuuguauuucuuugggcca

SEQ ID NO: 4919 - RNA, 20 nt, Human
cucuuuguuggcaaacucuu

SEQ ID NO: 4920 - RNA, 20 nt, Human
cucuuuucacucucaguggu

SEQ ID NO: 4921 - RNA, 22 nt, Human
cugaaaaauauguuuuggagaa

SEQ ID NO: 4922 - RNA, 22 nt, Human
cugaaaagcuuugaaccguuaa

SEQ ID NO: 4923 - RNA, 22 nt, Human
cugaaacuuuaguucugcaaca

SEQ ID NO: 4924 - RNA, 22 nt, Human
cugaaagaauaagauguuuaca

SEQ ID NO: 4925 - RNA, 22 nt, Human
cugaaaggguuacauaguaagu

SEQ ID NO: 4926 - RNA, 22 nt, Human
cugaaauaguuucauagaacuu

SEQ ID NO: 4927 - RNA, 22 nt, Human
cugaaaugacgguuuggggcaa

SEQ ID NO: 4928 - RNA, 22 nt, Human
cugaaaugggcaaaaguagauu

SEQ ID NO: 4929 - RNA, 22 nt, Human
cugaacaaagaaauagucaugg

SEQ ID NO: 4930 - RNA, 20 nt, Human
cugaacacagaauaagcaca

SEQ ID NO: 4931 - RNA, 22 nt, Human
cugaacaucccgcagugcacga

SEQ ID NO: 4932 - RNA, 22 nt, Human
cugaaccaucucuguucuguau

SEQ ID NO: 4933 - RNA, 22 nt, Human
cugaacucaugauaugcuuuug

SEQ ID NO: 4934 - RNA, 22 nt, Human
cugaacuucucugagccucagu

SEQ ID NO: 4935 - RNA, 22 nt, Human
cugaagacugcugagaaguuac

SEQ ID NO: 4936 - RNA, 22 nt, Human
cugaagaggacuggguuggagg

SEQ ID NO: 4937 - RNA, 20 nt, Human
cugaagaguggccugaucug

SEQ ID NO: 4938 - RNA, 22 nt, Human
uuugcucugacagugccagaga

SEQ ID NO: 4939 - RNA, 22 nt, Human
uuugcucuugcuggaaaaguug

SEQ ID NO: 4940 - RNA, 21 nt, Human
uuugcugaagauuuuaggcug

SEQ ID NO: 4941 - RNA, 21 nt, Human
uuugcugaaugauuccagggc

SEQ ID NO: 4942 - RNA, 22 nt, Human
uuugcugucagccgcuauuuuc

SEQ ID NO: 4943 - RNA, 22 nt, Human
uuugcugugcuuacauauguau

SEQ ID NO: 4944 - RNA, 22 nt, Human
uuugcuuaaaguucuuucuggu

SEQ ID NO: 4945 - RNA, 22 nt, Human
uuugcuuucuguugaacagagu

SEQ ID NO: 4946 - RNA, 22 nt, Human
uuuggaaacugccucagcucuu

SEQ ID NO: 4947 - RNA, 22 nt, Human
uuuggaaaugagaagccaccuu

SEQ ID NO: 4948 - RNA, 22 nt, Human
uuuggaacaagacaaaacauua

SEQ ID NO: 4949 - RNA, 22 nt, Human
uuuggaauguaguuuaaucauc

SEQ ID NO: 4950 - RNA, 22 nt, Human
uuuggaauuacuuacucaagcc

SEQ ID NO: 4951 - RNA, 22 nt, Human
uuuggaauuaugcuuaaaguuu

SEQ ID NO: 4952 - RNA, 22 nt, Human
uuuggaauuggaaagugcugug

SEQ ID NO: 4953 - RNA, 22 nt, Human
uuuggacaaaugucugacuuuc

SEQ ID NO: 4954 - RNA, 22 nt, Human
uuuggacauguugagucugaua

SEQ ID NO: 4955 - RNA, 23 nt, Human
uuuggacuugugacucuucuccu

SEQ ID NO: 4956 - RNA, 22 nt, Human
uuuggagaaaaguugagaccau

SEQ ID NO: 4957 - RNA, 22 nt, Human
uuuggagagcagcuaggcccuu

SEQ ID NO: 4958 - RNA, 22 nt, Human
uuuggaucacuguuccucuggg

SEQ ID NO: 4959 - RNA, 22 nt, Human
uuuggcaagcgaguacuuucug

SEQ ID NO: 4960 - RNA, 22 nt, Human
uuuggcacagcuucccagacuu

SEQ ID NO: 4961 - RNA, 19 nt, Human
uuuggcacucugaaguguu

SEQ ID NO: 4962 - RNA, 22 nt, Human
uuuggcacuguucuaggugcaa

SEQ ID NO: 4963 - RNA, 22 nt, Human
uuuggcauuuaauaggugauca

SEQ ID NO: 4964 - RNA, 22 nt, Human
uuuggccaagaaaguucugugg

SEQ ID NO: 4965 - RNA, 22 nt, Human
uuuggccacagauccuuggggg

SEQ ID NO: 4966 - RNA, 22 nt, Human
uuuggccacuucauagaucauu

SEQ ID NO: 4967 - RNA, 18 nt, Human
uuuggccaugaccuggcu

SEQ ID NO: 4968 - RNA, 22 nt, Human
uuuggccucaugaauuucuugc

SEQ ID NO: 4969 - RNA, 22 nt, Human
uuuggcgucucucaggagcuca

SEQ ID NO: 4970 - RNA, 22 nt, Human
uuuggcucugguucuggcucca

SEQ ID NO: 4971 - RNA, 22 nt, Human
uuuggcucuucccguaccauaa

SEQ ID NO: 4972 - RNA, 22 nt, Human
uuuggcugagaaguugugcuuu

SEQ ID NO: 4973 - RNA, 22 nt, Human
uuuggcuuaacuuacaugauau

SEQ ID NO: 4974 - RNA, 22 nt, Human
uuuggcuugcacuggcaccaac

SEQ ID NO: 4975 - RNA, 22 nt, Human
uuugggaaacuuaggggucaga

SEQ ID NO: 4976 - RNA, 22 nt, Human
uuugggaaccagaaguucaaaa

SEQ ID NO: 4977 - RNA, 22 nt, Human
uuugggaacucuaucauggaaa

SEQ ID NO: 4978 - RNA, 22 nt, Human
uuugggaacuuaauuaugucug

SEQ ID NO: 4979 - RNA, 22 nt, Human
uuugggaagaggaaucucugga

SEQ ID NO: 4980 - RNA, 19 nt, Human
uuugggaagcccagagugu

SEQ ID NO: 4981 - RNA, 22 nt, Human
uuugggaauaauugcacagauu

SEQ ID NO: 4982 - RNA, 22 nt, Human
uuugggaauuguagcugucuug

SEQ ID NO: 4983 - RNA, 22 nt, Human
uuugggacuggagcuuggagag

SEQ ID NO: 4984 - RNA, 22 nt, Human
uuugggcaaagguagaaggaga

SEQ ID NO: 4985 - RNA, 22 nt, Human
uuugggcaagcucacugauuca

SEQ ID NO: 4986 - RNA, 22 nt, Human
uuugggcaagguccagauuccu

SEQ ID NO: 4987 - RNA, 22 nt, Human
uuugggcacagauauuaaguau

SEQ ID NO: 4988 - RNA, 22 nt, Human
uuugggcagaagcugaaugucu

SEQ ID NO: 4989 - RNA, 22 nt, Human
uuugggcauuaguaaguuaagc

SEQ ID NO: 4990 - RNA, 22 nt, Human
uuugggcucuugcugaccuggg

SEQ ID NO: 4991 - RNA, 22 nt, Human
uuugggcugguuugccaugccc

SEQ ID NO: 4992 - RNA, 21 nt, Human
uuugggcuuuuacuggacgug

SEQ ID NO: 4993 - RNA, 22 nt, Human
uuuggguucagacaugauuaca

SEQ ID NO: 4994 - RNA, 22 nt, Human
uuuggucaaauauuauccugag

SEQ ID NO: 4995 - RNA, 22 nt, Human
uuuggucaggguaggacaguug

SEQ ID NO: 4996 - RNA, 22 nt, Human
uuugguccaaguuuuacucuuu

SEQ ID NO: 4997 - RNA, 22 nt, Human
uuuggucucauucacucauggg

SEQ ID NO: 4998 - RNA, 22 nt, Human
uuuggucucugugcauccuccu

SEQ ID NO: 4999 - RNA, 22 nt, Human
uuuggucuuuuguaaguuaucu

SEQ ID NO: 5000 - RNA, 22 nt, Human
aaaaugaugcuguaauuuggca

SEQ ID NO: 5001 - RNA, 20 nt, Human
aaaaugaugggcagggcagg

SEQ ID NO: 5002 - RNA, 22 nt, Human
aaaaugcaaaccuaccuacaua

SEQ ID NO: 5003 - RNA, 18 nt, Human
aaaaugcaggcgacaugg

SEQ ID NO: 5004 - RNA, 22 nt, Human
aaaaugcucaucagcgauggcu

SEQ ID NO: 5005 - RNA, 22 nt, Human
aaaauggcuguggucuggcaag

SEQ ID NO: 5006 - RNA, 22 nt, Human
aaaauguaugauggaggugcua

SEQ ID NO: 5007 - RNA, 22 nt, Human
aaaaugucugcuguugguuuau

SEQ ID NO: 5008 - RNA, 22 nt, Human
aaaauuauggaguaucccaaag

SEQ ID NO: 5009 - RNA, 22 nt, Human
aaaauucauagaacuguacgcu

SEQ ID NO: 5010 - RNA, 22 nt, Human
aaaauugagagucuugugcaag

SEQ ID NO: 5011 - RNA, 22 nt, Human
aaaauugaggccaguaugccau

SEQ ID NO: 5012 - RNA, 19 nt, Human
aaaauugcguauuuugagg

SEQ ID NO: 5013 - RNA, 22 nt, Human
aaaauugucagaaguugaucuu

SEQ ID NO: 5014 - RNA, 22 nt, Human
aaacaaccuaaaguuacugauc

SEQ ID NO: 5015 - RNA, 22 nt, Human
aaacaagagcuuacauggcugc

SEQ ID NO: 5016 - RNA, 22 nt, Human
aaacaagcaagcacauaauuuu

SEQ ID NO: 5017 - RNA, 20 nt, Human
aaacaagguugcucugagga

SEQ ID NO: 5018 - RNA, 22 nt, Human
aaacaaguguaaacuagucugu

SEQ ID NO: 5019 - RNA, 22 nt, Human
aaacaaugagcuuuuacacacu

SEQ ID NO: 5020 - RNA, 22 nt, Human
aaacaauguacacaugaauguu

SEQ ID NO: 5021 - RNA, 22 nt, Human
aaacaauguacauuuauaaugc

SEQ ID NO: 5022 - RNA, 23 nt, Human
aaacaaugucaucaggacuuggu

SEQ ID NO: 5023 - RNA, 22 nt, Human
aaacaauguugcugggugcggu

SEQ ID NO: 5024 - RNA, 22 nt, Human
aaacaauguugucuccaagagg

SEQ ID NO: 5025 - RNA, 22 nt, Human
aaacacaauguuucuuuguucu

SEQ ID NO: 5026 - RNA, 22 nt, Human
aaacacagcauguccuugggga

SEQ ID NO: 5027 - RNA, 22 nt, Human
aaacacugaagaccuaucuggu

SEQ ID NO: 5028 - RNA, 22 nt, Human
aaacacugcaggguuuacuuga

SEQ ID NO: 5029 - RNA, 22 nt, Human
aaacacugcgugguggcaacuc

SEQ ID NO: 5030 - RNA, 22 nt, Human
aaacacugugggacaucuuacu

SEQ ID NO: 5031 - RNA, 22 nt, Human
aaacacuucaaggacuucuguc

SEQ ID NO: 5032 - RNA, 22 nt, Human
aaacacuugcaaaaugguuccu

SEQ ID NO: 5033 - RNA, 22 nt, Human
aaacacuuuagaaagggacuug

SEQ ID NO: 5034 - RNA, 22 nt, Human
aaacagaugaguuauaauagcc

SEQ ID NO: 5035 - RNA, 22 nt, Human
aaacagcaauggagaagccagg

SEQ ID NO: 5036 - RNA, 22 nt, Human
aaacagcaggaacaucuugcca

SEQ ID NO: 5037 - RNA, 20 nt, Human
aaacagcuaaaccagcucuc

SEQ ID NO: 5038 - RNA, 22 nt, Human
aaacagcuaaguacauucaagg

SEQ ID NO: 5039 - RNA, 22 nt, Human
aaacagcuaauggccaggaaua

SEQ ID NO: 5040 - RNA, 22 nt, Human
ugucuccugggcccuggcccug

SEQ ID NO: 5041 - RNA, 22 nt, Human
ugucuccuugcuuuucccugua

SEQ ID NO: 5042 - RNA, 22 nt, Human
ugucucuagggcaaugugaacu

SEQ ID NO: 5043 - RNA, 19 nt, Human
ugucucugaaagaugagcu

SEQ ID NO: 5044 - RNA, 22 nt, Human
ugucucugaggugagggucagc

SEQ ID NO: 5045 - RNA, 22 nt, Human
ugucucugccagcuagcagaau

SEQ ID NO: 5046 - RNA, 22 nt, Human
ugucucugcuuuccuugcaggg

SEQ ID NO: 5047 - RNA, 22 nt, Human
ugucucugggugauucaguccu

SEQ ID NO: 5048 - RNA, 22 nt, Human
ugucucugguauuaggugaaaa

SEQ ID NO: 5049 - RNA, 22 nt, Human
ugucucugucuuccagggcugu

SEQ ID NO: 5050 - RNA, 22 nt, Human
ugucucugugagaucugacgau

SEQ ID NO: 5051 - RNA, 22 nt, Human
ugucucuucccacucagacccc

SEQ ID NO: 5052 - RNA, 22 nt, Human
ugucucuuggcucuaucacuua

SEQ ID NO: 5053 - RNA, 22 nt, Human
ugucucuugguguccagaggag

SEQ ID NO: 5054 - RNA, 20 nt, Human
ugucugaaaaggaagcuauc

SEQ ID NO: 5055 - RNA, 22 nt, Human
ugucugaacgaaguagguccac

SEQ ID NO: 5056 - RNA, 22 nt, Human
ugucugagugauccaguuucuc

SEQ ID NO: 5057 - RNA, 22 nt, Human
ugucugaguggugcaaggcuga

SEQ ID NO: 5058 - RNA, 21 nt, Human
ugucugccccuguuuaccaga

SEQ ID NO: 5059 - RNA, 22 nt, Human
ugucugccugcgggccggcaca

SEQ ID NO: 5060 - RNA, 22 nt, Human
ugucugcucgggguucccaccu

SEQ ID NO: 5061 - RNA, 22 nt, Human
ugucugcugcccuggagccugg

SEQ ID NO: 5062 - RNA, 18 nt, Human
ugucugcuucuccaacuc

SEQ ID NO: 5063 - RNA, 19 nt, Human
ugucuggaagagcugcagg

SEQ ID NO: 5064 - RNA, 22 nt, Human
ugucuggacauugacaaucaug

SEQ ID NO: 5065 - RNA, 22 nt, Human
ugucuggggguucugaaagcug

SEQ ID NO: 5066 - RNA, 22 nt, Human
ugucugguggguugacaggcag

SEQ ID NO: 5067 - RNA, 22 nt, Human
ugucuguaagguguuuauguua

SEQ ID NO: 5068 - RNA, 22 nt, Human
ugucuguaaucaacugaguuuc

SEQ ID NO: 5069 - RNA, 22 nt, Human
ugucuguauaucacuuuugucc

SEQ ID NO: 5070 - RNA, 20 nt, Human
ugucuguaugcagucauaua

SEQ ID NO: 5071 - RNA, 22 nt, Human
ugucuguccuuguuugguauca

SEQ ID NO: 5072 - RNA, 22 nt, Human
ugucugugaccucuuuggagcc

SEQ ID NO: 5073 - RNA, 22 nt, Human
ugucuguguccaaauuuccucu

SEQ ID NO: 5074 - RNA, 22 nt, Human
ugucugugugagcaaaugacuu

SEQ ID NO: 5075 - RNA, 19 nt, Human
ugucuuaauuaacucagag

SEQ ID NO: 5076 - RNA, 22 nt, Human
ugucuuaauuuggaugauguuu

SEQ ID NO: 5077 - RNA, 17 nt, Human
ugucuuaucuguccugu

SEQ ID NO: 5078 - RNA, 22 nt, Human
ugucuuauuuugaaguguucac

SEQ ID NO: 5079 - RNA, 22 nt, Human
ugucuucacaaagcagaaggga

SEQ ID NO: 5080 - RNA, 22 nt, Human
ugucuucagauaggcauucuuc

SEQ ID NO: 5081 - RNA, 22 nt, Human
ugucuucagcaaaugccuuucu

SEQ ID NO: 5082 - RNA, 21 nt, Human
ugucuucauaugagauggugu

SEQ ID NO: 5083 - RNA, 22 nt, Human
ugucuucauucuguauguccag

SEQ ID NO: 5084 - RNA, 22 nt, Human
ugucuuccucuuggcuugagcu

SEQ ID NO: 5085 - RNA, 23 nt, Human
ugucuugguuucuucacccuagu

SEQ ID NO: 5086 - RNA, 22 nt, Human
ugucuuuagaaagaagcagaca

SEQ ID NO: 5087 - RNA, 22 nt, Human
ugucuuuagagucacaaaacca

SEQ ID NO: 5088 - RNA, 22 nt, Human
ugucuuuagcccauauagacuu

SEQ ID NO: 5089 - RNA, 22 nt, Human
ugucuuuaguuuuacugucugg

SEQ ID NO: 5090 - RNA, 20 nt, Human
ugucuuuccauggcuggauc

SEQ ID NO: 5091 - RNA, 21 nt, Human
ugucuuuggccucauucccag

SEQ ID NO: 5092 - RNA, 22 nt, Human
ugucuuuggggcuguaccuguu

SEQ ID NO: 5093 - RNA, 19 nt, Human
ugucuuuggucugaguuuc

SEQ ID NO: 5094 - RNA, 22 nt, Human
ugucuuuugccaaagaucaguu

SEQ ID NO: 5095 - RNA, 22 nt, Human
ugugaaaagcaggcuacuuucu

SEQ ID NO: 5096 - RNA, 22 nt, Human
ugugaaagagucuuauaguuuc

SEQ ID NO: 5097 - RNA, 22 nt, Human
ugugaaagcaagucuaguucuc

SEQ ID NO: 5098 - RNA, 19 nt, Human
ugugaaagcuaguguucuu

SEQ ID NO: 5099 - RNA, 22 nt, Human
ugugaaaggagccauagacagu

SEQ ID NO: 5100 - RNA, 21 nt, Human
ugugaaauagcuaugcuacau

SEQ ID NO: 5101 - RNA, 22 nt, Human
ugugaaaucugaacucaaagau

SEQ ID NO: 5102 - RNA, 22 nt, Human
ugugaaauuacuuaaaggaaau

SEQ ID NO: 5103 - RNA, 18 nt, Human
ugugaacacauuuuucug

SEQ ID NO: 5104 - RNA, 22 nt, Human
ugugaacucuggaacaaaacua

SEQ ID NO: 5105 - RNA, 22 nt, Human
ugugaacuuuggaugguucuga

SEQ ID NO: 5106 - RNA, 22 nt, Human
ugugaagcauagauucuguaga

SEQ ID NO: 5107 - RNA, 22 nt, Human
ugugaaggacuuguuccauugu

SEQ ID NO: 5108 - RNA, 22 nt, Human
ugugaaggagaugaagggagug

SEQ ID NO: 5109 - RNA, 22 nt, Human
ugugaagguaaggaggggcaag

SEQ ID NO: 5110 - RNA, 22 nt, Human
ugugaagguaagguuugcuuga

SEQ ID NO: 5111 - RNA, 22 nt, Human
ugugaagguuaaauaauaugau

SEQ ID NO: 5112 - RNA, 22 nt, Human
ugugaauaaugccgcaauaaac

SEQ ID NO: 5113 - RNA, 22 nt, Human
ugugaauauuuccuucuuugga

SEQ ID NO: 5114 - RNA, 22 nt, Human
ugugaauggacaauuaaaucua

SEQ ID NO: 5115 - RNA, 22 nt, Human
ugugaauggcaguuggauagca

SEQ ID NO: 5116 - RNA, 22 nt, Human
ugugaauguauaguuuguauau

SEQ ID NO: 5117 - RNA, 22 nt, Human
ugugaaugucuagguuuuaugu

SEQ ID NO: 5118 - RNA, 23 nt, Human
ugugaauugaggacaucaaaagc

SEQ ID NO: 5119 - RNA, 20 nt, Human
ugugacaaaggcauauuuua

SEQ ID NO: 5120 - RNA, 22 nt, Human
ugugacaccacacccgacuaau

SEQ ID NO: 5121 - RNA, 21 nt, Human
ugugacagaggcggugccuac

SEQ ID NO: 5122 - RNA, 22 nt, Human
ugugacagaucuuuaaauaaug

SEQ ID NO: 5123 - RNA, 23 nt, Human
ugugacagggucauugaaaaggg

SEQ ID NO: 5124 - RNA, 22 nt, Human
ugugacaguaacuugggaugga

SEQ ID NO: 5125 - RNA, 19 nt, Human
ugugacaucacugggcagc

SEQ ID NO: 5126 - RNA, 22 nt, Human
ugugacccagacucaucuucuu

SEQ ID NO: 5127 - RNA, 23 nt, Human
ugugaccccuaggaguggggacc

SEQ ID NO: 5128 - RNA, 22 nt, Human
ugugaccucaucuuaacuggaa

SEQ ID NO: 5129 - RNA, 22 nt, Human
ugugacguuccugcuggcgacc

SEQ ID NO: 5130 - RNA, 22 nt, Human
ugugacuggaguccagcccacu

SEQ ID NO: 5131 - RNA, 22 nt, Human
ugugacuggcagaggugucugg

SEQ ID NO: 5132 - RNA, 22 nt, Human
ugugacuuauaacauagaauuu

SEQ ID NO: 5133 - RNA, 22 nt, Human
ugugacuugauguuugcaccag

SEQ ID NO: 5134 - RNA, 21 nt, Human
ugugagaagaguacugagguc

SEQ ID NO: 5135 - RNA, 22 nt, Human
ugugagacacacugcugcuuca

SEQ ID NO: 5136 - RNA, 22 nt, Human
ugugagacaggaccuguugacu

SEQ ID NO: 5137 - RNA, 22 nt, Human
ugugagacguguuagaacagug

SEQ ID NO: 5138 - RNA, 22 nt, Human
ugugagagagugcauuugcaua

SEQ ID NO: 5139 - RNA, 22 nt, Human
ugugagcacuggcugggaaagu

SEQ ID NO: 5140 - RNA, 22 nt, Human
ugugagcugaagugacaggcug

SEQ ID NO: 5141 - RNA, 22 nt, Human
ugugaggaccucagcagagucu

SEQ ID NO: 5142 - RNA, 22 nt, Human
uuuuggcucugcagguuugcac

SEQ ID NO: 5143 - RNA, 22 nt, Human
uuuuggcucugucuguaucuuu

SEQ ID NO: 5144 - RNA, 22 nt, Human
uuuuggcuuuuccucagcaagc

SEQ ID NO: 5145 - RNA, 22 nt, Human
uuuugguagaaucaacaaugua

SEQ ID NO: 5146 - RNA, 20 nt, Human
uuuuggugaauuccagaaua

SEQ ID NO: 5147 - RNA, 16 nt, Human
uuuuggugacccugga

SEQ ID NO: 5148 - RNA, 18 nt, Human
uuuuggugaggaagugag

SEQ ID NO: 5149 - RNA, 17 nt, Human
uuuuggugaguuguuuc

SEQ ID NO: 5150 - RNA, 22 nt, Human
uuuuggugcaccuagcuuuuuc

SEQ ID NO: 5151 - RNA, 22 nt, Human
uuuugguggugggcuuggcagc

SEQ ID NO: 5152 - RNA, 19 nt, Human
uuuugucuucccuuaguuu

SEQ ID NO: 5153 - RNA, 22 nt, Human
uuuugugaauaguuuaucuaag

SEQ ID NO: 5154 - RNA, 22 nt, Human
uuuugugacagaaagauuaagu

SEQ ID NO: 5155 - RNA, 22 nt, Human
uuuuguguagagauggggucuu

SEQ ID NO: 5156 - RNA, 22 nt, Human
uuuuguguccuucacaucaugu

SEQ ID NO: 5157 - RNA, 22 nt, Human
uuuuguguugccauguuaagca

SEQ ID NO: 5158 - RNA, 22 nt, Human
uuuuguguuguaaugucagcua

SEQ ID NO: 5159 - RNA, 22 nt, Human
uuuuguuggcuuaagaaauaca

SEQ ID NO: 5160 - RNA, 22 nt, Human
uuuuuaaccuaccuuaagagca

SEQ ID NO: 5161 - RNA, 22 nt, Human
uuuuuacacuuagcauugagcg

SEQ ID NO: 5162 - RNA, 22 nt, Human
uuuuuaguagagguggguuuca

SEQ ID NO: 5163 - RNA, 23 nt, Human
uuuuuaguuacaccucugccacc

SEQ ID NO: 5164 - RNA, 22 nt, Human
uuuuuauaacucuuuugugaca

SEQ ID NO: 5165 - RNA, 22 nt, Human
uuuuuauacuuugcucaagauu

SEQ ID NO: 5166 - RNA, 22 nt, Human
uuuuuaugccuacgcugaaaag

SEQ ID NO: 5167 - RNA, 22 nt, Human
uuuuucaagacaaccugcaugu

SEQ ID NO: 5168 - RNA, 22 nt, Human
uuuuucagccaugaauuacacu

SEQ ID NO: 5169 - RNA, 22 nt, Human
uuuuucaucugauugauaacuc

SEQ ID NO: 5170 - RNA, 22 nt, Human
uuuuucauugcagccucucucc

SEQ ID NO: 5171 - RNA, 22 nt, Human
uuuuuccaccguacuuccugag

SEQ ID NO: 5172 - RNA, 22 nt, Human
uuuuucccauauagaaagccaa

SEQ ID NO: 5173 - RNA, 22 nt, Human
uuuuuccuaagcaguggagcug

SEQ ID NO: 5174 - RNA, 22 nt, Human
uuuuucuacugguguuggugua

SEQ ID NO: 5175 - RNA, 22 nt, Human
uuuuucuagaccuuaaaggcca

SEQ ID NO: 5176 - RNA, 20 nt, Human
uuuuucugggcuuccauagc

SEQ ID NO: 5177 - RNA, 22 nt, Human
uuuuuggcagcucagaaacuuc

SEQ ID NO: 5178 - RNA, 22 nt, Human
uuuuuggguccaggcuguaucu

SEQ ID NO: 5179 - RNA, 22 nt, Human
uuuuuguauagaaaugaacuaa

SEQ ID NO: 5180 - RNA, 22 nt, Human
uuuuuguauaugcuucgaggau

SEQ ID NO: 5181 - RNA, 22 nt, Human
uuuuugucuauucacugauuca

SEQ ID NO: 5182 - RNA, 22 nt, Human
uuuuuguguauccugcuccaug

SEQ ID NO: 5183 - RNA, 22 nt, Human
uuuuuguucugauuauacuggu

SEQ ID NO: 5184 - RNA, 22 nt, Human
uuuuuuauagcaaugaacccac

SEQ ID NO: 5185 - RNA, 22 nt, Human
uuuuuuccuucaugacuuaaga

SEQ ID NO: 5186 - RNA, 22 nt, Human
uuuuuuggugcuccuaggaagg

SEQ ID NO: 5187 - RNA, 21 nt, Human
uuucucaguugugugagcagc

SEQ ID NO: 5188 - RNA, 21 nt, Human
uuucucauaaaauacucauua

SEQ ID NO: 5189 - RNA, 22 nt, Human
uuucucauagucaugccucuua

SEQ ID NO: 5190 - RNA, 22 nt, Human
uuucucaucuggaaacagugcu

SEQ ID NO: 5191 - RNA, 22 nt, Human
uuucucauggaacauagcuccu

SEQ ID NO: 5192 - RNA, 21 nt, Human
uuucuccaagugacugauucc

SEQ ID NO: 5193 - RNA, 22 nt, Human
uuucuccacgccagcuugcuua

SEQ ID NO: 5194 - RNA, 22 nt, Human
uuucuccacuucucuugccaac

SEQ ID NO: 5195 - RNA, 22 nt, Human
uuucucccccaugauaauuucu

SEQ ID NO: 5196 - RNA, 22 nt, Human
uuucuccuaacucaaauuuaag

SEQ ID NO: 5197 - RNA, 22 nt, Human
uuucuccuccagagagacacag

SEQ ID NO: 5198 - RNA, 22 nt, Human
uuucuccugaguuccacgcuac

SEQ ID NO: 5199 - RNA, 22 nt, Human
uuucuccugcccagaugccugg

SEQ ID NO: 5200 - RNA, 22 nt, Human
uuucuccugugaggucagaagu

SEQ ID NO: 5201 - RNA, 17 nt, Human
uuucuccuuccaucuca

SEQ ID NO: 5202 - RNA, 22 nt, Human
uuucucuccccaaguggaauug

SEQ ID NO: 5203 - RNA, 19 nt, Human
uuucucucccucaucccga

SEQ ID NO: 5204 - RNA, 22 nt, Human
uuucucucuacaguacuuucau

SEQ ID NO: 5205 - RNA, 22 nt, Human
uuucucucuauuuagacaggua

SEQ ID NO: 5206 - RNA, 23 nt, Human
uuucucugagaagcaguucucua

SEQ ID NO: 5207 - RNA, 22 nt, Human
uuucucugcugccugugucgau

SEQ ID NO: 5208 - RNA, 22 nt, Human
uuucucuggcauuagguauaaa

SEQ ID NO: 5209 - RNA, 22 nt, Human
uuucucuggccucaguuuaaca

SEQ ID NO: 5210 - RNA, 22 nt, Human
uuucucugggcacucuccaaac

SEQ ID NO: 5211 - RNA, 22 nt, Human
uuucucuuaaugucucugugcu

SEQ ID NO: 5212 - RNA, 22 nt, Human
uuucucuuugacaggaaucaga

SEQ ID NO: 5213 - RNA, 22 nt, Human
uuucugaagucuucuaacagau

SEQ ID NO: 5214 - RNA, 22 nt, Human
uuucugaauaacucuaugauau

SEQ ID NO: 5215 - RNA, 18 nt, Human
uuucugaaugucuauuuc

SEQ ID NO: 5216 - RNA, 22 nt, Human
uuucugagaaauuaaacacuuu

SEQ ID NO: 5217 - RNA, 22 nt, Human
uuucugcaaaauaaauagugac

SEQ ID NO: 5218 - RNA, 22 nt, Human
uuucugcaacgagucuuugacu

SEQ ID NO: 5219 - RNA, 19 nt, Human
uuucugcagcccagcagca

SEQ ID NO: 5220 - RNA, 22 nt, Human
uuucugcauauguauguaugga

SEQ ID NO: 5221 - RNA, 17 nt, Human
uuucugcaugauuggac

SEQ ID NO: 5222 - RNA, 22 nt, Human
uuucugcauuuacaaaaugagg

SEQ ID NO: 5223 - RNA, 22 nt, Human
uuucugccuuaucuuugcugag

SEQ ID NO: 5224 - RNA, 22 nt, Human
uuucugcucgcucucaaucagg

SEQ ID NO: 5225 - RNA, 22 nt, Human
uuucugcuuccuugagaaggag

SEQ ID NO: 5226 - RNA, 22 nt, Human
uuucugcuuucuauccuuguca

SEQ ID NO: 5227 - RNA, 22 nt, Human
cucuccagaauaugccgccgug

SEQ ID NO: 5228 - RNA, 22 nt, Human
cucuccaggcugggacaggacc

SEQ ID NO: 5229 - RNA, 22 nt, Human
cucuccagguuagagcacuuau

SEQ ID NO: 5230 - RNA, 22 nt, Human
cucucccuaugccucccaggag

SEQ ID NO: 5231 - RNA, 22 nt, Human
cucuccuacauuucauucacaa

SEQ ID NO: 5232 - RNA, 22 nt, Human
cucuccucagaacaggcccucu

SEQ ID NO: 5233 - RNA, 22 nt, Human
cucuccuccaggaacucacagu

SEQ ID NO: 5234 - RNA, 23 nt, Human
cucuccugaaggacaagcugccg

SEQ ID NO: 5235 - RNA, 17 nt, Human
cucuccuuccucugagg

SEQ ID NO: 5236 - RNA, 22 nt, Human
cucuccuugcagauggcugccu

SEQ ID NO: 5237 - RNA, 20 nt, Human
cucuccuugccgacuuggca

SEQ ID NO: 5238 - RNA, 22 nt, Human
cucucuagaggcccaccuugag

SEQ ID NO: 5239 - RNA, 22 nt, Human
cucucuauggaugcaguuuuuc

SEQ ID NO: 5240 - RNA, 22 nt, Human
cucucucaguguaauacaggau

SEQ ID NO: 5241 - RNA, 20 nt, Human
cucucuccaucucaguggcc

SEQ ID NO: 5242 - RNA, 22 nt, Human
cucucucuuguguugcugcaga

SEQ ID NO: 5243 - RNA, 22 nt, Human
cucucugcaaguuuugaaauag

SEQ ID NO: 5244 - RNA, 22 nt, Human
cucucuggaagggggagcugau

SEQ ID NO: 5245 - RNA, 22 nt, Human
cucucuggcccauccuguugcc

SEQ ID NO: 5246 - RNA, 22 nt, Human
cucucuguauguguauauuuau

SEQ ID NO: 5247 - RNA, 22 nt, Human
cucucuguuaugcuuucaugaa

SEQ ID NO: 5248 - RNA, 18 nt, Human
cucucuuuccacucuuug

SEQ ID NO: 5249 - RNA, 22 nt, Human
cucucuuuuucgugugccgaag

SEQ ID NO: 5250 - RNA, 22 nt, Human
cucugaaacuccagccccaggu

SEQ ID NO: 5251 - RNA, 22 nt, Human
cucugaaagcaaaacuagagaa

SEQ ID NO: 5252 - RNA, 22 nt, Human
cucugaaaguuagagaaaauag

SEQ ID NO: 5253 - RNA, 22 nt, Human
gcaguacacacauauguauucg

SEQ ID NO: 5254 - RNA, 22 nt, Human
gcaguagugucaguacagcaaa

SEQ ID NO: 5255 - RNA, 22 nt, Human
gcaguauacacugauacaugag

SEQ ID NO: 5256 - RNA, 22 nt, Human
gcaguaugaguguuuuagacau

SEQ ID NO: 5257 - RNA, 22 nt, Human
gcagucaucaguccuuuaauua

SEQ ID NO: 5258 - RNA, 22 nt, Human
gcaguccaaaguggcucucacc

SEQ ID NO: 5259 - RNA, 22 nt, Human
gcaguccauugacagaggucuu

SEQ ID NO: 5260 - RNA, 22 nt, Human
gcagucccauaucuuuaacaua

SEQ ID NO: 5261 - RNA, 22 nt, Human
gcaguccuguagcgacuuuuuu

SEQ ID NO: 5262 - RNA, 22 nt, Human
gcagucuauaaaucagcuuugc

SEQ ID NO: 5263 - RNA, 22 nt, Human
gcagucuaucuugugauuuaac

SEQ ID NO: 5264 - RNA, 22 nt, Human
gcagucucucaggauuuaagcu

SEQ ID NO: 5265 - RNA, 18 nt, Human
gcagucucucuggucuuc

SEQ ID NO: 5266 - RNA, 20 nt, Human
gcagucugccucuguguggu

SEQ ID NO: 5267 - RNA, 22 nt, Human
gcagucuuugaaugugaaauag

SEQ ID NO: 5268 - RNA, 22 nt, Human
gcagugaguuaugaucaugcca

SEQ ID NO: 5269 - RNA, 22 nt, Human
gcagugauuggaucagagaugg

SEQ ID NO: 5270 - RNA, 21 nt, Human
gcagugcagcuuggaggguag

SEQ ID NO: 5271 - RNA, 22 nt, Human
gcagugcaggaacauagcuucu

SEQ ID NO: 5272 - RNA, 22 nt, Human
gcagugcaugucggaacucauu

SEQ ID NO: 5273 - RNA, 22 nt, Human
gcagugccuugcuucucugucu

SEQ ID NO: 5274 - RNA, 22 nt, Human
gcagugcuaaggauucugccuu

SEQ ID NO: 5275 - RNA, 22 nt, Human
gcagugcugagaggugaucgga

SEQ ID NO: 5276 - RNA, 22 nt, Human
gcagugcuuuagucuguccuuu

SEQ ID NO: 5277 - RNA, 23 nt, Human
gcaguggaaugucucuguuugga

SEQ ID NO: 5278 - RNA, 22 nt, Human
gcaguggauccaaugguaucuu

SEQ ID NO: 5279 - RNA, 22 nt, Human
gcaguggcaccgcuggcucugg

SEQ ID NO: 5280 - RNA, 22 nt, Human
gcaguggcuaagcucgcaugca

SEQ ID NO: 5281 - RNA, 22 nt, Human
gcagugggagcuuaggcagugc

SEQ ID NO: 5282 - RNA, 22 nt, Human
gcaguggggcgcugggaguugg

SEQ ID NO: 5283 - RNA, 22 nt, Human
gcagugguccaguucacaccca

SEQ ID NO: 5284 - RNA, 22 nt, Human
gcaguggugggacaguggaaaa

SEQ ID NO: 5285 - RNA, 22 nt, Human
gcagugucagugccuggguggu

SEQ ID NO: 5286 - RNA, 19 nt, Human
gcagugucaugguaggagc

SEQ ID NO: 5287 - RNA, 22 nt, Human
gcagugugacgcuguucuccgu

SEQ ID NO: 5288 - RNA, 22 nt, Human
gcagugugcauggcuuuuggcc

SEQ ID NO: 5289 - RNA, 22 nt, Human
gcaguguguggugagggcugcc

SEQ ID NO: 5290 - RNA, 22 nt, Human
gcaguguuaaugcgaguguuca

SEQ ID NO: 5291 - RNA, 22 nt, Human
gcaguguuaccucuucaguggg

SEQ ID NO: 5292 - RNA, 22 nt, Human
gcaguguuaccuugggcugguu

SEQ ID NO: 5293 - RNA, 22 nt, Human
gcaguguuauguuuucuauaau

SEQ ID NO: 5294 - RNA, 22 nt, Human
gcaguguuccuucuacuggggc

SEQ ID NO: 5295 - RNA, 22 nt, Human
gcaguguugacuaugguaugag

SEQ ID NO: 5296 - RNA, 22 nt, Human
gcaguguugagccagcuggggg

SEQ ID NO: 5297 - RNA, 22 nt, Human
gcaguguugagugguggcugaa

SEQ ID NO: 5298 - RNA, 22 nt, Human
gcaguguuggcaggauggggcu

SEQ ID NO: 5299 - RNA, 22 nt, Human
gcaguguugguuugcucugcag

SEQ ID NO: 5300 - RNA, 22 nt, Human
gcaguguugugauccaggucuu

SEQ ID NO: 5301 - RNA, 22 nt, Human
gcaguguuucagugcuuuuucu

SEQ ID NO: 5302 - RNA, 23 nt, Human
gcaguguuugcuucaucuuaucc

SEQ ID NO: 5303 - RNA, 22 nt, Human
gcaguguuuuacagaccagcau

SEQ ID NO: 5304 - RNA, 21 nt, Human
gcaguuaauagcagagcacac

SEQ ID NO: 5305 - RNA, 22 nt, Human
gcaguuccuacaguggaaagcg

SEQ ID NO: 5306 - RNA, 22 nt, Human
gcaguucuacuuauccauagac

SEQ ID NO: 5307 - RNA, 22 nt, Human
gcaguuguaauaugaugugagg

SEQ ID NO: 5308 - RNA, 22 nt, Human
gcaguuuacugucaauaacucu

SEQ ID NO: 5309 - RNA, 22 nt, Human
gcauaaaugugcacacacaugu

SEQ ID NO: 5310 - RNA, 22 nt, Human
gcauaacaacagacucuguguu

SEQ ID NO: 5311 - RNA, 18 nt, Human
gcauacagaggggaagua

SEQ ID NO: 5312 - RNA, 22 nt, Human
gcauaggccacuagugccagga

SEQ ID NO: 5313 - RNA, 22 nt, Human
gcauauuaguaaucuuucaaca

SEQ ID NO: 5314 - RNA, 20 nt, Human
gcaucaagguacgcucucca

SEQ ID NO: 5315 - RNA, 19 nt, Human
gcaucauuugucucuucuu

SEQ ID NO: 5316 - RNA, 22 nt, Human
gcauccaggacuauaugaugau

SEQ ID NO: 5317 - RNA, 17 nt, Human
gcauccaguaacaugcc

SEQ ID NO: 5318 - RNA, 22 nt, Human
gcauccucccggugcugcuggc

SEQ ID NO: 5319 - RNA, 22 nt, Human
gcauccucugagagcucuagau

SEQ ID NO: 5320 - RNA, 22 nt, Human
gcaucucuacaacgaagacagu

SEQ ID NO: 5321 - RNA, 22 nt, Human
gcaucucuuacccacgagccag

SEQ ID NO: 5322 - RNA, 22 nt, Human
gcaucuuuagccucuccguggc

SEQ ID NO: 5323 - RNA, 22 nt, Human
gcaucuuucuguccauucagca

SEQ ID NO: 5324 - RNA, 22 nt, Human
gcaugagacuagcucaugagca

SEQ ID NO: 5325 - RNA, 22 nt, Human
gcaugagguucuuggccagcau

SEQ ID NO: 5326 - RNA, 22 nt, Human
gcaugauagcuaacuccccuca

SEQ ID NO: 5327 - RNA, 22 nt, Human
gcaugcaaucuauccuuaggaa

SEQ ID NO: 5328 - RNA, 22 nt, Human
gcaugcacggggcauaugggac

SEQ ID NO: 5329 - RNA, 22 nt, Human
gcaugcaggaagggcuugggga

SEQ ID NO: 5330 - RNA, 22 nt, Human
gcaugcagggagggucuggcug

SEQ ID NO: 5331 - RNA, 22 nt, Human
gcaugcaugugugcagacaguc

SEQ ID NO: 5332 - RNA, 22 nt, Human
gcaugcauuucacuagguaugu

SEQ ID NO: 5333 - RNA, 22 nt, Human
gcaugcauuuccauucucacau

SEQ ID NO: 5334 - RNA, 22 nt, Human
gcaugcugcagggaaugcuugu

SEQ ID NO: 5335 - RNA, 22 nt, Human
gcaugcugcugaggcuggaaua

SEQ ID NO: 5336 - RNA, 22 nt, Human
cucuuauuuuauggcauuugug

SEQ ID NO: 5337 - RNA, 22 nt, Human
cucuucaacugccaggcagucu

SEQ ID NO: 5338 - RNA, 22 nt, Human
cucuucaauagauuguugaggg

SEQ ID NO: 5339 - RNA, 22 nt, Human
cucuucaggauggcuugugaug

SEQ ID NO: 5340 - RNA, 21 nt, Human
cucuucaguggugagcucuuc

SEQ ID NO: 5341 - RNA, 22 nt, Human
cucuucaguucaccccuaagca

SEQ ID NO: 5342 - RNA, 22 nt, Human
cucuucauguguuuaauuuuua

SEQ ID NO: 5343 - RNA, 22 nt, Human
cucuucauuaguuccuguccca

SEQ ID NO: 5344 - RNA, 22 nt, Human
cucuuccaccuccuucaggaga

SEQ ID NO: 5345 - RNA, 22 nt, Human
cucuucuuggaaugcugacugu

SEQ ID NO: 5346 - RNA, 22 nt, Human
cucuugaagcaggggccaguuc

SEQ ID NO: 5347 - RNA, 21 nt, Human
cucuugaaugcuugauaagau

SEQ ID NO: 5348 - RNA, 22 nt, Human
cucuugaguggcaugcucuaac

SEQ ID NO: 5349 - RNA, 22 nt, Human
cucuugcagauaccuugaagga

SEQ ID NO: 5350 - RNA, 22 nt, Human
cucuugggagugcucuggagaa

SEQ ID NO: 5351 - RNA, 19 nt, Human
cucuuggguggcagaggcc

SEQ ID NO: 5352 - RNA, 22 nt, Human
cucuuuaaaguaaaauuugucu

SEQ ID NO: 5353 - RNA, 22 nt, Human
cucuuuaagcuccuaacagcca

SEQ ID NO: 5354 - RNA, 20 nt, Human
cucuuuacaugucucuuccu

SEQ ID NO: 5355 - RNA, 17 nt, Human
cucuuuauaaagaguua

SEQ ID NO: 5356 - RNA, 22 nt, Human
cucuuuccucgaugggcuccug

SEQ ID NO: 5357 - RNA, 22 nt, Human
cucuuugacgugcccauguccc

SEQ ID NO: 5358 - RNA, 20 nt, Human
cucuuugcaaugcagaagac

SEQ ID NO: 5359 - RNA, 22 nt, Human
cucuuugccuaacuguuuucaa

SEQ ID NO: 5360 - RNA, 22 nt, Human
cucuuuggauagaauuacaaag

SEQ ID NO: 5361 - RNA, 16 nt, Human
cucuuugggcuuccag

SEQ ID NO: 5362 - RNA, 22 nt, Human
cucuuuggggcuggaagccuag

SEQ ID NO: 5363 - RNA, 22 nt, Human
cucuuuggggugccccacuggu

SEQ ID NO: 5364 - RNA, 22 nt, Human
cucuuuggucgcaucauccauu

SEQ ID NO: 5365 - RNA, 22 nt, Human
cucuuuguggccaccuaaucuu

SEQ ID NO: 5366 - RNA, 22 nt, Human
cugaaguuuugacaucucauuu

SEQ ID NO: 5367 - RNA, 22 nt, Human
cugaauaauacagacuagcuuc

SEQ ID NO: 5368 - RNA, 22 nt, Human
cugaauaauauuccauuaugag

SEQ ID NO: 5369 - RNA, 22 nt, Human
cugaauaucauuuacauuugga

SEQ ID NO: 5370 - RNA, 22 nt, Human
cugaaucauggucauuaguuua

SEQ ID NO: 5371 - RNA, 22 nt, Human
cugaaugaaugguuugucuuau

SEQ ID NO: 5372 - RNA, 22 nt, Human
cugaaugaggaaaagagugagg

SEQ ID NO: 5373 - RNA, 22 nt, Human
cugaaugaguggauuuuucauu

SEQ ID NO: 5374 - RNA, 22 nt, Human
cugaaugucgaucagcuugggu

SEQ ID NO: 5375 - RNA, 22 nt, Human
cugaauuaauacacagaauggc

SEQ ID NO: 5376 - RNA, 22 nt, Human
cugacaaaggcaaggcaggggg

SEQ ID NO: 5377 - RNA, 22 nt, Human
cugacagcgagagaguugcccc

SEQ ID NO: 5378 - RNA, 22 nt, Human
cugacagcuccuagugcucacu

SEQ ID NO: 5379 - RNA, 22 nt, Human
cugacaguuuuugcuguauugu

SEQ ID NO: 5380 - RNA, 22 nt, Human
cugaccaacauggugaaaccuu

SEQ ID NO: 5381 - RNA, 22 nt, Human
cugaccagcccugcccagggaa

SEQ ID NO: 5382 - RNA, 22 nt, Human
cugacccuagcaucucugugca

SEQ ID NO: 5383 - RNA, 22 nt, Human
cugacccuggucaaguugccuc

SEQ ID NO: 5384 - RNA, 22 nt, Human
cugacccuugcucgggcccugu

SEQ ID NO: 5385 - RNA, 18 nt, Human
cugacccuuuuacauucc

SEQ ID NO: 5386 - RNA, 22 nt, Human
cugaccugcggggaggagggcc

SEQ ID NO: 5387 - RNA, 22 nt, Human
cugacucacuguggcucuuaau

SEQ ID NO: 5388 - RNA, 22 nt, Human
cugacucagcagcugaugaucc

SEQ ID NO: 5389 - RNA, 22 nt, Human
cugacucccuccccaaagcugg

SEQ ID NO: 5390 - RNA, 22 nt, Human
cugacuccuuaccauaugcuuu

SEQ ID NO: 5391 - RNA, 22 nt, Human
cugacucuccugagauggggag

SEQ ID NO: 5392 - RNA, 22 nt, Human
cugacucugacaggacuugugg

SEQ ID NO: 5393 - RNA, 22 nt, Human
cugacugucucuucucccauga

SEQ ID NO: 5394 - RNA, 22 nt, Human
cugagaaaagcuuucuuauaca

SEQ ID NO: 5395 - RNA, 22 nt, Human
cugagaaaaguaugagcucugg

SEQ ID NO: 5396 - RNA, 22 nt, Human
cugagaaaugcauuuuuccagc

SEQ ID NO: 5397 - RNA, 22 nt, Human
cugagaaggaagccuccacucu

SEQ ID NO: 5398 - RNA, 22 nt, Human
cugagaauaaagccagcaggag

SEQ ID NO: 5399 - RNA, 22 nt, Human
cugagacccagacaccugagga

SEQ ID NO: 5400 - RNA, 22 nt, Human
cugagagguaagcagcgcagug

SEQ ID NO: 5401 - RNA, 22 nt, Human
cugagagguaaucacacaaaau

SEQ ID NO: 5402 - RNA, 22 nt, Human
cugagaguaauuuucuacuuga

SEQ ID NO: 5403 - RNA, 22 nt, Human
cugagagugcucuuugauguca

SEQ ID NO: 5404 - RNA, 22 nt, Human
cugagauacuguggcgaaugca

SEQ ID NO: 5405 - RNA, 22 nt, Human
cugagaucuuuauacgaggcac

SEQ ID NO: 5406 - RNA, 23 nt, Human
cugagcacagcucugugggccuc

SEQ ID NO: 5407 - RNA, 22 nt, Human
cugagcaccuguuauagguuag

SEQ ID NO: 5408 - RNA, 22 nt, Human
cugagcacguaguuagggucca

SEQ ID NO: 5409 - RNA, 22 nt, Human
cugagcacugggcacauagcug

SEQ ID NO: 5410 - RNA, 22 nt, Human
cugagcagaggucaagauacuu

SEQ ID NO: 5411 - RNA, 22 nt, Human
cugagcagcaacccagagccuc

SEQ ID NO: 5412 - RNA, 22 nt, Human
cugagcagcaauugcuggccca

SEQ ID NO: 5413 - RNA, 22 nt, Human
cugagcagcucccugagugguc

SEQ ID NO: 5414 - RNA, 22 nt, Human
cugagcaggacagugggagacc

SEQ ID NO: 5415 - RNA, 19 nt, Human
cugagcaggcagguaggau

SEQ ID NO: 5416 - RNA, 22 nt, Human
cugagcagggaccaaaagcauu

SEQ ID NO: 5417 - RNA, 22 nt, Human
cugagcagucugacucaagcua

SEQ ID NO: 5418 - RNA, 22 nt, Human
cugagcagugguucuugagcgc

SEQ ID NO: 5419 - RNA, 22 nt, Human
cugagcaucauggcagaaucuu

SEQ ID NO: 5420 - RNA, 22 nt, Human
cugagcaugcuacaugcagcac

SEQ ID NO: 5421 - RNA, 22 nt, Human
cugagccacugcuuguucagug

SEQ ID NO: 5422 - RNA, 22 nt, Human
cugagccagagggagucggguc

SEQ ID NO: 5423 - RNA, 22 nt, Human
cugagccagcgggcucacuuuu

SEQ ID NO: 5424 - RNA, 22 nt, Human
cugagccaguagucagggacaa

SEQ ID NO: 5425 - RNA, 22 nt, Human
cugagccaugggucuaagcacu

SEQ ID NO: 5426 - RNA, 20 nt, Human
cugagcccagaucccagguc

SEQ ID NO: 5427 - RNA, 22 nt, Human
cugagcccucuguuuucccucu

SEQ ID NO: 5428 - RNA, 22 nt, Human
cugagcccugccucuugucacu

SEQ ID NO: 5429 - RNA, 22 nt, Human
cugagccuuauucaccagcccu

SEQ ID NO: 5430 - RNA, 22 nt, Human
cugagcugaaacuugagaggcu

SEQ ID NO: 5431 - RNA, 22 nt, Human
cugagcugguggaagcaugcag

SEQ ID NO: 5432 - RNA, 22 nt, Human
cugagcuguuuaaucccagaua

SEQ ID NO: 5433 - RNA, 22 nt, Human
cugagcuucagugcacugggag

SEQ ID NO: 5434 - RNA, 22 nt, Human
cugagcuuggcuuaucuccagc

SEQ ID NO: 5435 - RNA, 22 nt, Human
cugaggaagacagcagcugugu

SEQ ID NO: 5436 - RNA, 22 nt, Human
cugaggaaggcugggggcaucc

SEQ ID NO: 5437 - RNA, 22 nt, Human
cugaggacauugaugaggcaau

SEQ ID NO: 5438 - RNA, 22 nt, Human
cugaggagacagaagccaaaua

SEQ ID NO: 5439 - RNA, 22 nt, Human
cugaggagagaucacguggugu

SEQ ID NO: 5440 - RNA, 22 nt, Human
cugaggagauccccccagaagu

SEQ ID NO: 5441 - RNA, 22 nt, Human
cugaggaggcuaauuugaggau

SEQ ID NO: 5442 - RNA, 22 nt, Human
cugaggagggaaguccccaaag

SEQ ID NO: 5443 - RNA, 22 nt, Human
cugaggaguuggugaauaagcc

SEQ ID NO: 5444 - RNA, 22 nt, Human
cugaggaguuuggguuguucaa

SEQ ID NO: 5445 - RNA, 22 nt, Human
cugcaggacgaccgccucaucu

SEQ ID NO: 5446 - RNA, 22 nt, Human
cugcaggagcaaagccucugcu

SEQ ID NO: 5447 - RNA, 22 nt, Human
cugcaggauucucccaguugga

SEQ ID NO: 5448 - RNA, 22 nt, Human
cugcagggaccacaagcagguu

SEQ ID NO: 5449 - RNA, 22 nt, Human
cugcagggacccaagucuuugg

SEQ ID NO: 5450 - RNA, 22 nt, Human
cugcagggagcagauggcgugu

SEQ ID NO: 5451 - RNA, 22 nt, Human
cugcagggcagggccuccuggc

SEQ ID NO: 5452 - RNA, 22 nt, Human
cugcagggcauuguaacucuuu

SEQ ID NO: 5453 - RNA, 22 nt, Human
cugcagggugacguugcccacc

SEQ ID NO: 5454 - RNA, 22 nt, Human
cugcaggguuucgccaguugug

SEQ ID NO: 5455 - RNA, 22 nt, Human
cugcaggucucugugugcauuc

SEQ ID NO: 5456 - RNA, 22 nt, Human
cugcaguaaccacuguaggugu

SEQ ID NO: 5457 - RNA, 22 nt, Human
cugcaguaacgaucauggugcc

SEQ ID NO: 5458 - RNA, 22 nt, Human
cugcaguacaagaagcaucucu

SEQ ID NO: 5459 - RNA, 22 nt, Human
cugcaguaucuuaaaauuugua

SEQ ID NO: 5460 - RNA, 22 nt, Human
cugcagucaucugaagauuuug

SEQ ID NO: 5461 - RNA, 22 nt, Human
cugcagucuuccuuccuuaggc

SEQ ID NO: 5462 - RNA, 22 nt, Human
cugcagugaaaucaggaagcaa

SEQ ID NO: 5463 - RNA, 22 nt, Human
cugcagugaggauucuuaggug

SEQ ID NO: 5464 - RNA, 22 nt, Human
cugcagugccugccacugagcc

SEQ ID NO: 5465 - RNA, 22 nt, Human
cugcaguucuuuggcuuuuaga

SEQ ID NO: 5466 - RNA, 22 nt, Human
cugcaguugacucccuguuugc

SEQ ID NO: 5467 - RNA, 22 nt, Human
cugcaguugguggguccucggu

SEQ ID NO: 5468 - RNA, 22 nt, Human
cugcaguuucagccuuucuggc

SEQ ID NO: 5469 - RNA, 22 nt, Human
cugcauaucaaauuacuccugg

SEQ ID NO: 5470 - RNA, 22 nt, Human
cugcaucacagcaggaggcaca

SEQ ID NO: 5471 - RNA, 22 nt, Human
cugcaucacucuuacuggcuuu

SEQ ID NO: 5472 - RNA, 22 nt, Human
cugcaucauaaaauuuagaguu

SEQ ID NO: 5473 - RNA, 22 nt, Human
cugcaucauuggugauucagga

SEQ ID NO: 5474 - RNA, 22 nt, Human
cugcauccuaaccuccaugcag

SEQ ID NO: 5475 - RNA, 22 nt, Human
cugcauccuggaaauagcuaag

SEQ ID NO: 5476 - RNA, 21 nt, Human
cugcaucucauagaacauguc

SEQ ID NO: 5477 - RNA, 21 nt, Human
cugcaucugagucauuaugcc

SEQ ID NO: 5478 - RNA, 22 nt, Human
cugcaucugcauaaucaacuuc

SEQ ID NO: 5479 - RNA, 22 nt, Human
cugcaucuuagucaaaaucugu

SEQ ID NO: 5480 - RNA, 22 nt, Human
cugcaugguucaaaugagcuaa

SEQ ID NO: 5481 - RNA, 22 nt, Human
cugcauguguuucugcuggguu

SEQ ID NO: 5482 - RNA, 22 nt, Human
cugcauguuuacauuuuugaga

SEQ ID NO: 5483 - RNA, 22 nt, Human
cucuuuuaauugucauaacaac

SEQ ID NO: 5484 - RNA, 22 nt, Human
cucuuuuacaccaaaaggccua

SEQ ID NO: 5485 - RNA, 22 nt, Human
cucuuuuagagaugaaaauugg

SEQ ID NO: 5486 - RNA, 17 nt, Human
cucuuuugucuucuucc

SEQ ID NO: 5487 - RNA, 22 nt, Human
cucuuuuucaccucugucagcg

SEQ ID NO: 5488 - RNA, 22 nt, Human
cucuuuuucagccuuaccaaag

SEQ ID NO: 5489 - RNA, 19 nt, Human
cugaaaaacauucucagga

SEQ ID NO: 5490 - RNA, 22 nt, Human
cugaaaauguuacacaggaaga

SEQ ID NO: 5491 - RNA, 22 nt, Human
cugaaaauguuagugauacgaa

SEQ ID NO: 5492 - RNA, 19 nt, Human
cugaaacacagagagggcu

SEQ ID NO: 5493 - RNA, 22 nt, Human
cugaaacuacaguaaggagaac

SEQ ID NO: 5494 - RNA, 22 nt, Human
cugaaacuauggggaggggagc

SEQ ID NO: 5495 - RNA, 22 nt, Human
cugaaacuccaugagaaauugc

SEQ ID NO: 5496 - RNA, 20 nt, Human
cugaaaggagucgggauguc

SEQ ID NO: 5497 - RNA, 22 nt, Human
cugaaagguauaaauaagacuu

SEQ ID NO: 5498 - RNA, 17 nt, Human
cugaaauauuaugauaa

SEQ ID NO: 5499 - RNA, 22 nt, Human
cugaaauuccauuucagccaca

SEQ ID NO: 5500 - RNA, 22 nt, Human
cugaaauucugccucugcacaa

SEQ ID NO: 5501 - RNA, 22 nt, Human
cugaacaguacuuggccaguuu

SEQ ID NO: 5502 - RNA, 22 nt, Human
cugaacauucuugaacaucugu

SEQ ID NO: 5503 - RNA, 20 nt, Human
cugaaccaaggcuuucucag

SEQ ID NO: 5504 - RNA, 15 nt, Human
cugaacucuaaacca

SEQ ID NO: 5505 - RNA, 22 nt, Human
cugaacuuauugagugcuugcu

SEQ ID NO: 5506 - RNA, 22 nt, Human
cugaagaagucucuaggcuauu

SEQ ID NO: 5507 - RNA, 22 nt, Human
cugaagaauagcaggugggcac

SEQ ID NO: 5508 - RNA, 22 nt, Human
cugaagaaugacagugcuuuga

SEQ ID NO: 5509 - RNA, 18 nt, Human
cugaagacaaaaugucca

SEQ ID NO: 5510 - RNA, 22 nt, Human
cugaagagcaaaccaacuggac

SEQ ID NO: 5511 - RNA, 22 nt, Human
cugaagauuuuugguaaucaug

SEQ ID NO: 5512 - RNA, 23 nt, Human
cugaagcaauauccccucacuuc

SEQ ID NO: 5513 - RNA, 22 nt, Human
cugaagcaggccuacuucauug

SEQ ID NO: 5514 - RNA, 22 nt, Human
cugaagcaugcguuuguaaacu

SEQ ID NO: 5515 - RNA, 22 nt, Human
cugaagccaugugcucacuggu

SEQ ID NO: 5516 - RNA, 22 nt, Human
cugaagcuuaguuuacgcucca

SEQ ID NO: 5517 - RNA, 22 nt, Human
cugaaggacuuggugauaguug

SEQ ID NO: 5518 - RNA, 22 nt, Human
cugaaggagcauagucaguuuu

SEQ ID NO: 5519 - RNA, 22 nt, Human
cugaaggagguagagugacaua

SEQ ID NO: 5520 - RNA, 22 nt, Human
cugaaggauucaaaauggcagg

SEQ ID NO: 5521 - RNA, 18 nt, Human
cugaaggcaccagggcag

SEQ ID NO: 5522 - RNA, 22 nt, Human
cugaaggcauuuuugcugauuu

SEQ ID NO: 5523 - RNA, 22 nt, Human
cugaaggggguuucacugagcu

SEQ ID NO: 5524 - RNA, 22 nt, Human
cugaagucauacacuguucuga

SEQ ID NO: 5525 - RNA, 22 nt, Human
cugaagucccuguuuuguuuac

SEQ ID NO: 5526 - RNA, 19 nt, Human
cugaagucuuuucagcugg

SEQ ID NO: 5527 - RNA, 22 nt, Human
cugaaguuauuguacaaauuug

SEQ ID NO: 5528 - RNA, 22 nt, Human
cugaaguuucgagauggaugug

SEQ ID NO: 5529 - RNA, 22 nt, Human
cugaauaauguucucuuguaug

SEQ ID NO: 5530 - RNA, 22 nt, Human
cugaauggaaucaucccugcuu

SEQ ID NO: 5531 - RNA, 22 nt, Human
cugaauggcgaguuaguuaguu

SEQ ID NO: 5532 - RNA, 22 nt, Human
cugaauuacuuauuagugggga

SEQ ID NO: 5533 - RNA, 22 nt, Human
cugaauuagaugaaaaaggcuc

SEQ ID NO: 5534 - RNA, 22 nt, Human
cugacagcaaaggccaguggcu

SEQ ID NO: 5535 - RNA, 22 nt, Human
cugacagccauguuuuagagaa

SEQ ID NO: 5536 - RNA, 19 nt, Human
cugacagcgccugauaaga

SEQ ID NO: 5537 - RNA, 22 nt, Human
cugacagcugaagggucccaga

SEQ ID NO: 5538 - RNA, 22 nt, Human
cugacagcugcugccgccgcau

SEQ ID NO: 5539 - RNA, 22 nt, Human
cugacaguguacacugacagcu

SEQ ID NO: 5540 - RNA, 20 nt, Human
cugacccaaucucugucccc

SEQ ID NO: 5541 - RNA, 22 nt, Human
cugacccauauaagaguggagg

SEQ ID NO: 5542 - RNA, 22 nt, Human
cugacccuuaaugagcaaguaa

SEQ ID NO: 5543 - RNA, 23 nt, Human
cugaccugacccauaagcaagga

SEQ ID NO: 5544 - RNA, 22 nt, Human
cugaccugagugguacaaggca

SEQ ID NO: 5545 - RNA, 22 nt, Human
cugaccuguaacuguaagagac

SEQ ID NO: 5546 - RNA, 22 nt, Human
cugacucccaagcuagugcucu

SEQ ID NO: 5547 - RNA, 22 nt, Human
cugacugugagagcaggaaugg

SEQ ID NO: 5548 - RNA, 22 nt, Human
cugacuguugcuguugaugagg

SEQ ID NO: 5549 - RNA, 22 nt, Human
cugacuguuugcugaaaggucu

SEQ ID NO: 5550 - RNA, 22 nt, Human
cugacuuugacuuggucauuga

SEQ ID NO: 5551 - RNA, 22 nt, Human
cugacuuuuccaaauaauacuu

SEQ ID NO: 5552 - RNA, 22 nt, Human
cugacuuuuuucagccacagug

SEQ ID NO: 5553 - RNA, 22 nt, Human
cugagaaacauauuuccaucua

SEQ ID NO: 5554 - RNA, 22 nt, Human
cugcaucuguuagauuaucacc

SEQ ID NO: 5555 - RNA, 22 nt, Human
cugcaugucacucugcuguccc

SEQ ID NO: 5556 - RNA, 20 nt, Human
cugcauguuggagguguacc

SEQ ID NO: 5557 - RNA, 22 nt, Human
cugcauguuuucuuaauuguga

SEQ ID NO: 5558 - RNA, 22 nt, Human
cugcauuaaguugccuguaaga

SEQ ID NO: 5559 - RNA, 22 nt, Human
cugcauuacuaacaaacuccca

SEQ ID NO: 5560 - RNA, 22 nt, Human
cugcauuauuggggccuguuuc

SEQ ID NO: 5561 - RNA, 22 nt, Human
cugccacuagcuuucacaucuu

SEQ ID NO: 5562 - RNA, 22 nt, Human
cugccacuuacuaggcauggug

SEQ ID NO: 5563 - RNA, 22 nt, Human
cugccacuuuggagugcucaga

SEQ ID NO: 5564 - RNA, 22 nt, Human
cugccagacacguuaugcucau

SEQ ID NO: 5565 - RNA, 22 nt, Human
cugccagagaucugggcagagu

SEQ ID NO: 5566 - RNA, 22 nt, Human
cugccagcaagcuacccuggca

SEQ ID NO: 5567 - RNA, 22 nt, Human
cugccagcuagcuccuaguuga

SEQ ID NO: 5568 - RNA, 22 nt, Human
cugccagcucaccggcucagac

SEQ ID NO: 5569 - RNA, 22 nt, Human
cugccagcucgccacaaugaca

SEQ ID NO: 5570 - RNA, 22 nt, Human
cugccaggcagggagauggcug

SEQ ID NO: 5571 - RNA, 22 nt, Human
cugccagggcauccuguggugg

SEQ ID NO: 5572 - RNA, 22 nt, Human
cugccagggcccuacucaguuu

SEQ ID NO: 5573 - RNA, 22 nt, Human
cugccaggugccagggcgcggc

SEQ ID NO: 5574 - RNA, 22 nt, Human
cugccauccacggcccacucau

SEQ ID NO: 5575 - RNA, 22 nt, Human
cugccaucugagccaaaagugc

SEQ ID NO: 5576 - RNA, 22 nt, Human
cugccaugcucaagaagucuuu

SEQ ID NO: 5577 - RNA, 22 nt, Human
cugcccacacucauggggaagg

SEQ ID NO: 5578 - RNA, 22 nt, Human
cugcccaccccgaggcaggaag

SEQ ID NO: 5579 - RNA, 22 nt, Human
cugcccagaagcuuagagcuua

SEQ ID NO: 5580 - RNA, 18 nt, Human
cugcccagagcacuugug

SEQ ID NO: 5581 - RNA, 22 nt, Human
cugcccagauuuuaccaccugc

SEQ ID NO: 5582 - RNA, 22 nt, Human
cugcccauaaacuuuccaccug

SEQ ID NO: 5583 - RNA, 23 nt, Human
cugccccaauuauaaaagaagau

SEQ ID NO: 5584 - RNA, 22 nt, Human
cugccccagccuggggccuucu

SEQ ID NO: 5585 - RNA, 22 nt, Human
cugccccaggaccucuucugga

SEQ ID NO: 5586 - RNA, 22 nt, Human
cugcccccaggcugcauggcug

SEQ ID NO: 5587 - RNA, 22 nt, Human
cugccccucgaccaagcgcguc

SEQ ID NO: 5588 - RNA, 22 nt, Human
cugccccugccaggcagcuguc

SEQ ID NO: 5589 - RNA, 22 nt, Human
cugcccgucccuuugcucucgc

SEQ ID NO: 5590 - RNA, 21 nt, Human
cugcccuagauggcucuggaa

SEQ ID NO: 5591 - RNA, 22 nt, Human
cugcccugaccugccucagagu

SEQ ID NO: 5592 - RNA, 22 nt, Human
cugcccugacugaccuuuugaa

SEQ ID NO: 5593 - RNA, 22 nt, Human
cugcccugagucaugccagaug

SEQ ID NO: 5594 - RNA, 22 nt, Human
cugcccugauaugauuuagaac

SEQ ID NO: 5595 - RNA, 22 nt, Human
cugcccugccuggccagugugg

SEQ ID NO: 5596 - RNA, 22 nt, Human
cugcccugcucuccgggaucuu

SEQ ID NO: 5597 - RNA, 22 nt, Human
cugcccugcuuguuuccagugg

SEQ ID NO: 5598 - RNA, 22 nt, Human
cugcccuggaaaacguaucuua

SEQ ID NO: 5599 - RNA, 22 nt, Human
cugcccuggucccauggcugau

SEQ ID NO: 5600 - RNA, 22 nt, Human
cugcccugucugcagccuggcu

SEQ ID NO: 5601 - RNA, 22 nt, Human
cugcccugucuuuuucugauga

SEQ ID NO: 5602 - RNA, 22 nt, Human
cugcccugugcacaggaaacug

SEQ ID NO: 5603 - RNA, 20 nt, Human
cugccgaccacagccaugga

SEQ ID NO: 5604 - RNA, 22 nt, Human
cugccucagccuucugggugac

SEQ ID NO: 5605 - RNA, 22 nt, Human
cugccucagcguuguggcccua

SEQ ID NO: 5606 - RNA, 22 nt, Human
cugccuccaggcucaccuugac

SEQ ID NO: 5607 - RNA, 22 nt, Human
cugccuccuggcugauggguag

SEQ ID NO: 5608 - RNA, 22 nt, Human
cugccucucagccugaccgcca

SEQ ID NO: 5609 - RNA, 22 nt, Human
cugccucugguuuuggucccug

SEQ ID NO: 5610 - RNA, 22 nt, Human
cugccugacugauaaucucuga

SEQ ID NO: 5611 - RNA, 22 nt, Human
cugccugcacugccuggcucca

SEQ ID NO: 5612 - RNA, 22 nt, Human
cugccugcaggacaccucgcua

SEQ ID NO: 5613 - RNA, 22 nt, Human
gccuggaggaauguagcugagg

SEQ ID NO: 5614 - RNA, 20 nt, Human
gccuggaggcaaugggaaga

SEQ ID NO: 5615 - RNA, 22 nt, Human
gccuggaggcgagaacccaaug

SEQ ID NO: 5616 - RNA, 22 nt, Human
gccuggagggucccucucugga

SEQ ID NO: 5617 - RNA, 23 nt, Human
gccuggauuaaggcagugacuuc

SEQ ID NO: 5618 - RNA, 22 nt, Human
gccuggcacaguagggacccaa

SEQ ID NO: 5619 - RNA, 22 nt, Human
gccuggcacauugcaguggauu

SEQ ID NO: 5620 - RNA, 22 nt, Human
gccuggcaggaaucucagugcu

SEQ ID NO: 5621 - RNA, 22 nt, Human
gccuggcauauaguaguugugc

SEQ ID NO: 5622 - RNA, 22 nt, Human
gccuggcauuggagccggggca

SEQ ID NO: 5623 - RNA, 22 nt, Human
gccuggcuaagcagaaggaccc

SEQ ID NO: 5624 - RNA, 22 nt, Human
gccuggcugccggccuuggcaa

SEQ ID NO: 5625 - RNA, 22 nt, Human
gccuggcugcuagccagaggca

SEQ ID NO: 5626 - RNA, 22 nt, Human
gccuggcugggcaccaggggag

SEQ ID NO: 5627 - RNA, 22 nt, Human
gccuggcuggucacugccuggc

SEQ ID NO: 5628 - RNA, 22 nt, Human
gccuggcugucuggcaagguuc

SEQ ID NO: 5629 - RNA, 21 nt, Human
gccuggcuucacaggcacuga

SEQ ID NO: 5630 - RNA, 22 nt, Human
gccuggcuuggggcucaguggu

SEQ ID NO: 5631 - RNA, 22 nt, Human
gccugggacccuuagcucuugg

SEQ ID NO: 5632 - RNA, 18 nt, Human
gccugggagaaguuucac

SEQ ID NO: 5633 - RNA, 22 nt, Human
gccugggagaaugaccuccaac

SEQ ID NO: 5634 - RNA, 22 nt, Human
gccugggagaugcguuguggcc

SEQ ID NO: 5635 - RNA, 22 nt, Human
gccugggagauuaauuaggaag

SEQ ID NO: 5636 - RNA, 19 nt, Human
gccugggaugggcagaacu

SEQ ID NO: 5637 - RNA, 20 nt, Human
gccugggauuauccacuggu

SEQ ID NO: 5638 - RNA, 22 nt, Human
gccugggauucucaaaggggug

SEQ ID NO: 5639 - RNA, 22 nt, Human
gccuggggggcaugucauaaua

SEQ ID NO: 5640 - RNA, 22 nt, Human
gccugggugcucuguguaaggg

SEQ ID NO: 5641 - RNA, 22 nt, Human
gccuggguggagaggggugaca

SEQ ID NO: 5642 - RNA, 22 nt, Human
gccuggguuccugcuuuuguga

SEQ ID NO: 5643 - RNA, 22 nt, Human
gccuggugaaaggcagagagcg

SEQ ID NO: 5644 - RNA, 22 nt, Human
gccuggugucuccccaaggaag

SEQ ID NO: 5645 - RNA, 22 nt, Human
gccuguauuuauugagagugua

SEQ ID NO: 5646 - RNA, 20 nt, Human
gccuguccugagugucaugg

SEQ ID NO: 5647 - RNA, 22 nt, Human
gccugugaccccuccaucugcu

SEQ ID NO: 5648 - RNA, 22 nt, Human
gccugugcuguucccucugcca

SEQ ID NO: 5649 - RNA, 22 nt, Human
gccuguggguuggagcuuggcc

SEQ ID NO: 5650 - RNA, 22 nt, Human
gccugugucauguaguagcuuc

SEQ ID NO: 5651 - RNA, 22 nt, Human
gccuguguggaugggccccugg

SEQ ID NO: 5652 - RNA, 18 nt, Human
gccuguguucagccuuuc

SEQ ID NO: 5653 - RNA, 18 nt, Human
gccuguucccuacuaucc

SEQ ID NO: 5654 - RNA, 22 nt, Human
gccuguuuaucuaucaugaacu

SEQ ID NO: 5655 - RNA, 22 nt, Human
gccuguuucuaaucucauuucu

SEQ ID NO: 5656 - RNA, 22 nt, Human
gccuguuugacuggucucugcu

SEQ ID NO: 5657 - RNA, 22 nt, Human
gccuguuuguuugcaaaggagc

SEQ ID NO: 5658 - RNA, 22 nt, Human
gccuguuuuugcuucguuuaag

SEQ ID NO: 5659 - RNA, 22 nt, Human
gccuuacugagggcaauuuuga

SEQ ID NO: 5660 - RNA, 22 nt, Human
gccuuagccugcacuuccuguu

SEQ ID NO: 5661 - RNA, 22 nt, Human
gccuuaggggucagacagagcu

SEQ ID NO: 5662 - RNA, 22 nt, Human
gccuucagcccugacuggccag

SEQ ID NO: 5663 - RNA, 22 nt, Human
cugcugcucuugugcauuagug

SEQ ID NO: 5664 - RNA, 22 nt, Human
cugcugcugcuaucuacccagg

SEQ ID NO: 5665 - RNA, 21 nt, Human
cugcugcuggggucugggcag

SEQ ID NO: 5666 - RNA, 22 nt, Human
cugcugcuuuugcgggagaaca

SEQ ID NO: 5667 - RNA, 22 nt, Human
cugcuggaaguuugcuguggau

SEQ ID NO: 5668 - RNA, 22 nt, Human
cugcuggagggagcugauagug

SEQ ID NO: 5669 - RNA, 22 nt, Human
cugcuggagguuggagcaugca

SEQ ID NO: 5670 - RNA, 22 nt, Human
cugcuggcaagcccaguuggag

SEQ ID NO: 5671 - RNA, 22 nt, Human
cugcugggccuggucucugagg

SEQ ID NO: 5672 - RNA, 22 nt, Human
cugcugggggacacagguccgg

SEQ ID NO: 5673 - RNA, 22 nt, Human
cugcuggggucagagcacuggg

SEQ ID NO: 5674 - RNA, 22 nt, Human
cugcugggucuaugcaagugga

SEQ ID NO: 5675 - RNA, 22 nt, Human
cugcuggugcagaguggggcug

SEQ ID NO: 5676 - RNA, 22 nt, Human
cugcugguugcacagagcuagg

SEQ ID NO: 5677 - RNA, 22 nt, Human
cugcuguacuuaggaagaggaa

SEQ ID NO: 5678 - RNA, 22 nt, Human
cugcuguccaggagugcccugu

SEQ ID NO: 5679 - RNA, 22 nt, Human
cugcugucgccacggucgccgc

SEQ ID NO: 5680 - RNA, 22 nt, Human
cugcugucgccgagcugcaugc

SEQ ID NO: 5681 - RNA, 22 nt, Human
cugcugucuaguaucuuaaaaa

SEQ ID NO: 5682 - RNA, 22 nt, Human
cugcugucuuuauuucacugcu

SEQ ID NO: 5683 - RNA, 22 nt, Human
cugcugugagcacuccagccug

SEQ ID NO: 5684 - RNA, 22 nt, Human
cugcugugaguuuggaggucua

SEQ ID NO: 5685 - RNA, 22 nt, Human
cugcugugcauauuuaucuagg

SEQ ID NO: 5686 - RNA, 22 nt, Human
cugcugugccuuaaaaugcaag

SEQ ID NO: 5687 - RNA, 22 nt, Human
cugcuguggaugcaggaccuca

SEQ ID NO: 5688 - RNA, 22 nt, Human
cugcuguguaucauuuuagaug

SEQ ID NO: 5689 - RNA, 22 nt, Human
cugcuguguggugaaacucagu

SEQ ID NO: 5690 - RNA, 22 nt, Human
cugcuguguuccuccugcaucu

SEQ ID NO: 5691 - RNA, 22 nt, Human
cugcuguuugccgucauugccu

SEQ ID NO: 5692 - RNA, 23 nt, Human
cugcuguuuucuguaccugaagc

SEQ ID NO: 5693 - RNA, 22 nt, Human
cugcuuaaaaugcagauucugu

SEQ ID NO: 5694 - RNA, 22 nt, Human
cugcuucaaggaaaugaaucgg

SEQ ID NO: 5695 - RNA, 22 nt, Human
cugcuucacccugccugagaac

SEQ ID NO: 5696 - RNA, 22 nt, Human
cugcuucacguugugccuuguu

SEQ ID NO: 5697 - RNA, 22 nt, Human
cugcuucacuucgguugcauag

SEQ ID NO: 5698 - RNA, 20 nt, Human
cugcuuccaggcucaccccc

SEQ ID NO: 5699 - RNA, 22 nt, Human
cugcuuccauaaauaaugugcu

SEQ ID NO: 5700 - RNA, 22 nt, Human
cugcuuccauggucuggagacu

SEQ ID NO: 5701 - RNA, 22 nt, Human
cugcuuccugcugggauacuga

SEQ ID NO: 5702 - RNA, 22 nt, Human
cugcuucuccaaaguaggacuu

SEQ ID NO: 5703 - RNA, 22 nt, Human
cugcuucugggaugauggagua

SEQ ID NO: 5704 - RNA, 18 nt, Human
cugcuucugucugccagu

SEQ ID NO: 5705 - RNA, 22 nt, Human
cugcuugccuggacagcguuag

SEQ ID NO: 5706 - RNA, 17 nt, Human
cugcuuggccucugggg

SEQ ID NO: 5707 - RNA, 22 nt, Human
cugcuuggguccuggcaugggu

SEQ ID NO: 5708 - RNA, 22 nt, Human
cugcuugucuucgaggggugca

SEQ ID NO: 5709 - RNA, 22 nt, Human
cugcuuuaaguauucaacaaag

SEQ ID NO: 5710 - RNA, 22 nt, Human
cugcuuuaauguaagauauacc

SEQ ID NO: 5711 - RNA, 21 nt, Human
cugcuuuacuucagaggaucu

SEQ ID NO: 5712 - RNA, 22 nt, Human
cugcuuuagacggcuuucgcug

SEQ ID NO: 5713 - RNA, 22 nt, Human
cugcuuuauauugagcuugaaa

SEQ ID NO: 5714 - RNA, 22 nt, Human
cugcuuucugcaccccaggucg

SEQ ID NO: 5715 - RNA, 22 nt, Human
cugcuuugaaaauaaacuuguc

SEQ ID NO: 5716 - RNA, 18 nt, Human
cugcuuugccuucauucc

SEQ ID NO: 5717 - RNA, 22 nt, Human
cugcuuuggcucagugacauca

SEQ ID NO: 5718 - RNA, 22 nt, Human
cugcuuuguaaaauagacauaa

SEQ ID NO: 5719 - RNA, 22 nt, Human
cugcuuuguggaaucacacugg

SEQ ID NO: 5720 - RNA, 22 nt, Human
cugcuuuguguggucccuccag

SEQ ID NO: 5721 - RNA, 22 nt, Human
cugcuuuugagcccagugcuca

SEQ ID NO: 5722 - RNA, 22 nt, Human
cugcuuuuucuaggaggacaau

SEQ ID NO: 5723 - RNA, 22 nt, Human
cuggaaagcugcaggacccaga

SEQ ID NO: 5724 - RNA, 22 nt, Human
cuggaaagugcauguaaugagg

SEQ ID NO: 5725 - RNA, 22 nt, Human
cuggaaagugcuuuucugagag

SEQ ID NO: 5726 - RNA, 22 nt, Human
cuggaaaguucaagauaaagcu

SEQ ID NO: 5727 - RNA, 22 nt, Human
cuggaaaucacuacuagucaau

SEQ ID NO: 5728 - RNA, 22 nt, Human
cuggaaauuggagaugauguuu

SEQ ID NO: 5729 - RNA, 22 nt, Human
cuggaacaaguggccuugcaag

SEQ ID NO: 5730 - RNA, 22 nt, Human
gcuaaugacugaguuuuuagca

SEQ ID NO: 5731 - RNA, 22 nt, Human
gcuaaugugauagagcagaaag

SEQ ID NO: 5732 - RNA, 22 nt, Human
gcuaauucacaguaggaaauuu

SEQ ID NO: 5733 - RNA, 22 nt, Human
gcuacagacugagcauggcucu

SEQ ID NO: 5734 - RNA, 22 nt, Human
gcuacagauuuaucauguuaua

SEQ ID NO: 5735 - RNA, 22 nt, Human
gcuacaggagauaaaggccucu

SEQ ID NO: 5736 - RNA, 22 nt, Human
gcuacagugauaggaaacacau

SEQ ID NO: 5737 - RNA, 22 nt, Human
gcuacccagagccucacccugu

SEQ ID NO: 5738 - RNA, 22 nt, Human
gcuaccugagcaagagcuucaa

SEQ ID NO: 5739 - RNA, 22 nt, Human
gcuacuaggaagauuccaggau

SEQ ID NO: 5740 - RNA, 22 nt, Human
gcuacuaguacagcaaggacua

SEQ ID NO: 5741 - RNA, 22 nt, Human
gcuacugugaaggagucuuucu

SEQ ID NO: 5742 - RNA, 22 nt, Human
gcuagcaaaugucauuuggaag

SEQ ID NO: 5743 - RNA, 22 nt, Human
gcuagccugcaguggcuauggu

SEQ ID NO: 5744 - RNA, 22 nt, Human
gcuagcuggguuucacugugga

SEQ ID NO: 5745 - RNA, 22 nt, Human
gcuaggaaaggaagaacuuuga

SEQ ID NO: 5746 - RNA, 22 nt, Human
gcuaggaacauuuauauacaaa

SEQ ID NO: 5747 - RNA, 22 nt, Human
gcuaggaagaagggugcuugaa

SEQ ID NO: 5748 - RNA, 22 nt, Human
gcuaggaaucggacccaggaag

SEQ ID NO: 5749 - RNA, 22 nt, Human
gcuaggagauugagcucugaag

SEQ ID NO: 5750 - RNA, 22 nt, Human
gcuaggagugggauggaagucg

SEQ ID NO: 5751 - RNA, 16 nt, Human
gcuaggcaacaggcug

SEQ ID NO: 5752 - RNA, 22 nt, Human
gcuaggcuguguuucagacccu

SEQ ID NO: 5753 - RNA, 22 nt, Human
gcuagggaaccucuucugagga

SEQ ID NO: 5754 - RNA, 18 nt, Human
gcuagggcaugcauggug

SEQ ID NO: 5755 - RNA, 22 nt, Human
gcuaggucugugcgcagccgcu

SEQ ID NO: 5756 - RNA, 23 nt, Human
gcuaggugcuuccacacgugcug

SEQ ID NO: 5757 - RNA, 22 nt, Human
gcuaugcaggagccuaaugaca

SEQ ID NO: 5758 - RNA, 22 nt, Human
gcuaugggaugugcuguggaug

SEQ ID NO: 5759 - RNA, 22 nt, Human
gcuauguguaucuguuagagag

SEQ ID NO: 5760 - RNA, 22 nt, Human
gcuauuguuuauuuugaaucua

SEQ ID NO: 5761 - RNA, 22 nt, Human
gcuauuuauuaaaauagugaag

SEQ ID NO: 5762 - RNA, 22 nt, Human
gcuauuuauuaaaauggugaag

SEQ ID NO: 5763 - RNA, 22 nt, Human
gcuauuuuugagccauuuauaa

SEQ ID NO: 5764 - RNA, 22 nt, Human
gcucaaaugucauggggagccu

SEQ ID NO: 5765 - RNA, 19 nt, Human
gcucaacagcucggguccu

SEQ ID NO: 5766 - RNA, 22 nt, Human
gcucacagagggugcuuaauac

SEQ ID NO: 5767 - RNA, 22 nt, Human
gcucaccacugcuagagucuau

SEQ ID NO: 5768 - RNA, 22 nt, Human
gcucaccucgcugcaggugggu

SEQ ID NO: 5769 - RNA, 22 nt, Human
gcucacugccauucucuagaug

SEQ ID NO: 5770 - RNA, 22 nt, Human
gcucacuuaauuucaugcuaca

SEQ ID NO: 5771 - RNA, 22 nt, Human
gcucagacucuggccugaugau

SEQ ID NO: 5772 - RNA, 22 nt, Human
cuggagccauguauagccuaug

SEQ ID NO: 5773 - RNA, 22 nt, Human
cuggagccaugucuugacugcu

SEQ ID NO: 5774 - RNA, 22 nt, Human
cuggagccccagacagggagag

SEQ ID NO: 5775 - RNA, 22 nt, Human
cuggagccgcauggagcaggga

SEQ ID NO: 5776 - RNA, 22 nt, Human
cuggagccggcgagccccagcc

SEQ ID NO: 5777 - RNA, 22 nt, Human
cuggagcucuccagagccccgu

SEQ ID NO: 5778 - RNA, 22 nt, Human
cuggagcuggcccaggcuggcc

SEQ ID NO: 5779 - RNA, 22 nt, Human
cuggagcugggcuaggguagga

SEQ ID NO: 5780 - RNA, 22 nt, Human
cuggagcugucuucacaggccu

SEQ ID NO: 5781 - RNA, 22 nt, Human
cuggagcuguuuuuucaggaaa

SEQ ID NO: 5782 - RNA, 21 nt, Human
cuggagcuuggugagaagugu

SEQ ID NO: 5783 - RNA, 22 nt, Human
cuggaggaauaaucuccuaccc

SEQ ID NO: 5784 - RNA, 22 nt, Human
cuggaggacagaggccaugucu

SEQ ID NO: 5785 - RNA, 22 nt, Human
cuggaggaccccugccuggaag

SEQ ID NO: 5786 - RNA, 22 nt, Human
cuggaggagaacuugaggaagg

SEQ ID NO: 5787 - RNA, 21 nt, Human
cuggaggcagguggugccagg

SEQ ID NO: 5788 - RNA, 22 nt, Human
cuggaggccacuguacagauug

SEQ ID NO: 5789 - RNA, 22 nt, Human
cuggagggacuuucucacggau

SEQ ID NO: 5790 - RNA, 22 nt, Human
cuggagggauguaggguguauu

SEQ ID NO: 5791 - RNA, 22 nt, Human
cuggagggcugcagcgaggcug

SEQ ID NO: 5792 - RNA, 22 nt, Human
cuggagggcuucugcagguuac

SEQ ID NO: 5793 - RNA, 21 nt, Human
cuggaggguagaguugggcug

SEQ ID NO: 5794 - RNA, 22 nt, Human
cuggagggugagccucaucucu

SEQ ID NO: 5795 - RNA, 22 nt, Human
cuggagguaauguuauuuuugu

SEQ ID NO: 5796 - RNA, 22 nt, Human
cuggagucacacacaccaaggu

SEQ ID NO: 5797 - RNA, 22 nt, Human
cuggagucacucauguagcugc

SEQ ID NO: 5798 - RNA, 21 nt, Human
cuggagucuggggguggcagu

SEQ ID NO: 5799 - RNA, 22 nt, Human
cuggagucuuagguuaugguga

SEQ ID NO: 5800 - RNA, 22 nt, Human
cuggagucuucagcuugcugcc

SEQ ID NO: 5801 - RNA, 22 nt, Human
cuggagugaagcuuauuuuuca

SEQ ID NO: 5802 - RNA, 22 nt, Human
cuggagugaagucuggcagcuu

SEQ ID NO: 5803 - RNA, 22 nt, Human
cuggaguggccggugcuguggc

SEQ ID NO: 5804 - RNA, 20 nt, Human
cuggaguguagcaguggcug

SEQ ID NO: 5805 - RNA, 22 nt, Human
cuggaguucaguggcgugaaca

SEQ ID NO: 5806 - RNA, 22 nt, Human
cuggauaagaguuuuacuuccu

SEQ ID NO: 5807 - RNA, 22 nt, Human
cuggauccaucgggucccgagu

SEQ ID NO: 5808 - RNA, 22 nt, Human
cuggaucuguuugugcuugugg

SEQ ID NO: 5809 - RNA, 22 nt, Human
cuggauguaacgaagguuucac

SEQ ID NO: 5810 - RNA, 22 nt, Human
cuggaugugguaaugacuuuga

SEQ ID NO: 5811 - RNA, 22 nt, Human
cuggauguuuaugaaggaccca

SEQ ID NO: 5812 - RNA, 22 nt, Human
cuggauguuuugcuaaggacuc

SEQ ID NO: 5813 - RNA, 22 nt, Human
cuggauuaaguaaaauagagga

SEQ ID NO: 5814 - RNA, 22 nt, Human
cuggauucucaucagagccaga

SEQ ID NO: 5815 - RNA, 22 nt, Human
cuggauuuaggacuaguccaag

SEQ ID NO: 5816 - RNA, 22 nt, Human
cuggauuuuagaaggcuuccua

SEQ ID NO: 5817 - RNA, 22 nt, Human
cuggcaaguacugggccagcuc

SEQ ID NO: 5818 - RNA, 22 nt, Human
cuggcacauaguaggugcacag

SEQ ID NO: 5819 - RNA, 22 nt, Human
cuggcagcagcugguaccuuau

SEQ ID NO: 5820 - RNA, 19 nt, Human
cuggcagccugucuguguc

SEQ ID NO: 5821 - RNA, 22 nt, Human
cuggcagcgguuugcagccugg

SEQ ID NO: 5822 - RNA, 22 nt, Human
cuggcagcucugagucccuucu

SEQ ID NO: 5823 - RNA, 22 nt, Human
cuggcagcuucaggacacucgg

SEQ ID NO: 5824 - RNA, 22 nt, Human
cuggcaggaaguuagaugguaa

SEQ ID NO: 5825 - RNA, 22 nt, Human
cuggcaggagcauucacagagg

SEQ ID NO: 5826 - RNA, 20 nt, Human
cuggcaggagcgagucuacc

SEQ ID NO: 5827 - RNA, 22 nt, Human
cuggcaggagcuguggccguag

SEQ ID NO: 5828 - RNA, 22 nt, Human
cuggcaggaucuaaccagggaa

SEQ ID NO: 5829 - RNA, 22 nt, Human
cuggcagggcugguauucaaaa

SEQ ID NO: 5830 - RNA, 22 nt, Human
cuggcagguccagcuggacuca

SEQ ID NO: 5831 - RNA, 22 nt, Human
cuggcaggucucgcugacgugu

SEQ ID NO: 5832 - RNA, 22 nt, Human
cuggcagguggagguugcagug

SEQ ID NO: 5833 - RNA, 22 nt, Human
cuggcagucugguggaaggccu

SEQ ID NO: 5834 - RNA, 22 nt, Human
cuggcagugcccagucacuguu

SEQ ID NO: 5835 - RNA, 22 nt, Human
cuggcagugcccucagccccca

SEQ ID NO: 5836 - RNA, 22 nt, Human
cuggcaugaaauggcaucucau

SEQ ID NO: 5837 - RNA, 21 nt, Human
cuggcauuaugauagcguccu

SEQ ID NO: 5838 - RNA, 18 nt, Human
cuggcauucuucccugga

SEQ ID NO: 5839 - RNA, 22 nt, Human
cuggcauuuagacccacagcaa

SEQ ID NO: 5840 - RNA, 22 nt, Human
cuggccaacuugcuuguuggca

SEQ ID NO: 5841 - RNA, 22 nt, Human
cuggccaauccauuaauuuguu

SEQ ID NO: 5842 - RNA, 19 nt, Human
cuggccacaccugcugguu

SEQ ID NO: 5843 - RNA, 20 nt, Human
cuggccagaacgccuacaca

SEQ ID NO: 5844 - RNA, 22 nt, Human
cuggccagaguuggagggugug

SEQ ID NO: 5845 - RNA, 19 nt, Human
cuggccaggccaggggccc

SEQ ID NO: 5846 - RNA, 22 nt, Human
cuggccaggcuugggacagaca

SEQ ID NO: 5847 - RNA, 22 nt, Human
cuggccagugccugugggcccc

SEQ ID NO: 5848 - RNA, 22 nt, Human
cugggucacccaaaagggccag

SEQ ID NO: 5849 - RNA, 20 nt, Human
cugggucacuuggcugcucu

SEQ ID NO: 5850 - RNA, 22 nt, Human
cugggucccaauagcuuuuguu

SEQ ID NO: 5851 - RNA, 22 nt, Human
cugggucccacagccugcuggg

SEQ ID NO: 5852 - RNA, 22 nt, Human
cugggucccggcuucuauccac

SEQ ID NO: 5853 - RNA, 18 nt, Human
cugggucuccaggcugcc

SEQ ID NO: 5854 - RNA, 22 nt, Human
cugggucucuuuagggugccgu

SEQ ID NO: 5855 - RNA, 22 nt, Human
cugggucugggccuccuggagu

SEQ ID NO: 5856 - RNA, 22 nt, Human
cugggucugugcccagggaccu

SEQ ID NO: 5857 - RNA, 19 nt, Human
cugggucuuauucugugaa

SEQ ID NO: 5858 - RNA, 22 nt, Human
cugggucuucagcagcaggcgg

SEQ ID NO: 5859 - RNA, 22 nt, Human
cugggugacagagugagauggu

SEQ ID NO: 5860 - RNA, 22 nt, Human
cugggugaguauaggaaaggga

SEQ ID NO: 5861 - RNA, 22 nt, Human
cugggugccagcauggcugagu

SEQ ID NO: 5862 - RNA, 22 nt, Human
cugggugcgugagcgcaugcgu

SEQ ID NO: 5863 - RNA, 22 nt, Human
cuggguguagauggaaguuugg

SEQ ID NO: 5864 - RNA, 22 nt, Human
cuggguguuggguacugaccgu

SEQ ID NO: 5865 - RNA, 22 nt, Human
cugguaaagaagacaaacaggg

SEQ ID NO: 5866 - RNA, 23 nt, Human
cugguaaaucacuaaaauuacaa

SEQ ID NO: 5867 - RNA, 22 nt, Human
cugguaaaugaugagaagcacc

SEQ ID NO: 5868 - RNA, 22 nt, Human
cugguacaguguuacaaaaugg

SEQ ID NO: 5869 - RNA, 22 nt, Human
cugguacauaguaagaacacaa

SEQ ID NO: 5870 - RNA, 22 nt, Human
cugguacauuugaugauaauag

SEQ ID NO: 5871 - RNA, 22 nt, Human
cugguaggggugacuguuaucg

SEQ ID NO: 5872 - RNA, 22 nt, Human
cugguaguuugcaaaauggugu

SEQ ID NO: 5873 - RNA, 22 nt, Human
cuggucaaggagagucucugca

SEQ ID NO: 5874 - RNA, 22 nt, Human
cuggucacuccuccaccugcuu

SEQ ID NO: 5875 - RNA, 22 nt, Human
cuggucaggcugaacugccaca

SEQ ID NO: 5876 - RNA, 17 nt, Human
cuggucccaccaagccc

SEQ ID NO: 5877 - RNA, 22 nt, Human
cuggucccugaguaguuaugca

SEQ ID NO: 5878 - RNA, 22 nt, Human
cuggucccuggaccucccugga

SEQ ID NO: 5879 - RNA, 22 nt, Human
cuggucccuguagguauuugac

SEQ ID NO: 5880 - RNA, 22 nt, Human
cugguccucuccagcaggcauu

SEQ ID NO: 5881 - RNA, 22 nt, Human
cugggagcuagcucugagcuga

SEQ ID NO: 5882 - RNA, 22 nt, Human
cugggagcuuggagccuuuggu

SEQ ID NO: 5883 - RNA, 22 nt, Human
cugggagcuuguuaggaaugca

SEQ ID NO: 5884 - RNA, 22 nt, Human
cugggaggacaacuuggagcuc

SEQ ID NO: 5885 - RNA, 22 nt, Human
cugggaggcaccgcgucgugcu

SEQ ID NO: 5886 - RNA, 22 nt, Human
cugggaggcccacguugggaag

SEQ ID NO: 5887 - RNA, 20 nt, Human
cugggaggucuuccaaauca

SEQ ID NO: 5888 - RNA, 22 nt, Human
cugggaggugaacagaaaaacu

SEQ ID NO: 5889 - RNA, 22 nt, Human
cugggaggugcagcaaaaauca

SEQ ID NO: 5890 - RNA, 22 nt, Human
cugggaguacugggggauguca

SEQ ID NO: 5891 - RNA, 22 nt, Human
cugggagucaccaggagcaagg

SEQ ID NO: 5892 - RNA, 22 nt, Human
cugggagucccuggaauagcuc

SEQ ID NO: 5893 - RNA, 22 nt, Human
cugggagucuggccucuggucc

SEQ ID NO: 5894 - RNA, 22 nt, Human
cugggaguggugacagcucucg

SEQ ID NO: 5895 - RNA, 22 nt, Human
cugggaguguucuaggucacau

SEQ ID NO: 5896 - RNA, 22 nt, Human
cugggaguuucuagagaaagac

SEQ ID NO: 5897 - RNA, 22 nt, Human
cugggaguuuguuaguaaugca

SEQ ID NO: 5898 - RNA, 22 nt, Human
cugggaucagcaguagugauga

SEQ ID NO: 5899 - RNA, 22 nt, Human
cugggaugauagugcuaguauu

SEQ ID NO: 5900 - RNA, 22 nt, Human
cugggaugcggagguugcggug

SEQ ID NO: 5901 - RNA, 22 nt, Human
cugggaugucuauagaacacuu

SEQ ID NO: 5902 - RNA, 22 nt, Human
cugggcaauaugcugggccugg

SEQ ID NO: 5903 - RNA, 22 nt, Human
cugggcacaaguggcccuggau

SEQ ID NO: 5904 - RNA, 22 nt, Human
cugggcaccuuugcagcaggcu

SEQ ID NO: 5905 - RNA, 22 nt, Human
cugggcacugcagcaggcauca

SEQ ID NO: 5906 - RNA, 22 nt, Human
cugggcacuuuggggagccuac

SEQ ID NO: 5907 - RNA, 22 nt, Human
cugggcagagcuaacaccugag

SEQ ID NO: 5908 - RNA, 22 nt, Human
cugggcagaguccggaagaugg

SEQ ID NO: 5909 - RNA, 22 nt, Human
cugggcagcacaucaucguauc

SEQ ID NO: 5910 - RNA, 22 nt, Human
cugggcagcuguaucagggagu

SEQ ID NO: 5911 - RNA, 22 nt, Human
cugggcaggagaggugguugga

SEQ ID NO: 5912 - RNA, 22 nt, Human
cugggcagugcagcuauagaac

SEQ ID NO: 5913 - RNA, 22 nt, Human
cugggcagugguggcaucuuug

SEQ ID NO: 5914 - RNA, 22 nt, Human
cugggccacagacucaaggcag

SEQ ID NO: 5915 - RNA, 18 nt, Human
cugggccagaguuucugc

SEQ ID NO: 5916 - RNA, 22 nt, Human
cugggccaggaccaggguugaa

SEQ ID NO: 5917 - RNA, 22 nt, Human
cugggccagggaggugucugua

SEQ ID NO: 5918 - RNA, 22 nt, Human
cugggccaugggccagcgaggc

SEQ ID NO: 5919 - RNA, 22 nt, Human
cugggcccuauggaagaaaggg

SEQ ID NO: 5920 - RNA, 22 nt, Human
cugggccuaacccacagcguuu

SEQ ID NO: 5921 - RNA, 22 nt, Human
cugggccucaagcucagauuuc

SEQ ID NO: 5922 - RNA, 22 nt, Human
cugggccucacccuagaccaau

SEQ ID NO: 5923 - RNA, 22 nt, Human
cugggccucauccccagaguuu

SEQ ID NO: 5924 - RNA, 22 nt, Human
cugggccucauccucagaguuu

SEQ ID NO: 5925 - RNA, 22 nt, Human
cugggccuccagcucugccagc

SEQ ID NO: 5926 - RNA, 22 nt, Human
cugggccuggacgggcagaucu

SEQ ID NO: 5927 - RNA, 22 nt, Human
cugggccuggggcuguugagag

SEQ ID NO: 5928 - RNA, 22 nt, Human
cugggccugugacucccauccu

SEQ ID NO: 5929 - RNA, 22 nt, Human
cugggccugugggcacacggac

SEQ ID NO: 5930 - RNA, 22 nt, Human
cugggccuuagggcacucccuu

SEQ ID NO: 5931 - RNA, 22 nt, Human
cugggccuugcaucccagagcc

SEQ ID NO: 5932 - RNA, 22 nt, Human
cugggccuugccuugcccacag

SEQ ID NO: 5933 - RNA, 22 nt, Human
cugggccuuuaccuacggaguu

SEQ ID NO: 5934 - RNA, 22 nt, Human
cugggccuuugcuuauuaauuu

SEQ ID NO: 5935 - RNA, 22 nt, Human
cugggcucaaauccuggcccug

SEQ ID NO: 5936 - RNA, 21 nt, Human
cugggcucaagcaauccuuuc

SEQ ID NO: 5937 - RNA, 22 nt, Human
cugggcucagaaccuuguuaag

SEQ ID NO: 5938 - RNA, 22 nt, Human
cugggcuccuaaccauccaggu

SEQ ID NO: 5939 - RNA, 22 nt, Human
cugggcucuaagggagcaccgu

SEQ ID NO: 5940 - RNA, 22 nt, Human
cugggcucuagaaaggaaagaa

SEQ ID NO: 5941 - RNA, 22 nt, Human
cugggcucugcaguugauguuu

SEQ ID NO: 5942 - RNA, 22 nt, Human
cugggcucuucccagauccaga

SEQ ID NO: 5943 - RNA, 22 nt, Human
cugggcugaaaguguuccuuga

SEQ ID NO: 5944 - RNA, 22 nt, Human
cugggcugcaucaaagaggcau

SEQ ID NO: 5945 - RNA, 22 nt, Human
cugggcugccagguaggcacac

SEQ ID NO: 5946 - RNA, 22 nt, Human
cugggcuggacacacuuaaccu

SEQ ID NO: 5947 - RNA, 22 nt, Human
cugggcugucaauggcccucug

SEQ ID NO: 5948 - RNA, 22 nt, Human
cugggcugucccaaccccaucc

SEQ ID NO: 5949 - RNA, 22 nt, Human
cugggcugucccagggcggcag

SEQ ID NO: 5950 - RNA, 22 nt, Human
cugggcuguucugccccugggu

SEQ ID NO: 5951 - RNA, 22 nt, Human
cugggcuucucccccuggcaga

SEQ ID NO: 5952 - RNA, 22 nt, Human
cugggcuuguguuagcugacaa

SEQ ID NO: 5953 - RNA, 21 nt, Human
cugggcuuucucucaaagaca

SEQ ID NO: 5954 - RNA, 22 nt, Human
cugggcuuuugagucacaaggg

SEQ ID NO: 5955 - RNA, 20 nt, Human
cuggggacagcaauggcugu

SEQ ID NO: 5956 - RNA, 22 nt, Human
cuggggacucauucagagcaua

SEQ ID NO: 5957 - RNA, 22 nt, Human
cuggggagacgaucgauguucu

SEQ ID NO: 5958 - RNA, 22 nt, Human
cuggggaggaugcuacgaccug

SEQ ID NO: 5959 - RNA, 22 nt, Human
cuggggagugaaauucuuaaau

SEQ ID NO: 5960 - RNA, 22 nt, Human
cuggggcaugggccccuagagg

SEQ ID NO: 5961 - RNA, 22 nt, Human
cuggggcccaucgagggcugag

SEQ ID NO: 5962 - RNA, 22 nt, Human
cuggggcccgagccuugggcca

SEQ ID NO: 5963 - RNA, 22 nt, Human
cugucccucucacaccucacca

SEQ ID NO: 5964 - RNA, 22 nt, Human
cugucccuucauuauucacuac

SEQ ID NO: 5965 - RNA, 22 nt, Human
cuguccucaacccauccuucuc

SEQ ID NO: 5966 - RNA, 22 nt, Human
cuguccuccggccaccuacagu

SEQ ID NO: 5967 - RNA, 22 nt, Human
cuguccugaaagggagauuggg

SEQ ID NO: 5968 - RNA, 22 nt, Human
cuguccugaguucuuggagguc

SEQ ID NO: 5969 - RNA, 22 nt, Human
cuguccuguacuuugaggcccu

SEQ ID NO: 5970 - RNA, 23 nt, Human
cuguccuguaguucacguuggcc

SEQ ID NO: 5971 - RNA, 22 nt, Human
cuguccuguggaccugaggacg

SEQ ID NO: 5972 - RNA, 22 nt, Human
cuguccuguggugacagguaca

SEQ ID NO: 5973 - RNA, 20 nt, Human
cuguccuuuuguuggaagac

SEQ ID NO: 5974 - RNA, 22 nt, Human
cugucuaguuaggaugccagca

SEQ ID NO: 5975 - RNA, 22 nt, Human
cugucuccgcccucuugguagg

SEQ ID NO: 5976 - RNA, 22 nt, Human
cugucucucuaggacacugggg

SEQ ID NO: 5977 - RNA, 22 nt, Human
cugucugccaauaaucuauggc

SEQ ID NO: 5978 - RNA, 19 nt, Human
cugucugcggggccuguuc

SEQ ID NO: 5979 - RNA, 22 nt, Human
cugucugcuagaacaucuauac

SEQ ID NO: 5980 - RNA, 22 nt, Human
cugucugggucuacauccucug

SEQ ID NO: 5981 - RNA, 22 nt, Human
cugucuguacaaauguggggcc

SEQ ID NO: 5982 - RNA, 22 nt, Human
cugucuguacugagaguucugu

SEQ ID NO: 5983 - RNA, 22 nt, Human
cugucugucaaguucaucucca

SEQ ID NO: 5984 - RNA, 22 nt, Human
cugucugucaccaaaacagacu

SEQ ID NO: 5985 - RNA, 22 nt, Human
cugucugugaccucugcauguc

SEQ ID NO: 5986 - RNA, 22 nt, Human
cugucugugccucuucucccag

SEQ ID NO: 5987 - RNA, 22 nt, Human
cugucuguuucaaaagugguua

SEQ ID NO: 5988 - RNA, 22 nt, Human
cugucuucccgaggcccuggag

SEQ ID NO: 5989 - RNA, 22 nt, Human
cugucuucuccuuuguuucagg

SEQ ID NO: 5990 - RNA, 21 nt, Human
cuuguuuugaaaggacuggcc

SEQ ID NO: 5991 - RNA, 22 nt, Human
cuuuaaauaauacaagguccag

SEQ ID NO: 5992 - RNA, 22 nt, Human
cuuuaacaguuccauucaauuu

SEQ ID NO: 5993 - RNA, 22 nt, Human
cuuuaagagaucaccaaucaca

SEQ ID NO: 5994 - RNA, 22 nt, Human
cuuuaaggugaugagagaugcu

SEQ ID NO: 5995 - RNA, 23 nt, Human
cuuuaaugaaauucucugugaag

SEQ ID NO: 5996 - RNA, 22 nt, Human
cuuuaauucucaggugcacaua

SEQ ID NO: 5997 - RNA, 22 nt, Human
cuuuacaaagcaauuuugucuc

SEQ ID NO: 5998 - RNA, 22 nt, Human
cuuuacacaaugauuuucuuua

SEQ ID NO: 5999 - RNA, 22 nt, Human
cuuuacacauccuaaccagugu

SEQ ID NO: 6000 - RNA, 22 nt, Human
cuuuacagaaagagaacucugg

SEQ ID NO: 6001 - RNA, 22 nt, Human
cuuuacagaauaagaauacugg

SEQ ID NO: 6002 - RNA, 22 nt, Human
cuuuacagugcugcuaauggcu

SEQ ID NO: 6003 - RNA, 22 nt, Human
cuuuacauccuguuucccguuu

SEQ ID NO: 6004 - RNA, 22 nt, Human
cuuuacauuaauuucuacugau

SEQ ID NO: 6005 - RNA, 22 nt, Human
cuuuaccagauuccauugcaag

SEQ ID NO: 6006 - RNA, 22 nt, Human
cuuuacuucagcaagcuuuccu

SEQ ID NO: 6007 - RNA, 22 nt, Human
cuuuacuucucaaaauaaagca

SEQ ID NO: 6008 - RNA, 22 nt, Human
cuuuagaaaucuggauguauuu

SEQ ID NO: 6009 - RNA, 20 nt, Human
cuuuagaagaacccaagcau

SEQ ID NO: 6010 - RNA, 22 nt, Human
cuuuagcaacgaugaugauauu

SEQ ID NO: 6011 - RNA, 22 nt, Human
cuuuagugguauuuuagcaagu

SEQ ID NO: 6012 - RNA, 22 nt, Human
cuuuaguuaguagauaauggca

SEQ ID NO: 6013 - RNA, 20 nt, Human
cuuuaguuauuaacagcacu

SEQ ID NO: 6014 - RNA, 22 nt, Human
cuuuaguuuaagaacaugauga

SEQ ID NO: 6015 - RNA, 22 nt, Human
cuuuaucuguguccucuugccu

SEQ ID NO: 6016 - RNA, 22 nt, Human
cuuuaugaaggaacaaugcucc

SEQ ID NO: 6017 - RNA, 22 nt, Human
cuuuaugacugaguugucaauu

SEQ ID NO: 6018 - RNA, 22 nt, Human
cuuuauggaaucaaagacugga

SEQ ID NO: 6019 - RNA, 22 nt, Human
cuuuauguccaccagacugcaa

SEQ ID NO: 6020 - RNA, 22 nt, Human
cuuuauguucaguacaaugcuu

SEQ ID NO: 6021 - RNA, 22 nt, Human
cuuuauguuggggugucuuagu

SEQ ID NO: 6022 - RNA, 22 nt, Human
cuuuauuccuacaagauuuucu

SEQ ID NO: 6023 - RNA, 22 nt, Human
cuuuauucugcaaauugccuug

SEQ ID NO: 6024 - RNA, 22 nt, Human
cuuucaaugucaucugugaaug

SEQ ID NO: 6025 - RNA, 22 nt, Human
cuuucacagcacaagccugccu

SEQ ID NO: 6026 - RNA, 22 nt, Human
cuuucacucgagcuccugcagc

SEQ ID NO: 6027 - RNA, 22 nt, Human
cuuucagaagccggaagggcag

SEQ ID NO: 6028 - RNA, 22 nt, Human
cuuucagaggggcguacacagc

SEQ ID NO: 6029 - RNA, 22 nt, Human
cuuucagagguuacucaggaaa

SEQ ID NO: 6030 - RNA, 22 nt, Human
cuuucaguuaaugacuccauag

SEQ ID NO: 6031 - RNA, 22 nt, Human
cuuucauccgcagaugagccuc

SEQ ID NO: 6032 - RNA, 22 nt, Human
cuuucauuugauaagaaugcca

SEQ ID NO: 6033 - RNA, 22 nt, Human
cuuuccaacucuagugaaauuu

SEQ ID NO: 6034 - RNA, 22 nt, Human
cuuuccaagaaugcagauaccu

SEQ ID NO: 6035 - RNA, 22 nt, Human
cuuuccaaugcauuuccaaugu

SEQ ID NO: 6036 - RNA, 22 nt, Human
cuuuccaggaauccucacagcc

SEQ ID NO: 6037 - RNA, 22 nt, Human
cuuucccacgcaguggaugaga

SEQ ID NO: 6038 - RNA, 22 nt, Human
cuuucccuuagccccauucuau

SEQ ID NO: 6039 - RNA, 22 nt, Human
cuuuccuaguaguuacagaaug

SEQ ID NO: 6040 - RNA, 22 nt, Human
cuuuccuccacucccuaggcuu

SEQ ID NO: 6041 - RNA, 22 nt, Human
cuuuccuucucgugguucucac

SEQ ID NO: 6042 - RNA, 22 nt, Human
cuuucuaaauguuccuugauua

SEQ ID NO: 6043 - RNA, 22 nt, Human
cuuucuagaguauggagucugu

SEQ ID NO: 6044 - RNA, 22 nt, Human
cuuucucuggaggggagugguu

SEQ ID NO: 6045 - RNA, 22 nt, Human
cuuucucugugugguaaagggc

SEQ ID NO: 6046 - RNA, 22 nt, Human
cuuucucuucacugucaugauc

SEQ ID NO: 6047 - RNA, 22 nt, Human
cuuucucuucgaaaaccugccc

SEQ ID NO: 6048 - RNA, 22 nt, Human
cuuucugaucccugcaacccuc

SEQ ID NO: 6049 - RNA, 22 nt, Human
cuuucuggaguggaaagguauu

SEQ ID NO: 6050 - RNA, 22 nt, Human
cuuucuuccauagggcccaguc

SEQ ID NO: 6051 - RNA, 22 nt, Human
cuuugaaaaaugguuuccuaga

SEQ ID NO: 6052 - RNA, 22 nt, Human
cuuugaagagauuacugugcuc

SEQ ID NO: 6053 - RNA, 22 nt, Human
cuuugaagauggcaaauuuaga

SEQ ID NO: 6054 - RNA, 22 nt, Human
cuuugaauuaacgacacaagug

SEQ ID NO: 6055 - RNA, 22 nt, Human
cuuugacauccuuguuccucag

SEQ ID NO: 6056 - RNA, 22 nt, Human
cuuugacuccaucucucuuugu

SEQ ID NO: 6057 - RNA, 22 nt, Human
cuuugauuccaggcacauguuu

SEQ ID NO: 6058 - RNA, 23 nt, Human
cuuugcaaaaacauuagucagug

SEQ ID NO: 6059 - RNA, 22 nt, Human
cuuugcaaacgauuaccacaug

SEQ ID NO: 6060 - RNA, 22 nt, Human
cuuugcaaagucuuuggcaaga

SEQ ID NO: 6061 - RNA, 22 nt, Human
cuuugcaauagaggcacacaug

SEQ ID NO: 6062 - RNA, 22 nt, Human
cuuugcagauuuguuuagugcu

SEQ ID NO: 6063 - RNA, 17 nt, Human
cuuugcagcagacaugu

SEQ ID NO: 6064 - RNA, 22 nt, Human
cuuugcaguuagccuaggauug

SEQ ID NO: 6065 - RNA, 22 nt, Human
cuuugcaguuucagaacccuga

SEQ ID NO: 6066 - RNA, 21 nt, Human
cuuugcaucuauauguucuca

SEQ ID NO: 6067 - RNA, 22 nt, Human
cuuugcaugggucugaaggcuu

SEQ ID NO: 6068 - RNA, 22 nt, Human
cuuugcaugugguagaagguuc

SEQ ID NO: 6069 - RNA, 22 nt, Human
cuuugcugccagaacccagcag

SEQ ID NO: 6070 - RNA, 22 nt, Human
cuuugcuucuccaaccugcuca

SEQ ID NO: 6071 - RNA, 22 nt, Human
cuuugcuuuacucccacugugu

SEQ ID NO: 6072 - RNA, 22 nt, Human
cuuuggaaggaagaccuuucag

SEQ ID NO: 6073 - RNA, 22 nt, Human
cuuuggaauauuuuauugagaa

SEQ ID NO: 6074 - RNA, 22 nt, Human
cuuuggagaagaaugcauccuu

SEQ ID NO: 6075 - RNA, 22 nt, Human
cuuuggaggaaaauugagguca

SEQ ID NO: 6076 - RNA, 22 nt, Human
cuuuggaggaccuaugugcaau

SEQ ID NO: 6077 - RNA, 19 nt, Human
cuuuggaggaugaggcugg

SEQ ID NO: 6078 - RNA, 22 nt, Human
cuuuggaugacuggugcagguu

SEQ ID NO: 6079 - RNA, 22 nt, Human
cuuuggcaaugucauuuucaau

SEQ ID NO: 6080 - RNA, 22 nt, Human
cuuuggcuaacaaaucagcuug

SEQ ID NO: 6081 - RNA, 22 nt, Human
cuuuggcuacaagcgcugcaau

SEQ ID NO: 6082 - RNA, 22 nt, Human
cuuuggcucaugguuuuaucca

SEQ ID NO: 6083 - RNA, 22 nt, Human
cuuuggcuugcacuauuacacu

SEQ ID NO: 6084 - RNA, 22 nt, Human
cuuuggcuugcccuggcaguac

SEQ ID NO: 6085 - RNA, 22 nt, Human
cuuugggcaaagggccaauucg

SEQ ID NO: 6086 - RNA, 22 nt, Human
cuuuggugucauguuucugcgg

SEQ ID NO: 6087 - RNA, 22 nt, Human
cuuugguguucauuaaacaugg

SEQ ID NO: 6088 - RNA, 21 nt, Human
cuuugguuuccuccugccuuc

SEQ ID NO: 6089 - RNA, 22 nt, Human
cuuuguaagucuuucuccaaga

SEQ ID NO: 6090 - RNA, 22 nt, Human
cuuuguauucauccguaauaau

SEQ ID NO: 6091 - RNA, 19 nt, Human
cuuugucagaacaugcuuc

SEQ ID NO: 6092 - RNA, 22 nt, Human
cuuugucauuuugucucucagu

SEQ ID NO: 6093 - RNA, 22 nt, Human
cuuugugcaaacccuagaauca

SEQ ID NO: 6094 - RNA, 22 nt, Human
cuuuguuagcagccaauuuguu

SEQ ID NO: 6095 - RNA, 22 nt, Human
cuuuguucaugacaucugcuuc

SEQ ID NO: 6096 - RNA, 22 nt, Human
cuuuguucugcacacacagaca

SEQ ID NO: 6097 - RNA, 22 nt, Human
cuuuguuuauauuucuccucga

SEQ ID NO: 6098 - RNA, 22 nt, Human
cuuuuaaugagcauugcugucu

SEQ ID NO: 6099 - RNA, 22 nt, Human
cuugggauguaaccuuuguucc

SEQ ID NO: 6100 - RNA, 22 nt, Human
cuugggcaggggaaacagcugc

SEQ ID NO: 6101 - RNA, 22 nt, Human
cuugggccagcccagggggcau

SEQ ID NO: 6102 - RNA, 22 nt, Human
cuugggcucagacuugaggaca

SEQ ID NO: 6103 - RNA, 22 nt, Human
cuugggcuuagaagguaaguga

SEQ ID NO: 6104 - RNA, 22 nt, Human
cuuggggaugcaaagccagugu

SEQ ID NO: 6105 - RNA, 22 nt, Human
cuuggggcagcccaggcugagc

SEQ ID NO: 6106 - RNA, 22 nt, Human
cuuggggcagugcuuggcacau

SEQ ID NO: 6107 - RNA, 22 nt, Human
cuuuuacauuuguugaagagua

SEQ ID NO: 6108 - RNA, 22 nt, Human
cuuuuacugugaaaagaaacug

SEQ ID NO: 6109 - RNA, 22 nt, Human
cuuuuagcuguuuccauggcaa

SEQ ID NO: 6110 - RNA, 22 nt, Human
cuuuucaaacgcugaugucagu

SEQ ID NO: 6111 - RNA, 22 nt, Human
cuuuucaggcuacauuauggga

SEQ ID NO: 6112 - RNA, 19 nt, Human
cuuuucaucaacagccaau

SEQ ID NO: 6113 - RNA, 22 nt, Human
cuuuucaugccagcccaucaca

SEQ ID NO: 6114 - RNA, 22 nt, Human
cuuuuccucaggaggagacgcg

SEQ ID NO: 6115 - RNA, 21 nt, Human
cuuuucuagucccagccccgc

SEQ ID NO: 6116 - RNA, 21 nt, Human
cuuuucucuccgcaggacauu

SEQ ID NO: 6117 - RNA, 22 nt, Human
cuuuucuguaucaaaaggauua

SEQ ID NO: 6118 - RNA, 22 nt, Human
cuuuucugucagugcccaaauu

SEQ ID NO: 6119 - RNA, 22 nt, Human
cuuuucuuauguggacguaccu

SEQ ID NO: 6120 - RNA, 18 nt, Human
cuuuuguuuucccuccuc

SEQ ID NO: 6121 - RNA, 22 nt, Human
cuuuuuacucuguugucucagc

SEQ ID NO: 6122 - RNA, 22 nt, Human
cuuuuucaagucaaagagggua

SEQ ID NO: 6123 - RNA, 19 nt, Human
cuuuuucaccuucuagaag

SEQ ID NO: 6124 - RNA, 22 nt, Human
cuuuuuccucguagagccuaau

SEQ ID NO: 6125 - RNA, 22 nt, Human
cuuuuucugauguuccaugauu

SEQ ID NO: 6126 - RNA, 22 nt, Human
gaaaaaugagcugaugucaggg

SEQ ID NO: 6127 - RNA, 22 nt, Human
gaaaaccaccucccaucaagca

SEQ ID NO: 6128 - RNA, 22 nt, Human
gaaaacuaacggaaaaguuagg

SEQ ID NO: 6129 - RNA, 22 nt, Human
gaaaacuauuggccuagaacaa

SEQ ID NO: 6130 - RNA, 22 nt, Human
gaaaagaacugcaugggauuaa

SEQ ID NO: 6131 - RNA, 22 nt, Human
gaaaagagacagggugggugau

SEQ ID NO: 6132 - RNA, 22 nt, Human
gaaaagaguccugugugaggag

SEQ ID NO: 6133 - RNA, 22 nt, Human
gaaaagcuaggccaguucagcu

SEQ ID NO: 6134 - RNA, 22 nt, Human
gaaaaggauugguaaaauaucu

SEQ ID NO: 6135 - RNA, 22 nt, Human
gaaaaguacacagcccaaacau

SEQ ID NO: 6136 - RNA, 22 nt, Human
gaaaauaggcugcaucuccuuc

SEQ ID NO: 6137 - RNA, 22 nt, Human
gaaaauaguucaucacaaugau

SEQ ID NO: 6138 - RNA, 22 nt, Human
gaaaaugugccuuuggguauug

SEQ ID NO: 6139 - RNA, 22 nt, Human
gaaacaauacuuguccucacua

SEQ ID NO: 6140 - RNA, 22 nt, Human
gaaacagcacguuuggagagau

SEQ ID NO: 6141 - RNA, 22 nt, Human
gaaacagcuagaaagccauugg

SEQ ID NO: 6142 - RNA, 22 nt, Human
gaaacagugagaacuuuuccug

SEQ ID NO: 6143 - RNA, 22 nt, Human
gaaacauacgauuuaggagaaa

SEQ ID NO: 6144 - RNA, 22 nt, Human
gaaacauaguugagacacugcu

SEQ ID NO: 6145 - RNA, 22 nt, Human
gaaacauauuaauccagugaaa

SEQ ID NO: 6146 - RNA, 22 nt, Human
gaaacauugagcagaaggagaa

SEQ ID NO: 6147 - RNA, 20 nt, Human
gaaaccagaacgcagcccug

SEQ ID NO: 6148 - RNA, 22 nt, Human
gaaaccagcuagaggcagaggg

SEQ ID NO: 6149 - RNA, 22 nt, Human
gaaaccuauuuauaacuucuag

SEQ ID NO: 6150 - RNA, 22 nt, Human
gaaaccucuuagccucucuuug

SEQ ID NO: 6151 - RNA, 22 nt, Human
gaaaccugggauauauaaguuu

SEQ ID NO: 6152 - RNA, 22 nt, Human
gaaaccugugcugauuuguuag

SEQ ID NO: 6153 - RNA, 22 nt, Human
gaaacguuaaaccauauguaau

SEQ ID NO: 6154 - RNA, 22 nt, Human
gaaacguuggcauaaguuuaug

SEQ ID NO: 6155 - RNA, 22 nt, Human
gaaacuagauguauuagagauu

SEQ ID NO: 6156 - RNA, 22 nt, Human
gaaacugugaucguguucuggg

SEQ ID NO: 6157 - RNA, 22 nt, Human
gaaacuguuucuggcuuuggug

SEQ ID NO: 6158 - RNA, 22 nt, Human
gaaacuucuugucucacaguuc

SEQ ID NO: 6159 - RNA, 22 nt, Human
gaaacuuuuaaaccucaugagu

SEQ ID NO: 6160 - RNA, 22 nt, Human
gaaagaccagcaugaggcuuua

SEQ ID NO: 6161 - RNA, 22 nt, Human
gaaagacuaacuagaaagugca

SEQ ID NO: 6162 - RNA, 22 nt, Human
gaaagacuuccuuugagaguac

SEQ ID NO: 6163 - RNA, 22 nt, Human
gaaagaggaaggagauguauua

SEQ ID NO: 6164 - RNA, 22 nt, Human
gaaagauauuuauuggcaacag

SEQ ID NO: 6165 - RNA, 18 nt, Human
gaaagaugaacuuuuuuc

SEQ ID NO: 6166 - RNA, 22 nt, Human
gaaagcaaguugacugcagaau

SEQ ID NO: 6167 - RNA, 22 nt, Human
gaaagcacuaaaagagaauccu

SEQ ID NO: 6168 - RNA, 22 nt, Human
gaaagcacugugagaucuuguu

SEQ ID NO: 6169 - RNA, 17 nt, Human
gaaagcaucacaugcuc

SEQ ID NO: 6170 - RNA, 22 nt, Human
gaaaggagaggguuaaggagcu

SEQ ID NO: 6171 - RNA, 22 nt, Human
gaaaggagggcucacaaaagug

SEQ ID NO: 6172 - RNA, 22 nt, Human
gaaaggagugaauauuugugac

SEQ ID NO: 6173 - RNA, 22 nt, Human
gaaaggccaccaugccagggac

SEQ ID NO: 6174 - RNA, 22 nt, Human
gaaaggcuaaaauuauaagggu

SEQ ID NO: 6175 - RNA, 22 nt, Human
gaaaggcucacuuuagaucaug

SEQ ID NO: 6176 - RNA, 22 nt, Human
gaaaggcucagaaguuuguauu

SEQ ID NO: 6177 - RNA, 23 nt, Human
gaaaggcucugggacccccaacu

SEQ ID NO: 6178 - RNA, 22 nt, Human
gaaaggcugggauuuagcgcug

SEQ ID NO: 6179 - RNA, 22 nt, Human
gaaagggcaugggcaugacaac

SEQ ID NO: 6180 - RNA, 22 nt, Human
gaaaggugccccauaggcagga

SEQ ID NO: 6181 - RNA, 22 nt, Human
gaaagguugggugaauggugga

SEQ ID NO: 6182 - RNA, 22 nt, Human
gaaagguuucaucuacuuuuca

SEQ ID NO: 6183 - RNA, 22 nt, Human
gaaaguauucucccugaauuuu

SEQ ID NO: 6184 - RNA, 22 nt, Human
gaaaguauuuaaguccauauuu

SEQ ID NO: 6185 - RNA, 19 nt, Human
gaaagucauagagcuuguc

SEQ ID NO: 6186 - RNA, 22 nt, Human
gaaagugcagucagacaaggca

SEQ ID NO: 6187 - RNA, 22 nt, Human
gaaagugcaugugcccaccauu

SEQ ID NO: 6188 - RNA, 22 nt, Human
gaaaguuauugaaccuuauuua

SEQ ID NO: 6189 - RNA, 22 nt, Human
gaaaguucacacauccacaugg

SEQ ID NO: 6190 - RNA, 22 nt, Human
gaaaguugcaaucauggcuuuu

SEQ ID NO: 6191 - RNA, 22 nt, Human
gaaaguuugccucucucuugag

SEQ ID NO: 6192 - RNA, 22 nt, Human
gaaaguuuucucacacaguaau

SEQ ID NO: 6193 - RNA, 22 nt, Human
gaaauaacagcucuggaagagu

SEQ ID NO: 6194 - RNA, 22 nt, Human
gaaauaaccucaugcaccauga

SEQ ID NO: 6195 - RNA, 22 nt, Human
gaaauaauucugugucugaaca

SEQ ID NO: 6196 - RNA, 22 nt, Human
gaaauacaauuuugucccagcu

SEQ ID NO: 6197 - RNA, 22 nt, Human
gaaauacugcacacccuguaag

SEQ ID NO: 6198 - RNA, 22 nt, Human
gaaauagaggacagcuggauca

SEQ ID NO: 6199 - RNA, 22 nt, Human
gaaauaguacagcauaguucuu

SEQ ID NO: 6200 - RNA, 22 nt, Human
gaaauauugggacucagagcuu

SEQ ID NO: 6201 - RNA, 22 nt, Human
gaaaucaggaugauguuccaga

SEQ ID NO: 6202 - RNA, 22 nt, Human
gaaaucaguucugaaauuuaca

SEQ ID NO: 6203 - RNA, 22 nt, Human
gaaaucuacgauuagugaaaau

SEQ ID NO: 6204 - RNA, 22 nt, Human
gaaaucuacuuagugucuggau

SEQ ID NO: 6205 - RNA, 22 nt, Human
gaaaucugaacucuguauccuu

SEQ ID NO: 6206 - RNA, 22 nt, Human
gaaaucugaaucuucuguuggu

SEQ ID NO: 6207 - RNA, 22 nt, Human
gaaaucuuuauggaaauaacaa

SEQ ID NO: 6208 - RNA, 22 nt, Human
cuuugcagcucuagguggaagc

SEQ ID NO: 6209 - RNA, 22 nt, Human
cuuugcaggaguaugugauaau

SEQ ID NO: 6210 - RNA, 19 nt, Human
cuuugcaggggauggguga

SEQ ID NO: 6211 - RNA, 22 nt, Human
cuuugcagugaauccauaaaua

SEQ ID NO: 6212 - RNA, 18 nt, Human
cuuugcaguuacagggca

SEQ ID NO: 6213 - RNA, 23 nt, Human
cuuugccacccagagccugacag

SEQ ID NO: 6214 - RNA, 19 nt, Human
cuuugccacugauaggagu

SEQ ID NO: 6215 - RNA, 22 nt, Human
cuuugccauguugccugcagaa

SEQ ID NO: 6216 - RNA, 22 nt, Human
cuuugcuaauguugcauuuuca

SEQ ID NO: 6217 - RNA, 22 nt, Human
cuuugcuacugugaauagugcc

SEQ ID NO: 6218 - RNA, 18 nt, Human
cuuugcuauaaauuguau

SEQ ID NO: 6219 - RNA, 22 nt, Human
cuuugcuguuauaaugauagcu

SEQ ID NO: 6220 - RNA, 22 nt, Human
cuuugcuuacuggugucugcau

SEQ ID NO: 6221 - RNA, 19 nt, Human
cuuugcuuguuucuguguc

SEQ ID NO: 6222 - RNA, 22 nt, Human
cuuuggaaagugguucagguga

SEQ ID NO: 6223 - RNA, 22 nt, Human
cuuuggaacaagaagaaauggc

SEQ ID NO: 6224 - RNA, 22 nt, Human
gaaauguuaugagauauguacu

SEQ ID NO: 6225 - RNA, 22 nt, Human
gaaauguuccugaucccugauu

SEQ ID NO: 6226 - RNA, 22 nt, Human
gaaauguuguccugucucuuga

SEQ ID NO: 6227 - RNA, 22 nt, Human
gaaauguuuccuuuuguaugcu

SEQ ID NO: 6228 - RNA, 23 nt, Human
gaaauguuucuugauuaauccua

SEQ ID NO: 6229 - RNA, 22 nt, Human
gaaauuaaccaccuuuggcuuu

SEQ ID NO: 6230 - RNA, 22 nt, Human
gaaauuauugcuagagacugca

SEQ ID NO: 6231 - RNA, 22 nt, Human
gaaauucaaaaugucaguauag

SEQ ID NO: 6232 - RNA, 22 nt, Human
gaaauucaggacaaagacucuu

SEQ ID NO: 6233 - RNA, 22 nt, Human
gaaauugucagugauaugauac

SEQ ID NO: 6234 - RNA, 22 nt, Human
gaacaaacagucaggacagucu

SEQ ID NO: 6235 - RNA, 22 nt, Human
gaacaaauuggagaaaucagga

SEQ ID NO: 6236 - RNA, 22 nt, Human
gaacacaacucagaaugcuggu

SEQ ID NO: 6237 - RNA, 22 nt, Human
gaacacaagcguaugucuuugu

SEQ ID NO: 6238 - RNA, 22 nt, Human
gaacacagucaagggcugcugu

SEQ ID NO: 6239 - RNA, 22 nt, Human
gaacaccuggguccccuggggc

SEQ ID NO: 6240 - RNA, 22 nt, Human
gaacacugagaaagucagcuuu

SEQ ID NO: 6241 - RNA, 22 nt, Human
gaacacugggguaucauugagc

SEQ ID NO: 6242 - RNA, 19 nt, Human
gaacacuuacuauauuucu

SEQ ID NO: 6243 - RNA, 22 nt, Human
gaacacuuggcuuuggauuuaa

SEQ ID NO: 6244 - RNA, 22 nt, Human
gaacacuuuaacauuccuuuuc

SEQ ID NO: 6245 - RNA, 23 nt, Human
gaacagacauuagugagccaggc

SEQ ID NO: 6246 - RNA, 22 nt, Human
gaacagacuuggaggagugauc

SEQ ID NO: 6247 - RNA, 22 nt, Human
gaacagagaagcuuuacuaaag

SEQ ID NO: 6248 - RNA, 22 nt, Human
gaacagagcugacuacaaggca

SEQ ID NO: 6249 - RNA, 17 nt, Human
gaacagcagaggggaca

SEQ ID NO: 6250 - RNA, 22 nt, Human
gaacagcaugcaugcaagacua

SEQ ID NO: 6251 - RNA, 22 nt, Human
gaacagcuucuugggagcuggg

SEQ ID NO: 6252 - RNA, 22 nt, Human
gaacagguaaucaguaaaaugu

SEQ ID NO: 6253 - RNA, 22 nt, Human
gaacaguaacugucugcugugu

SEQ ID NO: 6254 - RNA, 22 nt, Human
gaacaguacuaagagcuuuaca

SEQ ID NO: 6255 - RNA, 22 nt, Human
gaacaguauuuccaggaauccc

SEQ ID NO: 6256 - RNA, 22 nt, Human
gaacagugccagcacacaauaa

SEQ ID NO: 6257 - RNA, 22 nt, Human
gaacaucaaggucugugucuag

SEQ ID NO: 6258 - RNA, 22 nt, Human
gaacaucaugaagaaaacauau

SEQ ID NO: 6259 - RNA, 22 nt, Human
gaacaugauggcuguuauuuug

SEQ ID NO: 6260 - RNA, 22 nt, Human
gaacauuauuguacaaaugucu

SEQ ID NO: 6261 - RNA, 23 nt, Human
gaacauucauugguugcuuuaga

SEQ ID NO: 6262 - RNA, 22 nt, Human
gaacauuugaugaugacauugg

SEQ ID NO: 6263 - RNA, 21 nt, Human
gaacauuuggguuguuucuac

SEQ ID NO: 6264 - RNA, 22 nt, Human
gaaccaugagaaauugcuauuu

SEQ ID NO: 6265 - RNA, 22 nt, Human
gaacccaguccaggugcagccu

SEQ ID NO: 6266 - RNA, 22 nt, Human
gaaccucuuugugcuucagcuu

SEQ ID NO: 6267 - RNA, 20 nt, Human
gaaccuggggaaggaguagg

SEQ ID NO: 6268 - RNA, 22 nt, Human
gaacgcacuuuguaaacuguaa

SEQ ID NO: 6269 - RNA, 22 nt, Human
gaacuacaggugcagcaaguga

SEQ ID NO: 6270 - RNA, 22 nt, Human
gaacuacaguaagaauugaugu

SEQ ID NO: 6271 - RNA, 22 nt, Human
gaacucuugguggucauuagau

SEQ ID NO: 6272 - RNA, 19 nt, Human
gaacugaggucugaggcuu

SEQ ID NO: 6273 - RNA, 22 nt, Human
gaacuggugagaguucacggga

SEQ ID NO: 6274 - RNA, 22 nt, Human
gaacuguaaaauaauuggcaau

SEQ ID NO: 6275 - RNA, 22 nt, Human
gaacuguuuuuaaguccuaaga

SEQ ID NO: 6276 - RNA, 22 nt, Human
gaacuuggaccugguccuuugg

SEQ ID NO: 6277 - RNA, 22 nt, Human
gaacuuuaaaacaaaguacagu

SEQ ID NO: 6278 - RNA, 22 nt, Human
gaacuuugcaaaugucagaagc

SEQ ID NO: 6279 - RNA, 17 nt, Human
gaacuuuuauuaaauuc

SEQ ID NO: 6280 - RNA, 22 nt, Human
gaagaaauugaauucaugagcu

SEQ ID NO: 6281 - RNA, 22 nt, Human
gaagaacaagcagugcuuuccu

SEQ ID NO: 6282 - RNA, 22 nt, Human
gaagaacuuuagggcagaauuu

SEQ ID NO: 6283 - RNA, 22 nt, Human
gaagaagacauggaacaauagu

SEQ ID NO: 6284 - RNA, 22 nt, Human
gaagaaggguaaggaguguuga

SEQ ID NO: 6285 - RNA, 22 nt, Human
gaagaaguauuuuuguccuguu

SEQ ID NO: 6286 - RNA, 19 nt, Human
gaagaaguuggaggaucuc

SEQ ID NO: 6287 - RNA, 22 nt, Human
gaagaauauauaaugauuuugu

SEQ ID NO: 6288 - RNA, 22 nt, Human
gaagaauccaugcuaauuuacc

SEQ ID NO: 6289 - RNA, 22 nt, Human
gaagaauccuguccucuuuagg

SEQ ID NO: 6290 - RNA, 22 nt, Human
gaagacacaauuggugggucca

SEQ ID NO: 6291 - RNA, 22 nt, Human
gaagacacucugcagaguuauc

SEQ ID NO: 6292 - RNA, 22 nt, Human
gaagacauguggauucuaguuu

SEQ ID NO: 6293 - RNA, 22 nt, Human
gaagaccacccccuacagcaca

SEQ ID NO: 6294 - RNA, 22 nt, Human
gaagaccauauucagcaggcau

SEQ ID NO: 6295 - RNA, 22 nt, Human
gaagagaaaggcaaggaguuuu

SEQ ID NO: 6296 - RNA, 22 nt, Human
gaagagaagguguaggccaucc

SEQ ID NO: 6297 - RNA, 22 nt, Human
gaagagagcagcaaacuggagu

SEQ ID NO: 6298 - RNA, 21 nt, Human
gaagagaguccucauccugag

SEQ ID NO: 6299 - RNA, 22 nt, Human
gaagagcuccaaaaacagugag

SEQ ID NO: 6300 - RNA, 22 nt, Human
gaagagcugacagugucauccu

SEQ ID NO: 6301 - RNA, 22 nt, Human
gaagagcugcacacuggggacu

SEQ ID NO: 6302 - RNA, 22 nt, Human
gaagagcuguagccugcucuuu

SEQ ID NO: 6303 - RNA, 22 nt, Human
gaagauaauuccuacuuauaac

SEQ ID NO: 6304 - RNA, 22 nt, Human
gaagauauucucuaaauacuuu

SEQ ID NO: 6305 - RNA, 22 nt, Human
gaagaucagaguaagcuuuuua

SEQ ID NO: 6306 - RNA, 22 nt, Human
gaagauguuauggagagcucag

SEQ ID NO: 6307 - RNA, 22 nt, Human
gaagauuuauaggagccuauua

SEQ ID NO: 6308 - RNA, 22 nt, Human
gaagauuuguuguaauuuuuag

SEQ ID NO: 6309 - RNA, 22 nt, Human
gaagauuuucuccuuuaaauga

SEQ ID NO: 6310 - RNA, 22 nt, Human
gaagcaaguggccugauucaga

SEQ ID NO: 6311 - RNA, 22 nt, Human
gaagcaaucuggcucccagcca

SEQ ID NO: 6312 - RNA, 22 nt, Human
gaagcacagggcucgaucucag

SEQ ID NO: 6313 - RNA, 22 nt, Human
gaagcacauggcugugagcaac

SEQ ID NO: 6314 - RNA, 22 nt, Human
gaagcacauuagaugugucuuc

SEQ ID NO: 6315 - RNA, 22 nt, Human
gaagcagaacccacuccccaac

SEQ ID NO: 6316 - RNA, 22 nt, Human
gaagcagaagguuuggacgugc

SEQ ID NO: 6317 - RNA, 22 nt, Human
ggagugaaucacuagaugcaga

SEQ ID NO: 6318 - RNA, 22 nt, Human
ggagugagagaguuuaagguca

SEQ ID NO: 6319 - RNA, 22 nt, Human
ggagugagcaaauagagauuug

SEQ ID NO: 6320 - RNA, 22 nt, Human
ggagugaggcauuuguagcuga

SEQ ID NO: 6321 - RNA, 22 nt, Human
ggagugaguggccuugucacug

SEQ ID NO: 6322 - RNA, 23 nt, Human
ggagugcaauggcgccaucucgg

SEQ ID NO: 6323 - RNA, 22 nt, Human
ggaguggccucuccugugcagg

SEQ ID NO: 6324 - RNA, 22 nt, Human
ggaguggcuguuucugccccca

SEQ ID NO: 6325 - RNA, 22 nt, Human
ggaguggugucacugagaggaa

SEQ ID NO: 6326 - RNA, 17 nt, Human
ggaguucugcagucagg

SEQ ID NO: 6327 - RNA, 22 nt, Human
ggaguugacggccgacacccag

SEQ ID NO: 6328 - RNA, 19 nt, Human
ggaguuuccaauggguaaa

SEQ ID NO: 6329 - RNA, 23 nt, Human
ggauaaaucucagcuucuuccau

SEQ ID NO: 6330 - RNA, 22 nt, Human
ggauacaacuagaagauggcag

SEQ ID NO: 6331 - RNA, 22 nt, Human
ggaucagaaucucugagaguuu

SEQ ID NO: 6332 - RNA, 22 nt, Human
ggaucaggcgccaugggaagug

SEQ ID NO: 6333 - RNA, 22 nt, Human
ggaucauuaacacauccaucac

SEQ ID NO: 6334 - RNA, 19 nt, Human
ggauccagaggaucugcca

SEQ ID NO: 6335 - RNA, 22 nt, Human
ggaugacagaugcaggcuuuga

SEQ ID NO: 6336 - RNA, 19 nt, Human
ggaugagggucaggcauag

SEQ ID NO: 6337 - RNA, 22 nt, Human
ggaugcaggaggucggggagca

SEQ ID NO: 6338 - RNA, 22 nt, Human
ggaugcaugugcauuuugaaaa

SEQ ID NO: 6339 - RNA, 17 nt, Human
cuucuagaaggcaaacu

SEQ ID NO: 6340 - RNA, 22 nt, Human
cuucuaggucuugauugaaugu

SEQ ID NO: 6341 - RNA, 22 nt, Human
cuucucaacugcacuugccagg

SEQ ID NO: 6342 - RNA, 22 nt, Human
cuucucagagcuuccagaaaac

SEQ ID NO: 6343 - RNA, 22 nt, Human
cuucucagaucucagcuuugag

SEQ ID NO: 6344 - RNA, 22 nt, Human
cuucucagcauuuugucagucu

SEQ ID NO: 6345 - RNA, 19 nt, Human
cuucuccagcuucuagaag

SEQ ID NO: 6346 - RNA, 22 nt, Human
cuucuccucugaguccugggag

SEQ ID NO: 6347 - RNA, 22 nt, Human
cuucuccuguaagaagaucaaa

SEQ ID NO: 6348 - RNA, 22 nt, Human
cuucucuacuuccuggaagggg

SEQ ID NO: 6349 - RNA, 22 nt, Human
cuucucucccuggcacucagac

SEQ ID NO: 6350 - RNA, 22 nt, Human
cuucucucugcauaggcauggg

SEQ ID NO: 6351 - RNA, 22 nt, Human
cuucucugcccauaggaaaugc

SEQ ID NO: 6352 - RNA, 22 nt, Human
cuucugaguuaacaguagauuu

SEQ ID NO: 6353 - RNA, 22 nt, Human
cuucugcaggccuuauuuuagu

SEQ ID NO: 6354 - RNA, 19 nt, Human
cuucugcagggugacagug

SEQ ID NO: 6355 - RNA, 22 nt, Human
cuucugccccuguagccugagu

SEQ ID NO: 6356 - RNA, 22 nt, Human
cuucugcugccgccucggcaca

SEQ ID NO: 6357 - RNA, 22 nt, Human
cuucugcugcuguucaugguug

SEQ ID NO: 6358 - RNA, 22 nt, Human
cuucuggagcucaccaacuucc

SEQ ID NO: 6359 - RNA, 22 nt, Human
cuucuggaggcuccagggaggu

SEQ ID NO: 6360 - RNA, 22 nt, Human
cuucuggcaaaacaggcagaaa

SEQ ID NO: 6361 - RNA, 19 nt, Human
cuucuggcccugagccacc

SEQ ID NO: 6362 - RNA, 22 nt, Human
cuucugggcagaaguuuugaga

SEQ ID NO: 6363 - RNA, 22 nt, Human
cuucuggguugcaggucuuggc

SEQ ID NO: 6364 - RNA, 22 nt, Human
cuucugugaagagcagaaccau

SEQ ID NO: 6365 - RNA, 22 nt, Human
cuucugugcuaaaugcaaaacc

SEQ ID NO: 6366 - RNA, 22 nt, Human
cuucuguguuuuacuauaugua

SEQ ID NO: 6367 - RNA, 22 nt, Human
cuucuuaacuguauauacuaug

SEQ ID NO: 6368 - RNA, 22 nt, Human
cuucuuaucaaguggcaaaucu

SEQ ID NO: 6369 - RNA, 22 nt, Human
cuucuucagaggccagccucug

SEQ ID NO: 6370 - RNA, 20 nt, Human
cuucuucagccuaugcuuca

SEQ ID NO: 6371 - RNA, 22 nt, Human
cuucuucauaggcaguccuguu

SEQ ID NO: 6372 - RNA, 22 nt, Human
cuucuucaucuguaaaacuugg

SEQ ID NO: 6373 - RNA, 22 nt, Human
cuucuucauguauugauagucu

SEQ ID NO: 6374 - RNA, 22 nt, Human
cuucuucucaaggggcaggugg

SEQ ID NO: 6375 - RNA, 22 nt, Human
cuucuucuggacaggcagcucc

SEQ ID NO: 6376 - RNA, 22 nt, Human
cuucuucugguuuauguggcaa

SEQ ID NO: 6377 - RNA, 22 nt, Human
cuucuucuucccccuucagggg

SEQ ID NO: 6378 - RNA, 19 nt, Human
cuucuucuuggcagccaag

SEQ ID NO: 6379 - RNA, 20 nt, Human
cuucuuggagaugguguuuu

SEQ ID NO: 6380 - RNA, 22 nt, Human
cuucuuggcugcaagucucugu

SEQ ID NO: 6381 - RNA, 22 nt, Human
cuucuugggcugccaguuucag

SEQ ID NO: 6382 - RNA, 21 nt, Human
cuucuuggggagcagcuagac

SEQ ID NO: 6383 - RNA, 22 nt, Human
cuucuugggucagagaaucauu

SEQ ID NO: 6384 - RNA, 22 nt, Human
cuucuuggugauggcuuaccug

SEQ ID NO: 6385 - RNA, 22 nt, Human
cuucuugguugguuucauucca

SEQ ID NO: 6386 - RNA, 22 nt, Human
cuucuugucagugauuucuucc

SEQ ID NO: 6387 - RNA, 22 nt, Human
cuucuugugcacucucuaugua

SEQ ID NO: 6388 - RNA, 18 nt, Human
cuucuuguuugauuuggg

SEQ ID NO: 6389 - RNA, 22 nt, Human
cuucuuucaagaauggauuagg

SEQ ID NO: 6390 - RNA, 22 nt, Human
cuucuuucccaggcauguuuua

SEQ ID NO: 6391 - RNA, 22 nt, Human
cuucuuugaaaaaggcagucag

SEQ ID NO: 6392 - RNA, 22 nt, Human
cuugaaagcuuugcgucuucua

SEQ ID NO: 6393 - RNA, 22 nt, Human
cuugaaaugacaggagcacauc

SEQ ID NO: 6394 - RNA, 22 nt, Human
cuugaaccaaucacuguagcca

SEQ ID NO: 6395 - RNA, 22 nt, Human
cuugaagaaaguauguugggau

SEQ ID NO: 6396 - RNA, 22 nt, Human
cuugaaguggagcuuuugaaau

SEQ ID NO: 6397 - RNA, 22 nt, Human
cuugaauccaaaugggagauga

SEQ ID NO: 6398 - RNA, 22 nt, Human
cuugaauguaaauaauguacag

SEQ ID NO: 6399 - RNA, 22 nt, Human
cuugacauuaguuaugcagaua

SEQ ID NO: 6400 - RNA, 22 nt, Human
cuugagaaaggaacaggaagcu

SEQ ID NO: 6401 - RNA, 22 nt, Human
cuugagaaugugagccacagau

SEQ ID NO: 6402 - RNA, 21 nt, Human
cuugagaauuaacuguucauu

SEQ ID NO: 6403 - RNA, 22 nt, Human
cuugagagccacuccuggggcc

SEQ ID NO: 6404 - RNA, 22 nt, Human
cuugagcacagcggcuucagga

SEQ ID NO: 6405 - RNA, 22 nt, Human
cuugagguaugaaaccugcauu

SEQ ID NO: 6406 - RNA, 22 nt, Human
cuugagguuuugacucagcuuu

SEQ ID NO: 6407 - RNA, 22 nt, Human
cuugaguaaagaaguauuuuag

SEQ ID NO: 6408 - RNA, 22 nt, Human
cuugaguuacagcucuccaaga

SEQ ID NO: 6409 - RNA, 22 nt, Human
cuugauccuaggauggaaggga

SEQ ID NO: 6410 - RNA, 22 nt, Human
cuugaucuacauagugaaaccc

SEQ ID NO: 6411 - RNA, 22 nt, Human
cuugaugaaauuuuucaauugu

SEQ ID NO: 6412 - RNA, 22 nt, Human
cuugaugacucaggaggaggag

SEQ ID NO: 6413 - RNA, 22 nt, Human
cuugaugagccuagugcuuaga

SEQ ID NO: 6414 - RNA, 22 nt, Human
cuugaugauagaaugugaggag

SEQ ID NO: 6415 - RNA, 22 nt, Human
cuugaugauagcaggcagggaa

SEQ ID NO: 6416 - RNA, 22 nt, Human
cuugauuuauuacccacuauau

SEQ ID NO: 6417 - RNA, 22 nt, Human
cuugcaaaguagcugagagguu

SEQ ID NO: 6418 - RNA, 22 nt, Human
cuugcacagaacucuuagaggu

SEQ ID NO: 6419 - RNA, 22 nt, Human
cuugcagccuuaccaaggcauu

SEQ ID NO: 6420 - RNA, 22 nt, Human
cuugcaggcccagccuuacaag

SEQ ID NO: 6421 - RNA, 22 nt, Human
cuugcaggccuuucuagcucua

SEQ ID NO: 6422 - RNA, 22 nt, Human
cuugcaguguggccuugaagag

SEQ ID NO: 6423 - RNA, 22 nt, Human
cuugccaguguugcagaagcuc

SEQ ID NO: 6424 - RNA, 20 nt, Human
cuugcccagggucuccugcc

SEQ ID NO: 6425 - RNA, 23 nt, Human
cuugccuggccucucugcccaga

SEQ ID NO: 6426 - RNA, 22 nt, Human
gaauugcugaugaaucugauug

SEQ ID NO: 6427 - RNA, 22 nt, Human
gaauuguacgcuuuacauaggu

SEQ ID NO: 6428 - RNA, 22 nt, Human
gaauuguaugcaguuacuugga

SEQ ID NO: 6429 - RNA, 22 nt, Human
gaauuuaaggaccaagcauuuu

SEQ ID NO: 6430 - RNA, 22 nt, Human
gaauuuacaaguugaauaacaa

SEQ ID NO: 6431 - RNA, 22 nt, Human
gaauuucaacaguccucaaaug

SEQ ID NO: 6432 - RNA, 22 nt, Human
gaauuucacaaggugaggauaa

SEQ ID NO: 6433 - RNA, 22 nt, Human
gaauuucagagguaacaucauc

SEQ ID NO: 6434 - RNA, 22 nt, Human
gaauuucaggacaacuggaagg

SEQ ID NO: 6435 - RNA, 22 nt, Human
gaauuugggguguguuauuuca

SEQ ID NO: 6436 - RNA, 22 nt, Human
gaauuugucccuugauauaaaa

SEQ ID NO: 6437 - RNA, 19 nt, Human
gaauuuuaggacuucagca

SEQ ID NO: 6438 - RNA, 22 nt, Human
gaauuuugcuuuuaugucaagu

SEQ ID NO: 6439 - RNA, 22 nt, Human
gacaaaaguguuuugaacaagg

SEQ ID NO: 6440 - RNA, 22 nt, Human
gacaaagagaaguaacaguacc

SEQ ID NO: 6441 - RNA, 22 nt, Human
gacaaagcgccugcucgcgggc

SEQ ID NO: 6442 - RNA, 22 nt, Human
gacaaagucaacaguacucuca

SEQ ID NO: 6443 - RNA, 22 nt, Human
gacaaaugaagucacugaccuu

SEQ ID NO: 6444 - RNA, 22 nt, Human
gacaacaauaauguggagcuga

SEQ ID NO: 6445 - RNA, 20 nt, Human
gacaacacagcuucaggucc

SEQ ID NO: 6446 - RNA, 22 nt, Human
gacaacagugguuucagguucc

SEQ ID NO: 6447 - RNA, 22 nt, Human
gacaagacaccucucuccaucc

SEQ ID NO: 6448 - RNA, 22 nt, Human
gacaagacagcuugcagacaac

SEQ ID NO: 6449 - RNA, 22 nt, Human
gacaagacaugugaugacauca

SEQ ID NO: 6450 - RNA, 22 nt, Human
gacaagacauugguaaagauau

SEQ ID NO: 6451 - RNA, 22 nt, Human
gacaagauaaugaagugcaauu

SEQ ID NO: 6452 - RNA, 22 nt, Human
gacaagauuaaccauaguuaag

SEQ ID NO: 6453 - RNA, 22 nt, Human
gacaagauuuagagucugcuaa

SEQ ID NO: 6454 - RNA, 22 nt, Human
gacaagcaggcuccugaagaaa

SEQ ID NO: 6455 - RNA, 22 nt, Human
gacaaggaaauuacuagcugga

SEQ ID NO: 6456 - RNA, 16 nt, Human
gacaaguggaggggcc

SEQ ID NO: 6457 - RNA, 21 nt, Human
gacaaugcagucuuuuuugga

SEQ ID NO: 6458 - RNA, 22 nt, Human
gacaauguaaaucaggauagca

SEQ ID NO: 6459 - RNA, 22 nt, Human
gacaauguguugaaagggaaaa

SEQ ID NO: 6460 - RNA, 22 nt, Human
gacaauuagguuaagagcaaga

SEQ ID NO: 6461 - RNA, 21 nt, Human
gacacaaaggguaguaauggu

SEQ ID NO: 6462 - RNA, 22 nt, Human
gacacagaauuuacucccgaua

SEQ ID NO: 6463 - RNA, 22 nt, Human
gacacagacaguuagagguaau

SEQ ID NO: 6464 - RNA, 22 nt, Human
gacacagagggcaccagauaug

SEQ ID NO: 6465 - RNA, 22 nt, Human
gacacagaugaucaggugugga

SEQ ID NO: 6466 - RNA, 22 nt, Human
gacacagcuuucugaagagcau

SEQ ID NO: 6467 - RNA, 22 nt, Human
gacacaggaaucaccuuggaug

SEQ ID NO: 6468 - RNA, 22 nt, Human
gacacaggauuccuggcucugc

SEQ ID NO: 6469 - RNA, 20 nt, Human
gacacaggcaguccucagag

SEQ ID NO: 6470 - RNA, 22 nt, Human
gaaaucuuuuaaccauucauuu

SEQ ID NO: 6471 - RNA, 22 nt, Human
gaaaucuuuucaucucauuuga

SEQ ID NO: 6472 - RNA, 22 nt, Human
gaaaucuuuuccaauuguuuag

SEQ ID NO: 6473 - RNA, 22 nt, Human
gaaaugaacugauuaucauugc

SEQ ID NO: 6474 - RNA, 22 nt, Human
gaaaugcagauucugauucugu

SEQ ID NO: 6475 - RNA, 22 nt, Human
gaaaugcaggcuuggauucagc

SEQ ID NO: 6476 - RNA, 22 nt, Human
gaaaugcauaaucuuaguagau

SEQ ID NO: 6477 - RNA, 22 nt, Human
gaaaugcuacacuuguuaauga

SEQ ID NO: 6478 - RNA, 22 nt, Human
gaaauguaauucucuugaagau

SEQ ID NO: 6479 - RNA, 22 nt, Human
gaaauguagaauugcuuaacug

SEQ ID NO: 6480 - RNA, 22 nt, Human
gaaauguauaagcuggucuuuu

SEQ ID NO: 6481 - RNA, 22 nt, Human
gaaauguaugucuucccccauu

SEQ ID NO: 6482 - RNA, 22 nt, Human
gaaaugucauugccuucagccc

SEQ ID NO: 6483 - RNA, 22 nt, Human
gaaaugucucuggauuugcuuu

SEQ ID NO: 6484 - RNA, 22 nt, Human
gaaaugucuuugacaagagagg

SEQ ID NO: 6485 - RNA, 22 nt, Human
gaaauguuuuacaaggcauacu

SEQ ID NO: 6486 - RNA, 22 nt, Human
gaaauucacuguauuucuuggg

SEQ ID NO: 6487 - RNA, 20 nt, Human
gaaauucucguauuaguuua

SEQ ID NO: 6488 - RNA, 22 nt, Human
gaaauucugugucccagagugc

SEQ ID NO: 6489 - RNA, 22 nt, Human
gaaauugccagaucuaguagau

SEQ ID NO: 6490 - RNA, 22 nt, Human
gaaauugucagcuucuuucagu

SEQ ID NO: 6491 - RNA, 22 nt, Human
gaaauugugcauuuagcaacac

SEQ ID NO: 6492 - RNA, 22 nt, Human
gaacaaauucucaucaacuugu

SEQ ID NO: 6493 - RNA, 22 nt, Human
gaacaacucuucuugagagaug

SEQ ID NO: 6494 - RNA, 22 nt, Human
gaacaaggauucccaaagaaga

SEQ ID NO: 6495 - RNA, 22 nt, Human
gaacacagcagggauaaccacu

SEQ ID NO: 6496 - RNA, 22 nt, Human
gaacacagcggggcuuacccgg

SEQ ID NO: 6497 - RNA, 22 nt, Human
gaacacagugguuguuuggagg

SEQ ID NO: 6498 - RNA, 22 nt, Human
gaacacaucacauuuuacagug

SEQ ID NO: 6499 - RNA, 22 nt, Human
gaacacaugauuauaaaugcua

SEQ ID NO: 6500 - RNA, 22 nt, Human
gaacacauguccuccuuggauu

SEQ ID NO: 6501 - RNA, 22 nt, Human
gaacacucauggaagaguuuuu

SEQ ID NO: 6502 - RNA, 22 nt, Human
gaacacuugcuguuaauaagug

SEQ ID NO: 6503 - RNA, 22 nt, Human
gaacagaagaggcuggugccac

SEQ ID NO: 6504 - RNA, 22 nt, Human
gaacagaauuaccgaagaucug

SEQ ID NO: 6505 - RNA, 22 nt, Human
gaacagacuuugccaauuacag

SEQ ID NO: 6506 - RNA, 22 nt, Human
gaacagaguugaaacaaggcug

SEQ ID NO: 6507 - RNA, 18 nt, Human
gaacagcaauuucauguu

SEQ ID NO: 6508 - RNA, 22 nt, Human
gaacagcauguaagaagcuacu

SEQ ID NO: 6509 - RNA, 22 nt, Human
gaacagcucugaagcaguaaau

SEQ ID NO: 6510 - RNA, 22 nt, Human
gaacagcugcuagagaucugug

SEQ ID NO: 6511 - RNA, 21 nt, Human
gaacaggaaaagcuggcuuca

SEQ ID NO: 6512 - RNA, 22 nt, Human
gaacagggaguacggcacauuu

SEQ ID NO: 6513 - RNA, 22 nt, Human
gaacaggguugggugagagagg

SEQ ID NO: 6514 - RNA, 22 nt, Human
gaacaguagaugagaugcuaga

SEQ ID NO: 6515 - RNA, 22 nt, Human
gaacaguuucccuguagaaaau

SEQ ID NO: 6516 - RNA, 22 nt, Human
gaacauacaagaauuaaguaca

SEQ ID NO: 6517 - RNA, 22 nt, Human
gaacaucugggaucauugcugu

SEQ ID NO: 6518 - RNA, 22 nt, Human
gaacaucugugaucucuuuggg

SEQ ID NO: 6519 - RNA, 20 nt, Human
gaacauggcagguggagggg

SEQ ID NO: 6520 - RNA, 22 nt, Human
gaacauuuauauuagauagcua

SEQ ID NO: 6521 - RNA, 20 nt, Human
gaacauuuggccauacugag

SEQ ID NO: 6522 - RNA, 22 nt, Human
gaaccacaaugugaagaaggag

SEQ ID NO: 6523 - RNA, 22 nt, Human
gaaccagcaguugccugaaaaa

SEQ ID NO: 6524 - RNA, 22 nt, Human
gaaccauuucugaauaguuugu

SEQ ID NO: 6525 - RNA, 21 nt, Human
gaacccagcagcagugcucug

SEQ ID NO: 6526 - RNA, 23 nt, Human
gaacccagcucugccacuugcca

SEQ ID NO: 6527 - RNA, 22 nt, Human
gaaccucagugaaacuggaggu

SEQ ID NO: 6528 - RNA, 22 nt, Human
gaaccucucagcagccaugauc

SEQ ID NO: 6529 - RNA, 20 nt, Human
gaaccucucccagccccugg

SEQ ID NO: 6530 - RNA, 22 nt, Human
gaaccucuuuaaagaacagaau

SEQ ID NO: 6531 - RNA, 21 nt, Human
gaaccugagugaagacuuggg

SEQ ID NO: 6532 - RNA, 22 nt, Human
gaaccuggaaucuauuacaagg

SEQ ID NO: 6533 - RNA, 22 nt, Human
gaaccuguaaguauagaugugg

SEQ ID NO: 6534 - RNA, 22 nt, Human
gaaccuguccugagugaggagu

SEQ ID NO: 6535 - RNA, 22 nt, Human
gaaggcuggggcaucagugaaa

SEQ ID NO: 6536 - RNA, 22 nt, Human
gaaggcuggggccuucucaucu

SEQ ID NO: 6537 - RNA, 16 nt, Human
gaaggcuuacugcagg

SEQ ID NO: 6538 - RNA, 22 nt, Human
gaaggcuuaugugugacuuucg

SEQ ID NO: 6539 - RNA, 22 nt, Human
gaagggaacugggucuccuugu

SEQ ID NO: 6540 - RNA, 22 nt, Human
gaagggaauuuggaggguuuca

SEQ ID NO: 6541 - RNA, 22 nt, Human
gaagggagaagguugggugacg

SEQ ID NO: 6542 - RNA, 19 nt, Human
gaaggggaagguggguacc

SEQ ID NO: 6543 - RNA, 22 nt, Human
gaaggggaguggcuagugugug

SEQ ID NO: 6544 - RNA, 22 nt, Human
gaagggggagcucuuccuaauu

SEQ ID NO: 6545 - RNA, 22 nt, Human
gaaggggguugcagucuagggu

SEQ ID NO: 6546 - RNA, 22 nt, Human
gaagguagcugcugagaugaca

SEQ ID NO: 6547 - RNA, 22 nt, Human
gaagguguccacuucucaccuc

SEQ ID NO: 6548 - RNA, 22 nt, Human
gaagguuuucaggagccuaguc

SEQ ID NO: 6549 - RNA, 22 nt, Human
gaagguuuuguuugcaaaucau

SEQ ID NO: 6550 - RNA, 22 nt, Human
gaaguacauucugauagggaag

SEQ ID NO: 6551 - RNA, 22 nt, Human
gaaguagaaagccucguaaaua

SEQ ID NO: 6552 - RNA, 22 nt, Human
gaaguagauucguugcaucuug

SEQ ID NO: 6553 - RNA, 23 nt, Human
gaagucagcccuacagagagcag

SEQ ID NO: 6554 - RNA, 22 nt, Human
gaaguccucaaugcauugucuu

SEQ ID NO: 6555 - RNA, 22 nt, Human
gaaguccuccuaucuugcucuu

SEQ ID NO: 6556 - RNA, 19 nt, Human
gaaguccucuaguaaauuu

SEQ ID NO: 6557 - RNA, 22 nt, Human
gaaguccugguccucucauuca

SEQ ID NO: 6558 - RNA, 22 nt, Human
gaagucucacagacagaucaga

SEQ ID NO: 6559 - RNA, 22 nt, Human
gaagucucauaguuaaaauucu

SEQ ID NO: 6560 - RNA, 22 nt, Human
gaagucugagugggggccaggc

SEQ ID NO: 6561 - RNA, 22 nt, Human
gaagucugcugcucaggaguuu

SEQ ID NO: 6562 - RNA, 22 nt, Human
gaagucuggcugacgagaguua

SEQ ID NO: 6563 - RNA, 22 nt, Human
gaagucuuuucuuccacccaaa

SEQ ID NO: 6564 - RNA, 22 nt, Human
gaagugcaaccugaaauacuag

SEQ ID NO: 6565 - RNA, 22 nt, Human
gaaguggaauuacugggucaua

SEQ ID NO: 6566 - RNA, 23 nt, Human
gaagugucugagcuguauuuuuc

SEQ ID NO: 6567 - RNA, 20 nt, Human
gaagugucuuguuucuggau

SEQ ID NO: 6568 - RNA, 22 nt, Human
gaagugugaaggugauguggag

SEQ ID NO: 6569 - RNA, 22 nt, Human
gaaguuacauacugucacuucu

SEQ ID NO: 6570 - RNA, 22 nt, Human
gaaguuagauguggucacugac

SEQ ID NO: 6571 - RNA, 22 nt, Human
gaaguuagucauugaagcccca

SEQ ID NO: 6572 - RNA, 22 nt, Human
gaaguuauagcuaugaucuuaa

SEQ ID NO: 6573 - RNA, 22 nt, Human
gaaguuaucaaagauguauucu

SEQ ID NO: 6574 - RNA, 22 nt, Human
gaaguuauuugcuaucuacuga

SEQ ID NO: 6575 - RNA, 22 nt, Human
gaaguucaaaagacagauuuga

SEQ ID NO: 6576 - RNA, 22 nt, Human
gaaguucaacugccaugcuugg

SEQ ID NO: 6577 - RNA, 22 nt, Human
gaaguucuagaacugugcccuu

SEQ ID NO: 6578 - RNA, 22 nt, Human
gaaguucucaaggaucacagaa

SEQ ID NO: 6579 - RNA, 22 nt, Human
gaaguucugggauuuccacagu

SEQ ID NO: 6580 - RNA, 23 nt, Human
gaaguucuguucagccagacaag

SEQ ID NO: 6581 - RNA, 22 nt, Human
gaaguugauagaguacaugauu

SEQ ID NO: 6582 - RNA, 22 nt, Human
gaaguuguaagccugggaaggu

SEQ ID NO: 6583 - RNA, 22 nt, Human
gaaguuuagguucuuauguuua

SEQ ID NO: 6584 - RNA, 22 nt, Human
gaaguuuauuucaaucuauuca

SEQ ID NO: 6585 - RNA, 22 nt, Human
gaaguuugauuuuucuccuaga

SEQ ID NO: 6586 - RNA, 22 nt, Human
gaaguuuuagucaaaauguaga

SEQ ID NO: 6587 - RNA, 22 nt, Human
gaauaacauuuuuuccuuuaca

SEQ ID NO: 6588 - RNA, 23 nt, Human
gaauacaaagcagaugguccagc

SEQ ID NO: 6589 - RNA, 22 nt, Human
gacacaguaauguguuucaucu

SEQ ID NO: 6590 - RNA, 22 nt, Human
gacacaguagccagugcaguga

SEQ ID NO: 6591 - RNA, 22 nt, Human
gacacagucaagaguggaggaa

SEQ ID NO: 6592 - RNA, 19 nt, Human
gacacaguugguuccuuug

SEQ ID NO: 6593 - RNA, 22 nt, Human
gacacaguuuuucucacggugg

SEQ ID NO: 6594 - RNA, 22 nt, Human
gacacauagaucuaucucacuc

SEQ ID NO: 6595 - RNA, 22 nt, Human
gacacauaugcguauaguuuag

SEQ ID NO: 6596 - RNA, 18 nt, Human
gacacauccccaggccuc

SEQ ID NO: 6597 - RNA, 22 nt, Human
gacacaugucagacggacaccc

SEQ ID NO: 6598 - RNA, 22 nt, Human
gacacauugaugugaguacaua

SEQ ID NO: 6599 - RNA, 22 nt, Human
gacaccaguaaauauucaaaag

SEQ ID NO: 6600 - RNA, 22 nt, Human
gacacuacguggcucacauuuc

SEQ ID NO: 6601 - RNA, 22 nt, Human
gacacugaggcaugcagagccg

SEQ ID NO: 6602 - RNA, 22 nt, Human
gacacuggauuucuagaaaugu

SEQ ID NO: 6603 - RNA, 22 nt, Human
gacacuggcuugucccgccauc

SEQ ID NO: 6604 - RNA, 22 nt, Human
gacacuguuauggugagguaag

SEQ ID NO: 6605 - RNA, 22 nt, Human
gacacuuuauuaagcuguuguu

SEQ ID NO: 6606 - RNA, 22 nt, Human
gacacuuugggacucagcccua

SEQ ID NO: 6607 - RNA, 22 nt, Human
gacacuuuggugcuuugugguu

SEQ ID NO: 6608 - RNA, 22 nt, Human
gacacuuuuuuaaagcucauua

SEQ ID NO: 6609 - RNA, 22 nt, Human
gacagaacucaaacaugagaag

SEQ ID NO: 6610 - RNA, 22 nt, Human
gacagaaucaucuccugggacu

SEQ ID NO: 6611 - RNA, 22 nt, Human
gacagacaggagcucacaggca

SEQ ID NO: 6612 - RNA, 22 nt, Human
gacagacuaaauggcuguagga

SEQ ID NO: 6613 - RNA, 22 nt, Human
gacagagauugaaucaggaaau

SEQ ID NO: 6614 - RNA, 22 nt, Human
gacagcaaugacggggcagcug

SEQ ID NO: 6615 - RNA, 22 nt, Human
gacagcagaauccauucccagu

SEQ ID NO: 6616 - RNA, 22 nt, Human
gacagcagauacuuucauugaa

SEQ ID NO: 6617 - RNA, 22 nt, Human
gacagcagccacagggagaggg

SEQ ID NO: 6618 - RNA, 22 nt, Human
gacagcaggaugugaggggaug

SEQ ID NO: 6619 - RNA, 22 nt, Human
gacagcagggacauguaggaag

SEQ ID NO: 6620 - RNA, 22 nt, Human
gacagcaugaucaaggagccca

SEQ ID NO: 6621 - RNA, 22 nt, Human
gacagcauuccaucugcagguu

SEQ ID NO: 6622 - RNA, 22 nt, Human
gacagccaucagcacacgcugc

SEQ ID NO: 6623 - RNA, 22 nt, Human
gacagcuccuuuuggugcauau

SEQ ID NO: 6624 - RNA, 22 nt, Human
gacagcugaaaaauguaaggua

SEQ ID NO: 6625 - RNA, 22 nt, Human
gacagcugaacaggugggauaa

SEQ ID NO: 6626 - RNA, 22 nt, Human
gacagcuguacacuccugguua

SEQ ID NO: 6627 - RNA, 22 nt, Human
gacaggaacauaaauguaggag

SEQ ID NO: 6628 - RNA, 22 nt, Human
gacaggaauguguggaugcgga

SEQ ID NO: 6629 - RNA, 22 nt, Human
gacaggaggcagagcucaggug

SEQ ID NO: 6630 - RNA, 22 nt, Human
gacaggcaauuaccagcgccca

SEQ ID NO: 6631 - RNA, 22 nt, Human
gacaggccuagauucacugcug

SEQ ID NO: 6632 - RNA, 22 nt, Human
gacaggcuggcaaugcccugcu

SEQ ID NO: 6633 - RNA, 22 nt, Human
gacaggcuuagggagggugcuc

SEQ ID NO: 6634 - RNA, 22 nt, Human
gacaggcuucaugauggcagga

SEQ ID NO: 6635 - RNA, 22 nt, Human
gacaggcuuucucaggaugagc

SEQ ID NO: 6636 - RNA, 22 nt, Human
gacaggcuuugagucccagaac

SEQ ID NO: 6637 - RNA, 22 nt, Human
gacagggaacuucauuagcugu

SEQ ID NO: 6638 - RNA, 22 nt, Human
gacagggacacagccagugagg

SEQ ID NO: 6639 - RNA, 22 nt, Human
gacagggccaaaccggcugauc

SEQ ID NO: 6640 - RNA, 22 nt, Human
gacagggcgcccagccuguuuc

SEQ ID NO: 6641 - RNA, 23 nt, Human
gacagggcugacuuggcagcugc

SEQ ID NO: 6642 - RNA, 22 nt, Human
gacaggguggcugauagggcuc

SEQ ID NO: 6643 - RNA, 23 nt, Human
gacagguaaggguugggagaauc

SEQ ID NO: 6644 - RNA, 22 nt, Human
gaauucuaccagggcaagaggg

SEQ ID NO: 6645 - RNA, 22 nt, Human
gaauucugucgcuuacuagaug

SEQ ID NO: 6646 - RNA, 22 nt, Human
gaauugaauucauuuacucaaa

SEQ ID NO: 6647 - RNA, 22 nt, Human
gaauuguaugcugucuugauag

SEQ ID NO: 6648 - RNA, 22 nt, Human
gaauuguauugauuuuucagag

SEQ ID NO: 6649 - RNA, 22 nt, Human
gaauugucuuggccagugagaa

SEQ ID NO: 6650 - RNA, 22 nt, Human
gaauuuaaaggccagaccugag

SEQ ID NO: 6651 - RNA, 22 nt, Human
gaauuuaagaggaugaaucugu

SEQ ID NO: 6652 - RNA, 22 nt, Human
gaauuucagaucagagaccauu

SEQ ID NO: 6653 - RNA, 22 nt, Human
gaauuucagggucugguaggaa

SEQ ID NO: 6654 - RNA, 22 nt, Human
gaauuugaaaagugaugggaau

SEQ ID NO: 6655 - RNA, 22 nt, Human
gaauuugcaggugugcugugua

SEQ ID NO: 6656 - RNA, 22 nt, Human
gaauuugcuuucgugacagggu

SEQ ID NO: 6657 - RNA, 22 nt, Human
gaauuugugcucaggaagauua

SEQ ID NO: 6658 - RNA, 22 nt, Human
gaauuuuagaauaugugggcuu

SEQ ID NO: 6659 - RNA, 18 nt, Human
gacaaaaguacagacaga

SEQ ID NO: 6660 - RNA, 22 nt, Human
gacaaagcagacaagauaauuc

SEQ ID NO: 6661 - RNA, 22 nt, Human
gacaaagccuaagaaguauuua

SEQ ID NO: 6662 - RNA, 18 nt, Human
gacaaaugcaauuuaaag

SEQ ID NO: 6663 - RNA, 22 nt, Human
gacaaauguaccccuagagucu

SEQ ID NO: 6664 - RNA, 22 nt, Human
gacaacaggcagacgucagaaa

SEQ ID NO: 6665 - RNA, 22 nt, Human
gacaaccgagcagcugugggaa

SEQ ID NO: 6666 - RNA, 22 nt, Human
gacaagacuauguagaaaguau

SEQ ID NO: 6667 - RNA, 22 nt, Human
gacaaggcaaccagggaggcuu

SEQ ID NO: 6668 - RNA, 22 nt, Human
gacaaggguucugcagagccug

SEQ ID NO: 6669 - RNA, 22 nt, Human
gacaaggugauaauagcuucug

SEQ ID NO: 6670 - RNA, 22 nt, Human
gacaagucaucuggggccugug

SEQ ID NO: 6671 - RNA, 22 nt, Human
gacaagugcugauuuaucuccc

SEQ ID NO: 6672 - RNA, 22 nt, Human
gacaaguuguggagaagagggu

SEQ ID NO: 6673 - RNA, 22 nt, Human
gacaauaagaaaagaggaggca

SEQ ID NO: 6674 - RNA, 22 nt, Human
gacaauacagaaagggacaugc

SEQ ID NO: 6675 - RNA, 19 nt, Human
gacaauuagagaucacuca

SEQ ID NO: 6676 - RNA, 22 nt, Human
gacacagaaggucacauguuca

SEQ ID NO: 6677 - RNA, 22 nt, Human
gacacagaauuccccuccaagu

SEQ ID NO: 6678 - RNA, 22 nt, Human
gacacagaccaccaggcccugg

SEQ ID NO: 6679 - RNA, 22 nt, Human
gacacagagacuugcaguugua

SEQ ID NO: 6680 - RNA, 22 nt, Human
gacacagcacuguacaaggaau

SEQ ID NO: 6681 - RNA, 18 nt, Human
gacacaggagagaguccc

SEQ ID NO: 6682 - RNA, 23 nt, Human
gacacaggagcacccagcugagc

SEQ ID NO: 6683 - RNA, 22 nt, Human
gacacagggacgugcucugccu

SEQ ID NO: 6684 - RNA, 22 nt, Human
gacacagggggauguguggacg

SEQ ID NO: 6685 - RNA, 21 nt, Human
gacacaguaaucuuggggcuu

SEQ ID NO: 6686 - RNA, 22 nt, Human
gacacagugguucugugaguaa

SEQ ID NO: 6687 - RNA, 22 nt, Human
gacacaguuacuuauuuugccu

SEQ ID NO: 6688 - RNA, 22 nt, Human
gacacauacagcaguaagucua

SEQ ID NO: 6689 - RNA, 18 nt, Human
gacaccagccucugcccc

SEQ ID NO: 6690 - RNA, 22 nt, Human
gacaccaggucuguuguccucc

SEQ ID NO: 6691 - RNA, 22 nt, Human
gacacuauaugacacuucaguu

SEQ ID NO: 6692 - RNA, 22 nt, Human
gacacugugcuagcugggcuua

SEQ ID NO: 6693 - RNA, 22 nt, Human
gacacuuuaggccaccaugcaa

SEQ ID NO: 6694 - RNA, 22 nt, Human
gacagaagaggaacuuggacag

SEQ ID NO: 6695 - RNA, 22 nt, Human
gacagacaccugggggguugcu

SEQ ID NO: 6696 - RNA, 22 nt, Human
gacagacacuguguccucacuu

SEQ ID NO: 6697 - RNA, 22 nt, Human
gacagacagggguucuccugga

SEQ ID NO: 6698 - RNA, 22 nt, Human
gacagacuucauauccuuccuc

SEQ ID NO: 6699 - RNA, 22 nt, Human
gacagagaggcugagcaguaca

SEQ ID NO: 6700 - RNA, 22 nt, Human
gacagaggcuggagcaccuccu

SEQ ID NO: 6701 - RNA, 22 nt, Human
gacagagguguccuugagucca

SEQ ID NO: 6702 - RNA, 22 nt, Human
gacagagugcagggcuagaaga

SEQ ID NO: 6703 - RNA, 22 nt, Human
gacagaugagggaguauucuca

SEQ ID NO: 6704 - RNA, 22 nt, Human
gacagauggucaguguugaagu

SEQ ID NO: 6705 - RNA, 22 nt, Human
gacagaugugggugacagcagc

SEQ ID NO: 6706 - RNA, 22 nt, Human
ggccacagugggaaauccuggg

SEQ ID NO: 6707 - RNA, 22 nt, Human
ggccaccuaggagccacaguga

SEQ ID NO: 6708 - RNA, 22 nt, Human
ggccaccuccgugaaggaauga

SEQ ID NO: 6709 - RNA, 19 nt, Human
ggccaccucucuucccagg

SEQ ID NO: 6710 - RNA, 22 nt, Human
ggccaccucugcccuaccgagu

SEQ ID NO: 6711 - RNA, 22 nt, Human
ggccaccuggcugugggggcag

SEQ ID NO: 6712 - RNA, 22 nt, Human
ggccaccuggguucgacugggc

SEQ ID NO: 6713 - RNA, 22 nt, Human
ggccacugaccuacaucugggg

SEQ ID NO: 6714 - RNA, 22 nt, Human
ggccagaaaguuaagcuguggc

SEQ ID NO: 6715 - RNA, 17 nt, Human
ggccagaggcggggcug

SEQ ID NO: 6716 - RNA, 22 nt, Human
ggccagagggagggcacaaauc

SEQ ID NO: 6717 - RNA, 22 nt, Human
ggccagaguugauggcaucuug

SEQ ID NO: 6718 - RNA, 19 nt, Human
ggccagcacagggcucugu

SEQ ID NO: 6719 - RNA, 22 nt, Human
ggccagcauauagagugaagua

SEQ ID NO: 6720 - RNA, 22 nt, Human
ggccagccuggggcucccagac

SEQ ID NO: 6721 - RNA, 22 nt, Human
ggccagcucaggguccuugggc

SEQ ID NO: 6722 - RNA, 20 nt, Human
ggccagcugaugcacgaugc

SEQ ID NO: 6723 - RNA, 22 nt, Human
ggccagcuggaguuccgggugg

SEQ ID NO: 6724 - RNA, 22 nt, Human
ggccagcuguggggccgagccu

SEQ ID NO: 6725 - RNA, 22 nt, Human
ggccaggaagggaagaucagca

SEQ ID NO: 6726 - RNA, 22 nt, Human
ggccaggagaggagggcacuga

SEQ ID NO: 6727 - RNA, 22 nt, Human
ggccaggagcugcacagggcuc

SEQ ID NO: 6728 - RNA, 22 nt, Human
ggccaggaggcaggggcucaau

SEQ ID NO: 6729 - RNA, 22 nt, Human
ggccaggcgaugaccccuccac

SEQ ID NO: 6730 - RNA, 22 nt, Human
ggccagggaggagaggccccug

SEQ ID NO: 6731 - RNA, 22 nt, Human
ggccagggccaaggcuuuccca

SEQ ID NO: 6732 - RNA, 21 nt, Human
ggccaguggccuugacuuucc

SEQ ID NO: 6733 - RNA, 19 nt, Human
ggccaucucugccccagca

SEQ ID NO: 6734 - RNA, 22 nt, Human
ggccaugccuggucuggcacca

SEQ ID NO: 6735 - RNA, 22 nt, Human
ggccaugcucguggcuggacug

SEQ ID NO: 6736 - RNA, 19 nt, Human
ggccauggcgggggucaca

SEQ ID NO: 6737 - RNA, 22 nt, Human
ggccaugggaagagguggagag

SEQ ID NO: 6738 - RNA, 20 nt, Human
ggccauggguugccugaggu

SEQ ID NO: 6739 - RNA, 22 nt, Human
ggccauggucaugggugagcuu

SEQ ID NO: 6740 - RNA, 22 nt, Human
ggccauggugguuugagcaccu

SEQ ID NO: 6741 - RNA, 22 nt, Human
ggccaugguuggggaagacaug

SEQ ID NO: 6742 - RNA, 22 nt, Human
ggccauguuuggcagaaggauu

SEQ ID NO: 6743 - RNA, 22 nt, Human
ggcccaaacggguccagugaaa

SEQ ID NO: 6744 - RNA, 19 nt, Human
ggcccaaguacugagugcc

SEQ ID NO: 6745 - RNA, 22 nt, Human
ggcccacaccaggggccacagu

SEQ ID NO: 6746 - RNA, 22 nt, Human
ggcccagaauacuuuguaaaau

SEQ ID NO: 6747 - RNA, 22 nt, Human
ggcccagacccaagaguggugg

SEQ ID NO: 6748 - RNA, 22 nt, Human
ggcccagagcucccuggcaccu

SEQ ID NO: 6749 - RNA, 22 nt, Human
ggcccagagggucaggagcuga

SEQ ID NO: 6750 - RNA, 22 nt, Human
ggcccagccggcgagucucgcg

SEQ ID NO: 6751 - RNA, 22 nt, Human
ggcccagccuugggguuucuuu

SEQ ID NO: 6752 - RNA, 22 nt, Human
ggcccagcgaggccaccuacag

SEQ ID NO: 6753 - RNA, 22 nt, Human
gagcugggcacacgccacuuga

SEQ ID NO: 6754 - RNA, 22 nt, Human
gagcuggucgaaaugggcugac

SEQ ID NO: 6755 - RNA, 22 nt, Human
gagcuggugaucagcuggagga

SEQ ID NO: 6756 - RNA, 22 nt, Human
gagcuggugcucuugucaagac

SEQ ID NO: 6757 - RNA, 22 nt, Human
gagcugguggugagaaagcucu

SEQ ID NO: 6758 - RNA, 22 nt, Human
gagcuguccaagauggucguaa

SEQ ID NO: 6759 - RNA, 22 nt, Human
gagcugucuggggacucugggu

SEQ ID NO: 6760 - RNA, 22 nt, Human
gagcugugccaaucugucuggg

SEQ ID NO: 6761 - RNA, 22 nt, Human
gagcugugcuuauaccaauuca

SEQ ID NO: 6762 - RNA, 22 nt, Human
gagcuguguucaugaggagaaa

SEQ ID NO: 6763 - RNA, 22 nt, Human
gagcuguguugucuaguaccga

SEQ ID NO: 6764 - RNA, 22 nt, Human
gagcuguuaagagggagugaca

SEQ ID NO: 6765 - RNA, 20 nt, Human
gagcuucaacucagcaaaca

SEQ ID NO: 6766 - RNA, 22 nt, Human
gagcuucagcgugugcuaaggg

SEQ ID NO: 6767 - RNA, 18 nt, Human
gagcuucaggcuaaccug

SEQ ID NO: 6768 - RNA, 22 nt, Human
gagcuuccagagacaucagagu

SEQ ID NO: 6769 - RNA, 22 nt, Human
gagcuuggaagcagauccucac

SEQ ID NO: 6770 - RNA, 22 nt, Human
gagcuuggaugucuuuuguuca

SEQ ID NO: 6771 - RNA, 22 nt, Human
gagcuuggggcauauggugcua

SEQ ID NO: 6772 - RNA, 22 nt, Human
gagcuuugucccuugggggcuc

SEQ ID NO: 6773 - RNA, 22 nt, Human
gagcuuuucuuccaguuaauga

SEQ ID NO: 6774 - RNA, 20 nt, Human
gaggaaaagcugccaggccu

SEQ ID NO: 6775 - RNA, 22 nt, Human
gaggaaaaugggacaggcugua

SEQ ID NO: 6776 - RNA, 18 nt, Human
gaggaaacaggcucugug

SEQ ID NO: 6777 - RNA, 18 nt, Human
gaggaacauucaccuccu

SEQ ID NO: 6778 - RNA, 22 nt, Human
gaggaaccaaaucagcuugcac

SEQ ID NO: 6779 - RNA, 22 nt, Human
gaggaaccaccuuggguaggcu

SEQ ID NO: 6780 - RNA, 22 nt, Human
gaggaaccuaugauuuagagca

SEQ ID NO: 6781 - RNA, 22 nt, Human
gaggaacuucaucucuaugcca

SEQ ID NO: 6782 - RNA, 22 nt, Human
gaggaagaaagcauaggugggg

SEQ ID NO: 6783 - RNA, 22 nt, Human
gaggaagaaucaggguggugag

SEQ ID NO: 6784 - RNA, 22 nt, Human
gaggaagaugguugaguggucc

SEQ ID NO: 6785 - RNA, 22 nt, Human
gaggaagcugcguggcauuuca

SEQ ID NO: 6786 - RNA, 22 nt, Human
gaggaaggagggaaagcgcgcg

SEQ ID NO: 6787 - RNA, 22 nt, Human
gaggaaggucccaucagaauuu

SEQ ID NO: 6788 - RNA, 22 nt, Human
gaggaaguucuaugauuacauc

SEQ ID NO: 6789 - RNA, 22 nt, Human
gaggacaccucacagccucaca

SEQ ID NO: 6790 - RNA, 23 nt, Human
gaggaccaaauauauacauggaa

SEQ ID NO: 6791 - RNA, 22 nt, Human
gaggaccuuuaguagaagugca

SEQ ID NO: 6792 - RNA, 22 nt, Human
gaggacucugcaggcugcuccu

SEQ ID NO: 6793 - RNA, 22 nt, Human
gaggacugaaacuuacaggaaa

SEQ ID NO: 6794 - RNA, 22 nt, Human
gaggagaagggcacggagaaaa

SEQ ID NO: 6795 - RNA, 22 nt, Human
gaggagaaugcgcaccacauau

SEQ ID NO: 6796 - RNA, 22 nt, Human
gaggagacaguggagccgcuac

SEQ ID NO: 6797 - RNA, 22 nt, Human
gaggagacugacagcagauucu

SEQ ID NO: 6798 - RNA, 22 nt, Human
gaggagagccugcacuuugacc

SEQ ID NO: 6799 - RNA, 22 nt, Human
gaggagaggcuggacgcgguga

SEQ ID NO: 6800 - RNA, 19 nt, Human
gaggagcuaucggagacag

SEQ ID NO: 6801 - RNA, 22 nt, Human
gaggagcuggcagcgucuccgc

SEQ ID NO: 6802 - RNA, 22 nt, Human
gaggagcugggacccugucauc

SEQ ID NO: 6803 - RNA, 22 nt, Human
gaggagcuguucccucaccucu

SEQ ID NO: 6804 - RNA, 19 nt, Human
gaggaggaaaacuagugua

SEQ ID NO: 6805 - RNA, 22 nt, Human
gaggaggaggaaguggaaccca

SEQ ID NO: 6806 - RNA, 22 nt, Human
gaggaggccaguggaaggaagc

SEQ ID NO: 6807 - RNA, 22 nt, Human
gaggaggcuaagugggcucugg

SEQ ID NO: 6808 - RNA, 22 nt, Human
gaggaggucccccgacaugccu

SEQ ID NO: 6809 - RNA, 22 nt, Human
gaggaggucgcugcugagcccc

SEQ ID NO: 6810 - RNA, 22 nt, Human
gaggaguggaguugcuggguug

SEQ ID NO: 6811 - RNA, 18 nt, Human
gaggaucagaaaucugua

SEQ ID NO: 6812 - RNA, 22 nt, Human
gaggaugcugcagugcaggaca

SEQ ID NO: 6813 - RNA, 22 nt, Human
gaggauggaggugugagcuaug

SEQ ID NO: 6814 - RNA, 22 nt, Human
gaggcaagaaaggacuuucuag

SEQ ID NO: 6815 - RNA, 22 nt, Human
gaggcaaggccgcacgucucag

SEQ ID NO: 6816 - RNA, 22 nt, Human
gaggcacagagcccuaggagcu

SEQ ID NO: 6817 - RNA, 23 nt, Human
gaggcacucaggaaaugugagug

SEQ ID NO: 6818 - RNA, 22 nt, Human
gaggcacucucgacaagggugg

SEQ ID NO: 6819 - RNA, 22 nt, Human
gaggcacugaauacuugagggu

SEQ ID NO: 6820 - RNA, 22 nt, Human
gaggcacuggaggaaaggagaa

SEQ ID NO: 6821 - RNA, 22 nt, Human
gaggcagagugcaccccaggag

SEQ ID NO: 6822 - RNA, 22 nt, Human
gaggcagcaauaaaaagaauuu

SEQ ID NO: 6823 - RNA, 22 nt, Human
gaggcagcaggcugaggaggau

SEQ ID NO: 6824 - RNA, 22 nt, Human
gacuaaauaaaagccaaacuuc

SEQ ID NO: 6825 - RNA, 22 nt, Human
gacuacaacaauaagaacagcu

SEQ ID NO: 6826 - RNA, 22 nt, Human
gacuaggcucucauagagguag

SEQ ID NO: 6827 - RNA, 22 nt, Human
gacuagggaaucauucuuggau

SEQ ID NO: 6828 - RNA, 19 nt, Human
gacuaucucuggagaccau

SEQ ID NO: 6829 - RNA, 22 nt, Human
gacuaugugaagugugaauagg

SEQ ID NO: 6830 - RNA, 22 nt, Human
gacuauuuaguuucagauuagu

SEQ ID NO: 6831 - RNA, 22 nt, Human
gacuauuuauaaugcugcagaa

SEQ ID NO: 6832 - RNA, 22 nt, Human
gacuauuuauuuacagaaagcu

SEQ ID NO: 6833 - RNA, 22 nt, Human
gacucagugauuugacaugccu

SEQ ID NO: 6834 - RNA, 22 nt, Human
gacuccagagugacuauuuguc

SEQ ID NO: 6835 - RNA, 22 nt, Human
gacuccauccaaucuguguucu

SEQ ID NO: 6836 - RNA, 22 nt, Human
gacuccucccgcucccaugccg

SEQ ID NO: 6837 - RNA, 22 nt, Human
gacuccugccuccucuguuugc

SEQ ID NO: 6838 - RNA, 21 nt, Human
gacucugcaccaaauuaagcc

SEQ ID NO: 6839 - RNA, 22 nt, Human
gacucugcuacaggccgagguu

SEQ ID NO: 6840 - RNA, 22 nt, Human
gacucugcugacuaguugacua

SEQ ID NO: 6841 - RNA, 22 nt, Human
gacucuggcagcacuagggggc

SEQ ID NO: 6842 - RNA, 22 nt, Human
gacucugguugcggguucugcu

SEQ ID NO: 6843 - RNA, 22 nt, Human
gacucuuucaaacagaaagcca

SEQ ID NO: 6844 - RNA, 22 nt, Human
gacugagaaucauagaaggcaa

SEQ ID NO: 6845 - RNA, 22 nt, Human
gacugcaugauguuccagagga

SEQ ID NO: 6846 - RNA, 22 nt, Human
gacugcuuaaauauaugauguu

SEQ ID NO: 6847 - RNA, 22 nt, Human
gacugcuugagaaggaacaaau

SEQ ID NO: 6848 - RNA, 22 nt, Human
gacuggagcccccaaggacacc

SEQ ID NO: 6849 - RNA, 22 nt, Human
gacuggagugccuccaggaaag

SEQ ID NO: 6850 - RNA, 22 nt, Human
gacuggauguuuaaucaacaga

SEQ ID NO: 6851 - RNA, 22 nt, Human
gacuggccuggggcugggcaca

SEQ ID NO: 6852 - RNA, 22 nt, Human
gacuggcucacuccacuccuau

SEQ ID NO: 6853 - RNA, 22 nt, Human
gacugggccaaggucagcagcu

SEQ ID NO: 6854 - RNA, 22 nt, Human
gacugggcuccaagagggagag

SEQ ID NO: 6855 - RNA, 22 nt, Human
gacuggggcucuagccaggccu

SEQ ID NO: 6856 - RNA, 22 nt, Human
gacuggucuuuugugauggaug

SEQ ID NO: 6857 - RNA, 22 nt, Human
gacugucuuguuucuaagauga

SEQ ID NO: 6858 - RNA, 22 nt, Human
gacuguggcagaaauguuguug

SEQ ID NO: 6859 - RNA, 22 nt, Human
gacuguggccuuggaccauggg

SEQ ID NO: 6860 - RNA, 22 nt, Human
gacugugggcuccuugagggca

SEQ ID NO: 6861 - RNA, 22 nt, Human
gacuguuaccuauauuuaugug

SEQ ID NO: 6862 - RNA, 23 nt, Human
ggcucacacggagugccuccacc

SEQ ID NO: 6863 - RNA, 22 nt, Human
ggcucagacucccaggcccucu

SEQ ID NO: 6864 - RNA, 22 nt, Human
ggcucagaggccagcagguaga

SEQ ID NO: 6865 - RNA, 22 nt, Human
ggcucagauuccgaguggcccu

SEQ ID NO: 6866 - RNA, 22 nt, Human
ggcucagcgcgcugggagggag

SEQ ID NO: 6867 - RNA, 22 nt, Human
ggcucagguuaccagucccucc

SEQ ID NO: 6868 - RNA, 22 nt, Human
ggcucagguuuaaagugcuuua

SEQ ID NO: 6869 - RNA, 19 nt, Human
ggcucagugacauaggugc

SEQ ID NO: 6870 - RNA, 22 nt, Human
ggcucaguguuuguggaacaua

SEQ ID NO: 6871 - RNA, 22 nt, Human
ggcucauaaacucaguucaguu

SEQ ID NO: 6872 - RNA, 22 nt, Human
ggcuccaaagggcagugugagg

SEQ ID NO: 6873 - RNA, 16 nt, Human
ggcuccagaauagcga

SEQ ID NO: 6874 - RNA, 22 nt, Human
ggcuccagaugucuccuggcaa

SEQ ID NO: 6875 - RNA, 23 nt, Human
ggcuccaggccugacgggcgcgg

SEQ ID NO: 6876 - RNA, 22 nt, Human
ggcuccagguacguaugggagg

SEQ ID NO: 6877 - RNA, 22 nt, Human
ggcuccaggugcaugccaggcu

SEQ ID NO: 6878 - RNA, 22 nt, Human
ggcuccaugcuccgcuucuugu

SEQ ID NO: 6879 - RNA, 22 nt, Human
ggcuccaugcugagcuuugaau

SEQ ID NO: 6880 - RNA, 22 nt, Human
ggcucccaggagggccuggagg

SEQ ID NO: 6881 - RNA, 23 nt, Human
ggcucccuccuagcuuucccaau

SEQ ID NO: 6882 - RNA, 18 nt, Human
ggcuccgacgggccgugc

SEQ ID NO: 6883 - RNA, 22 nt, Human
ggcuccucucuggccgcucccg

SEQ ID NO: 6884 - RNA, 22 nt, Human
ggcuccugauaggagaaugcgg

SEQ ID NO: 6885 - RNA, 22 nt, Human
ggcuccugauuugagggggcug

SEQ ID NO: 6886 - RNA, 23 nt, Human
ggcuccugcuucaugucccaccu

SEQ ID NO: 6887 - RNA, 22 nt, Human
ggcuccuggcaucuggugggua

SEQ ID NO: 6888 - RNA, 22 nt, Human
ggcuccuguuauuuaaugagga

SEQ ID NO: 6889 - RNA, 22 nt, Human
ggcucgagcagcuguguaggau

SEQ ID NO: 6890 - RNA, 22 nt, Human
ggcucugcagagggcccagcuu

SEQ ID NO: 6891 - RNA, 22 nt, Human
ggcucugcagugacuugagggg

SEQ ID NO: 6892 - RNA, 22 nt, Human
ggcucugcaugcagguugucag

SEQ ID NO: 6893 - RNA, 22 nt, Human
ggcucugcccagaugaagagga

SEQ ID NO: 6894 - RNA, 22 nt, Human
ggcucugcgcgguaaagugacu

SEQ ID NO: 6895 - RNA, 22 nt, Human
ggcucugcuccuggugccagug

SEQ ID NO: 6896 - RNA, 22 nt, Human
ggcucugcuggauugaggccag

SEQ ID NO: 6897 - RNA, 22 nt, Human
ggcucugcugguaagaugccuc

SEQ ID NO: 6898 - RNA, 22 nt, Human
ggcucuggaauguguagucagg

SEQ ID NO: 6899 - RNA, 22 nt, Human
ggcucugggguuggcccaucuc

SEQ ID NO: 6900 - RNA, 22 nt, Human
ggcucugguugaccaugauggc

SEQ ID NO: 6901 - RNA, 22 nt, Human
ggcucugucaccuaugagcuga

SEQ ID NO: 6902 - RNA, 22 nt, Human
ggcucuguggcuggccaugaug

SEQ ID NO: 6903 - RNA, 22 nt, Human
ggcucuugagaggcacagguuu

SEQ ID NO: 6904 - RNA, 22 nt, Human
ggcucuugggagcucagaguug

SEQ ID NO: 6905 - RNA, 22 nt, Human
ggcucuuguucguaccauggcu

SEQ ID NO: 6906 - RNA, 22 nt, Human
ggcucuuuaacuugucuaaauu

SEQ ID NO: 6907 - RNA, 22 nt, Human
ggcucuuuggcgggccuugaac

SEQ ID NO: 6908 - RNA, 22 nt, Human
ggcugaaagguaguaguaggcu

SEQ ID NO: 6909 - RNA, 22 nt, Human
ggcugaaauuggauccuugggc

SEQ ID NO: 6910 - RNA, 22 nt, Human
ggcugaagaacugggagucuca

SEQ ID NO: 6911 - RNA, 22 nt, Human
ggcugaaguucuuuuuguucag

SEQ ID NO: 6912 - RNA, 22 nt, Human
ggcugagaaucaacaaccugcu

SEQ ID NO: 6913 - RNA, 22 nt, Human
ggcugagacaaccugggaccca

SEQ ID NO: 6914 - RNA, 22 nt, Human
ggcugagccacugcgccuggcu

SEQ ID NO: 6915 - RNA, 19 nt, Human
ggcugagcgccuuggcugc

SEQ ID NO: 6916 - RNA, 22 nt, Human
ggcugagcguggcugccguggg

SEQ ID NO: 6917 - RNA, 22 nt, Human
ggcugagcuuauauaugugcug

SEQ ID NO: 6918 - RNA, 22 nt, Human
ggcugagcuuuucaugaugguu

SEQ ID NO: 6919 - RNA, 22 nt, Human
ggcugaggcggcgaugcccuug

SEQ ID NO: 6920 - RNA, 22 nt, Human
ggcugagguguggggaacuaua

SEQ ID NO: 6921 - RNA, 22 nt, Human
ggcugaguggcugggucuaguu

SEQ ID NO: 6922 - RNA, 22 nt, Human
ggcugaguugagaggauuacuu

SEQ ID NO: 6923 - RNA, 22 nt, Human
ggcugaucaggugcaaaugcau

SEQ ID NO: 6924 - RNA, 22 nt, Human
ggcugcaagcaugcacagauac

SEQ ID NO: 6925 - RNA, 22 nt, Human
ggcugcagaaguacuuccggau

SEQ ID NO: 6926 - RNA, 19 nt, Human
ggcugcagagccccggcgc

SEQ ID NO: 6927 - RNA, 22 nt, Human
ggcugcagagcugggugggccu

SEQ ID NO: 6928 - RNA, 22 nt, Human
ggcugcagaggcgaucugaggu

SEQ ID NO: 6929 - RNA, 22 nt, Human
ggcugcagauagccagccacca

SEQ ID NO: 6930 - RNA, 22 nt, Human
ggcugcaggaacgacggagggg

SEQ ID NO: 6931 - RNA, 20 nt, Human
ggcugcaggacucauuggcu

SEQ ID NO: 6932 - RNA, 22 nt, Human
ggcugcaggaugcccagccgug

SEQ ID NO: 6933 - RNA, 22 nt, Human
ggcugcaggcuucccuccagca

SEQ ID NO: 6934 - RNA, 21 nt, Human
ggcugcagggagcccuggggu

SEQ ID NO: 6935 - RNA, 22 nt, Human
ggcugcauaggcagaagcugug

SEQ ID NO: 6936 - RNA, 22 nt, Human
ggcugccacgucgaggguccaa

SEQ ID NO: 6937 - RNA, 22 nt, Human
gagcagcuuaugucaagccaga

SEQ ID NO: 6938 - RNA, 22 nt, Human
gagcaggacgugggaaugggaa

SEQ ID NO: 6939 - RNA, 22 nt, Human
gagcaggauggcacuucuguga

SEQ ID NO: 6940 - RNA, 22 nt, Human
gagcaggaugggagcuggggcc

SEQ ID NO: 6941 - RNA, 22 nt, Human
gagcaggcaacucugcagugcc

SEQ ID NO: 6942 - RNA, 22 nt, Human
gagcaggcucugccuguguguc

SEQ ID NO: 6943 - RNA, 22 nt, Human
gagcaguagaguacauggcucc

SEQ ID NO: 6944 - RNA, 22 nt, Human
gagcagugacuggagcaugaga

SEQ ID NO: 6945 - RNA, 22 nt, Human
gagcagugagugaauguugccu

SEQ ID NO: 6946 - RNA, 22 nt, Human
gagcaguggugguguguuagag

SEQ ID NO: 6947 - RNA, 22 nt, Human
gagcagugguugaacagaggca

SEQ ID NO: 6948 - RNA, 22 nt, Human
gagcaguucuccuugguagggg

SEQ ID NO: 6949 - RNA, 22 nt, Human
gagcaguugggcucuaggaagu

SEQ ID NO: 6950 - RNA, 22 nt, Human
gagcauccaugacuuuggcuuu

SEQ ID NO: 6951 - RNA, 21 nt, Human
gagcaucuccuuccuccugcu

SEQ ID NO: 6952 - RNA, 20 nt, Human
gagcaucugucugcugugca

SEQ ID NO: 6953 - RNA, 22 nt, Human
gagcauggugcuucagugaagg

SEQ ID NO: 6954 - RNA, 22 nt, Human
gagcauuugguuauaguaauuu

SEQ ID NO: 6955 - RNA, 22 nt, Human
gagccaagaucgcaccacugca

SEQ ID NO: 6956 - RNA, 22 nt, Human
gagccaagauugugucccugca

SEQ ID NO: 6957 - RNA, 22 nt, Human
gagccagaaaagcugccugacu

SEQ ID NO: 6958 - RNA, 16 nt, Human
gagccaggugccuuga

SEQ ID NO: 6959 - RNA, 22 nt, Human
gagccaugagauaguugguucg

SEQ ID NO: 6960 - RNA, 22 nt, Human
gagccauuguccaagccuguuu

SEQ ID NO: 6961 - RNA, 20 nt, Human
gagcccaaguagggagaaau

SEQ ID NO: 6962 - RNA, 22 nt, Human
gagcccagcuguccuuggcaaa

SEQ ID NO: 6963 - RNA, 22 nt, Human
gagcccaggaugguguauggcu

SEQ ID NO: 6964 - RNA, 21 nt, Human
gagcccaggcaucucauuaau

SEQ ID NO: 6965 - RNA, 22 nt, Human
gagcccagggugaaauagcagc

SEQ ID NO: 6966 - RNA, 22 nt, Human
gagccccuucugcagucagguu

SEQ ID NO: 6967 - RNA, 22 nt, Human
gagcccuccauggagccaggca

SEQ ID NO: 6968 - RNA, 19 nt, Human
gagcccucuccauggccac

SEQ ID NO: 6969 - RNA, 20 nt, Human
gagcccucugcacuagcgcc

SEQ ID NO: 6970 - RNA, 22 nt, Human
gagcccucuugucuauauggua

SEQ ID NO: 6971 - RNA, 22 nt, Human
gagguggcuuagucucuggaca

SEQ ID NO: 6972 - RNA, 22 nt, Human
gaggugggaugugugugcuacu

SEQ ID NO: 6973 - RNA, 19 nt, Human
gagguggguccccgcagcc

SEQ ID NO: 6974 - RNA, 22 nt, Human
gaggugucaucaggcagcucug

SEQ ID NO: 6975 - RNA, 22 nt, Human
gaggugucauuuaguuaaucag

SEQ ID NO: 6976 - RNA, 22 nt, Human
gaggugucuguuaggaauaggc

SEQ ID NO: 6977 - RNA, 19 nt, Human
gaggugucuuuccugagua

SEQ ID NO: 6978 - RNA, 22 nt, Human
gaggugugaugcagaguggugg

SEQ ID NO: 6979 - RNA, 22 nt, Human
gagguguguuacagauugucau

SEQ ID NO: 6980 - RNA, 22 nt, Human
gagguuagaggucagugcaguc

SEQ ID NO: 6981 - RNA, 22 nt, Human
gagguuggcgcccugccuggcc

SEQ ID NO: 6982 - RNA, 22 nt, Human
gagguugggaaguccaagcugg

SEQ ID NO: 6983 - RNA, 22 nt, Human
gagguuggugaggggacacggu

SEQ ID NO: 6984 - RNA, 22 nt, Human
gagguuucuuaucaagaaagcu

SEQ ID NO: 6985 - RNA, 22 nt, Human
gaguagggaugcuggugacucc

SEQ ID NO: 6986 - RNA, 22 nt, Human
gaguagguugucagacuccaaa

SEQ ID NO: 6987 - RNA, 22 nt, Human
gaguauaaguaauuucaagcaa

SEQ ID NO: 6988 - RNA, 22 nt, Human
gaguauauuucucucucuuaag

SEQ ID NO: 6989 - RNA, 22 nt, Human
gaguauucaauauauacaaaug

SEQ ID NO: 6990 - RNA, 22 nt, Human
gagucacaaagccuuucuuauu

SEQ ID NO: 6991 - RNA, 22 nt, Human
gagucaccuugggucagcgaua

SEQ ID NO: 6992 - RNA, 22 nt, Human
gagucagaauguccuccugcgg

SEQ ID NO: 6993 - RNA, 22 nt, Human
gagucaugcacugucuuucucc

SEQ ID NO: 6994 - RNA, 22 nt, Human
gagucauugcacacuagcucag

SEQ ID NO: 6995 - RNA, 22 nt, Human
gaguccagcucauugucuggga

SEQ ID NO: 6996 - RNA, 22 nt, Human
gaguccagcucugccucuuacu

SEQ ID NO: 6997 - RNA, 22 nt, Human
gaguccaggauuugagcucugu

SEQ ID NO: 6998 - RNA, 22 nt, Human
gaguccaggcuggucaaauagc

SEQ ID NO: 6999 - RNA, 22 nt, Human
gaguccaguguuuaccaggggu

SEQ ID NO: 7000 - RNA, 22 nt, Human
gaguccaguuguucacagaggc

SEQ ID NO: 7001 - RNA, 21 nt, Human
gaguccuggcuaggguggcag

SEQ ID NO: 7002 - RNA, 19 nt, Human
gaguccugugcuccuuguu

SEQ ID NO: 7003 - RNA, 22 nt, Human
gaguccuuaauacacuggugga

SEQ ID NO: 7004 - RNA, 22 nt, Human
gaguccuucuggcuggcaggau

SEQ ID NO: 7005 - RNA, 22 nt, Human
gaguccuugacacauaguaggu

SEQ ID NO: 7006 - RNA, 22 nt, Human
gaguccuuggcaucaucaguac

SEQ ID NO: 7007 - RNA, 22 nt, Human
gaguccuuuugugccacaggga

SEQ ID NO: 7008 - RNA, 18 nt, Human
gagucgucggagagucug

SEQ ID NO: 7009 - RNA, 22 nt, Human
gagucuaaggaaaaauagagua

SEQ ID NO: 7010 - RNA, 22 nt, Human
gagucuggaaugaugaagaccu

SEQ ID NO: 7011 - RNA, 22 nt, Human
gagucuuucugggcuuguucuu

SEQ ID NO: 7012 - RNA, 22 nt, Human
gagucuuugguaaagucugcug

SEQ ID NO: 7013 - RNA, 22 nt, Human
gagucuuuguauuuacuuccca

SEQ ID NO: 7014 - RNA, 22 nt, Human
gagugaaaaaggaagggccaua

SEQ ID NO: 7015 - RNA, 22 nt, Human
gagugacucuagaaaguuucuu

SEQ ID NO: 7016 - RNA, 22 nt, Human
gagugaggcuggaaucauggcu

SEQ ID NO: 7017 - RNA, 22 nt, Human
gagugaguagcuacaguuuuua

SEQ ID NO: 7018 - RNA, 19 nt, Human
gagugauggaucuccuugc

SEQ ID NO: 7019 - RNA, 22 nt, Human
gagugcaauguagacaucaggg

SEQ ID NO: 7020 - RNA, 22 nt, Human
gagugccaagagaagaggcugg

SEQ ID NO: 7021 - RNA, 22 nt, Human
gagugccagauggaccucuugg

SEQ ID NO: 7022 - RNA, 22 nt, Human
gagugcuccuggauggauuucc

SEQ ID NO: 7023 - RNA, 22 nt, Human
gagugcuguaucugagaaagca

SEQ ID NO: 7024 - RNA, 20 nt, Human
gagugcuuuggcuugcucuc

SEQ ID NO: 7025 - RNA, 22 nt, Human
gaguggagcaaaagagguagau

SEQ ID NO: 7026 - RNA, 22 nt, Human
gaguggcagaacuggggguccu

SEQ ID NO: 7027 - RNA, 22 nt, Human
gaguggcauaugugccugugaa

SEQ ID NO: 7028 - RNA, 21 nt, Human
gagugggacaugggagugguu

SEQ ID NO: 7029 - RNA, 22 nt, Human
gagugggcuuggggagaguuug

SEQ ID NO: 7030 - RNA, 22 nt, Human
gagugguaaugagcagauuagg

SEQ ID NO: 7031 - RNA, 22 nt, Human
gagugguaggcaguguuaggaa

SEQ ID NO: 7032 - RNA, 22 nt, Human
gagugguuagaaguaguguggc

SEQ ID NO: 7033 - RNA, 22 nt, Human
gaguguaaucugaaaacuugaa

SEQ ID NO: 7034 - RNA, 22 nt, Human
gagugucaaggcucucuuuggc

SEQ ID NO: 7035 - RNA, 22 nt, Human
gaguguccgugcagccccagac

SEQ ID NO: 7036 - RNA, 22 nt, Human
gagugucucacaguagcauuuu

SEQ ID NO: 7037 - RNA, 22 nt, Human
gagugucuguggggcauggaca

SEQ ID NO: 7038 - RNA, 22 nt, Human
gagugugcuuagagagcugcau

SEQ ID NO: 7039 - RNA, 18 nt, Human
gaguguggcacugggccc

SEQ ID NO: 7040 - RNA, 22 nt, Human
gaguguguuauuaaagauggaa

SEQ ID NO: 7041 - RNA, 22 nt, Human
gaguguuccagaaacuggcccu

SEQ ID NO: 7042 - RNA, 22 nt, Human
gaguuaaaagcccucucagcag

SEQ ID NO: 7043 - RNA, 22 nt, Human
gaguuaauaggguucuuuguga

SEQ ID NO: 7044 - RNA, 22 nt, Human
gaguuaauguguacacaaaggg

SEQ ID NO: 7045 - RNA, 22 nt, Human
gaguuacacagaagucaguuug

SEQ ID NO: 7046 - RNA, 22 nt, Human
gaguuacauucauuguuacgcu

SEQ ID NO: 7047 - RNA, 22 nt, Human
gaguuagagccauagagcacgg

SEQ ID NO: 7048 - RNA, 22 nt, Human
gaguucugaacugugaaaugca

SEQ ID NO: 7049 - RNA, 22 nt, Human
gaguugaagaaauaguuuugau

SEQ ID NO: 7050 - RNA, 22 nt, Human
gaguuguucaacgugugugaaa

SEQ ID NO: 7051 - RNA, 22 nt, Human
gaguuuaaaacgcuuguauuua

SEQ ID NO: 7052 - RNA, 22 nt, Human
gaguuuaaagcauacauauuuu

SEQ ID NO: 7053 - RNA, 22 nt, Human
gaguuuagauggcauuaaggua

SEQ ID NO: 7054 - RNA, 22 nt, Human
gaguuuagguucaugaacgagu

SEQ ID NO: 7055 - RNA, 22 nt, Human
gaguuuaguuuggcuuaaacug

SEQ ID NO: 7056 - RNA, 22 nt, Human
gaguuuauucaggaaauagcca

SEQ ID NO: 7057 - RNA, 22 nt, Human
gaguuuauuugacuggauucuc

SEQ ID NO: 7058 - RNA, 22 nt, Human
gaguuucuccagugcuaguugu

SEQ ID NO: 7059 - RNA, 22 nt, Human
gaguuugauagagaggaaccgg

SEQ ID NO: 7060 - RNA, 22 nt, Human
gauaaaauaacuauggaauacu

SEQ ID NO: 7061 - RNA, 22 nt, Human
gauaaaauucuuauuuuacccg

SEQ ID NO: 7062 - RNA, 21 nt, Human
gauaaagcagcuugccuaagg

SEQ ID NO: 7063 - RNA, 20 nt, Human
gauaaauugucucuuaagug

SEQ ID NO: 7064 - RNA, 22 nt, Human
gauaacccccaagaaggucuuu

SEQ ID NO: 7065 - RNA, 19 nt, Human
gauaaguuuccagguaacu

SEQ ID NO: 7066 - RNA, 22 nt, Human
gauaauauuagaagauacaaau

SEQ ID NO: 7067 - RNA, 22 nt, Human
gauaaugaugacaaugacaacc

SEQ ID NO: 7068 - RNA, 22 nt, Human
gauaaugugccgauaauuucua

SEQ ID NO: 7069 - RNA, 22 nt, Human
gauaauuauaggcuaagccacu

SEQ ID NO: 7070 - RNA, 22 nt, Human
gauaauuuugguuccagguugg

SEQ ID NO: 7071 - RNA, 22 nt, Human
gggauaggagauugggaguguu

SEQ ID NO: 7072 - RNA, 22 nt, Human
gggauauguuuagguguuggag

SEQ ID NO: 7073 - RNA, 22 nt, Human
gggaucagaaacauagcccuga

SEQ ID NO: 7074 - RNA, 20 nt, Human
gggaucaggaaaggaggcua

SEQ ID NO: 7075 - RNA, 22 nt, Human
gggauccauccgugcagcagag

SEQ ID NO: 7076 - RNA, 22 nt, Human
gggaucugcuccagagggaaaa

SEQ ID NO: 7077 - RNA, 22 nt, Human
gggaucugggacaacagguggu

SEQ ID NO: 7078 - RNA, 22 nt, Human
gggaucugggccucacacacau

SEQ ID NO: 7079 - RNA, 23 nt, Human
gggaucuguaaaccuggagaacc

SEQ ID NO: 7080 - RNA, 22 nt, Human
gauuuucuugggaaacaaugag

SEQ ID NO: 7081 - RNA, 22 nt, Human
gauuuugucaaauuccaaaugu

SEQ ID NO: 7082 - RNA, 22 nt, Human
gcaaaaacugcaauuacuuuug

SEQ ID NO: 7083 - RNA, 22 nt, Human
gcaaaaauuccagggacgacuc

SEQ ID NO: 7084 - RNA, 22 nt, Human
gcaaaaguacagccggauuucu

SEQ ID NO: 7085 - RNA, 22 nt, Human
gcaaaaugaucuucuucaggcu

SEQ ID NO: 7086 - RNA, 22 nt, Human
gcaaaauuaaacuuagcaucau

SEQ ID NO: 7087 - RNA, 22 nt, Human
gcaaacaagcugccugaagauu

SEQ ID NO: 7088 - RNA, 22 nt, Human
gcaaacaaggacauacauccug

SEQ ID NO: 7089 - RNA, 22 nt, Human
gcaaacaugcugagaaauaaga

SEQ ID NO: 7090 - RNA, 22 nt, Human
gcaaacauuccacagaaggaag

SEQ ID NO: 7091 - RNA, 18 nt, Human
gcaaacauucuuccaguc

SEQ ID NO: 7092 - RNA, 22 nt, Human
gcaaagaaaugucagugagagg

SEQ ID NO: 7093 - RNA, 22 nt, Human
gcaaagacaaauuagaacuccu

SEQ ID NO: 7094 - RNA, 23 nt, Human
gcaaagacucugccaaaaacugc

SEQ ID NO: 7095 - RNA, 22 nt, Human
gcaaagcagaacccucucuauc

SEQ ID NO: 7096 - RNA, 22 nt, Human
gcaaaggccacuggggcgaugg

SEQ ID NO: 7097 - RNA, 22 nt, Human
gcaaaggcuucuuuuauucucc

SEQ ID NO: 7098 - RNA, 22 nt, Human
gcaaaguaaaaauagauucuga

SEQ ID NO: 7099 - RNA, 22 nt, Human
gcaaagucucaagacccaagug

SEQ ID NO: 7100 - RNA, 22 nt, Human
gcaaauacauguugagcaccua

SEQ ID NO: 7101 - RNA, 22 nt, Human
gcaaaucaccaccuagcuggau

SEQ ID NO: 7102 - RNA, 19 nt, Human
gcaaaucugaccaaauagu

SEQ ID NO: 7103 - RNA, 22 nt, Human
gcaaaugaguuguaacauaaaa

SEQ ID NO: 7104 - RNA, 22 nt, Human
gcaaaugcucuccagccugggu

SEQ ID NO: 7105 - RNA, 22 nt, Human
gcaaaugcucuccuuggucagg

SEQ ID NO: 7106 - RNA, 20 nt, Human
gcaaauggacacucagggaa

SEQ ID NO: 7107 - RNA, 22 nt, Human
gcaaauguucuauauuugcugu

SEQ ID NO: 7108 - RNA, 22 nt, Human
gcaaauucuuaacuggacugug

SEQ ID NO: 7109 - RNA, 22 nt, Human
gcaaauugcuagcuuucucugc

SEQ ID NO: 7110 - RNA, 22 nt, Human
gcaacacaauaucccaguacau

SEQ ID NO: 7111 - RNA, 22 nt, Human
gcaacaguuggauuccagagga

SEQ ID NO: 7112 - RNA, 22 nt, Human
gcaacaugaagaaaacagaacc

SEQ ID NO: 7113 - RNA, 22 nt, Human
gcaacauucauguucuguaacc

SEQ ID NO: 7114 - RNA, 22 nt, Human
gcaacauugagucuaaguacca

SEQ ID NO: 7115 - RNA, 22 nt, Human
gcaaccauuuggaauguaaaaa

SEQ ID NO: 7116 - RNA, 22 nt, Human
gcaagaaaagagccuucagugg

SEQ ID NO: 7117 - RNA, 22 nt, Human
gcaagaacaggugcuuggcaag

SEQ ID NO: 7118 - RNA, 22 nt, Human
gcaagaacugcaauuacuuuug

SEQ ID NO: 7119 - RNA, 22 nt, Human
gcaagacaugucuaagguuuaa

SEQ ID NO: 7120 - RNA, 22 nt, Human
gcaagauagaguugcaaauauu

SEQ ID NO: 7121 - RNA, 22 nt, Human
gcaagaugguuauaaaaaaugu

SEQ ID NO: 7122 - RNA, 22 nt, Human
gcaagauuguguggcugaagua

SEQ ID NO: 7123 - RNA, 22 nt, Human
gcaagcaagcagguagagcuga

SEQ ID NO: 7124 - RNA, 22 nt, Human
gcaagcaaguaucuggcaggga

SEQ ID NO: 7125 - RNA, 20 nt, Human
gcaagcaugaagaguagaga

SEQ ID NO: 7126 - RNA, 21 nt, Human
gcaagccaccacugcugccac

SEQ ID NO: 7127 - RNA, 22 nt, Human
gcaagcugaugugauagugaaa

SEQ ID NO: 7128 - RNA, 22 nt, Human
gcaagcugcuuaagcucauugu

SEQ ID NO: 7129 - RNA, 22 nt, Human
gcaagcuggcuguuagaggaug

SEQ ID NO: 7130 - RNA, 20 nt, Human
gcaagcuuauuagugauauu

SEQ ID NO: 7131 - RNA, 22 nt, Human
gcaaggacucccugggucauuc

SEQ ID NO: 7132 - RNA, 22 nt, Human
gcaaggagacuguagggccaag

SEQ ID NO: 7133 - RNA, 20 nt, Human
gcaaggcacagugaggaggg

SEQ ID NO: 7134 - RNA, 22 nt, Human
gcaaggcagcgcggaguagcua

SEQ ID NO: 7135 - RNA, 18 nt, Human
gcaaggcucaggccaggc

SEQ ID NO: 7136 - RNA, 20 nt, Human
gcaaggcuccaaggggugug

SEQ ID NO: 7137 - RNA, 22 nt, Human
gcaaggcuggugguggugaagu

SEQ ID NO: 7138 - RNA, 22 nt, Human
gcaaggcuuugugaauuuuaaa

SEQ ID NO: 7139 - RNA, 22 nt, Human
gcaaguacaaacgcaucggcug

SEQ ID NO: 7140 - RNA, 22 nt, Human
gcaaguaggaaguguccuccuu

SEQ ID NO: 7141 - RNA, 23 nt, Human
gcaagugaggcgucagcagucaa

SEQ ID NO: 7142 - RNA, 21 nt, Human
gcaaguguuucugacaguggc

SEQ ID NO: 7143 - RNA, 22 nt, Human
gcaauaaacauguuugaugcgc

SEQ ID NO: 7144 - RNA, 23 nt, Human
gcaauacaagacuggucaugagc

SEQ ID NO: 7145 - RNA, 22 nt, Human
gcaauagauuaugaucuacagu

SEQ ID NO: 7146 - RNA, 22 nt, Human
gcaauaguauuuauuaaaguag

SEQ ID NO: 7147 - RNA, 20 nt, Human
gcaauauaugagugcaauaa

SEQ ID NO: 7148 - RNA, 22 nt, Human
gcaaugagcacccagagggcag

SEQ ID NO: 7149 - RNA, 22 nt, Human
gcaaugcauauguggguagcau

SEQ ID NO: 7150 - RNA, 22 nt, Human
gcaaugggcacagcccagccca

SEQ ID NO: 7151 - RNA, 22 nt, Human
gcaauguuuuuccuuccauauu

SEQ ID NO: 7152 - RNA, 22 nt, Human
gcaauuauuuuugcaccaaugu

SEQ ID NO: 7153 - RNA, 22 nt, Human
gcaauuguacuagaaaacaaua

SEQ ID NO: 7154 - RNA, 22 nt, Human
gcacaaaagguacuucauguag

SEQ ID NO: 7155 - RNA, 22 nt, Human
gcacaagaauaaccauauuuaa

SEQ ID NO: 7156 - RNA, 22 nt, Human
gcacaaggagaauucauuagug

SEQ ID NO: 7157 - RNA, 22 nt, Human
gcacaaggagcaguguaugaaa

SEQ ID NO: 7158 - RNA, 22 nt, Human
gcacaauaacagccaagguuau

SEQ ID NO: 7159 - RNA, 22 nt, Human
gcacaauaauuuuuuuaagagg

SEQ ID NO: 7160 - RNA, 22 nt, Human
gcacaauuccaugggacagccc

SEQ ID NO: 7161 - RNA, 22 nt, Human
gcacacacaugugaguacaugc

SEQ ID NO: 7162 - RNA, 22 nt, Human
gcacacagaacauuuggauccu

SEQ ID NO: 7163 - RNA, 22 nt, Human
gcacacagaauugauucacugu

SEQ ID NO: 7164 - RNA, 16 nt, Human
gcacacagccagccuu

SEQ ID NO: 7165 - RNA, 22 nt, Human
gcacacagggauuuuugaaugg

SEQ ID NO: 7166 - RNA, 22 nt, Human
gcacacaggggaguucucagaa

SEQ ID NO: 7167 - RNA, 22 nt, Human
gcacacaguacuauaugcuaca

SEQ ID NO: 7168 - RNA, 22 nt, Human
gcacacaguauaugcucauuaa

SEQ ID NO: 7169 - RNA, 22 nt, Human
gcacacaugcaugugugcaucc

SEQ ID NO: 7170 - RNA, 19 nt, Human
gcacacccugcaccaccau

SEQ ID NO: 7171 - RNA, 22 nt, Human
gcacaccuuagaggggagcugc

SEQ ID NO: 7172 - RNA, 19 nt, Human
gcacacguugugcuugagc

SEQ ID NO: 7173 - RNA, 22 nt, Human
gcacacuuaauacucacugugc

SEQ ID NO: 7174 - RNA, 22 nt, Human
gcacagaacagagaaauagcca

SEQ ID NO: 7175 - RNA, 22 nt, Human
gcacagaacccuaucuuucgga

SEQ ID NO: 7176 - RNA, 22 nt, Human
gcacagaauaacacucugggcu

SEQ ID NO: 7177 - RNA, 22 nt, Human
gcacagagagcagugggggaca

SEQ ID NO: 7178 - RNA, 18 nt, Human
gcacagagcccaggcucu

SEQ ID NO: 7179 - RNA, 22 nt, Human
gcacagagcuggcccuccaggc

SEQ ID NO: 7180 - RNA, 22 nt, Human
gcacagaggaagcacagacucu

SEQ ID NO: 7181 - RNA, 22 nt, Human
gcacagagucacuagcuaagca

SEQ ID NO: 7182 - RNA, 22 nt, Human
gcacagcaauuucuauaagcuc

SEQ ID NO: 7183 - RNA, 22 nt, Human
gcacagcacagcaacauguuuu

SEQ ID NO: 7184 - RNA, 22 nt, Human
gcacagccacugagugagaacc

SEQ ID NO: 7185 - RNA, 22 nt, Human
gagcuuggcagugucacuaggg

SEQ ID NO: 7186 - RNA, 22 nt, Human
gagcuuggccucuugaacgugg

SEQ ID NO: 7187 - RNA, 22 nt, Human
gagcuuggcuggaccucacgga

SEQ ID NO: 7188 - RNA, 22 nt, Human
gagcuuggugcacagugguuaa

SEQ ID NO: 7189 - RNA, 22 nt, Human
gcagaccugaccuugggcagca

SEQ ID NO: 7190 - RNA, 17 nt, Human
gcagacugcgggucccc

SEQ ID NO: 7191 - RNA, 22 nt, Human
gcagagaaaguuuuguccucag

SEQ ID NO: 7192 - RNA, 22 nt, Human
gcagagacagacuaaugaaaag

SEQ ID NO: 7193 - RNA, 22 nt, Human
gggcuauagcacuauguauggg

SEQ ID NO: 7194 - RNA, 22 nt, Human
gggcucagacaucccuccugga

SEQ ID NO: 7195 - RNA, 23 nt, Human
gggcucagauuucauucugugcc

SEQ ID NO: 7196 - RNA, 22 nt, Human
gggcucagcugggcgugcuggu

SEQ ID NO: 7197 - RNA, 22 nt, Human
gggcucaggucagggcaucagc

SEQ ID NO: 7198 - RNA, 22 nt, Human
gggcuccaaaauccuguagccu

SEQ ID NO: 7199 - RNA, 22 nt, Human
gggcuccacagcagugagugga

SEQ ID NO: 7200 - RNA, 22 nt, Human
gggcuccaccuagggacacugg

SEQ ID NO: 7201 - RNA, 21 nt, Human
gggcuccagagauguagcuuc

SEQ ID NO: 7202 - RNA, 22 nt, Human
gggcuccagccacuggcugagg

SEQ ID NO: 7203 - RNA, 22 nt, Human
gggcuccagccagcuccuugug

SEQ ID NO: 7204 - RNA, 20 nt, Human
gggcuccagcugugauucuu

SEQ ID NO: 7205 - RNA, 22 nt, Human
gggcuccaggcaggcaggaaau

SEQ ID NO: 7206 - RNA, 22 nt, Human
gggcucugagcucugggaauua

SEQ ID NO: 7207 - RNA, 22 nt, Human
gggcucugcgcucagcuccagc

SEQ ID NO: 7208 - RNA, 22 nt, Human
gggcucuggaaggugcaccaug

SEQ ID NO: 7209 - RNA, 22 nt, Human
gggcucugggaugcucuuagag

SEQ ID NO: 7210 - RNA, 22 nt, Human
gggcucuggggugcccuggcau

SEQ ID NO: 7211 - RNA, 22 nt, Human
gggcucugguacuuccuggcuc

SEQ ID NO: 7212 - RNA, 22 nt, Human
gggcucuggugccuucacagaa

SEQ ID NO: 7213 - RNA, 22 nt, Human
gggcucugugcaccccagcacc

SEQ ID NO: 7214 - RNA, 22 nt, Human
gggcucugugguugugcuuugu

SEQ ID NO: 7215 - RNA, 22 nt, Human
gggcucuguguucuagcucucg

SEQ ID NO: 7216 - RNA, 22 nt, Human
gggcucuguuuagaccagagau

SEQ ID NO: 7217 - RNA, 20 nt, Human
gggcucuuagguagcagggg

SEQ ID NO: 7218 - RNA, 22 nt, Human
gggcucuuuucugagcuucacu

SEQ ID NO: 7219 - RNA, 22 nt, Human
gggcugacaccacccaggcgca

SEQ ID NO: 7220 - RNA, 22 nt, Human
gggcugacagcacgccuucugu

SEQ ID NO: 7221 - RNA, 17 nt, Human
gggcugacaguggccuc

SEQ ID NO: 7222 - RNA, 22 nt, Human
gggcugaccccaccccucacuc

SEQ ID NO: 7223 - RNA, 22 nt, Human
gggcugacucugcacugagcca

SEQ ID NO: 7224 - RNA, 22 nt, Human
gggcugagacgauggggucuuc

SEQ ID NO: 7225 - RNA, 22 nt, Human
gggcugagagugacuguucugu

SEQ ID NO: 7226 - RNA, 22 nt, Human
gggcugaggaacauauuuuguu

SEQ ID NO: 7227 - RNA, 22 nt, Human
gggcugaugaugagcagaggug

SEQ ID NO: 7228 - RNA, 22 nt, Human
gggcugcaaugcuucaguuguu

SEQ ID NO: 7229 - RNA, 22 nt, Human
gggcugcacuagggcaagguga

SEQ ID NO: 7230 - RNA, 22 nt, Human
gggcugccaagccugccugccu

SEQ ID NO: 7231 - RNA, 22 nt, Human
gggcugccuuucuucugggagc

SEQ ID NO: 7232 - RNA, 22 nt, Human
gggcugcuacgagaacugaaua

SEQ ID NO: 7233 - RNA, 23 nt, Human
gggcugcuccaggccaaggcugg

SEQ ID NO: 7234 - RNA, 22 nt, Human
gggcugcugccaccagguggau

SEQ ID NO: 7235 - RNA, 22 nt, Human
gggcugcugggcaagaaacauu

SEQ ID NO: 7236 - RNA, 22 nt, Human
gggcugcuuccuggggaaugcu

SEQ ID NO: 7237 - RNA, 22 nt, Human
gggcugcuuggaggaggcgcuc

SEQ ID NO: 7238 - RNA, 22 nt, Human
gggcugcuuuuaagggucucag

SEQ ID NO: 7239 - RNA, 22 nt, Human
gggcuggaagacaggaaaugcu

SEQ ID NO: 7240 - RNA, 16 nt, Human
gggcuggagauacagu

SEQ ID NO: 7241 - RNA, 22 nt, Human
gggcuggagccagcuguggcug

SEQ ID NO: 7242 - RNA, 22 nt, Human
gggcuggaggaccggccucgga

SEQ ID NO: 7243 - RNA, 22 nt, Human
gggcuggaggagauccagaggc

SEQ ID NO: 7244 - RNA, 19 nt, Human
gggcuggagggauagagcc

SEQ ID NO: 7245 - RNA, 22 nt, Human
gggcuggagucuucugaaagcc

SEQ ID NO: 7246 - RNA, 22 nt, Human
gggcuggaucucacgugagacc

SEQ ID NO: 7247 - RNA, 17 nt, Human
gggcuggauggccaugg

SEQ ID NO: 7248 - RNA, 22 nt, Human
gggcuggcucccagguguugaa

SEQ ID NO: 7249 - RNA, 22 nt, Human
gggcugggauggcuugaagauu

SEQ ID NO: 7250 - RNA, 22 nt, Human
gggcugggauugcuugcuguga

SEQ ID NO: 7251 - RNA, 22 nt, Human
gggcuggucuggcuuagucagg

SEQ ID NO: 7252 - RNA, 22 nt, Human
gggcugugagaguggggcugcu

SEQ ID NO: 7253 - RNA, 22 nt, Human
gggcugugaggugagaacuuac

SEQ ID NO: 7254 - RNA, 22 nt, Human
gggcuguguaaugugcucuuuu

SEQ ID NO: 7255 - RNA, 22 nt, Human
gggcuguguaucaguuaucuau

SEQ ID NO: 7256 - RNA, 22 nt, Human
gggcugugugcaguacgggucc

SEQ ID NO: 7257 - RNA, 22 nt, Human
gggcuucaaaauuggcacucuu

SEQ ID NO: 7258 - RNA, 22 nt, Human
gggcuucagauccagggaccuc

SEQ ID NO: 7259 - RNA, 22 nt, Human
gggcuucaguucugaccaucuu

SEQ ID NO: 7260 - RNA, 22 nt, Human
gggcuucuaagugaaaguguaa

SEQ ID NO: 7261 - RNA, 22 nt, Human
gggcuucuacuugcaaaggaua

SEQ ID NO: 7262 - RNA, 22 nt, Human
gggcuucuauucaagucuguuu

SEQ ID NO: 7263 - RNA, 22 nt, Human
gggcuucuggcuacuguaugag

SEQ ID NO: 7264 - RNA, 22 nt, Human
gggcuucugggcaccacucccu

SEQ ID NO: 7265 - RNA, 22 nt, Human
gggcuuggcuggggccaccaga

SEQ ID NO: 7266 - RNA, 22 nt, Human
gggcuuuaacacccagucaggg

SEQ ID NO: 7267 - RNA, 22 nt, Human
ggggaaaggccauggcaagaac

SEQ ID NO: 7268 - RNA, 22 nt, Human
ggggaagaauggcagaaaacau

SEQ ID NO: 7269 - RNA, 22 nt, Human
ggggaaggaaaguuauuagcag

SEQ ID NO: 7270 - RNA, 22 nt, Human
ggggaaggauaugauuagacua

SEQ ID NO: 7271 - RNA, 16 nt, Human
ggggaaggcaagaggg

SEQ ID NO: 7272 - RNA, 22 nt, Human
ggggaagggaguccaaguguua

SEQ ID NO: 7273 - RNA, 20 nt, Human
ggggaagucacugcagucag

SEQ ID NO: 7274 - RNA, 22 nt, Human
ggggaaugagugcccagaaagc

SEQ ID NO: 7275 - RNA, 22 nt, Human
ggggagaauuaccaaaagcgcu

SEQ ID NO: 7276 - RNA, 22 nt, Human
ggggagaugcuuagguccgggg

SEQ ID NO: 7277 - RNA, 22 nt, Human
ggggaggaguguacagguuuau

SEQ ID NO: 7278 - RNA, 22 nt, Human
ggggaggcaagaugaagugagg

SEQ ID NO: 7279 - RNA, 19 nt, Human
ggggagguauuguuuucau

SEQ ID NO: 7280 - RNA, 22 nt, Human
ggggaucuaggcuuaugagggc

SEQ ID NO: 7281 - RNA, 22 nt, Human
ggggauggaggcgugugguccu

SEQ ID NO: 7282 - RNA, 22 nt, Human
ggggauggauuccgggucccug

SEQ ID NO: 7283 - RNA, 22 nt, Human
ggggauggugggaaggcaaucu

SEQ ID NO: 7284 - RNA, 22 nt, Human
ggggcagagaauaaaaaccuaa

SEQ ID NO: 7285 - RNA, 22 nt, Human
ggggcagaguagcuggggugug

SEQ ID NO: 7286 - RNA, 22 nt, Human
ggggcagauggaacagagcaca

SEQ ID NO: 7287 - RNA, 22 nt, Human
ggggcagggagguuaucgccga

SEQ ID NO: 7288 - RNA, 21 nt, Human
ggggcaucaagacagaguuag

SEQ ID NO: 7289 - RNA, 22 nt, Human
ggggccagcuucgcgugcucuu

SEQ ID NO: 7290 - RNA, 22 nt, Human
ggggccagguccagcuuccaaa

SEQ ID NO: 7291 - RNA, 22 nt, Human
ggggcccagcaccccuccucgc

SEQ ID NO: 7292 - RNA, 21 nt, Human
ggggccucuccacacagccgg

SEQ ID NO: 7293 - RNA, 23 nt, Human
ggggccugcaccggucugcgcgg

SEQ ID NO: 7294 - RNA, 22 nt, Human
ggggccugcgagguucaacuuc

SEQ ID NO: 7295 - RNA, 22 nt, Human
ggggccuguagagcuucaggga

SEQ ID NO: 7296 - RNA, 22 nt, Human
ggggcggggcucugagaagcau

SEQ ID NO: 7297 - RNA, 22 nt, Human
ggggcucacaccucccuaaggg

SEQ ID NO: 7298 - RNA, 22 nt, Human
gagguucacuuccugaaauagc

SEQ ID NO: 7299 - RNA, 22 nt, Human
gagguucacuuccuggauccuu

SEQ ID NO: 7300 - RNA, 22 nt, Human
gagguucagcugcugccuggua

SEQ ID NO: 7301 - RNA, 22 nt, Human
gagguucaggaaaugggcaaag

SEQ ID NO: 7302 - RNA, 22 nt, Human
gagguucgauacagcguauuua

SEQ ID NO: 7303 - RNA, 22 nt, Human
gagguuucacuguguuguccag

SEQ ID NO: 7304 - RNA, 22 nt, Human
gaguaaaucgucauugcagcau

SEQ ID NO: 7305 - RNA, 22 nt, Human
gaguaacagcauaaauuuguga

SEQ ID NO: 7306 - RNA, 22 nt, Human
gcaaacuggcaaaccugucugu

SEQ ID NO: 7307 - RNA, 22 nt, Human
gcaaacugguagcucgccugcc

SEQ ID NO: 7308 - RNA, 22 nt, Human
gcaaagaaugcagauuugccuc

SEQ ID NO: 7309 - RNA, 22 nt, Human
gcaaagcaaaugccugaaggcg

SEQ ID NO: 7310 - RNA, 22 nt, Human
gcaaagcaagauucagauguag

SEQ ID NO: 7311 - RNA, 22 nt, Human
gcaaagcacacuggagaugucg

SEQ ID NO: 7312 - RNA, 22 nt, Human
gcaaagcugggugugaaugcac

SEQ ID NO: 7313 - RNA, 22 nt, Human
gcaaagucugcaucuggaucag

SEQ ID NO: 7314 - RNA, 22 nt, Human
gcaaagugaaauggggcagaga

SEQ ID NO: 7315 - RNA, 22 nt, Human
gcaaauaaaugcucacugcugu

SEQ ID NO: 7316 - RNA, 22 nt, Human
gcaaaugcacugcauuuagauu

SEQ ID NO: 7317 - RNA, 22 nt, Human
gcaaauggagugaagagcugga

SEQ ID NO: 7318 - RNA, 22 nt, Human
gcaaauguuuuugaguguuuac

SEQ ID NO: 7319 - RNA, 22 nt, Human
gcaaauuaaccaaucaugcucg

SEQ ID NO: 7320 - RNA, 22 nt, Human
gcaacacagaucuucuuuguug

SEQ ID NO: 7321 - RNA, 18 nt, Human
gcaacaguaucagcaggc

SEQ ID NO: 7322 - RNA, 22 nt, Human
gcaacuguuuugagcacccagu

SEQ ID NO: 7323 - RNA, 21 nt, Human
gcaacuuaucgcauucugcag

SEQ ID NO: 7324 - RNA, 22 nt, Human
gcaagaacgaauccuacuugcu

SEQ ID NO: 7325 - RNA, 23 nt, Human
gcaagagacagagcauccuguuc

SEQ ID NO: 7326 - RNA, 22 nt, Human
gcaagaguuuuuucucucuuga

SEQ ID NO: 7327 - RNA, 22 nt, Human
gcaagauuuacagacaacuucg

SEQ ID NO: 7328 - RNA, 22 nt, Human
gcaagauuucuuuuaggugaag

SEQ ID NO: 7329 - RNA, 22 nt, Human
gcaagcaaaaugggagauuccc

SEQ ID NO: 7330 - RNA, 22 nt, Human
gcaagcaaauuauuuauaggca

SEQ ID NO: 7331 - RNA, 23 nt, Human
gcaagcaaggcaggguaaagaga

SEQ ID NO: 7332 - RNA, 22 nt, Human
gcaagcacagauagacucagcc

SEQ ID NO: 7333 - RNA, 22 nt, Human
gcaagcagcccagaacagcucu

SEQ ID NO: 7334 - RNA, 22 nt, Human
gcaagcaguucgcagcccgccu

SEQ ID NO: 7335 - RNA, 18 nt, Human
gcaagcccucuccauuaa

SEQ ID NO: 7336 - RNA, 22 nt, Human
gcaagcuucauauggcauuuuc

SEQ ID NO: 7337 - RNA, 22 nt, Human
gcaaggaagagcagguggugcu

SEQ ID NO: 7338 - RNA, 22 nt, Human
gcaaggaagcagaguugcuauc

SEQ ID NO: 7339 - RNA, 22 nt, Human
gcaaggcagcauccuuuugagg

SEQ ID NO: 7340 - RNA, 18 nt, Human
gcaaggcagcucucuggg

SEQ ID NO: 7341 - RNA, 22 nt, Human
gcaaggcaguccuggggcccug

SEQ ID NO: 7342 - RNA, 22 nt, Human
gcaaggccugaggugggugcuc

SEQ ID NO: 7343 - RNA, 17 nt, Human
gcaaggccuguuuguuc

SEQ ID NO: 7344 - RNA, 22 nt, Human
gcaaggcucccgcagcccaggg

SEQ ID NO: 7345 - RNA, 22 nt, Human
gcaaggcugaccucucuagacu

SEQ ID NO: 7346 - RNA, 22 nt, Human
gcaaggcugcccacuucaaaag

SEQ ID NO: 7347 - RNA, 22 nt, Human
gcaaggcugcugccacccaucu

SEQ ID NO: 7348 - RNA, 22 nt, Human
gcaaggcugggagaugaggccu

SEQ ID NO: 7349 - RNA, 22 nt, Human
gcaaggcuguugcugcugcaag

SEQ ID NO: 7350 - RNA, 21 nt, Human
gcaaggcuuuuguguuuccca

SEQ ID NO: 7351 - RNA, 17 nt, Human
gcaagggaugggagauu

SEQ ID NO: 7352 - RNA, 22 nt, Human
gcaaggucuuucagaaaggaaa

SEQ ID NO: 7353 - RNA, 22 nt, Human
gcaaguccuuugcaugcaggga

SEQ ID NO: 7354 - RNA, 20 nt, Human
gcaagugaaaacuaugggug

SEQ ID NO: 7355 - RNA, 22 nt, Human
gcaauaaaauguaaugauuggg

SEQ ID NO: 7356 - RNA, 22 nt, Human
gcaauaaaguagcagcucauca

SEQ ID NO: 7357 - RNA, 22 nt, Human
gcaauacagaagaguggcaagg

SEQ ID NO: 7358 - RNA, 22 nt, Human
gcaauacaguagguuuauuggu

SEQ ID NO: 7359 - RNA, 22 nt, Human
gcaauacucaacacuuuugcuu

SEQ ID NO: 7360 - RNA, 22 nt, Human
gcaauacugagauuauuguacu

SEQ ID NO: 7361 - RNA, 22 nt, Human
gcaauagacuguuuuuauuguu

SEQ ID NO: 7362 - RNA, 22 nt, Human
gcaauagugccuauucucuuga

SEQ ID NO: 7363 - RNA, 22 nt, Human
gcaaugauauugaagugaugaa

SEQ ID NO: 7364 - RNA, 22 nt, Human
gcaaugcaaucagaugauuauu

SEQ ID NO: 7365 - RNA, 22 nt, Human
gcaaugcauaacagagugggcc

SEQ ID NO: 7366 - RNA, 22 nt, Human
gcaaugucugugcuaaaaacug

SEQ ID NO: 7367 - RNA, 22 nt, Human
gcaauguuaagaucacaccugg

SEQ ID NO: 7368 - RNA, 20 nt, Human
gcaauguugguuccugucac

SEQ ID NO: 7369 - RNA, 22 nt, Human
gcacaacaccaagggagguauc

SEQ ID NO: 7370 - RNA, 22 nt, Human
gcacaagcacgagcagcgugcg

SEQ ID NO: 7371 - RNA, 16 nt, Human
gcacacacaucaauga

SEQ ID NO: 7372 - RNA, 22 nt, Human
gcacacagaaucagugggcaua

SEQ ID NO: 7373 - RNA, 22 nt, Human
gcacacagauuaggaaacagaa

SEQ ID NO: 7374 - RNA, 22 nt, Human
gcacacagccagcugagggcua

SEQ ID NO: 7375 - RNA, 20 nt, Human
gcacacauagaaaugcauau

SEQ ID NO: 7376 - RNA, 22 nt, Human
gcacacauauauaugagcaugu

SEQ ID NO: 7377 - RNA, 22 nt, Human
gcacacaugcaugcacaggagu

SEQ ID NO: 7378 - RNA, 22 nt, Human
gcacacaugcguguauaugggu

SEQ ID NO: 7379 - RNA, 22 nt, Human
gcacacaugugaguguccuuuc

SEQ ID NO: 7380 - RNA, 22 nt, Human
gcacacuccuggauccuagaga

SEQ ID NO: 7381 - RNA, 22 nt, Human
gcacacugcggugaugugaguc

SEQ ID NO: 7382 - RNA, 22 nt, Human
gcacacugugaauuugcauaug

SEQ ID NO: 7383 - RNA, 22 nt, Human
gcacagaaguaaaauacaaguc

SEQ ID NO: 7384 - RNA, 22 nt, Human
gcacagacauauccauauuuac

SEQ ID NO: 7385 - RNA, 22 nt, Human
gcacagacuuugauugcaguca

SEQ ID NO: 7386 - RNA, 22 nt, Human
gcacagagagucccgggugccc

SEQ ID NO: 7387 - RNA, 18 nt, Human
gcacagagcaaguuucau

SEQ ID NO: 7388 - RNA, 22 nt, Human
gcacagagccugguaccgagaa

SEQ ID NO: 7389 - RNA, 22 nt, Human
gcacagagcuuguuuacauuug

SEQ ID NO: 7390 - RNA, 22 nt, Human
gcacagagguggaggacaaaua

SEQ ID NO: 7391 - RNA, 22 nt, Human
gcacagcagcugggggcccugg

SEQ ID NO: 7392 - RNA, 22 nt, Human
gcacagcaugaagagaggaagc

SEQ ID NO: 7393 - RNA, 22 nt, Human
gcacagccugucccuguccugg

SEQ ID NO: 7394 - RNA, 22 nt, Human
gcacagcuaugagcugaauugu

SEQ ID NO: 7395 - RNA, 22 nt, Human
gcacagcuggacucugccuggc

SEQ ID NO: 7396 - RNA, 22 nt, Human
gcacaggagccagguccuucac

SEQ ID NO: 7397 - RNA, 22 nt, Human
gcacaggcaauagauacagcua

SEQ ID NO: 7398 - RNA, 22 nt, Human
gcacaggcuguuggccuucaga

SEQ ID NO: 7399 - RNA, 21 nt, Human
gcacagggacagaucaucaca

SEQ ID NO: 7400 - RNA, 22 nt, Human
gcacagggaggcuggccuggcc

SEQ ID NO: 7401 - RNA, 22 nt, Human
gcacagggcaacaggucuguua

SEQ ID NO: 7402 - RNA, 22 nt, Human
gcacaggucaggagaugagauu

SEQ ID NO: 7403 - RNA, 22 nt, Human
gcacagguugcaaaaguucaca

SEQ ID NO: 7404 - RNA, 22 nt, Human
gcacaguaccugucacagaggc

SEQ ID NO: 7405 - RNA, 22 nt, Human
gcacaguagguauuuacccagu

SEQ ID NO: 7406 - RNA, 22 nt, Human
gcacaguauugcacaacucuag

SEQ ID NO: 7407 - RNA, 20 nt, Human
gcagcugaaaguaugacacc

SEQ ID NO: 7408 - RNA, 22 nt, Human
gcagcugaagcugcaguuccag

SEQ ID NO: 7409 - RNA, 18 nt, Human
gcagcugacacuggaguu

SEQ ID NO: 7410 - RNA, 20 nt, Human
gcagcugcccccagucccug

SEQ ID NO: 7411 - RNA, 22 nt, Human
gcagcugccuaaagugcuaaga

SEQ ID NO: 7412 - RNA, 22 nt, Human
gcagcugccuauucagggcuug

SEQ ID NO: 7413 - RNA, 22 nt, Human
gcagcugcgcugguguggggca

SEQ ID NO: 7414 - RNA, 22 nt, Human
gcagcugcuguggcaucaagcu

SEQ ID NO: 7415 - RNA, 19 nt, Human
gcagcugcuugaaaagaaa

SEQ ID NO: 7416 - RNA, 22 nt, Human
gcagcuggagaaauaccacccu

SEQ ID NO: 7417 - RNA, 22 nt, Human
gcagcuggagcaucuucucauc

SEQ ID NO: 7418 - RNA, 22 nt, Human
gcagcuggagccagccagacac

SEQ ID NO: 7419 - RNA, 22 nt, Human
gcagcugggccccagccucucc

SEQ ID NO: 7420 - RNA, 22 nt, Human
gcagcuggggaggucgugggga

SEQ ID NO: 7421 - RNA, 21 nt, Human
gcagcuggucucagagcuugc

SEQ ID NO: 7422 - RNA, 22 nt, Human
gcagcuggugcaaaugucacuc

SEQ ID NO: 7423 - RNA, 23 nt, Human
gcagcugguuagaagggaaggag

SEQ ID NO: 7424 - RNA, 22 nt, Human
gauacaguauuuaaagagcaac

SEQ ID NO: 7425 - RNA, 22 nt, Human
gauacaguguguuaacgagaaa

SEQ ID NO: 7426 - RNA, 22 nt, Human
gauacauuccgggagggcuacc

SEQ ID NO: 7427 - RNA, 22 nt, Human
gauacauuucaaggaggacugg

SEQ ID NO: 7428 - RNA, 22 nt, Human
gauaccuuuuguuggaauuucc

SEQ ID NO: 7429 - RNA, 22 nt, Human
gauacuuuccauccaaaugcau

SEQ ID NO: 7430 - RNA, 22 nt, Human
gauagaaagguguugaaaucca

SEQ ID NO: 7431 - RNA, 22 nt, Human
gauagcaacauagaacagaauu

SEQ ID NO: 7432 - RNA, 22 nt, Human
gauagcugcugggauauuuuua

SEQ ID NO: 7433 - RNA, 22 nt, Human
gauaggaccagguaaccucuaa

SEQ ID NO: 7434 - RNA, 22 nt, Human
gauaggauuauucccauuucca

SEQ ID NO: 7435 - RNA, 22 nt, Human
gauagggcuucacuaggcggag

SEQ ID NO: 7436 - RNA, 19 nt, Human
gauauaaagagauggugaa

SEQ ID NO: 7437 - RNA, 22 nt, Human
gauauacaauccacaguugauu

SEQ ID NO: 7438 - RNA, 22 nt, Human
gauauaguuggaauuauaaagg

SEQ ID NO: 7439 - RNA, 22 nt, Human
gauauaucacagcuuacuguca

SEQ ID NO: 7440 - RNA, 22 nt, Human
gauaucauaucagacaaccucu

SEQ ID NO: 7441 - RNA, 22 nt, Human
gauaugaaguggcauugugaag

SEQ ID NO: 7442 - RNA, 22 nt, Human
gauauguauugaaugaucauuu

SEQ ID NO: 7443 - RNA, 22 nt, Human
gauauucaaagauuacugauau

SEQ ID NO: 7444 - RNA, 22 nt, Human
gauauucaacuaaagugaauua

SEQ ID NO: 7445 - RNA, 22 nt, Human
gauauucuauuuuagccagcua

SEQ ID NO: 7446 - RNA, 22 nt, Human
gauauucuggugaaaccuuugg

SEQ ID NO: 7447 - RNA, 22 nt, Human
gauauuuacaaauuugccaaua

SEQ ID NO: 7448 - RNA, 21 nt, Human
gauauuuaugacucauuccuu

SEQ ID NO: 7449 - RNA, 22 nt, Human
gauauuuugagaaauccuauga

SEQ ID NO: 7450 - RNA, 22 nt, Human
gauauuuuuaguauuucugccu

SEQ ID NO: 7451 - RNA, 22 nt, Human
gaucaauucaaacuauuuuccu

SEQ ID NO: 7452 - RNA, 22 nt, Human
gaucacaauuuagacuuuuuaa

SEQ ID NO: 7453 - RNA, 22 nt, Human
gaucacaguauuuuagaugugu

SEQ ID NO: 7454 - RNA, 22 nt, Human
gaucagaaucuucauuuucagu

SEQ ID NO: 7455 - RNA, 22 nt, Human
gaucagaaugggacauauccug

SEQ ID NO: 7456 - RNA, 22 nt, Human
gaucagaauucuuguguguuuc

SEQ ID NO: 7457 - RNA, 20 nt, Human
gaucaggaagcggcuuggga

SEQ ID NO: 7458 - RNA, 22 nt, Human
gaucaggaauauuggaaaguac

SEQ ID NO: 7459 - RNA, 22 nt, Human
gaucaugugauuugaaguaaug

SEQ ID NO: 7460 - RNA, 22 nt, Human
gaucauuaacaaccuuacccuu

SEQ ID NO: 7461 - RNA, 22 nt, Human
gaucauuuuguauagcaaaggu

SEQ ID NO: 7462 - RNA, 22 nt, Human
gauccaaauuauuuuuuagagg

SEQ ID NO: 7463 - RNA, 22 nt, Human
gauccacaggaaccaaaacgca

SEQ ID NO: 7464 - RNA, 22 nt, Human
gauccacaguuugaugaucaua

SEQ ID NO: 7465 - RNA, 22 nt, Human
gauccacuguguuuguguugag

SEQ ID NO: 7466 - RNA, 22 nt, Human
gauccccaggacuagggggugg

SEQ ID NO: 7467 - RNA, 22 nt, Human
gauccugucuguggagucagca

SEQ ID NO: 7468 - RNA, 22 nt, Human
gauccugugguuuuccugugca

SEQ ID NO: 7469 - RNA, 22 nt, Human
gaucggguggguucugccauca

SEQ ID NO: 7470 - RNA, 22 nt, Human
gaucuagaaggcaaauauagug

SEQ ID NO: 7471 - RNA, 22 nt, Human
gaucugagaucuaaaccagagg

SEQ ID NO: 7472 - RNA, 22 nt, Human
gaucugggcuggagacugagaa

SEQ ID NO: 7473 - RNA, 22 nt, Human
gaucuguccuggcaguuaacac

SEQ ID NO: 7474 - RNA, 22 nt, Human
gaucuguuauaaucucuuuuau

SEQ ID NO: 7475 - RNA, 16 nt, Human
gaucuguucuauuuca

SEQ ID NO: 7476 - RNA, 22 nt, Human
gaucuugagcaaguugcauccc

SEQ ID NO: 7477 - RNA, 22 nt, Human
gaucuuggggggaucaccaugg

SEQ ID NO: 7478 - RNA, 22 nt, Human
gaucuuucaucuauguauuuag

SEQ ID NO: 7479 - RNA, 22 nt, Human
gaucuuuucagguuucucuagu

SEQ ID NO: 7480 - RNA, 22 nt, Human
gaugaaaaauugcugugucaua

SEQ ID NO: 7481 - RNA, 22 nt, Human
gaugaagcuaaaucuaagguuu

SEQ ID NO: 7482 - RNA, 18 nt, Human
gaugaagcugcuggggau

SEQ ID NO: 7483 - RNA, 22 nt, Human
gaugaagcuuugaagucuaauc

SEQ ID NO: 7484 - RNA, 22 nt, Human
gaugaagucauuauccuuuugg

SEQ ID NO: 7485 - RNA, 22 nt, Human
gaugaauuguuauggcuacgag

SEQ ID NO: 7486 - RNA, 20 nt, Human
gaugacauacucacuuaggg

SEQ ID NO: 7487 - RNA, 22 nt, Human
gaugaggaauuugagguuagaa

SEQ ID NO: 7488 - RNA, 22 nt, Human
gaugaggcaagccagaggacug

SEQ ID NO: 7489 - RNA, 18 nt, Human
gaugaggcugucugagaa

SEQ ID NO: 7490 - RNA, 22 nt, Human
gaugagucauucacagucguga

SEQ ID NO: 7491 - RNA, 21 nt, Human
gaugaugccauccuccaucuc

SEQ ID NO: 7492 - RNA, 21 nt, Human
gaugauggcaggcagcacugg

SEQ ID NO: 7493 - RNA, 22 nt, Human
gaugaugugucccaagaaguag

SEQ ID NO: 7494 - RNA, 22 nt, Human
gaugauucuguguuuggaaugc

SEQ ID NO: 7495 - RNA, 22 nt, Human
gaugauuuaaguggccaaagua

SEQ ID NO: 7496 - RNA, 22 nt, Human
gaugauuugaggauuucaugag

SEQ ID NO: 7497 - RNA, 22 nt, Human
gaugauuuuaguugacuaaacu

SEQ ID NO: 7498 - RNA, 22 nt, Human
gaugauuuucuguguuagaaga

SEQ ID NO: 7499 - RNA, 22 nt, Human
gaugauuuugaugcaguaaaga

SEQ ID NO: 7500 - RNA, 22 nt, Human
gaugcaaaaguaucauuuuaau

SEQ ID NO: 7501 - RNA, 22 nt, Human
gaugcaaagcauuuuugugugu

SEQ ID NO: 7502 - RNA, 22 nt, Human
gaugcacaugugaguauagaag

SEQ ID NO: 7503 - RNA, 22 nt, Human
gaugcacugcaguauauacugu

SEQ ID NO: 7504 - RNA, 22 nt, Human
gaugcacuugccccuccucaga

SEQ ID NO: 7505 - RNA, 22 nt, Human
gaugcaggugugccacagagcu

SEQ ID NO: 7506 - RNA, 22 nt, Human
gaugcagugcuuaaaucauuug

SEQ ID NO: 7507 - RNA, 22 nt, Human
gaugcugagagguggagggaac

SEQ ID NO: 7508 - RNA, 22 nt, Human
gaugcugccagucaaucccaag

SEQ ID NO: 7509 - RNA, 22 nt, Human
gaugcuuaagauguugguggca

SEQ ID NO: 7510 - RNA, 18 nt, Human
gauggaaaguguaugagu

SEQ ID NO: 7511 - RNA, 22 nt, Human
gauggaaugaauggcagauaca

SEQ ID NO: 7512 - RNA, 22 nt, Human
gauggaaugucacuucuguggu

SEQ ID NO: 7513 - RNA, 22 nt, Human
gauggacagccuggaaggaaag

SEQ ID NO: 7514 - RNA, 22 nt, Human
gauggaggaaaaguuggaaugc

SEQ ID NO: 7515 - RNA, 22 nt, Human
gauggauacuauaggaggcaca

SEQ ID NO: 7516 - RNA, 22 nt, Human
gcagagcuggaacugguacuca

SEQ ID NO: 7517 - RNA, 18 nt, Human
gcagagcugggauuccca

SEQ ID NO: 7518 - RNA, 22 nt, Human
gcagagcugggauuuguacugg

SEQ ID NO: 7519 - RNA, 20 nt, Human
gcagagcuguucugugggga

SEQ ID NO: 7520 - RNA, 23 nt, Human
gcagaggagcaagcuggacacca

SEQ ID NO: 7521 - RNA, 22 nt, Human
gcagaggauagcauaugaaccu

SEQ ID NO: 7522 - RNA, 22 nt, Human
gcagaggccaggccaccagcaa

SEQ ID NO: 7523 - RNA, 22 nt, Human
gcagaggccaucaacuuugcca

SEQ ID NO: 7524 - RNA, 22 nt, Human
gcagaggccugaagguggcggg

SEQ ID NO: 7525 - RNA, 22 nt, Human
gcagaggcuccauuuuacagau

SEQ ID NO: 7526 - RNA, 22 nt, Human
gcagaggcucuuuaaugcuuag

SEQ ID NO: 7527 - RNA, 22 nt, Human
gcagaggcugggugucccaguc

SEQ ID NO: 7528 - RNA, 22 nt, Human
gcagaggguccugugccagcag

SEQ ID NO: 7529 - RNA, 22 nt, Human
gcagagguggaugcaauugggg

SEQ ID NO: 7530 - RNA, 23 nt, Human
gcagagguuauguuuuuuaggcu

SEQ ID NO: 7531 - RNA, 22 nt, Human
gcagagugaagcaguauggaaa

SEQ ID NO: 7532 - RNA, 22 nt, Human
gcagagugaggaagagcuucca

SEQ ID NO: 7533 - RNA, 22 nt, Human
gcagagugauggaaugugggug

SEQ ID NO: 7534 - RNA, 22 nt, Human
gcagagugccgagauggaagcg

SEQ ID NO: 7535 - RNA, 20 nt, Human
gcagagugugagagggugaa

SEQ ID NO: 7536 - RNA, 22 nt, Human
gcagaguucucuuccagcuaac

SEQ ID NO: 7537 - RNA, 22 nt, Human
gcagaguuggagccagcccagg

SEQ ID NO: 7538 - RNA, 18 nt, Human
gcagaucauuagauaauu

SEQ ID NO: 7539 - RNA, 19 nt, Human
gcagauccaaaagucacau

SEQ ID NO: 7540 - RNA, 22 nt, Human
gcagaugcagaacucagugggu

SEQ ID NO: 7541 - RNA, 22 nt, Human
gcagaugcagagauggcugggg

SEQ ID NO: 7542 - RNA, 22 nt, Human
gcagauggacuguaugaccuga

SEQ ID NO: 7543 - RNA, 18 nt, Human
gcagauggagauucaggg

SEQ ID NO: 7544 - RNA, 22 nt, Human
gcagauggcgcaguggaaguuc

SEQ ID NO: 7545 - RNA, 21 nt, Human
gcagaugggagucaucaggcu

SEQ ID NO: 7546 - RNA, 22 nt, Human
gcagaugguggaggcaagaggc

SEQ ID NO: 7547 - RNA, 22 nt, Human
gcagaugguggggcaggaaaau

SEQ ID NO: 7548 - RNA, 22 nt, Human
gcagauggugggggaggaguac

SEQ ID NO: 7549 - RNA, 22 nt, Human
gcagcaaacuuccacaaguaga

SEQ ID NO: 7550 - RNA, 18 nt, Human
gcagcaaagggcccgggg

SEQ ID NO: 7551 - RNA, 21 nt, Human
gcagcaaaugacaacagugag

SEQ ID NO: 7552 - RNA, 22 nt, Human
gcagcaacgcggcccuacugcu

SEQ ID NO: 7553 - RNA, 22 nt, Human
gcagcacacgguggugcccugg

SEQ ID NO: 7554 - RNA, 20 nt, Human
gcagcagacagacaggggac

SEQ ID NO: 7555 - RNA, 22 nt, Human
gcagcagagaacacaaugaugg

SEQ ID NO: 7556 - RNA, 22 nt, Human
gcagcagagcuuuguccuggcu

SEQ ID NO: 7557 - RNA, 22 nt, Human
gcagcagaggcccuacucuuug

SEQ ID NO: 7558 - RNA, 22 nt, Human
guauuuuaagugacuacuaggu

SEQ ID NO: 7559 - RNA, 22 nt, Human
guauuuuacugcucaaagcucu

SEQ ID NO: 7560 - RNA, 22 nt, Human
guauuuuauggcaugcaguggc

SEQ ID NO: 7561 - RNA, 22 nt, Human
guauuuuauggccuggggccua

SEQ ID NO: 7562 - RNA, 22 nt, Human
guauuuuucauuccaagugaga

SEQ ID NO: 7563 - RNA, 22 nt, Human
gucaaaacaaaguuaagaauuc

SEQ ID NO: 7564 - RNA, 22 nt, Human
gucaaacaaauuaacauaucca

SEQ ID NO: 7565 - RNA, 20 nt, Human
gucaaacuacuggcagugcc

SEQ ID NO: 7566 - RNA, 22 nt, Human
gucaaauauacuaagagguaaa

SEQ ID NO: 7567 - RNA, 22 nt, Human
gucaaauauaugcaaaacuauu

SEQ ID NO: 7568 - RNA, 22 nt, Human
gucaaauauuaugcagcuugga

SEQ ID NO: 7569 - RNA, 22 nt, Human
gucaacaaguaguuuucuucca

SEQ ID NO: 7570 - RNA, 22 nt, Human
gucaacaagugguuauugggau

SEQ ID NO: 7571 - RNA, 22 nt, Human
gucaacaauuccaguuuuuacu

SEQ ID NO: 7572 - RNA, 22 nt, Human
gucaacagagacagagacacug

SEQ ID NO: 7573 - RNA, 22 nt, Human
gucaacaucggaaagcguguaa

SEQ ID NO: 7574 - RNA, 22 nt, Human
gucaacauguucugggugaaug

SEQ ID NO: 7575 - RNA, 22 nt, Human
gucaacuguaccuaaagaaagu

SEQ ID NO: 7576 - RNA, 22 nt, Human
gucaacuugcaagaugcugggc

SEQ ID NO: 7577 - RNA, 22 nt, Human
gucaacuuuaagaugaucuuuu

SEQ ID NO: 7578 - RNA, 22 nt, Human
gucacacacauuucuuuggugc

SEQ ID NO: 7579 - RNA, 22 nt, Human
gucacacucagaaugacuagag

SEQ ID NO: 7580 - RNA, 22 nt, Human
gucacaggaaaggguguaaggg

SEQ ID NO: 7581 - RNA, 22 nt, Human
gucacaggccuggaugaggggc

SEQ ID NO: 7582 - RNA, 22 nt, Human
gucacaguggggucacagugug

SEQ ID NO: 7583 - RNA, 22 nt, Human
gucacaugccagugcacacagg

SEQ ID NO: 7584 - RNA, 22 nt, Human
gucacauucaugcagaaucaaa

SEQ ID NO: 7585 - RNA, 22 nt, Human
gucaccaucuacagcuccaaac

SEQ ID NO: 7586 - RNA, 22 nt, Human
gucacccacucccugcugcugu

SEQ ID NO: 7587 - RNA, 22 nt, Human
gucacccguuugacuauccacc

SEQ ID NO: 7588 - RNA, 22 nt, Human
gucaccucgcugucuuccugag

SEQ ID NO: 7589 - RNA, 22 nt, Human
gucaccucucaucacaugcuac

SEQ ID NO: 7590 - RNA, 22 nt, Human
gucaccuugaacaggcuacuca

SEQ ID NO: 7591 - RNA, 22 nt, Human
gucacuuuauuaauuuugguga

SEQ ID NO: 7592 - RNA, 21 nt, Human
gucagagaugcccaacugccu

SEQ ID NO: 7593 - RNA, 22 nt, Human
gucagagcccuucccugauuuu

SEQ ID NO: 7594 - RNA, 20 nt, Human
gucagaggacccuagagcga

SEQ ID NO: 7595 - RNA, 22 nt, Human
gucagaggggacaagacacaga

SEQ ID NO: 7596 - RNA, 22 nt, Human
gucagaggggcagcugccaggc

SEQ ID NO: 7597 - RNA, 22 nt, Human
gucagaucuuuggggaugcugu

SEQ ID NO: 7598 - RNA, 22 nt, Human
gucagcaauaguuaguuuacaa

SEQ ID NO: 7599 - RNA, 22 nt, Human
gucagcagaaacgccacaugca

SEQ ID NO: 7600 - RNA, 22 nt, Human
gucagcauaguucacacacagu

SEQ ID NO: 7601 - RNA, 22 nt, Human
gucagcuacugcagggaacuuu

SEQ ID NO: 7602 - RNA, 22 nt, Human
gucagcucucuuauccaugagg

SEQ ID NO: 7603 - RNA, 21 nt, Human
gucagcugugugugaggaccc

SEQ ID NO: 7604 - RNA, 22 nt, Human
gucaggacaagguggucuccag

SEQ ID NO: 7605 - RNA, 22 nt, Human
gucaggacauuuuaccauccug

SEQ ID NO: 7606 - RNA, 22 nt, Human
gucaggagauagggcaagcuuc

SEQ ID NO: 7607 - RNA, 22 nt, Human
gucaggaucucccaguacauau

SEQ ID NO: 7608 - RNA, 22 nt, Human
gucaggaugacaagugcuuuca

SEQ ID NO: 7609 - RNA, 22 nt, Human
gucaggaugcuauuguuauuaa

SEQ ID NO: 7610 - RNA, 22 nt, Human
gucaggauguuuauucuccagu

SEQ ID NO: 7611 - RNA, 20 nt, Human
gucaggauuaguaaacucug

SEQ ID NO: 7612 - RNA, 22 nt, Human
gucaggauuauaauccccaugg

SEQ ID NO: 7613 - RNA, 22 nt, Human
gucaggauuauuuuauuaaaag

SEQ ID NO: 7614 - RNA, 21 nt, Human
gucaggcccauagcagugccu

SEQ ID NO: 7615 - RNA, 22 nt, Human
gucaggcugcuggagcuugggu

SEQ ID NO: 7616 - RNA, 22 nt, Human
gucagggauccacugcucuucu

SEQ ID NO: 7617 - RNA, 22 nt, Human
gucagggcacagugacagcucc

SEQ ID NO: 7618 - RNA, 22 nt, Human
gucaggggccaugggccaagga

SEQ ID NO: 7619 - RNA, 21 nt, Human
gucagugcugaaacaccuucc

SEQ ID NO: 7620 - RNA, 22 nt, Human
gucaguguagguucaucagugg

SEQ ID NO: 7621 - RNA, 20 nt, Human
gucagugucuucaguaguga

SEQ ID NO: 7622 - RNA, 22 nt, Human
gucagugugaguugauuccaua

SEQ ID NO: 7623 - RNA, 22 nt, Human
gucaguucauuagcacuuccaa

SEQ ID NO: 7624 - RNA, 22 nt, Human
gucauaaagcuuguugcauuua

SEQ ID NO: 7625 - RNA, 22 nt, Human
gccagagcacaggcugguagua

SEQ ID NO: 7626 - RNA, 18 nt, Human
gccagagcauaucuccag

SEQ ID NO: 7627 - RNA, 22 nt, Human
gccagagcaugcacugccugca

SEQ ID NO: 7628 - RNA, 22 nt, Human
gccagagcugagacacgagucc

SEQ ID NO: 7629 - RNA, 23 nt, Human
gccagaggaacgcagagcuuucu

SEQ ID NO: 7630 - RNA, 22 nt, Human
gccagagugccaucagugccau

SEQ ID NO: 7631 - RNA, 22 nt, Human
gccagaucugacauaguggaag

SEQ ID NO: 7632 - RNA, 22 nt, Human
gccagauguagauagcaaggua

SEQ ID NO: 7633 - RNA, 22 nt, Human
gccagcaacuaggagcugaauu

SEQ ID NO: 7634 - RNA, 22 nt, Human
gccagcaaggaggggaaaaaug

SEQ ID NO: 7635 - RNA, 19 nt, Human
gccagcacccagcuguguc

SEQ ID NO: 7636 - RNA, 19 nt, Human
gccagcagaaugaugaggc

SEQ ID NO: 7637 - RNA, 22 nt, Human
gccagcagccacagaagucacu

SEQ ID NO: 7638 - RNA, 22 nt, Human
gccagcaguccaguccuuagug

SEQ ID NO: 7639 - RNA, 22 nt, Human
gccagcaguccugcugugugcc

SEQ ID NO: 7640 - RNA, 22 nt, Human
gccagcauccugguggugguug

SEQ ID NO: 7641 - RNA, 22 nt, Human
gccagccacaagggaggcuugu

SEQ ID NO: 7642 - RNA, 22 nt, Human
gccagccacuucagcuauggcu

SEQ ID NO: 7643 - RNA, 22 nt, Human
gccagccacuucccagacuggc

SEQ ID NO: 7644 - RNA, 22 nt, Human
gccagccagaguggcugugugu

SEQ ID NO: 7645 - RNA, 22 nt, Human
gccagccaggaagaaaguaaga

SEQ ID NO: 7646 - RNA, 21 nt, Human
gccagccaugcuugccuaggc

SEQ ID NO: 7647 - RNA, 22 nt, Human
gccagcccagcuccaggggaaa

SEQ ID NO: 7648 - RNA, 22 nt, Human
gccagccccagacauccuaucg

SEQ ID NO: 7649 - RNA, 22 nt, Human
gccagccccuuagggcucuccc

SEQ ID NO: 7650 - RNA, 22 nt, Human
gccagccuucuguggccugcaa

SEQ ID NO: 7651 - RNA, 21 nt, Human
gccagcggccgcccuccagga

SEQ ID NO: 7652 - RNA, 22 nt, Human
gccagcucuguggcuguacuug

SEQ ID NO: 7653 - RNA, 22 nt, Human
gccagcugaaauuucaguucug

SEQ ID NO: 7654 - RNA, 21 nt, Human
gccagcugcagggcuuccuug

SEQ ID NO: 7655 - RNA, 22 nt, Human
gccagcuggaaaucugcuugaa

SEQ ID NO: 7656 - RNA, 22 nt, Human
gccagcuggcugcaggucccag

SEQ ID NO: 7657 - RNA, 22 nt, Human
gccagcuguaucuuuggccagc

SEQ ID NO: 7658 - RNA, 22 nt, Human
gccagcuguucagacauucuuu

SEQ ID NO: 7659 - RNA, 22 nt, Human
gccaggaaaaaccggcccugcu

SEQ ID NO: 7660 - RNA, 22 nt, Human
gccaggaaaaaggguggccaau

SEQ ID NO: 7661 - RNA, 22 nt, Human
gccaggaaauucaugccagauc

SEQ ID NO: 7662 - RNA, 22 nt, Human
gccaggaagcaguuagaugggu

SEQ ID NO: 7663 - RNA, 22 nt, Human
gccaggaaggcucccuggucac

SEQ ID NO: 7664 - RNA, 22 nt, Human
gccaggaaugcauaaaugaccu

SEQ ID NO: 7665 - RNA, 19 nt, Human
gccaggacauccuccugcu

SEQ ID NO: 7666 - RNA, 22 nt, Human
gccaggacugagaaugggagca

SEQ ID NO: 7667 - RNA, 22 nt, Human
gccaggagaaugcuagcagagg

SEQ ID NO: 7668 - RNA, 22 nt, Human
gccaggaggcugcuguguaggc

SEQ ID NO: 7669 - RNA, 21 nt, Human
gccaggaguagauuacauuua

SEQ ID NO: 7670 - RNA, 23 nt, Human
gccaggcacaugguggacacgca

SEQ ID NO: 7671 - RNA, 22 nt, Human
gccaggcacugcucuaagcccu

SEQ ID NO: 7672 - RNA, 22 nt, Human
gccaggcagacaggucaucagg

SEQ ID NO: 7673 - RNA, 22 nt, Human
gcaguuagcuugucacaguccu

SEQ ID NO: 7674 - RNA, 22 nt, Human
gcaguuauguauguguuugaga

SEQ ID NO: 7675 - RNA, 22 nt, Human
gcaguuaugugaaucaugugac

SEQ ID NO: 7676 - RNA, 22 nt, Human
gcaguuuggaaaaugugccucu

SEQ ID NO: 7677 - RNA, 22 nt, Human
gcauaaaggacuauaaggauca

SEQ ID NO: 7678 - RNA, 19 nt, Human
gcauaaauacacuauuguc

SEQ ID NO: 7679 - RNA, 22 nt, Human
gcauaauuaaacaggcaagauu

SEQ ID NO: 7680 - RNA, 22 nt, Human
gcauaucagcaucaaaacacag

SEQ ID NO: 7681 - RNA, 22 nt, Human
gcauaugaucacgugugucggu

SEQ ID NO: 7682 - RNA, 22 nt, Human
gcauauggcuucauuuaauucu

SEQ ID NO: 7683 - RNA, 22 nt, Human
gcauauuuucacaagcucuugg

SEQ ID NO: 7684 - RNA, 22 nt, Human
gcauccaaaccauucaucagcc

SEQ ID NO: 7685 - RNA, 20 nt, Human
gcauccagacacccagcugc

SEQ ID NO: 7686 - RNA, 22 nt, Human
gcauccagguagagcuugcggg

SEQ ID NO: 7687 - RNA, 22 nt, Human
gcauccagucuuggcuccugga

SEQ ID NO: 7688 - RNA, 22 nt, Human
gcauccaugcaugcagggugug

SEQ ID NO: 7689 - RNA, 22 nt, Human
gcauccauggagagcacucuga

SEQ ID NO: 7690 - RNA, 19 nt, Human
gcauccauggaggccgcuu

SEQ ID NO: 7691 - RNA, 22 nt, Human
gcauccuggcucuaggugucau

SEQ ID NO: 7692 - RNA, 22 nt, Human
gcaucuaaacuugcaucauugu

SEQ ID NO: 7693 - RNA, 22 nt, Human
gcaucuaaaucacuuuaaugua

SEQ ID NO: 7694 - RNA, 22 nt, Human
gcaucuaagguggauaacuucu

SEQ ID NO: 7695 - RNA, 22 nt, Human
gcaucuaauccaguccagcauc

SEQ ID NO: 7696 - RNA, 19 nt, Human
gcaucugcaugaugggguu

SEQ ID NO: 7697 - RNA, 22 nt, Human
gcaucuguuagagugugcaugc

SEQ ID NO: 7698 - RNA, 21 nt, Human
gcaugaaaacagccugugcuc

SEQ ID NO: 7699 - RNA, 22 nt, Human
gcaugaaaugagcgaauauaau

SEQ ID NO: 7700 - RNA, 20 nt, Human
gcaugaggaaucauugcagc

SEQ ID NO: 7701 - RNA, 22 nt, Human
gcaugagggggguuaggaaguu

SEQ ID NO: 7702 - RNA, 22 nt, Human
gcaugaugaaggaggaggaguc

SEQ ID NO: 7703 - RNA, 22 nt, Human
gcaugcaaauagucaugcuucc

SEQ ID NO: 7704 - RNA, 22 nt, Human
gcaugcaaggggugugaaguga

SEQ ID NO: 7705 - RNA, 22 nt, Human
gcaugcaauguaucagugauag

SEQ ID NO: 7706 - RNA, 22 nt, Human
gcaugcacaccugugcacauuu

SEQ ID NO: 7707 - RNA, 22 nt, Human
gcaugcacaguuuuucaccuca

SEQ ID NO: 7708 - RNA, 22 nt, Human
gcaugcagaaaaugaacaacga

SEQ ID NO: 7709 - RNA, 22 nt, Human
gcaugcagucaaccaguaaggg

SEQ ID NO: 7710 - RNA, 22 nt, Human
gcaugcagugcaauucaaugua

SEQ ID NO: 7711 - RNA, 22 nt, Human
gcaugcaugauguuggcagugg

SEQ ID NO: 7712 - RNA, 22 nt, Human
gcaugcauuacaugggauaugc

SEQ ID NO: 7713 - RNA, 21 nt, Human
gcaugccugcaucuuaguguu

SEQ ID NO: 7714 - RNA, 20 nt, Human
gcaugcuuggagagagagaa

SEQ ID NO: 7715 - RNA, 22 nt, Human
gcauggaugggaguggacagau

SEQ ID NO: 7716 - RNA, 22 nt, Human
gcauggcaaauaucgagggcag

SEQ ID NO: 7717 - RNA, 22 nt, Human
gcauggcauuaacaagauggaa

SEQ ID NO: 7718 - RNA, 22 nt, Human
gcauggccucugugcuuguugc

SEQ ID NO: 7719 - RNA, 22 nt, Human
gcauggccuugugcuccuucuc

SEQ ID NO: 7720 - RNA, 20 nt, Human
gcauggcuaaucuguacuga

SEQ ID NO: 7721 - RNA, 22 nt, Human
gcauggcuauuaugaggcagaa

SEQ ID NO: 7722 - RNA, 22 nt, Human
gcauggcuauucuaacucacau

SEQ ID NO: 7723 - RNA, 22 nt, Human
gcaugggaggacagucugggcu

SEQ ID NO: 7724 - RNA, 22 nt, Human
gcaugggcaagaggacuggggg

SEQ ID NO: 7725 - RNA, 17 nt, Human
gcauguaguacauguaa

SEQ ID NO: 7726 - RNA, 22 nt, Human
gcauguggauauguuaggguga

SEQ ID NO: 7727 - RNA, 22 nt, Human
gcaugugucaucugccuuucgu

SEQ ID NO: 7728 - RNA, 22 nt, Human
gcaugugucuuuauagcagcau

SEQ ID NO: 7729 - RNA, 22 nt, Human
gcaugugugagaccuuuuagca

SEQ ID NO: 7730 - RNA, 22 nt, Human
gcaugugugucacuuuccugcc

SEQ ID NO: 7731 - RNA, 22 nt, Human
gcauguguuagagugugcaugc

SEQ ID NO: 7732 - RNA, 22 nt, Human
gcauguguugguuuaugcaugu

SEQ ID NO: 7733 - RNA, 22 nt, Human
gcauuagaaacuauugcugcaa

SEQ ID NO: 7734 - RNA, 22 nt, Human
gcagcugcaggcaggcuugcug

SEQ ID NO: 7735 - RNA, 22 nt, Human
gcagcuggaagugacacucugu

SEQ ID NO: 7736 - RNA, 22 nt, Human
gcagcuggcccugacacgcaga

SEQ ID NO: 7737 - RNA, 22 nt, Human
gcagcugucagaaguuggaauc

SEQ ID NO: 7738 - RNA, 22 nt, Human
gcagcuucagccagagggccag

SEQ ID NO: 7739 - RNA, 22 nt, Human
gcagcuuccugaguguggacag

SEQ ID NO: 7740 - RNA, 22 nt, Human
gcagcuuuagaaacaagggcug

SEQ ID NO: 7741 - RNA, 22 nt, Human
gcagcuuucuaagcuuuauugc

SEQ ID NO: 7742 - RNA, 22 nt, Human
gcagcuuucugcaaugucaucc

SEQ ID NO: 7743 - RNA, 22 nt, Human
gcagcuuucugggacagaaagg

SEQ ID NO: 7744 - RNA, 22 nt, Human
gcagcuuucuugcccuaaucuu

SEQ ID NO: 7745 - RNA, 22 nt, Human
gcagcuuugaagacuuauuugc

SEQ ID NO: 7746 - RNA, 22 nt, Human
gcagcuuuggagguggaacucu

SEQ ID NO: 7747 - RNA, 22 nt, Human
gcagcuuuguggagaggcccau

SEQ ID NO: 7748 - RNA, 22 nt, Human
gcaggaaaaccuucccauguuu

SEQ ID NO: 7749 - RNA, 22 nt, Human
gcaggaaagguugagacuuugc

SEQ ID NO: 7750 - RNA, 19 nt, Human
gcaggaaaugagugauugc

SEQ ID NO: 7751 - RNA, 22 nt, Human
gcaggaacagggcuucaagcuu

SEQ ID NO: 7752 - RNA, 22 nt, Human
gcaggaaccacugccccccugu

SEQ ID NO: 7753 - RNA, 22 nt, Human
gcaggaaccccgggaggcuggc

SEQ ID NO: 7754 - RNA, 22 nt, Human
gcaggaacccggccgcccuggc

SEQ ID NO: 7755 - RNA, 22 nt, Human
gcaggaacuggagcuggauguu

SEQ ID NO: 7756 - RNA, 22 nt, Human
gcaggaacuugcaaaaugagca

SEQ ID NO: 7757 - RNA, 23 nt, Human
gcaggacaacagagugggaaggc

SEQ ID NO: 7758 - RNA, 22 nt, Human
gcaggacucaaaucugaaggca

SEQ ID NO: 7759 - RNA, 22 nt, Human
gcaggagacaacuguaaggaga

SEQ ID NO: 7760 - RNA, 22 nt, Human
gcaggagagucugugccagguu

SEQ ID NO: 7761 - RNA, 22 nt, Human
gcaggagcaauggccuaucaga

SEQ ID NO: 7762 - RNA, 22 nt, Human
gcaggagcuuugcuuacugcug

SEQ ID NO: 7763 - RNA, 22 nt, Human
gcaggaguguggugggacaucc

SEQ ID NO: 7764 - RNA, 22 nt, Human
gcaggaguuaggcgucguggau

SEQ ID NO: 7765 - RNA, 19 nt, Human
gcaggauaggcugagacua

SEQ ID NO: 7766 - RNA, 22 nt, Human
gcaggaugaacuaacaccugca

SEQ ID NO: 7767 - RNA, 22 nt, Human
gcaggaugaaggcagaggcuga

SEQ ID NO: 7768 - RNA, 21 nt, Human
gcaggaugcaucuuggugucu

SEQ ID NO: 7769 - RNA, 22 nt, Human
gcaggauugggcagagggugaa

SEQ ID NO: 7770 - RNA, 22 nt, Human
gcaggcaauuuuggaaggucag

SEQ ID NO: 7771 - RNA, 22 nt, Human
gcaggcacaugggcgggucugg

SEQ ID NO: 7772 - RNA, 22 nt, Human
gcaggcaccacggcucaggucu

SEQ ID NO: 7773 - RNA, 14 nt, Human
gcaggcagaccacc

SEQ ID NO: 7774 - RNA, 16 nt, Human
gcaggcagaucacaug

SEQ ID NO: 7775 - RNA, 14 nt, Human
gcaggcagaucacc

SEQ ID NO: 7776 - RNA, 14 nt, Human
gcaggcagaucacu

SEQ ID NO: 7777 - RNA, 14 nt, Human
gcaggcagaucauu

SEQ ID NO: 7778 - RNA, 22 nt, Human
gcaggcagccacgauucccuug

SEQ ID NO: 7779 - RNA, 15 nt, Human
gcaggcaggucaccu

SEQ ID NO: 7780 - RNA, 22 nt, Human
gcaggcagucaucuuucauauu

SEQ ID NO: 7781 - RNA, 22 nt, Human
gcaggcaguugcaguuuucuag

SEQ ID NO: 7782 - RNA, 22 nt, Human
gcaggcaguuugcuuuucccuc

SEQ ID NO: 7783 - RNA, 22 nt, Human
gcaggccaagcccucgcagaga

SEQ ID NO: 7784 - RNA, 19 nt, Human
gcaggccaggaggcggagg

SEQ ID NO: 7785 - RNA, 22 nt, Human
gcaggccaggcuaggggcuguc

SEQ ID NO: 7786 - RNA, 22 nt, Human
gcaggccauucaggagaugugc

SEQ ID NO: 7787 - RNA, 19 nt, Human
gcaggcccagucgggcugg

SEQ ID NO: 7788 - RNA, 22 nt, Human
gcaggccugucuugcucgcccu

SEQ ID NO: 7789 - RNA, 22 nt, Human
gucuggacugcaaaauaaggau

SEQ ID NO: 7790 - RNA, 22 nt, Human
gucuggacuuuaucccaagguu

SEQ ID NO: 7791 - RNA, 22 nt, Human
gucuggagccacccuaagcauu

SEQ ID NO: 7792 - RNA, 22 nt, Human
gucuggagccugggucccugcu

SEQ ID NO: 7793 - RNA, 22 nt, Human
gucuggaggggagauuuggguu

SEQ ID NO: 7794 - RNA, 18 nt, Human
gucuggaggucaggagcu

SEQ ID NO: 7795 - RNA, 22 nt, Human
gucuggaguaccauaaaaagga

SEQ ID NO: 7796 - RNA, 22 nt, Human
gucuggcacauaagaggagcuc

SEQ ID NO: 7797 - RNA, 16 nt, Human
gucuggccuaccugcc

SEQ ID NO: 7798 - RNA, 22 nt, Human
gucuggccugccagcucuggug

SEQ ID NO: 7799 - RNA, 22 nt, Human
gucuggcuguuccugccuguga

SEQ ID NO: 7800 - RNA, 22 nt, Human
gucuggcuuuugcccuguguuu

SEQ ID NO: 7801 - RNA, 22 nt, Human
gucugggacaggacuggggaac

SEQ ID NO: 7802 - RNA, 22 nt, Human
gucugggcaccuggccugggaa

SEQ ID NO: 7803 - RNA, 22 nt, Human
gucuggguggcugcuuucagcu

SEQ ID NO: 7804 - RNA, 22 nt, Human
gucugguauucaauuauuauuu

SEQ ID NO: 7805 - RNA, 22 nt, Human
gucuguaauuauuaaagaaagg

SEQ ID NO: 7806 - RNA, 22 nt, Human
gucuguagaauaaauaugagua

SEQ ID NO: 7807 - RNA, 22 nt, Human
gucugucacucaggggcuggag

SEQ ID NO: 7808 - RNA, 22 nt, Human
gucugucucucuccagagugca

SEQ ID NO: 7809 - RNA, 22 nt, Human
gucugucuguuguugagaagca

SEQ ID NO: 7810 - RNA, 22 nt, Human
gucugugcuuauucagcagggg

SEQ ID NO: 7811 - RNA, 22 nt, Human
gucuguggcaggggagaaguuu

SEQ ID NO: 7812 - RNA, 22 nt, Human
gucugugugcacagagcuuugg

SEQ ID NO: 7813 - RNA, 18 nt, Human
gucuguguggcuugggga

SEQ ID NO: 7814 - RNA, 22 nt, Human
gucuuauuggguccaagguggc

SEQ ID NO: 7815 - RNA, 22 nt, Human
gucuuauuuaaggacaagaaga

SEQ ID NO: 7816 - RNA, 22 nt, Human
gucuuauuuaaggcuuauacaa

SEQ ID NO: 7817 - RNA, 22 nt, Human
gucuucaauugcauuugauggg

SEQ ID NO: 7818 - RNA, 22 nt, Human
gucuucaggacccggaauuuug

SEQ ID NO: 7819 - RNA, 22 nt, Human
gucuucaggaccuggaauuuug

SEQ ID NO: 7820 - RNA, 19 nt, Human
gucuucugaauguggcugc

SEQ ID NO: 7821 - RNA, 22 nt, Human
gucuucuggaagagagccagcu

SEQ ID NO: 7822 - RNA, 22 nt, Human
gucuucuguuuacuuugaaguu

SEQ ID NO: 7823 - RNA, 22 nt, Human
gucuucuuguuuugaaggaaau

SEQ ID NO: 7824 - RNA, 19 nt, Human
gucuuggcucucaaccauc

SEQ ID NO: 7825 - RNA, 20 nt, Human
gucuuguagcucaaguuauu

SEQ ID NO: 7826 - RNA, 22 nt, Human
gucuugucaguguuggcagcuu

SEQ ID NO: 7827 - RNA, 22 nt, Human
gucuuuaagggacugaauuugg

SEQ ID NO: 7828 - RNA, 22 nt, Human
gucuuuagagcuccuggcaucu

SEQ ID NO: 7829 - RNA, 22 nt, Human
gucuuuaucuuugaaauuaguc

SEQ ID NO: 7830 - RNA, 20 nt, Human
gucuuuauguuuuaugaccu

SEQ ID NO: 7831 - RNA, 22 nt, Human
gucuuucuaugcauagagcaga

SEQ ID NO: 7832 - RNA, 22 nt, Human
gucuuucugccaugugaagaga

SEQ ID NO: 7833 - RNA, 22 nt, Human
gucuuucugcugcacggacugc

SEQ ID NO: 7834 - RNA, 22 nt, Human
gucuuucuuaauucaagugcuu

SEQ ID NO: 7835 - RNA, 18 nt, Human
gucuuuggaguggaggua

SEQ ID NO: 7836 - RNA, 22 nt, Human
gucuuuggauguaagauaaagu

SEQ ID NO: 7837 - RNA, 22 nt, Human
gugaaacacccuccaaugcaca

SEQ ID NO: 7838 - RNA, 22 nt, Human
gugaaagacagcauuaauggcu

SEQ ID NO: 7839 - RNA, 22 nt, Human
gugaacaggagaaagugaugga

SEQ ID NO: 7840 - RNA, 22 nt, Human
gugaacaucagauuacaugaga

SEQ ID NO: 7841 - RNA, 22 nt, Human
gugaacauugaggcagaaagga

SEQ ID NO: 7842 - RNA, 22 nt, Human
gugaaccaagaagucaaagcga

SEQ ID NO: 7843 - RNA, 22 nt, Human
gugaacuauuggguaucauaaa

SEQ ID NO: 7844 - RNA, 22 nt, Human
gcccaagagagcgaagguuggc

SEQ ID NO: 7845 - RNA, 22 nt, Human
gcccaagaguuaagucucugcu

SEQ ID NO: 7846 - RNA, 22 nt, Human
gcccaagaucacacuggaaauc

SEQ ID NO: 7847 - RNA, 22 nt, Human
gcccaagccgccuuccagagac

SEQ ID NO: 7848 - RNA, 22 nt, Human
gcccaagggcaucaaguucuac

SEQ ID NO: 7849 - RNA, 22 nt, Human
gcccaaggucacacacaggaag

SEQ ID NO: 7850 - RNA, 20 nt, Human
gcccaagguccagaaggggg

SEQ ID NO: 7851 - RNA, 22 nt, Human
gcccaagucagugcuucuggca

SEQ ID NO: 7852 - RNA, 22 nt, Human
gcccaauagagaaauagugaaa

SEQ ID NO: 7853 - RNA, 22 nt, Human
gcccaauaguggggauauaccu

SEQ ID NO: 7854 - RNA, 23 nt, Human
gcccacauuggugcaugaauguu

SEQ ID NO: 7855 - RNA, 22 nt, Human
gcccacauuuuuggcuuagagg

SEQ ID NO: 7856 - RNA, 22 nt, Human
gcccaccuaaccugcucaccuu

SEQ ID NO: 7857 - RNA, 22 nt, Human
gcccagaagugacucagcacug

SEQ ID NO: 7858 - RNA, 22 nt, Human
gcccagacauuuggccaaacau

SEQ ID NO: 7859 - RNA, 22 nt, Human
gcccagagagaugcuguagacc

SEQ ID NO: 7860 - RNA, 23 nt, Human
gcccagagaggcucaccaggaau

SEQ ID NO: 7861 - RNA, 18 nt, Human
gcccagaggucugggccc

SEQ ID NO: 7862 - RNA, 21 nt, Human
gcccagaguccucccacucca

SEQ ID NO: 7863 - RNA, 22 nt, Human
gcccagaguuugaagauacagu

SEQ ID NO: 7864 - RNA, 22 nt, Human
gcccagcaaggaccaagggccg

SEQ ID NO: 7865 - RNA, 21 nt, Human
gcccagcaaggugagaaggcc

SEQ ID NO: 7866 - RNA, 22 nt, Human
gcccagcacuccucucugacau

SEQ ID NO: 7867 - RNA, 22 nt, Human
gcccagcagcugguggagaagg

SEQ ID NO: 7868 - RNA, 22 nt, Human
gcccagcaggacagagugguuu

SEQ ID NO: 7869 - RNA, 22 nt, Human
gcccagccagagcugugugaug

SEQ ID NO: 7870 - RNA, 22 nt, Human
gcccagcugagaagcgcggggc

SEQ ID NO: 7871 - RNA, 22 nt, Human
gcccaggaaagauagggccuca

SEQ ID NO: 7872 - RNA, 22 nt, Human
gcccaggaaauaaaagugggcu

SEQ ID NO: 7873 - RNA, 22 nt, Human
gcccaggaaguugaggcugccg

SEQ ID NO: 7874 - RNA, 20 nt, Human
gcccaggaauuugcauuucu

SEQ ID NO: 7875 - RNA, 22 nt, Human
gcccaggacucagggugucgcg

SEQ ID NO: 7876 - RNA, 22 nt, Human
gcccaggaggucaaguagcuau

SEQ ID NO: 7877 - RNA, 22 nt, Human
gcccaggaguucaaggcugcag

SEQ ID NO: 7878 - RNA, 22 nt, Human
gcccaggaguucaagucuagug

SEQ ID NO: 7879 - RNA, 22 nt, Human
gcccaggaguugguggcugcag

SEQ ID NO: 7880 - RNA, 22 nt, Human
gcccaggaguuugcauuuuaac

SEQ ID NO: 7881 - RNA, 22 nt, Human
gcccaggauggagaauaguggu

SEQ ID NO: 7882 - RNA, 22 nt, Human
gcccaggccggagagcagugcu

SEQ ID NO: 7883 - RNA, 22 nt, Human
gcccaggcuagcguagagugca

SEQ ID NO: 7884 - RNA, 22 nt, Human
gcccagggucuacaaaaauauu

SEQ ID NO: 7885 - RNA, 22 nt, Human
gcccaggugcccucugccuuac

SEQ ID NO: 7886 - RNA, 22 nt, Human
gcccaucuucuagcagcuguua

SEQ ID NO: 7887 - RNA, 20 nt, Human
gcccaugaggacugcagcug

SEQ ID NO: 7888 - RNA, 22 nt, Human
gcccaugcacuuucugugaugg

SEQ ID NO: 7889 - RNA, 22 nt, Human
gcccauggacacccaagugcca

SEQ ID NO: 7890 - RNA, 22 nt, Human
gcccauggcagaacugugagca

SEQ ID NO: 7891 - RNA, 22 nt, Human
gccccaagggagcccagcacac

SEQ ID NO: 7892 - RNA, 22 nt, Human
gccccaccgagggugcaguccu

SEQ ID NO: 7893 - RNA, 22 nt, Human
gccccagccuaguuuucuuuca

SEQ ID NO: 7894 - RNA, 15 nt, Human
gccccaggaaucaaa

SEQ ID NO: 7895 - RNA, 22 nt, Human
gccccaggauaaauuuguaaga

SEQ ID NO: 7896 - RNA, 22 nt, Human
gcccccagaagggccacagauu

SEQ ID NO: 7897 - RNA, 22 nt, Human
gcccccucaaagaggaagcucu

SEQ ID NO: 7898 - RNA, 22 nt, Human
gccccuccgggcgcgucauagc

SEQ ID NO: 7899 - RNA, 22 nt, Human
gccccucucccuugaggcaggc

SEQ ID NO: 7900 - RNA, 22 nt, Human
gccccuguuguggcuuugucua

SEQ ID NO: 7901 - RNA, 22 nt, Human
gccccuucguggaagugcauuc

SEQ ID NO: 7902 - RNA, 22 nt, Human
gcccgugucuccugcucugugg

SEQ ID NO: 7903 - RNA, 21 nt, Human
gcccuaggcuaccuggagcgc

SEQ ID NO: 7904 - RNA, 22 nt, Human
gcccuagggggaaccgaggacu

SEQ ID NO: 7905 - RNA, 22 nt, Human
gcccuaucauucauugagugcu

SEQ ID NO: 7906 - RNA, 22 nt, Human
gcaggccuuggcaaugagccug

SEQ ID NO: 7907 - RNA, 22 nt, Human
gcaggcucaaaagcugguagga

SEQ ID NO: 7908 - RNA, 22 nt, Human
gcaggcucacucuguuuggcuc

SEQ ID NO: 7909 - RNA, 22 nt, Human
gcaggcuccaaggccugggaga

SEQ ID NO: 7910 - RNA, 22 nt, Human
gcaggcucguuggaaguccccu

SEQ ID NO: 7911 - RNA, 22 nt, Human
gcaggcugaguauuacccuagu

SEQ ID NO: 7912 - RNA, 22 nt, Human
gcaggcugccaccuucugaguu

SEQ ID NO: 7913 - RNA, 22 nt, Human
gcaggcuggaggcuguucuggg

SEQ ID NO: 7914 - RNA, 22 nt, Human
gcaggcuggucugaccaucccu

SEQ ID NO: 7915 - RNA, 22 nt, Human
gcaggcuugagagaucagaugg

SEQ ID NO: 7916 - RNA, 18 nt, Human
gcaggcuuuuccuggguc

SEQ ID NO: 7917 - RNA, 22 nt, Human
gcagggaagggaaacagagacc

SEQ ID NO: 7918 - RNA, 22 nt, Human
gcagggaaggggacggaaccag

SEQ ID NO: 7919 - RNA, 22 nt, Human
gcagggaaggggcaugcuggag

SEQ ID NO: 7920 - RNA, 21 nt, Human
gcagggacaaagcuucaggag

SEQ ID NO: 7921 - RNA, 22 nt, Human
gcagggacaucuucagaucacu

SEQ ID NO: 7922 - RNA, 22 nt, Human
gcagggaccaaaagaggcagua

SEQ ID NO: 7923 - RNA, 22 nt, Human
gcagggaccuugcccacccucc

SEQ ID NO: 7924 - RNA, 22 nt, Human
gcagggacugugaucucacaga

SEQ ID NO: 7925 - RNA, 22 nt, Human
gcagggacuuuggcaacaggug

SEQ ID NO: 7926 - RNA, 22 nt, Human
gcagggaggaagagaugcuucc

SEQ ID NO: 7927 - RNA, 22 nt, Human
gcagggcagcuuagucccuguc

SEQ ID NO: 7928 - RNA, 22 nt, Human
gcagggcagggcaagaacuggg

SEQ ID NO: 7929 - RNA, 22 nt, Human
gcagggcauagaggcacggagg

SEQ ID NO: 7930 - RNA, 22 nt, Human
gcagggcggcccagagcaggcc

SEQ ID NO: 7931 - RNA, 22 nt, Human
gcagggcuccccaggcccgagg

SEQ ID NO: 7932 - RNA, 19 nt, Human
gcagggcucucccagaugc

SEQ ID NO: 7933 - RNA, 18 nt, Human
gcagggcuggacaaguca

SEQ ID NO: 7934 - RNA, 22 nt, Human
gcagggcuggggcugcuccuga

SEQ ID NO: 7935 - RNA, 22 nt, Human
gcagggcugggugggagacaga

SEQ ID NO: 7936 - RNA, 22 nt, Human
gcagggcuuagaaaugguggcu

SEQ ID NO: 7937 - RNA, 22 nt, Human
gcaggggcuaaggacacagaga

SEQ ID NO: 7938 - RNA, 22 nt, Human
gcaggggcugagcaccagcggg

SEQ ID NO: 7939 - RNA, 22 nt, Human
gcagggguggaggcuguccugu

SEQ ID NO: 7940 - RNA, 22 nt, Human
gcaggguauaauacuuagguga

SEQ ID NO: 7941 - RNA, 22 nt, Human
gcagggucuugagaggcagcca

SEQ ID NO: 7942 - RNA, 22 nt, Human
gcagggugaaggucacauagaa

SEQ ID NO: 7943 - RNA, 22 nt, Human
gcagggugacguugcccaccuc

SEQ ID NO: 7944 - RNA, 22 nt, Human
gcagggugugucucauacaguu

SEQ ID NO: 7945 - RNA, 22 nt, Human
gcagguccagucaccagagaga

SEQ ID NO: 7946 - RNA, 22 nt, Human
gcaggucccagaaaguuaauuc

SEQ ID NO: 7947 - RNA, 22 nt, Human
gcaggugaaagugaguagugag

SEQ ID NO: 7948 - RNA, 22 nt, Human
gcaggugagggugucugaauag

SEQ ID NO: 7949 - RNA, 22 nt, Human
gcaggugaugugaugugagcau

SEQ ID NO: 7950 - RNA, 19 nt, Human
gcagguggauguggucagc

SEQ ID NO: 7951 - RNA, 22 nt, Human
gcagguggauuaucagaagugc

SEQ ID NO: 7952 - RNA, 22 nt, Human
gcagguggcagaggugggaucu

SEQ ID NO: 7953 - RNA, 22 nt, Human
gcccuguuuugaaacuugcaua

SEQ ID NO: 7954 - RNA, 22 nt, Human
gcccuuacaggguggucagcca

SEQ ID NO: 7955 - RNA, 22 nt, Human
gcccuuagggccacugucacug

SEQ ID NO: 7956 - RNA, 22 nt, Human
gcccuuauaaacaaggcuucag

SEQ ID NO: 7957 - RNA, 22 nt, Human
gcccuucauuuauaguuggaau

SEQ ID NO: 7958 - RNA, 22 nt, Human
gcccuuggaaagccaaggcagc

SEQ ID NO: 7959 - RNA, 22 nt, Human
gcccuugggagguuccacuggg

SEQ ID NO: 7960 - RNA, 22 nt, Human
gcccuuggggugucuguaauaa

SEQ ID NO: 7961 - RNA, 22 nt, Human
gcccuuucuucuucuggacugg

SEQ ID NO: 7962 - RNA, 22 nt, Human
gccgaagcugccgucugguccu

SEQ ID NO: 7963 - RNA, 22 nt, Human
gccgagcacagugcagcugccu

SEQ ID NO: 7964 - RNA, 22 nt, Human
gccggacugcugcagcugcuag

SEQ ID NO: 7965 - RNA, 22 nt, Human
gccguccuacgccaucauagcg

SEQ ID NO: 7966 - RNA, 22 nt, Human
gccgugggugucauggcccaua

SEQ ID NO: 7967 - RNA, 20 nt, Human
gccuaagagcuagcugucac

SEQ ID NO: 7968 - RNA, 22 nt, Human
gccuaauaacuagcuguguaac

SEQ ID NO: 7969 - RNA, 22 nt, Human
gccuaggagacaagcgugaaag

SEQ ID NO: 7970 - RNA, 22 nt, Human
gccuaggaucaaccacaugaaa

SEQ ID NO: 7971 - RNA, 22 nt, Human
gccuagggguaagaguacuggc

SEQ ID NO: 7972 - RNA, 20 nt, Human
gccuagggucacuucaguga

SEQ ID NO: 7973 - RNA, 19 nt, Human
gccuaugucuucaaaucau

SEQ ID NO: 7974 - RNA, 22 nt, Human
gccuauuuuauuaugcauguaa

SEQ ID NO: 7975 - RNA, 22 nt, Human
gccucacauauucaugguuacu

SEQ ID NO: 7976 - RNA, 22 nt, Human
gccucagcuguugcaggggccc

SEQ ID NO: 7977 - RNA, 22 nt, Human
gccucaggacuggcauacucau

SEQ ID NO: 7978 - RNA, 22 nt, Human
gccucaggccgcccugcugcuc

SEQ ID NO: 7979 - RNA, 22 nt, Human
gccucaggugcaucucucauuc

SEQ ID NO: 7980 - RNA, 22 nt, Human
gccucaguaaccuuaggggaua

SEQ ID NO: 7981 - RNA, 22 nt, Human
gccucaguguccuccuccaugu

SEQ ID NO: 7982 - RNA, 22 nt, Human
gccucaguuuauacaccuguaa

SEQ ID NO: 7983 - RNA, 18 nt, Human
gccucaguuuccucaccu

SEQ ID NO: 7984 - RNA, 18 nt, Human
gccuccaccauggagggu

SEQ ID NO: 7985 - RNA, 22 nt, Human
gccuccagcuggggcauuucag

SEQ ID NO: 7986 - RNA, 22 nt, Human
gccucccuguucuuccacaaua

SEQ ID NO: 7987 - RNA, 22 nt, Human
gccucccuuggugucucccggg

SEQ ID NO: 7988 - RNA, 22 nt, Human
gccuccucuugagggucaggga

SEQ ID NO: 7989 - RNA, 22 nt, Human
gccuccuguuaugccaugugcc

SEQ ID NO: 7990 - RNA, 22 nt, Human
gccucuagggcuguugggaauu

SEQ ID NO: 7991 - RNA, 22 nt, Human
gccucuccucuuaauaccauua

SEQ ID NO: 7992 - RNA, 22 nt, Human
gccucucugggcugccgaggcu

SEQ ID NO: 7993 - RNA, 22 nt, Human
gccucugcaacuccgccuuggu

SEQ ID NO: 7994 - RNA, 22 nt, Human
gccucugcugacaagauggaca

SEQ ID NO: 7995 - RNA, 22 nt, Human
gccucugcugcaagccugguug

SEQ ID NO: 7996 - RNA, 19 nt, Human
gccucugcuggggacaggc

SEQ ID NO: 7997 - RNA, 20 nt, Human
gccucuggagccaaggacca

SEQ ID NO: 7998 - RNA, 22 nt, Human
gccucugggcucugccccuggc

SEQ ID NO: 7999 - RNA, 22 nt, Human
gccucuggucccucaugcugug

SEQ ID NO: 8000 - RNA, 22 nt, Human
gccucuuguuuccuuacaugga

SEQ ID NO: 8001 - RNA, 22 nt, Human
gccugagacagugugguccaau

SEQ ID NO: 8002 - RNA, 22 nt, Human
gccugagagaacugaccaagag

SEQ ID NO: 8003 - RNA, 22 nt, Human
gccugagaguugaaguucagug

SEQ ID NO: 8004 - RNA, 22 nt, Human
gccugagaucagccaagccccu

SEQ ID NO: 8005 - RNA, 22 nt, Human
gccugagauucugcauuucuaa

SEQ ID NO: 8006 - RNA, 22 nt, Human
gccugagcagcuauacacacag

SEQ ID NO: 8007 - RNA, 21 nt, Human
gccugagcaugucuucagguc

SEQ ID NO: 8008 - RNA, 19 nt, Human
gccugagccagccaugcaa

SEQ ID NO: 8009 - RNA, 20 nt, Human
gccugagcuccgccuccugu

SEQ ID NO: 8010 - RNA, 22 nt, Human
gccugaggaaugcuccugacuu

SEQ ID NO: 8011 - RNA, 20 nt, Human
gccugauggacauuucaguu

SEQ ID NO: 8012 - RNA, 19 nt, Human
gccugcagaaaaggcaggg

SEQ ID NO: 8013 - RNA, 22 nt, Human
gccugcagacguguuuuccuca

SEQ ID NO: 8014 - RNA, 22 nt, Human
gccugcagauauauaggauggu

SEQ ID NO: 8015 - RNA, 22 nt, Human
gccugcagccucaagggcugag

SEQ ID NO: 8016 - RNA, 18 nt, Human
gccugcaggcacgggggu

SEQ ID NO: 8017 - RNA, 22 nt, Human
gccugcagggcccuuguggguc

SEQ ID NO: 8018 - RNA, 20 nt, Human
gccugcagguuggaugggau

SEQ ID NO: 8019 - RNA, 21 nt, Human
gccugcaguuuugaagcccuu

SEQ ID NO: 8020 - RNA, 22 nt, Human
gccugccacgcaugcagaguca

SEQ ID NO: 8021 - RNA, 19 nt, Human
gccugccagauaguaauga

SEQ ID NO: 8022 - RNA, 22 nt, Human
gccugccaguguuugaggauug

SEQ ID NO: 8023 - RNA, 22 nt, Human
gccugcccacggggcuggcaua

SEQ ID NO: 8024 - RNA, 18 nt, Human
gccugccuagagcuugcc

SEQ ID NO: 8025 - RNA, 22 nt, Human
gcauagaagguuuugguaucaa

SEQ ID NO: 8026 - RNA, 22 nt, Human
gcauagaauuuagagacaaaag

SEQ ID NO: 8027 - RNA, 22 nt, Human
gcauagcuuugaugcugccuua

SEQ ID NO: 8028 - RNA, 19 nt, Human
gcaucaaagcugacuccug

SEQ ID NO: 8029 - RNA, 22 nt, Human
gcaucaagacgaugugaaaucg

SEQ ID NO: 8030 - RNA, 17 nt, Human
gcaucacagauaacacg

SEQ ID NO: 8031 - RNA, 22 nt, Human
gcauccaaauguuucauuucuu

SEQ ID NO: 8032 - RNA, 22 nt, Human
gcauccaggcugccccucugcg

SEQ ID NO: 8033 - RNA, 20 nt, Human
gcauccauauaugcaugugu

SEQ ID NO: 8034 - RNA, 22 nt, Human
gcauccaucagcagauugacug

SEQ ID NO: 8035 - RNA, 22 nt, Human
gcaucuaaauaaacgugggagu

SEQ ID NO: 8036 - RNA, 22 nt, Human
gcaucucuuuagaaucagaugg

SEQ ID NO: 8037 - RNA, 22 nt, Human
gcaucugauccaauagauauau

SEQ ID NO: 8038 - RNA, 22 nt, Human
gcaucuucacacaaagccagug

SEQ ID NO: 8039 - RNA, 22 nt, Human
gcaugauuaauaugcuuacugu

SEQ ID NO: 8040 - RNA, 22 nt, Human
gcaugcaaaaaauguauuuguu

SEQ ID NO: 8041 - RNA, 23 nt, Human
gcaugcaaagaauauagguguuc

SEQ ID NO: 8042 - RNA, 23 nt, Human
gcaugcaacuugcaguaguauuc

SEQ ID NO: 8043 - RNA, 22 nt, Human
gcaugcaaggaccaagggagca

SEQ ID NO: 8044 - RNA, 22 nt, Human
gcaugcaauuaugguauuagau

SEQ ID NO: 8045 - RNA, 22 nt, Human
gcaugcagacagucugagacca

SEQ ID NO: 8046 - RNA, 22 nt, Human
gcaugcagagaauaccugugau

SEQ ID NO: 8047 - RNA, 22 nt, Human
gcaugcaguaaaauucagcaac

SEQ ID NO: 8048 - RNA, 22 nt, Human
gcaugcauuuucugagagucag

SEQ ID NO: 8049 - RNA, 22 nt, Human
gcaugcuacagcccaacuguga

SEQ ID NO: 8050 - RNA, 22 nt, Human
gcaugcugagcccacgccuggg

SEQ ID NO: 8051 - RNA, 22 nt, Human
gcauggcaagacccugucucua

SEQ ID NO: 8052 - RNA, 22 nt, Human
gcauggcagccaguacauggug

SEQ ID NO: 8053 - RNA, 21 nt, Human
gcauggcaggucacuggggca

SEQ ID NO: 8054 - RNA, 22 nt, Human
gcauggcagugaggauggugcu

SEQ ID NO: 8055 - RNA, 22 nt, Human
gcauggcauuugaagguagaag

SEQ ID NO: 8056 - RNA, 22 nt, Human
gcauggcuccugucuuacuccc

SEQ ID NO: 8057 - RNA, 22 nt, Human
gcauggcugcucccuggcugca

SEQ ID NO: 8058 - RNA, 22 nt, Human
gcauggcugguguccugaggga

SEQ ID NO: 8059 - RNA, 22 nt, Human
gcauggcuguugaagucagcuc

SEQ ID NO: 8060 - RNA, 22 nt, Human
gcauggcuuacagaggcugcag

SEQ ID NO: 8061 - RNA, 22 nt, Human
gcauggcuuccaaaagugcuaa

SEQ ID NO: 8062 - RNA, 22 nt, Human
gcauggcuucugccaggcaccu

SEQ ID NO: 8063 - RNA, 22 nt, Human
guugccuucuaugauucucagu

SEQ ID NO: 8064 - RNA, 22 nt, Human
guugcugaaauuaauauuggag

SEQ ID NO: 8065 - RNA, 22 nt, Human
guugcugauggcaagauuccag

SEQ ID NO: 8066 - RNA, 22 nt, Human
guugcugcaaaggaguguaggu

SEQ ID NO: 8067 - RNA, 22 nt, Human
guugcuuuuuugauagguggaa

SEQ ID NO: 8068 - RNA, 22 nt, Human
guuggagugcagcuugugcgau

SEQ ID NO: 8069 - RNA, 22 nt, Human
guuggcacuuagccccagucua

SEQ ID NO: 8070 - RNA, 22 nt, Human
guuggcagagagaagccuagca

SEQ ID NO: 8071 - RNA, 22 nt, Human
guugggcugaagugugugcuua

SEQ ID NO: 8072 - RNA, 22 nt, Human
guugggcugggagcugcccuga

SEQ ID NO: 8073 - RNA, 22 nt, Human
guuggggaaggugggagaaugu

SEQ ID NO: 8074 - RNA, 22 nt, Human
guuggucauaucauugaagcuu

SEQ ID NO: 8075 - RNA, 22 nt, Human
guugguuaggucaggauucaga

SEQ ID NO: 8076 - RNA, 22 nt, Human
guuguaaauacaguacugaaac

SEQ ID NO: 8077 - RNA, 19 nt, Human
guuguaaauggagguuucu

SEQ ID NO: 8078 - RNA, 22 nt, Human
guuguaaguuuaaugucaauug

SEQ ID NO: 8079 - RNA, 23 nt, Human
guuguaauggauaaugcaaauug

SEQ ID NO: 8080 - RNA, 22 nt, Human
guuguacaaaauaucagugagg

SEQ ID NO: 8081 - RNA, 22 nt, Human
guuguacauaugaggauaaguu

SEQ ID NO: 8082 - RNA, 22 nt, Human
guugugcagaagugccucagua

SEQ ID NO: 8083 - RNA, 22 nt, Human
guugugcagggcgaggaccuga

SEQ ID NO: 8084 - RNA, 22 nt, Human
guuguugaugaagaucugacug

SEQ ID NO: 8085 - RNA, 22 nt, Human
guuguuuauaaaaauaucuagc

SEQ ID NO: 8086 - RNA, 22 nt, Human
guuguuuuaaaauacuccagaa

SEQ ID NO: 8087 - RNA, 22 nt, Human
guuguuuuauaggcucaugccu

SEQ ID NO: 8088 - RNA, 22 nt, Human
guuguuuucacaaacccaugau

SEQ ID NO: 8089 - RNA, 19 nt, Human
guuguuuuucuuauuaugg

SEQ ID NO: 8090 - RNA, 22 nt, Human
guuguuuuugaacggugguggc

SEQ ID NO: 8091 - RNA, 22 nt, Human
guuguuuuuguucucuauagcu

SEQ ID NO: 8092 - RNA, 22 nt, Human
guuuaaagucuuggaaggagga

SEQ ID NO: 8093 - RNA, 22 nt, Human
guuuaaauaauuaggggccugu

SEQ ID NO: 8094 - RNA, 22 nt, Human
guuuaaccaagagcauugugca

SEQ ID NO: 8095 - RNA, 22 nt, Human
guuuaagaggguuucauuccca

SEQ ID NO: 8096 - RNA, 22 nt, Human
guuuaauaauguugaauuacua

SEQ ID NO: 8097 - RNA, 22 nt, Human
guuuacaacaucuuguccuuca

SEQ ID NO: 8098 - RNA, 22 nt, Human
guuuacauaugucugucugcac

SEQ ID NO: 8099 - RNA, 22 nt, Human
guuuacauauuuuaauugguga

SEQ ID NO: 8100 - RNA, 22 nt, Human
guuuacugcucuagguugcaca

SEQ ID NO: 8101 - RNA, 22 nt, Human
guuuacuguuuucugauaagug

SEQ ID NO: 8102 - RNA, 22 nt, Human
guuuacuuagaugcucaugcag

SEQ ID NO: 8103 - RNA, 22 nt, Human
guuuagaaaauagugaagcaag

SEQ ID NO: 8104 - RNA, 22 nt, Human
guuuagaacacggaaauacuga

SEQ ID NO: 8105 - RNA, 21 nt, Human
guuuagaaguagucuggcuca

SEQ ID NO: 8106 - RNA, 22 nt, Human
guuuagaaugaaacuuuugagc

SEQ ID NO: 8107 - RNA, 22 nt, Human
guuuagaauucuaacuuuaagg

SEQ ID NO: 8108 - RNA, 22 nt, Human
guuuagacuccuuggucuucug

SEQ ID NO: 8109 - RNA, 22 nt, Human
guuuagcaauaaaaacacauga

SEQ ID NO: 8110 - RNA, 20 nt, Human
guuuagcauggcagugaaag

SEQ ID NO: 8111 - RNA, 22 nt, Human
guuuaguguuucaagacucuuu

SEQ ID NO: 8112 - RNA, 22 nt, Human
guuuauaaggcccaauauuucu

SEQ ID NO: 8113 - RNA, 22 nt, Human
guuuauaagguaaaggagagag

SEQ ID NO: 8114 - RNA, 22 nt, Human
guuuauaugugugccacucuua

SEQ ID NO: 8115 - RNA, 22 nt, Human
guuuaucugcacucucuuguag

SEQ ID NO: 8116 - RNA, 22 nt, Human
guuuaugaaauuucaggcauuu

SEQ ID NO: 8117 - RNA, 22 nt, Human
guuuaugaauguuacuauagag

SEQ ID NO: 8118 - RNA, 22 nt, Human
guuuaugaguuacguagggguu

SEQ ID NO: 8119 - RNA, 22 nt, Human
guuuauuagaguuuucugucug

SEQ ID NO: 8120 - RNA, 22 nt, Human
guuuauuccagcaaucugcuua

SEQ ID NO: 8121 - RNA, 22 nt, Human
guuuauugauaaaagcuggaca

SEQ ID NO: 8122 - RNA, 22 nt, Human
guuucaaagcacagcucacauu

SEQ ID NO: 8123 - RNA, 22 nt, Human
guuucaaaggugucaggcaguu

SEQ ID NO: 8124 - RNA, 22 nt, Human
guuucaaguagcugcugauuau

SEQ ID NO: 8125 - RNA, 22 nt, Human
guuucaauuucacuuuccaggc

SEQ ID NO: 8126 - RNA, 22 nt, Human
guuucacaagcaacggguaagg

SEQ ID NO: 8127 - RNA, 22 nt, Human
guuucacauaauuuuaaauugu

SEQ ID NO: 8128 - RNA, 22 nt, Human
guuucagaacaccccauuuggg

SEQ ID NO: 8129 - RNA, 22 nt, Human
guuucauaggcaugugaccuau

SEQ ID NO: 8130 - RNA, 22 nt, Human
guuucauauauaguaacugaaa

SEQ ID NO: 8131 - RNA, 22 nt, Human
guuucaugacugauguuguuga

SEQ ID NO: 8132 - RNA, 18 nt, Human
guuucaugcaugugaaac

SEQ ID NO: 8133 - RNA, 19 nt, Human
guuucauuaagauaggaaa

SEQ ID NO: 8134 - RNA, 22 nt, Human
guuucauucggcagcucauaag

SEQ ID NO: 8135 - RNA, 22 nt, Human
guuucauuuacaucuguaggua

SEQ ID NO: 8136 - RNA, 20 nt, Human
guuuccaaauugugcauuuu

SEQ ID NO: 8137 - RNA, 22 nt, Human
guuuccacgucucaguuccaaa

SEQ ID NO: 8138 - RNA, 22 nt, Human
guuuccagcucuuagcaaaggc

SEQ ID NO: 8139 - RNA, 22 nt, Human
guuuccaggcuuugguaugguu

SEQ ID NO: 8140 - RNA, 22 nt, Human
guuuccaugcaguagagcuuag

SEQ ID NO: 8141 - RNA, 22 nt, Human
guuuccauggaagcaaaggugg

SEQ ID NO: 8142 - RNA, 22 nt, Human
guuuccauggcucuguuaaugg

SEQ ID NO: 8143 - RNA, 22 nt, Human
guuuccaugggagaagacagug

SEQ ID NO: 8144 - RNA, 22 nt, Human
guuuccaugguguuucuugggu

SEQ ID NO: 8145 - RNA, 22 nt, Human
guuucccaaauuguucacaggg

SEQ ID NO: 8146 - RNA, 22 nt, Human
guuucccauaucuagggagagg

SEQ ID NO: 8147 - RNA, 22 nt, Human
guuuccuauaacucaggcacca

SEQ ID NO: 8148 - RNA, 22 nt, Human
guuuccugacccuggcccagca

SEQ ID NO: 8149 - RNA, 22 nt, Human
guuuccugcgugugccacucau

SEQ ID NO: 8150 - RNA, 22 nt, Human
guuuccuggaaacauuaggaga

SEQ ID NO: 8151 - RNA, 22 nt, Human
guuuccuguggccacagaauaa

SEQ ID NO: 8152 - RNA, 19 nt, Human
guuuccuuggguguaggga

SEQ ID NO: 8153 - RNA, 22 nt, Human
guuuccuuuuucugcccucaau

SEQ ID NO: 8154 - RNA, 22 nt, Human
guuucgucaggcuuauucuauc

SEQ ID NO: 8155 - RNA, 22 nt, Human
guuucuaauuggaacuuugagg

SEQ ID NO: 8156 - RNA, 22 nt, Human
guuucuacaugccucuuucacc

SEQ ID NO: 8157 - RNA, 22 nt, Human
guuucucuuaacacauaaagua

SEQ ID NO: 8158 - RNA, 22 nt, Human
gcuccuggccagcacagggccc

SEQ ID NO: 8159 - RNA, 22 nt, Human
gcuccuggcuccaggcagccaa

SEQ ID NO: 8160 - RNA, 22 nt, Human
gcuccuggcucucugagggcug

SEQ ID NO: 8161 - RNA, 22 nt, Human
gcuccuggcucuggccaaggga

SEQ ID NO: 8162 - RNA, 22 nt, Human
gcuccuggguguggcugccccu

SEQ ID NO: 8163 - RNA, 22 nt, Human
gcuccuggugcaaaguuucuuc

SEQ ID NO: 8164 - RNA, 18 nt, Human
gcuccugguuggaaagaa

SEQ ID NO: 8165 - RNA, 22 nt, Human
gcuccugucagucaucaggugc

SEQ ID NO: 8166 - RNA, 22 nt, Human
gcuccuguccuuagccccagag

SEQ ID NO: 8167 - RNA, 22 nt, Human
gcuccugugaaggcauuaggug

SEQ ID NO: 8168 - RNA, 22 nt, Human
gcucgcuuagauuuuccucuga

SEQ ID NO: 8169 - RNA, 22 nt, Human
gcucggagucccaccugggaaa

SEQ ID NO: 8170 - RNA, 22 nt, Human
gcucgguggccagccugaggcc

SEQ ID NO: 8171 - RNA, 22 nt, Human
gcucguugaaccuguccccgag

SEQ ID NO: 8172 - RNA, 22 nt, Human
gcuaggaguggugggucaagga

SEQ ID NO: 8173 - RNA, 22 nt, Human
gcuaggcuucaaaaucucccug

SEQ ID NO: 8174 - RNA, 22 nt, Human
gcuagggacuagggaaggagca

SEQ ID NO: 8175 - RNA, 22 nt, Human
gcuaggugcagcagacagcuua

SEQ ID NO: 8176 - RNA, 22 nt, Human
gcuaguccacagccauccaggc

SEQ ID NO: 8177 - RNA, 22 nt, Human
gcuaguuucuugaauacucuaa

SEQ ID NO: 8178 - RNA, 22 nt, Human
gcuauacacauuucuugguagu

SEQ ID NO: 8179 - RNA, 22 nt, Human
gcuauacagcaggagaauggaa

SEQ ID NO: 8180 - RNA, 22 nt, Human
gcuauaggaagaaauuuguuuu

SEQ ID NO: 8181 - RNA, 22 nt, Human
gcuauaggguacauuuguguuu

SEQ ID NO: 8182 - RNA, 23 nt, Human
gcuauagguagaaggaaucuuuu

SEQ ID NO: 8183 - RNA, 22 nt, Human
gcuaucucuuuaguacuagauu

SEQ ID NO: 8184 - RNA, 22 nt, Human
gcuaucuucauggaaauacagg

SEQ ID NO: 8185 - RNA, 21 nt, Human
gcuaugaauguagaaaauuau

SEQ ID NO: 8186 - RNA, 22 nt, Human
gcuauguguguuuugcugcagc

SEQ ID NO: 8187 - RNA, 22 nt, Human
gcuauuuagugagucacauccu

SEQ ID NO: 8188 - RNA, 22 nt, Human
gcucacaggcaguguugggaga

SEQ ID NO: 8189 - RNA, 22 nt, Human
gcucacaggggcagacgaguug

SEQ ID NO: 8190 - RNA, 22 nt, Human
gcucacaguacagugcuggcuc

SEQ ID NO: 8191 - RNA, 22 nt, Human
gcucacagucugcugagugcag

SEQ ID NO: 8192 - RNA, 22 nt, Human
gcucacagucuggcauagucuc

SEQ ID NO: 8193 - RNA, 22 nt, Human
gcucagaaaagugaggcucagu

SEQ ID NO: 8194 - RNA, 22 nt, Human
gcucagaaauggcagauggaga

SEQ ID NO: 8195 - RNA, 22 nt, Human
gcucagaccccacccuggcaga

SEQ ID NO: 8196 - RNA, 22 nt, Human
gcucagagaaauuauaggaauu

SEQ ID NO: 8197 - RNA, 22 nt, Human
gcucagagaauuuacugcugcc

SEQ ID NO: 8198 - RNA, 22 nt, Human
gcucagagagaggauauguuau

SEQ ID NO: 8199 - RNA, 21 nt, Human
gcucagagaggguaauuaacc

SEQ ID NO: 8200 - RNA, 22 nt, Human
gcucagagauggggaaugaaaa

SEQ ID NO: 8201 - RNA, 22 nt, Human
gcucagagaugucugcugccuu

SEQ ID NO: 8202 - RNA, 22 nt, Human
gcucagagcagaugguacucag

SEQ ID NO: 8203 - RNA, 19 nt, Human
gcucagagccaugggggcu

SEQ ID NO: 8204 - RNA, 22 nt, Human
gcucagagcuugaaguuccacu

SEQ ID NO: 8205 - RNA, 22 nt, Human
gcucagaggaugcuccuuuaug

SEQ ID NO: 8206 - RNA, 19 nt, Human
gcucagagggcccugugcu

SEQ ID NO: 8207 - RNA, 21 nt, Human
gcucagcaaaggugaggugca

SEQ ID NO: 8208 - RNA, 19 nt, Human
gcucagcagacccagugcu

SEQ ID NO: 8209 - RNA, 22 nt, Human
gcucagccgaacuucagagcag

SEQ ID NO: 8210 - RNA, 22 nt, Human
gcucagcugagcgaaggacaug

SEQ ID NO: 8211 - RNA, 22 nt, Human
gcucagcugcaccuggagagcc

SEQ ID NO: 8212 - RNA, 22 nt, Human
gcucagcuugggagcgcccggu

SEQ ID NO: 8213 - RNA, 22 nt, Human
gcucaggaaaacagucuaguaa

SEQ ID NO: 8214 - RNA, 22 nt, Human
gcucaggaaauaguuuaguguu

SEQ ID NO: 8215 - RNA, 22 nt, Human
gcucaggacccaggugugaccu

SEQ ID NO: 8216 - RNA, 22 nt, Human
gcucaggagcugacagccucaa

SEQ ID NO: 8217 - RNA, 22 nt, Human
gcucaggaucccaggggugugc

SEQ ID NO: 8218 - RNA, 22 nt, Human
gcucaggauuucauccaugugu

SEQ ID NO: 8219 - RNA, 22 nt, Human
gcucaggcaaauuucuggugaa

SEQ ID NO: 8220 - RNA, 22 nt, Human
gcucaggccuccagaggggcaa

SEQ ID NO: 8221 - RNA, 22 nt, Human
gcucaggcuggauugcaguggc

SEQ ID NO: 8222 - RNA, 19 nt, Human
gcucaggcugugugugggg

SEQ ID NO: 8223 - RNA, 22 nt, Human
gcucagggcgcgagggacgugg

SEQ ID NO: 8224 - RNA, 22 nt, Human
gcucagggcuaaggcugagggg

SEQ ID NO: 8225 - RNA, 22 nt, Human
gcucagggugcaguguccauga

SEQ ID NO: 8226 - RNA, 22 nt, Human
gcucaggucuuacccaugccug

SEQ ID NO: 8227 - RNA, 19 nt, Human
gcucagucuccugauugcu

SEQ ID NO: 8228 - RNA, 22 nt, Human
gcucagugagauauugacucca

SEQ ID NO: 8229 - RNA, 19 nt, Human
gcucagugaugccagacca

SEQ ID NO: 8230 - RNA, 22 nt, Human
gcucagugcaucauuccaggcu

SEQ ID NO: 8231 - RNA, 22 nt, Human
gcucaguguucaucuguaugca

SEQ ID NO: 8232 - RNA, 23 nt, Human
gcucaucaggcuuagagucaagg

SEQ ID NO: 8233 - RNA, 22 nt, Human
gcucauccagcaagccagggcc

SEQ ID NO: 8234 - RNA, 22 nt, Human
gcucaugggcccagagcagccc

SEQ ID NO: 8235 - RNA, 22 nt, Human
gcucaugugugauuacaguuuu

SEQ ID NO: 8236 - RNA, 20 nt, Human
gcuccaagccccuuuagagg

SEQ ID NO: 8237 - RNA, 22 nt, Human
gcuccacuaggaaucugcucuu

SEQ ID NO: 8238 - RNA, 22 nt, Human
gcuccacugccccugggcaccg

SEQ ID NO: 8239 - RNA, 22 nt, Human
gcuccacuuccuucugcccuca

SEQ ID NO: 8240 - RNA, 22 nt, Human
gcuccagagcagagacuagguu

SEQ ID NO: 8241 - RNA, 22 nt, Human
gcuccaggcgagcuggaccaga

SEQ ID NO: 8242 - RNA, 22 nt, Human
gcuccagggacccaagagaaaa

SEQ ID NO: 8243 - RNA, 22 nt, Human
gcuccagguauuugcccuuuua

SEQ ID NO: 8244 - RNA, 22 nt, Human
gcucccaacucaggccuccucc

SEQ ID NO: 8245 - RNA, 22 nt, Human
gcucccaccuccagccugaguu

SEQ ID NO: 8246 - RNA, 22 nt, Human
gcucccacgcaauucuuuucag

SEQ ID NO: 8247 - RNA, 22 nt, Human
gcucccacugcagcccugagcc

SEQ ID NO: 8248 - RNA, 22 nt, Human
gcucccagauuucagccuugug

SEQ ID NO: 8249 - RNA, 22 nt, Human
gcucccagcaauugaggcagcc

SEQ ID NO: 8250 - RNA, 22 nt, Human
gcucccagcauugcuucccagg

SEQ ID NO: 8251 - RNA, 22 nt, Human
gcucccagggcagcgcagaaga

SEQ ID NO: 8252 - RNA, 22 nt, Human
gcucccagucugauggaggaga

SEQ ID NO: 8253 - RNA, 22 nt, Human
gcuccccaggcugguccccucg

SEQ ID NO: 8254 - RNA, 22 nt, Human
gcucccugcauuucccacccuu

SEQ ID NO: 8255 - RNA, 22 nt, Human
gcuccucuccucggagucgggg

SEQ ID NO: 8256 - RNA, 22 nt, Human
gcuccugcaggacccaggagac

SEQ ID NO: 8257 - RNA, 22 nt, Human
gcuccuggcaggcagugugugu

SEQ ID NO: 8258 - RNA, 22 nt, Human
gcuccugggcccugggcuaacu

SEQ ID NO: 8259 - RNA, 22 nt, Human
gcuccugggcucuaccuugcua

SEQ ID NO: 8260 - RNA, 21 nt, Human
gcuccuggugcugcguggcgc

SEQ ID NO: 8261 - RNA, 22 nt, Human
gcuccuggugcuguagagauuu

SEQ ID NO: 8262 - RNA, 22 nt, Human
gcuccuguaauuuuuaaaaguc

SEQ ID NO: 8263 - RNA, 22 nt, Human
gcuccugugcaggucucgguug

SEQ ID NO: 8264 - RNA, 22 nt, Human
gcuccuguuuguuuguuccuga

SEQ ID NO: 8265 - RNA, 22 nt, Human
gcuccuguuuucuuccagaaau

SEQ ID NO: 8266 - RNA, 22 nt, Human
gcuccuucaggugguagcuguu

SEQ ID NO: 8267 - RNA, 22 nt, Human
gcuccuucuggcucccuuuugg

SEQ ID NO: 8268 - RNA, 22 nt, Human
gcucgcagaucaccugggggcg

SEQ ID NO: 8269 - RNA, 22 nt, Human
gcucgcgccgcaccgguccacc

SEQ ID NO: 8270 - RNA, 22 nt, Human
gcucguacaccagcguggaggu

SEQ ID NO: 8271 - RNA, 19 nt, Human
gcucuaaaagauuuugaag

SEQ ID NO: 8272 - RNA, 22 nt, Human
gcucuaaagaacccagaggagu

SEQ ID NO: 8273 - RNA, 20 nt, Human
gcucuaaagccacagauuga

SEQ ID NO: 8274 - RNA, 22 nt, Human
gcucuaauugaaaaauacugca

SEQ ID NO: 8275 - RNA, 22 nt, Human
gcucuagguuccuagccaaguc

SEQ ID NO: 8276 - RNA, 22 nt, Human
gcugagcagguuugaugcuuuu

SEQ ID NO: 8277 - RNA, 22 nt, Human
gcugagccccccugcguggguc

SEQ ID NO: 8278 - RNA, 22 nt, Human
gcugagcucccagcaguaucug

SEQ ID NO: 8279 - RNA, 22 nt, Human
gcugagcugggacaguccuggg

SEQ ID NO: 8280 - RNA, 22 nt, Human
gcugaggaagucagguggccca

SEQ ID NO: 8281 - RNA, 22 nt, Human
ggcuggcagaggggagucugug

SEQ ID NO: 8282 - RNA, 22 nt, Human
ggcuggcagcuucaucccagau

SEQ ID NO: 8283 - RNA, 22 nt, Human
ggcuggcauccagggaaaucca

SEQ ID NO: 8284 - RNA, 22 nt, Human
ggcuggcauuuacacaaugcau

SEQ ID NO: 8285 - RNA, 22 nt, Human
ggcuggccagggcccucgcugg

SEQ ID NO: 8286 - RNA, 22 nt, Human
ggcuggccuguguggccgccac

SEQ ID NO: 8287 - RNA, 22 nt, Human
ggcuggcgcucucccagcgcug

SEQ ID NO: 8288 - RNA, 22 nt, Human
ggcuggcuacauuggaggaagg

SEQ ID NO: 8289 - RNA, 22 nt, Human
ggcuggcuggcugguagacaag

SEQ ID NO: 8290 - RNA, 22 nt, Human
ggcuggcuggcuuagcagagga

SEQ ID NO: 8291 - RNA, 22 nt, Human
ggcuggcuugccaagcucaggg

SEQ ID NO: 8292 - RNA, 22 nt, Human
ggcuggcuuggugagcugucac

SEQ ID NO: 8293 - RNA, 22 nt, Human
ggcugggagccccacagaguca

SEQ ID NO: 8294 - RNA, 22 nt, Human
ggcugggagcuggacaggccgg

SEQ ID NO: 8295 - RNA, 22 nt, Human
ggcugggcauccauccaugaga

SEQ ID NO: 8296 - RNA, 22 nt, Human
ggcugggccagggccuguggac

SEQ ID NO: 8297 - RNA, 22 nt, Human
ggcugggcucgcugauuggcug

SEQ ID NO: 8298 - RNA, 22 nt, Human
ggcuggucaggaaacuaggcuc

SEQ ID NO: 8299 - RNA, 22 nt, Human
ggcuggucucagugcuggguuc

SEQ ID NO: 8300 - RNA, 22 nt, Human
ggcuggugaguucagagaaccc

SEQ ID NO: 8301 - RNA, 22 nt, Human
ggcugguguugagugccuguag

SEQ ID NO: 8302 - RNA, 21 nt, Human
ggcugguguuuagcugugaua

SEQ ID NO: 8303 - RNA, 22 nt, Human
ggcuguagguuggugcuggaca

SEQ ID NO: 8304 - RNA, 22 nt, Human
ggcuguagucagugacauggua

SEQ ID NO: 8305 - RNA, 22 nt, Human
ggcugucagggugagcuggcuu

SEQ ID NO: 8306 - RNA, 22 nt, Human
ggcuguccaccuaccaugccgg

SEQ ID NO: 8307 - RNA, 20 nt, Human
ggcugucccgcggcugccgg

SEQ ID NO: 8308 - RNA, 22 nt, Human
ggcugucucugugacugccacc

SEQ ID NO: 8309 - RNA, 22 nt, Human
ggcugugaacccuggcagugug

SEQ ID NO: 8310 - RNA, 22 nt, Human
ggcugugaaguagcaggggcag

SEQ ID NO: 8311 - RNA, 22 nt, Human
ggcugugcaccauccaccuccc

SEQ ID NO: 8312 - RNA, 17 nt, Human
ggcugugccaggugaga

SEQ ID NO: 8313 - RNA, 22 nt, Human
ggcugugcccucacauggggca

SEQ ID NO: 8314 - RNA, 20 nt, Human
ggcugugcccuuccguggcc

SEQ ID NO: 8315 - RNA, 18 nt, Human
ggcugugcguggaggcug

SEQ ID NO: 8316 - RNA, 22 nt, Human
ggcugugcugagggggaagccc

SEQ ID NO: 8317 - RNA, 22 nt, Human
ggcuguggucucaucuagccuu

SEQ ID NO: 8318 - RNA, 22 nt, Human
ggcuguggucugggugcucccc

SEQ ID NO: 8319 - RNA, 22 nt, Human
ggcuguguccuguaugauuauu

SEQ ID NO: 8320 - RNA, 22 nt, Human
ggcuguguuccaagugucagga

SEQ ID NO: 8321 - RNA, 22 nt, Human
ggcuguguuucuguuugacauu

SEQ ID NO: 8322 - RNA, 22 nt, Human
ggcuguugacagacauagguuu

SEQ ID NO: 8323 - RNA, 22 nt, Human
ggcuuaaaacuuugaaaguguu

SEQ ID NO: 8324 - RNA, 22 nt, Human
ggcuuaaaguuuucuagaauaa

SEQ ID NO: 8325 - RNA, 22 nt, Human
ggcuuaagaugguagcuuugag

SEQ ID NO: 8326 - RNA, 22 nt, Human
ggcuuagaaggcaaaugacuug

SEQ ID NO: 8327 - RNA, 20 nt, Human
ggcuuagacugaguucucac

SEQ ID NO: 8328 - RNA, 22 nt, Human
ggcuuauauauuuucacuugcc

SEQ ID NO: 8329 - RNA, 22 nt, Human
ggcuuauauugcucuauucaca

SEQ ID NO: 8330 - RNA, 22 nt, Human
ggcuucaccaggugcaugcaug

SEQ ID NO: 8331 - RNA, 22 nt, Human
ggcuucacucauaauuagguuc

SEQ ID NO: 8332 - RNA, 22 nt, Human
ggcuucagaggagaagagggug

SEQ ID NO: 8333 - RNA, 17 nt, Human
ggcuucagggagcuggg

SEQ ID NO: 8334 - RNA, 22 nt, Human
ggcuucaggggcccagucagca

SEQ ID NO: 8335 - RNA, 22 nt, Human
ggcuuccagcugggccuuggag

SEQ ID NO: 8336 - RNA, 22 nt, Human
ggcuuccagugaugccucuuug

SEQ ID NO: 8337 - RNA, 22 nt, Human
ggcuucccaggcgguccccaca

SEQ ID NO: 8338 - RNA, 22 nt, Human
ggcuuccccacaaagcacacaa

SEQ ID NO: 8339 - RNA, 20 nt, Human
ggcuuccccgccaucuuccg

SEQ ID NO: 8340 - RNA, 22 nt, Human
ggcuuccccuccagugcucugu

SEQ ID NO: 8341 - RNA, 22 nt, Human
ggcuuccuccuuccugcuguca

SEQ ID NO: 8342 - RNA, 22 nt, Human
ggcuucucagcacacuguccac

SEQ ID NO: 8343 - RNA, 22 nt, Human
ggcuucucucuucacauggcuu

SEQ ID NO: 8344 - RNA, 22 nt, Human
ggcuucugaaacuguauugaga

SEQ ID NO: 8345 - RNA, 22 nt, Human
ggcuucugaaaucucugugcgu

SEQ ID NO: 8346 - RNA, 22 nt, Human
ggcuucuuaaucaugagaguga

SEQ ID NO: 8347 - RNA, 23 nt, Human
ggcuucuugccugucuuggugcu

SEQ ID NO: 8348 - RNA, 22 nt, Human
ggcuucuugugugucaggcucu

SEQ ID NO: 8349 - RNA, 22 nt, Human
ggcuugaacucccaaucauuua

SEQ ID NO: 8350 - RNA, 22 nt, Human
ggcuugaagggaggaaagcagg

SEQ ID NO: 8351 - RNA, 22 nt, Human
ggcuugaauggauauaaucugu

SEQ ID NO: 8352 - RNA, 22 nt, Human
ggcuugagacccgggagccaga

SEQ ID NO: 8353 - RNA, 22 nt, Human
ggcuuggcagaggugggugcuu

SEQ ID NO: 8354 - RNA, 22 nt, Human
ggcuuguccuucugguugucuu

SEQ ID NO: 8355 - RNA, 22 nt, Human
ggcuuguugaaacacagauugu

SEQ ID NO: 8356 - RNA, 22 nt, Human
ggcuuuaaacacugaaauugca

SEQ ID NO: 8357 - RNA, 22 nt, Human
ggcuuuacuauaugguacauuu

SEQ ID NO: 8358 - RNA, 22 nt, Human
ggcuuuauauuguuugagcaga

SEQ ID NO: 8359 - RNA, 22 nt, Human
ggcuuuaugcacagcagauggu

SEQ ID NO: 8360 - RNA, 22 nt, Human
ggcuuucaacacaggcuuuccu

SEQ ID NO: 8361 - RNA, 22 nt, Human
ggcuuucuccuugccuuagucu

SEQ ID NO: 8362 - RNA, 22 nt, Human
ggcuuucugagucaaacacuga

SEQ ID NO: 8363 - RNA, 23 nt, Human
ggcuuugcucuggguucuagggu

SEQ ID NO: 8364 - RNA, 22 nt, Human
ggcuuugcuuuggcuguuucag

SEQ ID NO: 8365 - RNA, 22 nt, Human
ggcuuugggcccucaagucucc

SEQ ID NO: 8366 - RNA, 22 nt, Human
ggcuuuggggguguccaagaaa

SEQ ID NO: 8367 - RNA, 22 nt, Human
ggcuuugguagacacagauuga

SEQ ID NO: 8368 - RNA, 21 nt, Human
gggaaacucugcuuaacagag

SEQ ID NO: 8369 - RNA, 22 nt, Human
gggaaacugcaacucagagagg

SEQ ID NO: 8370 - RNA, 22 nt, Human
gggaaacuggggacugaaucug

SEQ ID NO: 8371 - RNA, 22 nt, Human
gggaaagaagaucuagauacug

SEQ ID NO: 8372 - RNA, 22 nt, Human
gggaaagaccuuccuggggugu

SEQ ID NO: 8373 - RNA, 22 nt, Human
gggaaauagagcuggaaccuug

SEQ ID NO: 8374 - RNA, 23 nt, Human
gggaaaucaaaagauauuucuuc

SEQ ID NO: 8375 - RNA, 22 nt, Human
gggaaauuguaacaagucuguu

SEQ ID NO: 8376 - RNA, 22 nt, Human
gggaaauuuuagguuugucucg

SEQ ID NO: 8377 - RNA, 22 nt, Human
gggaacuauuuuaagcacuuga

SEQ ID NO: 8378 - RNA, 22 nt, Human
gggaacuguguggugcucugau

SEQ ID NO: 8379 - RNA, 22 nt, Human
gggaagaagacauggugaaggc

SEQ ID NO: 8380 - RNA, 22 nt, Human
gggaagcagaucauaccagacc

SEQ ID NO: 8381 - RNA, 22 nt, Human
gggaaggacauucugggcucag

SEQ ID NO: 8382 - RNA, 22 nt, Human
gggaaggagguggcuugaagug

SEQ ID NO: 8383 - RNA, 22 nt, Human
gggaaggcaccaugguguucca

SEQ ID NO: 8384 - RNA, 22 nt, Human
gggaaggcagugucugguugaa

SEQ ID NO: 8385 - RNA, 22 nt, Human
gggaaggccgguccagucaggu

SEQ ID NO: 8386 - RNA, 22 nt, Human
gggaagguauuuagcugcugaa

SEQ ID NO: 8387 - RNA, 22 nt, Human
ggccaugccugugggugcaggc

SEQ ID NO: 8388 - RNA, 22 nt, Human
ggccauggaccccgagcugacc

SEQ ID NO: 8389 - RNA, 22 nt, Human
ggcccacacugacagcugagcu

SEQ ID NO: 8390 - RNA, 22 nt, Human
ggcccagaaaaaggcuuagaau

SEQ ID NO: 8391 - RNA, 22 nt, Human
ggcccagaauacaugaaguaua

SEQ ID NO: 8392 - RNA, 22 nt, Human
ggcccagagucugcaauggagu

SEQ ID NO: 8393 - RNA, 22 nt, Human
ggcccagcaucuugugaaguuu

SEQ ID NO: 8394 - RNA, 22 nt, Human
ggcccagcccgagucagccuuc

SEQ ID NO: 8395 - RNA, 22 nt, Human
ggcccagccuggcaacaaugac

SEQ ID NO: 8396 - RNA, 22 nt, Human
ggcccagcucuauugaauuaca

SEQ ID NO: 8397 - RNA, 22 nt, Human
ggcccagcuuucauuccuugcu

SEQ ID NO: 8398 - RNA, 22 nt, Human
ggcccaggcuggagugcggugg

SEQ ID NO: 8399 - RNA, 22 nt, Human
ggcccagguccagcgaguaccu

SEQ ID NO: 8400 - RNA, 22 nt, Human
ggcccagugucccggucguggc

SEQ ID NO: 8401 - RNA, 22 nt, Human
ggccccaaaugucaauaguacu

SEQ ID NO: 8402 - RNA, 21 nt, Human
ggccccagcccauggguucuc

SEQ ID NO: 8403 - RNA, 22 nt, Human
ggccccagccucaguccccuga

SEQ ID NO: 8404 - RNA, 22 nt, Human
ggccccaggaccuccacggucc

SEQ ID NO: 8405 - RNA, 22 nt, Human
ggccccagggaagaaggugguc

SEQ ID NO: 8406 - RNA, 22 nt, Human
ggccccagguagaagauauaga

SEQ ID NO: 8407 - RNA, 22 nt, Human
ggccccaguucacuccuggccg

SEQ ID NO: 8408 - RNA, 22 nt, Human
ggcccccaggguggguguagac

SEQ ID NO: 8409 - RNA, 22 nt, Human
ggccccucuuguggcacauacg

SEQ ID NO: 8410 - RNA, 22 nt, Human
ggccccuggcaccaggcugauu

SEQ ID NO: 8411 - RNA, 22 nt, Human
ggcccugagcacagcuccucuc

SEQ ID NO: 8412 - RNA, 22 nt, Human
ggcccugagcugaaguacugug

SEQ ID NO: 8413 - RNA, 22 nt, Human
ggcccugcugaagccgggucua

SEQ ID NO: 8414 - RNA, 19 nt, Human
ggcccuguaggaugugagu

SEQ ID NO: 8415 - RNA, 22 nt, Human
ggcccuguccccuucaguuuug

SEQ ID NO: 8416 - RNA, 22 nt, Human
ggcccuuccucuugugcuggca

SEQ ID NO: 8417 - RNA, 22 nt, Human
ggcccuuccugcucucuuagcu

SEQ ID NO: 8418 - RNA, 22 nt, Human
ggcccuugcagcaggcgcuggc

SEQ ID NO: 8419 - RNA, 20 nt, Human
ggccggggagcucuccaggg

SEQ ID NO: 8420 - RNA, 22 nt, Human
ggccuagccucuccugagagag

SEQ ID NO: 8421 - RNA, 22 nt, Human
ggccuaggaaggggauguaacu

SEQ ID NO: 8422 - RNA, 22 nt, Human
ggccucagaggaggugugaguc

SEQ ID NO: 8423 - RNA, 18 nt, Human
ggccucagccuggccgga

SEQ ID NO: 8424 - RNA, 20 nt, Human
ggccucaguguccuuguuug

SEQ ID NO: 8425 - RNA, 22 nt, Human
ggccucaguuucuucaacugua

SEQ ID NO: 8426 - RNA, 22 nt, Human
ggccuccuguuggcuaguguga

SEQ ID NO: 8427 - RNA, 22 nt, Human
ggccucgcggcuucugguggcu

SEQ ID NO: 8428 - RNA, 22 nt, Human
ggccucggcccacugcugcggu

SEQ ID NO: 8429 - RNA, 22 nt, Human
ggccucucagggcagagacccu

SEQ ID NO: 8430 - RNA, 22 nt, Human
ggccucucaugcccagagccaa

SEQ ID NO: 8431 - RNA, 22 nt, Human
ggccucugaggacagccuuggc

SEQ ID NO: 8432 - RNA, 22 nt, Human
ggccucugcccucacuccuguc

SEQ ID NO: 8433 - RNA, 22 nt, Human
ggccucugccucaucugggcac

SEQ ID NO: 8434 - RNA, 22 nt, Human
ggccucugcuuaugcugaugac

SEQ ID NO: 8435 - RNA, 22 nt, Human
ggccucuggcaggcaggcccuc

SEQ ID NO: 8436 - RNA, 23 nt, Human
ggccucuguguucugcccacaug

SEQ ID NO: 8437 - RNA, 22 nt, Human
ggccugaaauagcucugagguu

SEQ ID NO: 8438 - RNA, 22 nt, Human
ggccugacauuugcaucaacac

SEQ ID NO: 8439 - RNA, 21 nt, Human
ggccugagcaccuguccaccu

SEQ ID NO: 8440 - RNA, 22 nt, Human
ggccugagcucuggggaggcaa

SEQ ID NO: 8441 - RNA, 22 nt, Human
ggccugaggcaauagucagaca

SEQ ID NO: 8442 - RNA, 19 nt, Human
ggccugaggccacagaucc

SEQ ID NO: 8443 - RNA, 17 nt, Human
ggccugcaccuccugcu

SEQ ID NO: 8444 - RNA, 19 nt, Human
ggccugcccaaugucugcu

SEQ ID NO: 8445 - RNA, 22 nt, Human
ggccugcuaaccugaaacggag

SEQ ID NO: 8446 - RNA, 22 nt, Human
ggccugcuauuggugggcagac

SEQ ID NO: 8447 - RNA, 22 nt, Human
ggccugcucaaacagauuccug

SEQ ID NO: 8448 - RNA, 22 nt, Human
ggccugcugcugguuagauggg

SEQ ID NO: 8449 - RNA, 22 nt, Human
ggccugcuguguacugauguca

SEQ ID NO: 8450 - RNA, 22 nt, Human
ggccugcuucucugggcuuucu

SEQ ID NO: 8451 - RNA, 22 nt, Human
ggccuggaaggacagcgugaug

SEQ ID NO: 8452 - RNA, 22 nt, Human
ggccuggaaugcuuuccuacca

SEQ ID NO: 8453 - RNA, 22 nt, Human
ggccuggacaaaugcaccaagg

SEQ ID NO: 8454 - RNA, 22 nt, Human
ggccuggagaaggcccagggag

SEQ ID NO: 8455 - RNA, 22 nt, Human
ggccuggccuccagaugugggc

SEQ ID NO: 8456 - RNA, 22 nt, Human
ggccuggccucccuuccuagcg

SEQ ID NO: 8457 - RNA, 19 nt, Human
ggccuggcuaucccugcug

SEQ ID NO: 8458 - RNA, 22 nt, Human
ggccuggcucuugcccagccug

SEQ ID NO: 8459 - RNA, 22 nt, Human
ggccugggcccacugucaagag

SEQ ID NO: 8460 - RNA, 22 nt, Human
ggccugugcaagacagcacccc

SEQ ID NO: 8461 - RNA, 19 nt, Human
ggccugugcagagcccguc

SEQ ID NO: 8462 - RNA, 22 nt, Human
ggccugugcugucagcccuagu

SEQ ID NO: 8463 - RNA, 22 nt, Human
ggccugugggaggacagcuggg

SEQ ID NO: 8464 - RNA, 22 nt, Human
ggccugugucugugccuguccu

SEQ ID NO: 8465 - RNA, 22 nt, Human
ggccuuagcugucuuuccuuug

SEQ ID NO: 8466 - RNA, 22 nt, Human
ggccuuccagggaagacagggc

SEQ ID NO: 8467 - RNA, 22 nt, Human
ggccuuccauugcucuuuucua

SEQ ID NO: 8468 - RNA, 21 nt, Human
ggccuuccccugcagucuccg

SEQ ID NO: 8469 - RNA, 22 nt, Human
ggccuugagagccagugcaggc

SEQ ID NO: 8470 - RNA, 22 nt, Human
ggccuugaucucucuaacugcu

SEQ ID NO: 8471 - RNA, 22 nt, Human
ggccuugcagccacagaacaca

SEQ ID NO: 8472 - RNA, 22 nt, Human
ggccuugccucaauagcuccac

SEQ ID NO: 8473 - RNA, 22 nt, Human
ggccuuggaaagauacccagcu

SEQ ID NO: 8474 - RNA, 20 nt, Human
ggccuuggaauagcacagcu

SEQ ID NO: 8475 - RNA, 20 nt, Human
ggccuuggccucuuugcagc

SEQ ID NO: 8476 - RNA, 21 nt, Human
ggccuuggcgggggccgaauu

SEQ ID NO: 8477 - RNA, 22 nt, Human
ggccuugggauguggcugcagc

SEQ ID NO: 8478 - RNA, 17 nt, Human
ggccuuggggccucagu

SEQ ID NO: 8479 - RNA, 19 nt, Human
ggccuuggggucccaaagu

SEQ ID NO: 8480 - RNA, 20 nt, Human
ggccuuggguuucgccuguu

SEQ ID NO: 8481 - RNA, 22 nt, Human
ggccuugguaaauuggcauuug

SEQ ID NO: 8482 - RNA, 22 nt, Human
ggccuuggugccauggccaguu

SEQ ID NO: 8483 - RNA, 19 nt, Human
ggccuuucaccuggaugcu

SEQ ID NO: 8484 - RNA, 22 nt, Human
ggccuuuuguguccuugcccgu

SEQ ID NO: 8485 - RNA, 22 nt, Human
ggcgagggaaguuuacugugag

SEQ ID NO: 8486 - RNA, 22 nt, Human
ggcgccccauauaguucuuaau

SEQ ID NO: 8487 - RNA, 22 nt, Human
ggcgccgcacucggugcagccg

SEQ ID NO: 8488 - RNA, 22 nt, Human
ggcggcacgcaggcugcugucg

SEQ ID NO: 8489 - RNA, 22 nt, Human
ggcggccugugggucggccuca

SEQ ID NO: 8490 - RNA, 22 nt, Human
ggcggggguccaggagccugca

SEQ ID NO: 8491 - RNA, 22 nt, Human
ggcgguggcgugaagguggcug

SEQ ID NO: 8492 - RNA, 22 nt, Human
ggcuaaggaacgcaggcuucuc

SEQ ID NO: 8493 - RNA, 22 nt, Human
ggcuacagaggccgugagccug

SEQ ID NO: 8494 - RNA, 22 nt, Human
ggcuacagcgggguggagacgg

SEQ ID NO: 8495 - RNA, 22 nt, Human
ggcuagaagucagaggucaaga

SEQ ID NO: 8496 - RNA, 22 nt, Human
ggcuagaguggaacuggagcgg

SEQ ID NO: 8497 - RNA, 22 nt, Human
ggcuagcaagguagcagaaugc

SEQ ID NO: 8498 - RNA, 22 nt, Human
ggcuaggccucaggccugccug

SEQ ID NO: 8499 - RNA, 22 nt, Human
ggccugugcugagaaccuggcu

SEQ ID NO: 8500 - RNA, 22 nt, Human
ggccuguggcaaggugagaaug

SEQ ID NO: 8501 - RNA, 17 nt, Human
ggccuguguggcugcag

SEQ ID NO: 8502 - RNA, 20 nt, Human
ggccuuagggagggcuguaa

SEQ ID NO: 8503 - RNA, 22 nt, Human
ggccuuagguucccugccucca

SEQ ID NO: 8504 - RNA, 22 nt, Human
ggccuucacgugaccuggcgug

SEQ ID NO: 8505 - RNA, 22 nt, Human
ggccuucugccuuucagcaaug

SEQ ID NO: 8506 - RNA, 22 nt, Human
ggccuugagcagggagaaacca

SEQ ID NO: 8507 - RNA, 22 nt, Human
ggccuugauguucuugggagau

SEQ ID NO: 8508 - RNA, 22 nt, Human
ggccuuggaguccuccacugga

SEQ ID NO: 8509 - RNA, 22 nt, Human
ggccuugggcagacacgucaca

SEQ ID NO: 8510 - RNA, 22 nt, Human
ggccuugggcgagucccucagu

SEQ ID NO: 8511 - RNA, 22 nt, Human
ggccuuggguauagguggguau

SEQ ID NO: 8512 - RNA, 22 nt, Human
ggccuugguggcuuugcugaug

SEQ ID NO: 8513 - RNA, 22 nt, Human
ggccuuuaagcaauugaaaaga

SEQ ID NO: 8514 - RNA, 22 nt, Human
ggccuuugcguccacgccgcuu

SEQ ID NO: 8515 - RNA, 22 nt, Human
ggcgagcagagcacugccagga

SEQ ID NO: 8516 - RNA, 22 nt, Human
ggcgagcaugagucacucuggg

SEQ ID NO: 8517 - RNA, 22 nt, Human
ggcgagggagcagugcgguggg

SEQ ID NO: 8518 - RNA, 22 nt, Human
ggcgaggugucugccaucaagc

SEQ ID NO: 8519 - RNA, 22 nt, Human
ggcgcaggccuuggauccuggu

SEQ ID NO: 8520 - RNA, 22 nt, Human
ggcgcaguugagcgugcuguuc

SEQ ID NO: 8521 - RNA, 22 nt, Human
ggcgccagcacugcagcgccuc

SEQ ID NO: 8522 - RNA, 22 nt, Human
ggcgccagcccaggccgucgug

SEQ ID NO: 8523 - RNA, 22 nt, Human
ggcgcggugacucagccucgcu

SEQ ID NO: 8524 - RNA, 22 nt, Human
ggcgcuggccacgguggcucug

SEQ ID NO: 8525 - RNA, 22 nt, Human
ggcgcugucgugagcucgcccg

SEQ ID NO: 8526 - RNA, 22 nt, Human
ggcggcuacuccuccuggugag

SEQ ID NO: 8527 - RNA, 22 nt, Human
ggcgggaaguucuugcccacuu

SEQ ID NO: 8528 - RNA, 22 nt, Human
ggcgggagauggggccguucag

SEQ ID NO: 8529 - RNA, 22 nt, Human
ggcgggaggcugaggaguuggu

SEQ ID NO: 8530 - RNA, 22 nt, Human
ggcggggccucgcgaacggccu

SEQ ID NO: 8531 - RNA, 22 nt, Human
ggcggggucugagcgccgcgcc

SEQ ID NO: 8532 - RNA, 22 nt, Human
ggcgggugcacagacccuuccc

SEQ ID NO: 8533 - RNA, 22 nt, Human
ggcggugguugagaggacggcg

SEQ ID NO: 8534 - RNA, 22 nt, Human
ggcguggcagucaggaaaaggu

SEQ ID NO: 8535 - RNA, 22 nt, Human
ggcguggggccuucugcccgcu

SEQ ID NO: 8536 - RNA, 22 nt, Human
ggcuaaagauguguucuuugga

SEQ ID NO: 8537 - RNA, 19 nt, Human
ggcuaaugucuuugaaaua

SEQ ID NO: 8538 - RNA, 22 nt, Human
ggcuacagacugcauaagggca

SEQ ID NO: 8539 - RNA, 22 nt, Human
ggcuacaguggcacugggcuuu

SEQ ID NO: 8540 - RNA, 22 nt, Human
ggcuagaacuuuacacuuugca

SEQ ID NO: 8541 - RNA, 23 nt, Human
ggcuagaguggaggggaacugca

SEQ ID NO: 8542 - RNA, 22 nt, Human
ggcuaggcgggcacauggugga

SEQ ID NO: 8543 - RNA, 22 nt, Human
ggcuagggaaaaugauuggaua

SEQ ID NO: 8544 - RNA, 22 nt, Human
ggcuaggggaauaaucuguggu

SEQ ID NO: 8545 - RNA, 22 nt, Human
ggcuauggaaauggcaggacau

SEQ ID NO: 8546 - RNA, 22 nt, Human
ggcuauggaagauaaggcugaa

SEQ ID NO: 8547 - RNA, 22 nt, Human
ggcuauguguguccaguguauu

SEQ ID NO: 8548 - RNA, 22 nt, Human
ggcuauuucauuuaguacuagg

SEQ ID NO: 8549 - RNA, 22 nt, Human
ggcucaagcagucugccugccu

SEQ ID NO: 8550 - RNA, 19 nt, Human
ggcucaagcauccagguag

SEQ ID NO: 8551 - RNA, 22 nt, Human
ggcucacaaaauguugcuuaau

SEQ ID NO: 8552 - RNA, 22 nt, Human
ggcucaccauggccucccugcu

SEQ ID NO: 8553 - RNA, 22 nt, Human
ggcucaccauuuucacucucug

SEQ ID NO: 8554 - RNA, 22 nt, Human
ggcucacgcaauuaucccggcc

SEQ ID NO: 8555 - RNA, 23 nt, Human
ggcucagaaaaaguccuggccuc

SEQ ID NO: 8556 - RNA, 22 nt, Human
ggcucagaaggccaugcucugc

SEQ ID NO: 8557 - RNA, 22 nt, Human
ggcucagagguugaggccggca

SEQ ID NO: 8558 - RNA, 22 nt, Human
ggcucagaguuaggacccaugu

SEQ ID NO: 8559 - RNA, 22 nt, Human
ggcucagcacagggcuggcauc

SEQ ID NO: 8560 - RNA, 18 nt, Human
ggcucagcaggcucucuc

SEQ ID NO: 8561 - RNA, 22 nt, Human
ggcucagcuuggugcgcagaaa

SEQ ID NO: 8562 - RNA, 22 nt, Human
ggcucaggacacagugguuuag

SEQ ID NO: 8563 - RNA, 22 nt, Human
ggcucaggaccugggauugcca

SEQ ID NO: 8564 - RNA, 22 nt, Human
ggcucaggaugagccuucucau

SEQ ID NO: 8565 - RNA, 22 nt, Human
ggcucaggccagaccacgacuc

SEQ ID NO: 8566 - RNA, 18 nt, Human
ggcucaggcuauccuaac

SEQ ID NO: 8567 - RNA, 22 nt, Human
ggcucagggaaugaggaagaau

SEQ ID NO: 8568 - RNA, 19 nt, Human
ggcucagggcgcugccgcc

SEQ ID NO: 8569 - RNA, 22 nt, Human
ggcucagguuuccuucccagcu

SEQ ID NO: 8570 - RNA, 22 nt, Human
ggcucauguuucagaaagugga

SEQ ID NO: 8571 - RNA, 22 nt, Human
ggcuccaacacuaaauguguuu

SEQ ID NO: 8572 - RNA, 22 nt, Human
ggcuccaagucucagagugaag

SEQ ID NO: 8573 - RNA, 22 nt, Human
ggcuccacugcugaccacucca

SEQ ID NO: 8574 - RNA, 22 nt, Human
ggcuccagaaaucauagagcag

SEQ ID NO: 8575 - RNA, 22 nt, Human
ggcuccagaggccuuaccugca

SEQ ID NO: 8576 - RNA, 18 nt, Human
ggcuccaggaccuaccca

SEQ ID NO: 8577 - RNA, 22 nt, Human
ggcuccagggaguggagagaag

SEQ ID NO: 8578 - RNA, 22 nt, Human
ggcuccagguuuaaggguaugu

SEQ ID NO: 8579 - RNA, 22 nt, Human
ggcucccacccauagggcgagu

SEQ ID NO: 8580 - RNA, 22 nt, Human
ggcucccugggugcuccugcuc

SEQ ID NO: 8581 - RNA, 22 nt, Human
ggcuccugaaagacuaugggaa

SEQ ID NO: 8582 - RNA, 22 nt, Human
ggcuccugagaaugggccauca

SEQ ID NO: 8583 - RNA, 22 nt, Human
ggcuccugccgucuuuucugag

SEQ ID NO: 8584 - RNA, 21 nt, Human
ggcuccugcuuugugaggggc

SEQ ID NO: 8585 - RNA, 22 nt, Human
ggcuccuggaggcaccacuggu

SEQ ID NO: 8586 - RNA, 22 nt, Human
ggcuccugggagauagagguca

SEQ ID NO: 8587 - RNA, 22 nt, Human
ggcuccuggggaggugagcuug

SEQ ID NO: 8588 - RNA, 22 nt, Human
ggcuccuguccccucagcugcu

SEQ ID NO: 8589 - RNA, 22 nt, Human
ggcuccuguggcaagacagcuu

SEQ ID NO: 8590 - RNA, 19 nt, Human
ggcuccuguggcugcagcc

SEQ ID NO: 8591 - RNA, 20 nt, Human
ggcuccuucuuucauggccc

SEQ ID NO: 8592 - RNA, 22 nt, Human
ggcucucagggaaaggccuccc

SEQ ID NO: 8593 - RNA, 22 nt, Human
ggcucucugaggaaacccuucc

SEQ ID NO: 8594 - RNA, 22 nt, Human
ggcucucuggaggagcucaccc

SEQ ID NO: 8595 - RNA, 22 nt, Human
ggcucucuuaacuggccauccu

SEQ ID NO: 8596 - RNA, 22 nt, Human
ggcucugaaggagacagcugcu

SEQ ID NO: 8597 - RNA, 22 nt, Human
ggcucugaauuauuccugaguc

SEQ ID NO: 8598 - RNA, 22 nt, Human
ggcucugaccucccaggcaguu

SEQ ID NO: 8599 - RNA, 22 nt, Human
ggcucugaggcagaucgauggg

SEQ ID NO: 8600 - RNA, 22 nt, Human
ggcucugcccagguggacagca

SEQ ID NO: 8601 - RNA, 22 nt, Human
ggcucugccucugacccucugg

SEQ ID NO: 8602 - RNA, 22 nt, Human
ggcucugccugcccagcagcac

SEQ ID NO: 8603 - RNA, 22 nt, Human
ggcucugcgccugcggggacuu

SEQ ID NO: 8604 - RNA, 22 nt, Human
ggcucugcggcgugugcgcagg

SEQ ID NO: 8605 - RNA, 22 nt, Human
ggcucugcucacagcccgcagc

SEQ ID NO: 8606 - RNA, 22 nt, Human
ggcucugcugcaagucuuccuc

SEQ ID NO: 8607 - RNA, 22 nt, Human
ggcucugcugcacccuuggcuc

SEQ ID NO: 8608 - RNA, 22 nt, Human
ggcucugcuuccuggaauugug

SEQ ID NO: 8609 - RNA, 22 nt, Human
ucaggauccauagacucccaaa

SEQ ID NO: 8610 - RNA, 22 nt, Human
ucaggaugacuucaaggaggaa

SEQ ID NO: 8611 - RNA, 22 nt, Human
ucaggauggagucuauccagug

SEQ ID NO: 8612 - RNA, 22 nt, Human
gggaagugauggagccaggauu

SEQ ID NO: 8613 - RNA, 22 nt, Human
gggaaugaccuuaauaaguagg

SEQ ID NO: 8614 - RNA, 22 nt, Human
gggaaugugucugauggaaaga

SEQ ID NO: 8615 - RNA, 22 nt, Human
gggacaauggaggccucucucc

SEQ ID NO: 8616 - RNA, 22 nt, Human
gggacagaggcaaacuagcaga

SEQ ID NO: 8617 - RNA, 22 nt, Human
gggacaugaggccauagugauu

SEQ ID NO: 8618 - RNA, 22 nt, Human
gggacauggcuaggauuccaau

SEQ ID NO: 8619 - RNA, 22 nt, Human
gggaccacuccgacauguaggg

SEQ ID NO: 8620 - RNA, 22 nt, Human
gggaccaggucagggcucugac

SEQ ID NO: 8621 - RNA, 22 nt, Human
gggaccagugucugugagaaaa

SEQ ID NO: 8622 - RNA, 22 nt, Human
gggacccagguaauccugugcu

SEQ ID NO: 8623 - RNA, 22 nt, Human
gggacccugggaggcuggcgca

SEQ ID NO: 8624 - RNA, 19 nt, Human
gggaccugacuaauuggca

SEQ ID NO: 8625 - RNA, 22 nt, Human
gggaccugaggcccugcuccac

SEQ ID NO: 8626 - RNA, 22 nt, Human
gggaccugccaaggccacccag

SEQ ID NO: 8627 - RNA, 22 nt, Human
gggacgacaggcucugugguag

SEQ ID NO: 8628 - RNA, 22 nt, Human
gggacgagaucuuggcagugug

SEQ ID NO: 8629 - RNA, 22 nt, Human
gggacgagccccaggcuggagg

SEQ ID NO: 8630 - RNA, 22 nt, Human
gggacgugagugaagaaggucu

SEQ ID NO: 8631 - RNA, 22 nt, Human
gggacuggaacuacuggugcag

SEQ ID NO: 8632 - RNA, 22 nt, Human
gggacuguccucugugucugug

SEQ ID NO: 8633 - RNA, 22 nt, Human
gggagaacuggguggagcaucu

SEQ ID NO: 8634 - RNA, 22 nt, Human
gggagaagaaugugucaauugu

SEQ ID NO: 8635 - RNA, 22 nt, Human
gggagacacgcugcaggcauaa

SEQ ID NO: 8636 - RNA, 22 nt, Human
gggagacacuugcuuuagaggg

SEQ ID NO: 8637 - RNA, 22 nt, Human
gggagagaauuauugccagacc

SEQ ID NO: 8638 - RNA, 22 nt, Human
gggagagcgggaggugccacag

SEQ ID NO: 8639 - RNA, 22 nt, Human
gggagagguuacccgagcaacu

SEQ ID NO: 8640 - RNA, 22 nt, Human
gggagaguagcuggaagguucu

SEQ ID NO: 8641 - RNA, 22 nt, Human
gggagcauaaacucagauuuca

SEQ ID NO: 8642 - RNA, 22 nt, Human
gggagcauuuauuuuccguuag

SEQ ID NO: 8643 - RNA, 22 nt, Human
gggagccacucagcugagaguu

SEQ ID NO: 8644 - RNA, 19 nt, Human
gggagccagacccuuugcu

SEQ ID NO: 8645 - RNA, 22 nt, Human
gggagccagagucaccuagaga

SEQ ID NO: 8646 - RNA, 22 nt, Human
gggagccagccuuugccuauaa

SEQ ID NO: 8647 - RNA, 22 nt, Human
gggagccaugcuggucuucuuu

SEQ ID NO: 8648 - RNA, 22 nt, Human
gggagcgggacugcgcaggcuu

SEQ ID NO: 8649 - RNA, 22 nt, Human
gggagcucucccugaggccugg

SEQ ID NO: 8650 - RNA, 22 nt, Human
gggagcugaaguagggguaaau

SEQ ID NO: 8651 - RNA, 22 nt, Human
gggagcugagcuggaagagaau

SEQ ID NO: 8652 - RNA, 19 nt, Human
gggagcugaggucuuuggu

SEQ ID NO: 8653 - RNA, 22 nt, Human
gggagcugcugaacacaagggu

SEQ ID NO: 8654 - RNA, 22 nt, Human
gggagcuggaugauugaggcaa

SEQ ID NO: 8655 - RNA, 18 nt, Human
gggagcugggaagcuggu

SEQ ID NO: 8656 - RNA, 22 nt, Human
gggagcuggggcauuuauaccc

SEQ ID NO: 8657 - RNA, 22 nt, Human
gggagcugguuccugcccucca

SEQ ID NO: 8658 - RNA, 22 nt, Human
gggagcugugggauugguugag

SEQ ID NO: 8659 - RNA, 19 nt, Human
gggagcuuuccaucugucc

SEQ ID NO: 8660 - RNA, 22 nt, Human
gggaggagcugagugugugugc

SEQ ID NO: 8661 - RNA, 20 nt, Human
gggaggccccagaguccagg

SEQ ID NO: 8662 - RNA, 22 nt, Human
gggagggaaggaggcgccgugu

SEQ ID NO: 8663 - RNA, 22 nt, Human
gggagggagaggacaguucuau

SEQ ID NO: 8664 - RNA, 22 nt, Human
gggagggaggugcugguucacg

SEQ ID NO: 8665 - RNA, 16 nt, Human
gggagggaguuggugg

SEQ ID NO: 8666 - RNA, 22 nt, Human
gggagggauuaguucugccugg

SEQ ID NO: 8667 - RNA, 22 nt, Human
gggagggccagugcucucuaga

SEQ ID NO: 8668 - RNA, 22 nt, Human
gggagggcuuggacccagaugu

SEQ ID NO: 8669 - RNA, 22 nt, Human
gggagggucugagagcugcacc

SEQ ID NO: 8670 - RNA, 22 nt, Human
gggagguaaagaugagcucagu

SEQ ID NO: 8671 - RNA, 22 nt, Human
gggagugguccuuuccuaucug

SEQ ID NO: 8672 - RNA, 22 nt, Human
gggaguguugagcgcccugcca

SEQ ID NO: 8673 - RNA, 22 nt, Human
gggauagguuuggaagaggugg

SEQ ID NO: 8674 - RNA, 21 nt, Human
gggaucugaggcaagucuccu

SEQ ID NO: 8675 - RNA, 22 nt, Human
gggaucugaguaggcagaagcu

SEQ ID NO: 8676 - RNA, 22 nt, Human
gggaucugaguugucaggaagg

SEQ ID NO: 8677 - RNA, 22 nt, Human
gggaucugauuuaggaugggag

SEQ ID NO: 8678 - RNA, 22 nt, Human
gggaucuugggaacacccuuac

SEQ ID NO: 8679 - RNA, 22 nt, Human
gggaucuuguuuaauauuguuu

SEQ ID NO: 8680 - RNA, 22 nt, Human
gggaugaggaucaaucagggag

SEQ ID NO: 8681 - RNA, 22 nt, Human
gggaugauggaaaagucuguua

SEQ ID NO: 8682 - RNA, 22 nt, Human
gggauggcucaaaggagucagg

SEQ ID NO: 8683 - RNA, 22 nt, Human
gggauggggagcuggaaagggg

SEQ ID NO: 8684 - RNA, 22 nt, Human
gggaugucacugugccuggcac

SEQ ID NO: 8685 - RNA, 22 nt, Human
gggauuacagaugugagccauu

SEQ ID NO: 8686 - RNA, 18 nt, Human
gggcaagcggcugucacc

SEQ ID NO: 8687 - RNA, 22 nt, Human
gggcaagcucuucagaagcucu

SEQ ID NO: 8688 - RNA, 22 nt, Human
gggcaaguguuuugucugccug

SEQ ID NO: 8689 - RNA, 22 nt, Human
gggcacagcccagugggguccc

SEQ ID NO: 8690 - RNA, 22 nt, Human
gggcacagccuaacuauggaga

SEQ ID NO: 8691 - RNA, 22 nt, Human
gggcacaggaauuugggaugug

SEQ ID NO: 8692 - RNA, 22 nt, Human
gggcacauguaaagcuggagaa

SEQ ID NO: 8693 - RNA, 23 nt, Human
gggcaccaggagcaccggacagg

SEQ ID NO: 8694 - RNA, 22 nt, Human
gggcaccuggcuagugacagug

SEQ ID NO: 8695 - RNA, 22 nt, Human
gggcaccuugggucucaggcaa

SEQ ID NO: 8696 - RNA, 22 nt, Human
gggcacugaacacccucuucgc

SEQ ID NO: 8697 - RNA, 22 nt, Human
gggcacugaaugccaagcuagg

SEQ ID NO: 8698 - RNA, 22 nt, Human
gggcacugagaauuuuccacuu

SEQ ID NO: 8699 - RNA, 22 nt, Human
gggcacugcuggaggcucccug

SEQ ID NO: 8700 - RNA, 22 nt, Human
gggcacugcuuugcucugucac

SEQ ID NO: 8701 - RNA, 22 nt, Human
gggcacuggccgcccaucccug

SEQ ID NO: 8702 - RNA, 22 nt, Human
gggcacugggucuucuccacgc

SEQ ID NO: 8703 - RNA, 22 nt, Human
gggcacuggugcugccaucuug

SEQ ID NO: 8704 - RNA, 22 nt, Human
gggcagagguucaacuucaaca

SEQ ID NO: 8705 - RNA, 22 nt, Human
gggcagauggggcacaggcuga

SEQ ID NO: 8706 - RNA, 22 nt, Human
gggcagcacagacagugaaggc

SEQ ID NO: 8707 - RNA, 21 nt, Human
gggcagcacgucauuccugug

SEQ ID NO: 8708 - RNA, 22 nt, Human
gggcagcacguuucaggaggau

SEQ ID NO: 8709 - RNA, 22 nt, Human
gggcagcacucauaccuauauu

SEQ ID NO: 8710 - RNA, 22 nt, Human
gggcagcagaggaucccuuaau

SEQ ID NO: 8711 - RNA, 22 nt, Human
gggcagcauucugugggcaggu

SEQ ID NO: 8712 - RNA, 22 nt, Human
gggcagccgcgugaccugccag

SEQ ID NO: 8713 - RNA, 20 nt, Human
gggcagccucgggagugggu

SEQ ID NO: 8714 - RNA, 22 nt, Human
gggcagcuccuguggaauccac

SEQ ID NO: 8715 - RNA, 22 nt, Human
gggcagcucugcccaucagagg

SEQ ID NO: 8716 - RNA, 22 nt, Human
gggcagcuggcuuauagguuug

SEQ ID NO: 8717 - RNA, 22 nt, Human
gggcagcuguaucugagcuuau

SEQ ID NO: 8718 - RNA, 22 nt, Human
ggggugggguuacucauugugc

SEQ ID NO: 8719 - RNA, 20 nt, Human
gggguugacccucuuggacu

SEQ ID NO: 8720 - RNA, 22 nt, Human
gggguugguuuaaaugcuugag

SEQ ID NO: 8721 - RNA, 22 nt, Human
ggguaagcugcuuuaucucucu

SEQ ID NO: 8722 - RNA, 22 nt, Human
ggguaaggucagccagaaguuc

SEQ ID NO: 8723 - RNA, 22 nt, Human
ggguacuuaauauuuacggggu

SEQ ID NO: 8724 - RNA, 21 nt, Human
ggguagcagaggaggccgugg

SEQ ID NO: 8725 - RNA, 22 nt, Human
ggguagcaugugucagaguuug

SEQ ID NO: 8726 - RNA, 22 nt, Human
ggguaggaaauccagagguggc

SEQ ID NO: 8727 - RNA, 22 nt, Human
ggguaggaugguagaagggacc

SEQ ID NO: 8728 - RNA, 22 nt, Human
ggguaggccgugggucaccagg

SEQ ID NO: 8729 - RNA, 22 nt, Human
ggguaggcugcuccuggggccc

SEQ ID NO: 8730 - RNA, 18 nt, Human
ggguauccagaacugguc

SEQ ID NO: 8731 - RNA, 22 nt, Human
ggguauuugacaaacugacacu

SEQ ID NO: 8732 - RNA, 22 nt, Human
gggucaagccguugcccaaggc

SEQ ID NO: 8733 - RNA, 22 nt, Human
gggucacuuuugcuauguuggc

SEQ ID NO: 8734 - RNA, 22 nt, Human
ggguccagacacuccagaggaa

SEQ ID NO: 8735 - RNA, 22 nt, Human
ggguccagagccucagcccaga

SEQ ID NO: 8736 - RNA, 22 nt, Human
ggguccagaguugaagagguua

SEQ ID NO: 8737 - RNA, 16 nt, Human
ggguccagaucugcuc

SEQ ID NO: 8738 - RNA, 22 nt, Human
ggguccagauggugagaguuaa

SEQ ID NO: 8739 - RNA, 20 nt, Human
ggguccaggacucugaauuu

SEQ ID NO: 8740 - RNA, 22 nt, Human
ggguccagggacguuucugcag

SEQ ID NO: 8741 - RNA, 22 nt, Human
ggguccaguuucaucugagguu

SEQ ID NO: 8742 - RNA, 22 nt, Human
gggucccaggaaggagcagugu

SEQ ID NO: 8743 - RNA, 22 nt, Human
ggguccccucaucauggagacu

SEQ ID NO: 8744 - RNA, 22 nt, Human
ggguccuggaaucugcauuuua

SEQ ID NO: 8745 - RNA, 21 nt, Human
ggguccugggaugggauccag

SEQ ID NO: 8746 - RNA, 22 nt, Human
gggucuaggagacaugggcaag

SEQ ID NO: 8747 - RNA, 22 nt, Human
gggucuccauguuaacaucacu

SEQ ID NO: 8748 - RNA, 22 nt, Human
gggucuccugagagaagaugcu

SEQ ID NO: 8749 - RNA, 22 nt, Human
gggucucuccuccccagcugug

SEQ ID NO: 8750 - RNA, 22 nt, Human
gggucugagcugaggggaaauc

SEQ ID NO: 8751 - RNA, 22 nt, Human
gggucugcuccaccugcagccc

SEQ ID NO: 8752 - RNA, 22 nt, Human
gggucuggagggcagcccuucu

SEQ ID NO: 8753 - RNA, 22 nt, Human
gggucuucauuuauucuacacu

SEQ ID NO: 8754 - RNA, 22 nt, Human
gggucuucgccgccgccauaac

SEQ ID NO: 8755 - RNA, 22 nt, Human
gggugacagcagcuaaugacag

SEQ ID NO: 8756 - RNA, 22 nt, Human
gggugacauuaggaagauagac

SEQ ID NO: 8757 - RNA, 22 nt, Human
gggugagagucaggcagagauu

SEQ ID NO: 8758 - RNA, 22 nt, Human
gggugaggcccauuugaggcca

SEQ ID NO: 8759 - RNA, 22 nt, Human
gggugaggccuugcugccauca

SEQ ID NO: 8760 - RNA, 22 nt, Human
gggugcaaacccguucugcacc

SEQ ID NO: 8761 - RNA, 22 nt, Human
gggugcaggcagcccaggcagg

SEQ ID NO: 8762 - RNA, 22 nt, Human
gggugcaggggacccuagggac

SEQ ID NO: 8763 - RNA, 22 nt, Human
gggugccugaguuagggcagaa

SEQ ID NO: 8764 - RNA, 22 nt, Human
gggugcgguccccacagcccgu

SEQ ID NO: 8765 - RNA, 22 nt, Human
gggugcugggaggcugacaucu

SEQ ID NO: 8766 - RNA, 22 nt, Human
ggguggaauuguuggcaucgga

SEQ ID NO: 8767 - RNA, 22 nt, Human
ggguggagagaaagaaacguga

SEQ ID NO: 8768 - RNA, 22 nt, Human
ggguggagccaguugacucugu

SEQ ID NO: 8769 - RNA, 22 nt, Human
ggguggagcuuggacaccagua

SEQ ID NO: 8770 - RNA, 22 nt, Human
ggguggcagcuguugccaaggu

SEQ ID NO: 8771 - RNA, 22 nt, Human
ggguggcaggauuggcaggagu

SEQ ID NO: 8772 - RNA, 22 nt, Human
ggguggccuuaggcaagucacu

SEQ ID NO: 8773 - RNA, 20 nt, Human
gggugggagagucugagggu

SEQ ID NO: 8774 - RNA, 17 nt, Human
gggugggcacugcuggc

SEQ ID NO: 8775 - RNA, 21 nt, Human
ggguggguggaauuaggagug

SEQ ID NO: 8776 - RNA, 16 nt, Human
ggguggucuuggagac

SEQ ID NO: 8777 - RNA, 22 nt, Human
gggugguggcggaggcuccagg

SEQ ID NO: 8778 - RNA, 22 nt, Human
ggguguagaaagaacccucugg

SEQ ID NO: 8779 - RNA, 22 nt, Human
ggguguccagggcgugucugga

SEQ ID NO: 8780 - RNA, 22 nt, Human
ggguguccugugccaagcuggg

SEQ ID NO: 8781 - RNA, 22 nt, Human
ggguguguuccuaaggaaacca

SEQ ID NO: 8782 - RNA, 18 nt, Human
ggguucaccugccuuugg

SEQ ID NO: 8783 - RNA, 22 nt, Human
ggguucagacuaaagcuaugca

SEQ ID NO: 8784 - RNA, 22 nt, Human
ggguucagagucaggugugaua

SEQ ID NO: 8785 - RNA, 22 nt, Human
ggguucccugccuggccacucu

SEQ ID NO: 8786 - RNA, 22 nt, Human
ggguugaggcggaugucggcgg

SEQ ID NO: 8787 - RNA, 22 nt, Human
gguaaaaaucacaaauacuuua

SEQ ID NO: 8788 - RNA, 22 nt, Human
gguaacacauggaacauuuaca

SEQ ID NO: 8789 - RNA, 22 nt, Human
gguaacugcagaaugugccuca

SEQ ID NO: 8790 - RNA, 22 nt, Human
gguaagcacuucauguacauga

SEQ ID NO: 8791 - RNA, 22 nt, Human
gguacacauugugacuguauua

SEQ ID NO: 8792 - RNA, 22 nt, Human
gguacagaauaaaaauccuaca

SEQ ID NO: 8793 - RNA, 22 nt, Human
gguacauuuuucugucacuuug

SEQ ID NO: 8794 - RNA, 22 nt, Human
gguagaaggggaagagguccau

SEQ ID NO: 8795 - RNA, 22 nt, Human
gguagacaacuuuguaauagcc

SEQ ID NO: 8796 - RNA, 20 nt, Human
gguagcagcugcugucaucc

SEQ ID NO: 8797 - RNA, 20 nt, Human
gguagcugcugcaguuggua

SEQ ID NO: 8798 - RNA, 22 nt, Human
gguaggaguauuuugcagcagu

SEQ ID NO: 8799 - RNA, 22 nt, Human
gguaggagugaagacuuaagau

SEQ ID NO: 8800 - RNA, 22 nt, Human
gguaggcagaucacugucuaug

SEQ ID NO: 8801 - RNA, 22 nt, Human
gguagggaugggauuuggaagu

SEQ ID NO: 8802 - RNA, 22 nt, Human
gguaggggaagacaagugaaaa

SEQ ID NO: 8803 - RNA, 22 nt, Human
gguaguacauggaagaguacac

SEQ ID NO: 8804 - RNA, 22 nt, Human
gguagucauggauagcuaugag

SEQ ID NO: 8805 - RNA, 22 nt, Human
gguagugaggugaaagagaggu

SEQ ID NO: 8806 - RNA, 22 nt, Human
gguauaaaugaucagaucgcug

SEQ ID NO: 8807 - RNA, 22 nt, Human
gguaucaaagaagggggugcca

SEQ ID NO: 8808 - RNA, 22 nt, Human
gguauuuauaugucugaagcug

SEQ ID NO: 8809 - RNA, 22 nt, Human
ggucaaagggugagauggcagg

SEQ ID NO: 8810 - RNA, 22 nt, Human
ggucaagacgggcucugcccuu

SEQ ID NO: 8811 - RNA, 22 nt, Human
ggucacaaggcagauaauaagg

SEQ ID NO: 8812 - RNA, 22 nt, Human
ggucacaagguacuguaagaaa

SEQ ID NO: 8813 - RNA, 22 nt, Human
ggucacagggaagggcucucaa

SEQ ID NO: 8814 - RNA, 22 nt, Human
ggucacaggggagaagagugau

SEQ ID NO: 8815 - RNA, 22 nt, Human
ggucacauauccucgguuugga

SEQ ID NO: 8816 - RNA, 22 nt, Human
ggucacaugugauuugagccaa

SEQ ID NO: 8817 - RNA, 22 nt, Human
ggucacauucugagguauuagg

SEQ ID NO: 8818 - RNA, 22 nt, Human
ggucacugcucuaaacaaaagu

SEQ ID NO: 8819 - RNA, 22 nt, Human
ggucacugucuucugggcucug

SEQ ID NO: 8820 - RNA, 22 nt, Human
ggucagagcuggagagauaggg

SEQ ID NO: 8821 - RNA, 22 nt, Human
ggucagcagugcagggcagagc

SEQ ID NO: 8822 - RNA, 22 nt, Human
ggucagcaguuucuuugaauuu

SEQ ID NO: 8823 - RNA, 19 nt, Human
ggucagcugggcuagaggc

SEQ ID NO: 8824 - RNA, 22 nt, Human
ggucaggauccaagucugugcu

SEQ ID NO: 8825 - RNA, 21 nt, Human
ggucaggcaugugcccugagc

SEQ ID NO: 8826 - RNA, 22 nt, Human
ggucagggcucuuccaguggcu

SEQ ID NO: 8827 - RNA, 22 nt, Human
gggaugacaaagugucuguccc

SEQ ID NO: 8828 - RNA, 22 nt, Human
gggaugagagcugggacagaag

SEQ ID NO: 8829 - RNA, 22 nt, Human
gggaugcagacuacagggcuua

SEQ ID NO: 8830 - RNA, 22 nt, Human
gggaugcaguauguauauuuuc

SEQ ID NO: 8831 - RNA, 22 nt, Human
gggaugcagucagagccccugu

SEQ ID NO: 8832 - RNA, 22 nt, Human
gggaugccaguccuggcccugc

SEQ ID NO: 8833 - RNA, 22 nt, Human
gggauggaucuuggcugaggcu

SEQ ID NO: 8834 - RNA, 22 nt, Human
gggauggcugccugcaucagga

SEQ ID NO: 8835 - RNA, 22 nt, Human
gggaugguggcuugcaucugua

SEQ ID NO: 8836 - RNA, 22 nt, Human
gggauucaucaacuguuuuaca

SEQ ID NO: 8837 - RNA, 22 nt, Human
gggcaaaaccugggcaucauga

SEQ ID NO: 8838 - RNA, 22 nt, Human
gggcaaaggcagaaagcggugu

SEQ ID NO: 8839 - RNA, 22 nt, Human
gggcaacagagcgagggccugu

SEQ ID NO: 8840 - RNA, 22 nt, Human
gggcaagaagcuggaagcauuc

SEQ ID NO: 8841 - RNA, 22 nt, Human
gggcaagcuuugaacaucagca

SEQ ID NO: 8842 - RNA, 22 nt, Human
gggcaauggaugugaugacucc

SEQ ID NO: 8843 - RNA, 22 nt, Human
gggcaauucacaggguuguuau

SEQ ID NO: 8844 - RNA, 22 nt, Human
gggcacaccuugucugagcaca

SEQ ID NO: 8845 - RNA, 22 nt, Human
gggcacagagaagguuuuagug

SEQ ID NO: 8846 - RNA, 22 nt, Human
gggcacagagggucuugaagaa

SEQ ID NO: 8847 - RNA, 22 nt, Human
gggcacaggagaaggaucuggc

SEQ ID NO: 8848 - RNA, 22 nt, Human
gggcacaguacuccaaucaacu

SEQ ID NO: 8849 - RNA, 22 nt, Human
gggcacagucuaaaguugggcc

SEQ ID NO: 8850 - RNA, 22 nt, Human
gggcaccagcggccgcacugcc

SEQ ID NO: 8851 - RNA, 22 nt, Human
gggcacugagggcccacaggau

SEQ ID NO: 8852 - RNA, 22 nt, Human
gggcacuggcagucggggacgc

SEQ ID NO: 8853 - RNA, 22 nt, Human
gggcacuguggggcccaugcug

SEQ ID NO: 8854 - RNA, 22 nt, Human
gggcagagaaauggacaguugg

SEQ ID NO: 8855 - RNA, 21 nt, Human
gggcagaggggccuccugggu

SEQ ID NO: 8856 - RNA, 22 nt, Human
gggcagaggggcgcuucccucu

SEQ ID NO: 8857 - RNA, 22 nt, Human
gggcagcaaaucugagucuggu

SEQ ID NO: 8858 - RNA, 18 nt, Human
gggcagcacagcagccuc

SEQ ID NO: 8859 - RNA, 22 nt, Human
gggaggagcuuggagauucacu

SEQ ID NO: 8860 - RNA, 22 nt, Human
gggaggagggugcuggcuaaac

SEQ ID NO: 8861 - RNA, 22 nt, Human
gggaggcacgaggcgcgcagug

SEQ ID NO: 8862 - RNA, 22 nt, Human
gggagggacacaaagaguuccc

SEQ ID NO: 8863 - RNA, 22 nt, Human
gggagggaggugaugcuuggcu

SEQ ID NO: 8864 - RNA, 22 nt, Human
gggagggaucugcuaggcaaug

SEQ ID NO: 8865 - RNA, 22 nt, Human
gggagggguugcauguuugagu

SEQ ID NO: 8866 - RNA, 22 nt, Human
gggaggugaaagguugcugcag

SEQ ID NO: 8867 - RNA, 22 nt, Human
gggaggugauuaggaccaugua

SEQ ID NO: 8868 - RNA, 22 nt, Human
gggagguguucugccaacgcgg

SEQ ID NO: 8869 - RNA, 22 nt, Human
gggagugguugauggugaaaau

SEQ ID NO: 8870 - RNA, 22 nt, Human
gggagugugcagaagcuggggg

SEQ ID NO: 8871 - RNA, 18 nt, Human
gggauauaucagugaaga

SEQ ID NO: 8872 - RNA, 23 nt, Human
gggauauggaccuuggaggaguc

SEQ ID NO: 8873 - RNA, 22 nt, Human
gggaucagacucugggauguag

SEQ ID NO: 8874 - RNA, 22 nt, Human
gggaucagcaagccacugcacc

SEQ ID NO: 8875 - RNA, 19 nt, Human
gggaucagcccagggcucu

SEQ ID NO: 8876 - RNA, 18 nt, Human
gggaucaggcugccuagg

SEQ ID NO: 8877 - RNA, 22 nt, Human
gggaucaguuaaggagaguuuu

SEQ ID NO: 8878 - RNA, 22 nt, Human
gggaucuggaauuuugguaugu

SEQ ID NO: 8879 - RNA, 23 nt, Human
gggaucuguaaguugaagacaaa

SEQ ID NO: 8880 - RNA, 20 nt, Human
gggaucuuccaggcucuccu

SEQ ID NO: 8881 - RNA, 22 nt, Human
gggaugagaguagggugugaaa

SEQ ID NO: 8882 - RNA, 20 nt, Human
gggaugagaguccuagcucu

SEQ ID NO: 8883 - RNA, 22 nt, Human
gggaugauaaugccagaguuaa

SEQ ID NO: 8884 - RNA, 22 nt, Human
gggauggacugacgguagcgcg

SEQ ID NO: 8885 - RNA, 22 nt, Human
gggauggacuuggggacuccag

SEQ ID NO: 8886 - RNA, 22 nt, Human
gggauggccuagacuagcuugg

SEQ ID NO: 8887 - RNA, 22 nt, Human
gggauggcuuuguggcugacuc

SEQ ID NO: 8888 - RNA, 22 nt, Human
gggaugggagagcauuuagaga

SEQ ID NO: 8889 - RNA, 19 nt, Human
gggaugggcccucacccuc

SEQ ID NO: 8890 - RNA, 22 nt, Human
gggauggggucaacauguaccu

SEQ ID NO: 8891 - RNA, 22 nt, Human
gggauuuaguaggauaguauac

SEQ ID NO: 8892 - RNA, 22 nt, Human
gggauuucaccauguugguugg

SEQ ID NO: 8893 - RNA, 22 nt, Human
gggcaaaauacuuauaaaggcu

SEQ ID NO: 8894 - RNA, 19 nt, Human
gggcaaagugaucguccug

SEQ ID NO: 8895 - RNA, 22 nt, Human
gggcaacugaaaaauuguauuc

SEQ ID NO: 8896 - RNA, 22 nt, Human
gggcaaggcagaagaguuggag

SEQ ID NO: 8897 - RNA, 22 nt, Human
gggcaaguccggugcccagagc

SEQ ID NO: 8898 - RNA, 22 nt, Human
gggcaagugucaagcaugucau

SEQ ID NO: 8899 - RNA, 22 nt, Human
gggcaaguugagaagaaugcua

SEQ ID NO: 8900 - RNA, 22 nt, Human
gggcaaugggcuuuucuguaag

SEQ ID NO: 8901 - RNA, 19 nt, Human
gggcacagccuccccccag

SEQ ID NO: 8902 - RNA, 22 nt, Human
gggcacagcugcuacccagugc

SEQ ID NO: 8903 - RNA, 22 nt, Human
gggcacagucugcagcccccca

SEQ ID NO: 8904 - RNA, 21 nt, Human
gggcacugaaagggaauagca

SEQ ID NO: 8905 - RNA, 22 nt, Human
gggcacugacagggucccaacu

SEQ ID NO: 8906 - RNA, 22 nt, Human
gggcacugaguggaugaugcag

SEQ ID NO: 8907 - RNA, 22 nt, Human
gggcacuggaggccaaggagcu

SEQ ID NO: 8908 - RNA, 22 nt, Human
gggcacugugcuaggugcugag

SEQ ID NO: 8909 - RNA, 22 nt, Human
gggcacugugcugggugcuuua

SEQ ID NO: 8910 - RNA, 19 nt, Human
gggcagaauggcaucucag

SEQ ID NO: 8911 - RNA, 22 nt, Human
gggcagagacucagaaacagaa

SEQ ID NO: 8912 - RNA, 22 nt, Human
gggcagaggcucuggcccaucc

SEQ ID NO: 8913 - RNA, 22 nt, Human
gggcagaugucuggacaccuca

SEQ ID NO: 8914 - RNA, 22 nt, Human
gggcagcaugaggacccucauc

SEQ ID NO: 8915 - RNA, 22 nt, Human
gggcagcauuugaaaaacagau

SEQ ID NO: 8916 - RNA, 22 nt, Human
gggcagcccagaacugcugcag

SEQ ID NO: 8917 - RNA, 22 nt, Human
gggcagccucggugccugcugc

SEQ ID NO: 8918 - RNA, 22 nt, Human
gggcagcucagccaccaugcag

SEQ ID NO: 8919 - RNA, 22 nt, Human
gggcagcucucacagcagccaa

SEQ ID NO: 8920 - RNA, 22 nt, Human
gggcagcucuggcugugggaag

SEQ ID NO: 8921 - RNA, 22 nt, Human
gggcaggcugagcaugucaccu

SEQ ID NO: 8922 - RNA, 22 nt, Human
gggcaggucugggucagccuga

SEQ ID NO: 8923 - RNA, 22 nt, Human
gggcagguggccucuuguacua

SEQ ID NO: 8924 - RNA, 22 nt, Human
gggcagguguugucaaucuaau

SEQ ID NO: 8925 - RNA, 22 nt, Human
gggcagguguuuccaaggugag

SEQ ID NO: 8926 - RNA, 23 nt, Human
gggcagguuuuuauaggcuucag

SEQ ID NO: 8927 - RNA, 22 nt, Human
gggcagugacaaaggggaugaa

SEQ ID NO: 8928 - RNA, 22 nt, Human
gggcaguggcucacgccuguaa

SEQ ID NO: 8929 - RNA, 22 nt, Human
gggcagugguccaggcuacagc

SEQ ID NO: 8930 - RNA, 22 nt, Human
gggcaguguugcucucaaaguc

SEQ ID NO: 8931 - RNA, 22 nt, Human
gggcaguuuauucuagaugguu

SEQ ID NO: 8932 - RNA, 18 nt, Human
gggcaucauucacaaagu

SEQ ID NO: 8933 - RNA, 21 nt, Human
gggcauccuuucccacccugc

SEQ ID NO: 8934 - RNA, 22 nt, Human
gggcaugccugcgcagugcaug

SEQ ID NO: 8935 - RNA, 23 nt, Human
gggcauggaguguagguggaagg

SEQ ID NO: 8936 - RNA, 22 nt, Human
uccaggcugugcgcaccgugug

SEQ ID NO: 8937 - RNA, 22 nt, Human
uccaggcuugagaccaggcucu

SEQ ID NO: 8938 - RNA, 22 nt, Human
uccaggcuuuuucaugcugucu

SEQ ID NO: 8939 - RNA, 22 nt, Human
uccagggaaggugugaggcugg

SEQ ID NO: 8940 - RNA, 21 nt, Human
uccagggaauuucaacuuuua

SEQ ID NO: 8941 - RNA, 22 nt, Human
uccagggaucuuuagagucuuu

SEQ ID NO: 8942 - RNA, 22 nt, Human
uccagggaugguaaugagcagu

SEQ ID NO: 8943 - RNA, 20 nt, Human
uccagggcaacuagagugug

SEQ ID NO: 8944 - RNA, 22 nt, Human
uccagggcagggugcgcauggg

SEQ ID NO: 8945 - RNA, 23 nt, Human
uccagggcaguggcugggucugc

SEQ ID NO: 8946 - RNA, 22 nt, Human
uccagggccacagaggaugcua

SEQ ID NO: 8947 - RNA, 22 nt, Human
uccagggccaugaaguugcaca

SEQ ID NO: 8948 - RNA, 22 nt, Human
uccagggccccccaguugcacg

SEQ ID NO: 8949 - RNA, 22 nt, Human
uccagggccugagguugaagug

SEQ ID NO: 8950 - RNA, 21 nt, Human
uccaggggccagcacccaagc

SEQ ID NO: 8951 - RNA, 19 nt, Human
uccaggggcuccaccuccu

SEQ ID NO: 8952 - RNA, 22 nt, Human
uccaggggcugucuuggaaucu

SEQ ID NO: 8953 - RNA, 22 nt, Human
uccagguacucauuggcuguua

SEQ ID NO: 8954 - RNA, 22 nt, Human
uccagguaggccaagacagcua

SEQ ID NO: 8955 - RNA, 22 nt, Human
uccagguaucuggcuuccacau

SEQ ID NO: 8956 - RNA, 22 nt, Human
uccagguaucuuuaugaaacuu

SEQ ID NO: 8957 - RNA, 22 nt, Human
uccagguaugacaggccacucc

SEQ ID NO: 8958 - RNA, 22 nt, Human
uccagguaugacauggcuguuu

SEQ ID NO: 8959 - RNA, 22 nt, Human
uccagguccagagguucaacug

SEQ ID NO: 8960 - RNA, 22 nt, Human
uccaggucccuggggagauuuu

SEQ ID NO: 8961 - RNA, 22 nt, Human
uccaggucuggccugcuaggca

SEQ ID NO: 8962 - RNA, 22 nt, Human
uccaggucugguuggacagguu

SEQ ID NO: 8963 - RNA, 22 nt, Human
uccaggucuuccuauuccaggu

SEQ ID NO: 8964 - RNA, 22 nt, Human
uccaggugugcucugugcccug

SEQ ID NO: 8965 - RNA, 22 nt, Human
uccagguuuucugaaggcagga

SEQ ID NO: 8966 - RNA, 22 nt, Human
uccaguacaggucucucauuuc

SEQ ID NO: 8967 - RNA, 22 nt, Human
uccaguaucaaaguccuagucc

SEQ ID NO: 8968 - RNA, 22 nt, Human
uccagucaugguguccucacaa

SEQ ID NO: 8969 - RNA, 22 nt, Human
uccagucccuugccuccacagc

SEQ ID NO: 8970 - RNA, 22 nt, Human
uccaguccuagaaacuggagag

SEQ ID NO: 8971 - RNA, 23 nt, Human
uccagucuccugaaaggcagcgu

SEQ ID NO: 8972 - RNA, 22 nt, Human
uccagugcaauggcucauucau

SEQ ID NO: 8973 - RNA, 22 nt, Human
uccagugcauucagacacuugg

SEQ ID NO: 8974 - RNA, 22 nt, Human
uccaguggcaccuuggcccuca

SEQ ID NO: 8975 - RNA, 22 nt, Human
uccaguggcaggcggugagguc

SEQ ID NO: 8976 - RNA, 22 nt, Human
gggcagcauaacaaucacugaa

SEQ ID NO: 8977 - RNA, 22 nt, Human
gggcagcaucaggaggggcuuu

SEQ ID NO: 8978 - RNA, 22 nt, Human
gggcagcucggaagugggaaag

SEQ ID NO: 8979 - RNA, 22 nt, Human
gggcagcucuuugguauccuuc

SEQ ID NO: 8980 - RNA, 22 nt, Human
gggcagcugcagggauggugac

SEQ ID NO: 8981 - RNA, 22 nt, Human
gggcagcugccaagugcaucgc

SEQ ID NO: 8982 - RNA, 22 nt, Human
gggcagcugccacuccgcuugc

SEQ ID NO: 8983 - RNA, 22 nt, Human
gggcagcugccccucucugggc

SEQ ID NO: 8984 - RNA, 22 nt, Human
gggcagcuggccagguauucug

SEQ ID NO: 8985 - RNA, 22 nt, Human
gggcagcugucuugguucucaa

SEQ ID NO: 8986 - RNA, 23 nt, Human
gggcagcuuaagcuuguuuuucu

SEQ ID NO: 8987 - RNA, 22 nt, Human
gggcaggagaagguggaugucc

SEQ ID NO: 8988 - RNA, 22 nt, Human
gggcaggagagaacagucaugg

SEQ ID NO: 8989 - RNA, 22 nt, Human
gggcagggguagcauuccaagu

SEQ ID NO: 8990 - RNA, 21 nt, Human
gggcaggucucugaugucaac

SEQ ID NO: 8991 - RNA, 22 nt, Human
gggcagucacagugcuggagca

SEQ ID NO: 8992 - RNA, 22 nt, Human
gggcagugaauauuggugggaa

SEQ ID NO: 8993 - RNA, 19 nt, Human
gggcaguggcacuagggag

SEQ ID NO: 8994 - RNA, 20 nt, Human
gggcaguggcgcuaucucag

SEQ ID NO: 8995 - RNA, 22 nt, Human
gggcaguggguggcugcagccu

SEQ ID NO: 8996 - RNA, 22 nt, Human
gggcagugucuggcccccaggc

SEQ ID NO: 8997 - RNA, 22 nt, Human
gggcaguguugugguucucuau

SEQ ID NO: 8998 - RNA, 22 nt, Human
gggcaguugauggaggucugga

SEQ ID NO: 8999 - RNA, 22 nt, Human
gggcaucugguggagccucagg

SEQ ID NO: 9000 - RNA, 22 nt, Human
gggcaugcaggacuguggcaga

SEQ ID NO: 9001 - RNA, 22 nt, Human
gggcaugccugagccugccacu

SEQ ID NO: 9002 - RNA, 22 nt, Human
gggcaugguggugcacaccugu

SEQ ID NO: 9003 - RNA, 22 nt, Human
gggcauguacauaaucuagaaa

SEQ ID NO: 9004 - RNA, 22 nt, Human
gggcauguagugugcauagaga

SEQ ID NO: 9005 - RNA, 22 nt, Human
gggcauuucuugucaauguagg

SEQ ID NO: 9006 - RNA, 22 nt, Human
gggccaagggugcguggcagga

SEQ ID NO: 9007 - RNA, 22 nt, Human
gggccacaggccuugcccgcag

SEQ ID NO: 9008 - RNA, 21 nt, Human
gggccacucuagagaaagaaa

SEQ ID NO: 9009 - RNA, 22 nt, Human
gggccagaccucuucucaggga

SEQ ID NO: 9010 - RNA, 22 nt, Human
gggccagcaguaucggaggcau

SEQ ID NO: 9011 - RNA, 22 nt, Human
gggccagcucugugauguaggg

SEQ ID NO: 9012 - RNA, 22 nt, Human
gggccaggucggugaaugguca

SEQ ID NO: 9013 - RNA, 22 nt, Human
gggcccagcgugguuccaucug

SEQ ID NO: 9014 - RNA, 22 nt, Human
gggccccaaaaugccaggcucu

SEQ ID NO: 9015 - RNA, 22 nt, Human
gggccccuugcugcucugcugg

SEQ ID NO: 9016 - RNA, 22 nt, Human
gggcccugccccguggcucuga

SEQ ID NO: 9017 - RNA, 22 nt, Human
gggcccugcgacucgcggcgga

SEQ ID NO: 9018 - RNA, 22 nt, Human
gggcccuggggauguggacgcg

SEQ ID NO: 9019 - RNA, 22 nt, Human
gggccguagaccacguccgggc

SEQ ID NO: 9020 - RNA, 22 nt, Human
gggccucaccucuccaccgccu

SEQ ID NO: 9021 - RNA, 22 nt, Human
gggccucagguucuggagaagg

SEQ ID NO: 9022 - RNA, 22 nt, Human
gggccugacugagagcuccuca

SEQ ID NO: 9023 - RNA, 22 nt, Human
gggccugagacugagggugagg

SEQ ID NO: 9024 - RNA, 22 nt, Human
gggccugggaacuugcauuuag

SEQ ID NO: 9025 - RNA, 22 nt, Human
gggccugucucacucccugguu

SEQ ID NO: 9026 - RNA, 22 nt, Human
gggccuucuaguuagccccaau

SEQ ID NO: 9027 - RNA, 23 nt, Human
gggccuuggauuuguggaguuca

SEQ ID NO: 9028 - RNA, 22 nt, Human
gggcgcugggugucgagacuca

SEQ ID NO: 9029 - RNA, 22 nt, Human
gggcgggguggcucaugccugu

SEQ ID NO: 9030 - RNA, 22 nt, Human
gggcguggauggucagugcagg

SEQ ID NO: 9031 - RNA, 22 nt, Human
gggcuaagugaagauugcucca

SEQ ID NO: 9032 - RNA, 22 nt, Human
gggcuagaaguuagcuagagaa

SEQ ID NO: 9033 - RNA, 22 nt, Human
gggcuagggccugcuaugguuu

SEQ ID NO: 9034 - RNA, 20 nt, Human
gggcuagguagccauuuggc

SEQ ID NO: 9035 - RNA, 22 nt, Human
gggcucaggaguuugaggcugc

SEQ ID NO: 9036 - RNA, 22 nt, Human
gggcucaggccuggccucucac

SEQ ID NO: 9037 - RNA, 22 nt, Human
gggcucagggacacaugugugu

SEQ ID NO: 9038 - RNA, 21 nt, Human
gggcucaguggaaaagagugu

SEQ ID NO: 9039 - RNA, 22 nt, Human
gggcuccaaaaucuaugucuuc

SEQ ID NO: 9040 - RNA, 22 nt, Human
gggcuccaaggaggccagccug

SEQ ID NO: 9041 - RNA, 22 nt, Human
gggcuccagcuguuugccauga

SEQ ID NO: 9042 - RNA, 22 nt, Human
gggcuccaguuguccccaggau

SEQ ID NO: 9043 - RNA, 22 nt, Human
gggcuccaguuuggccaggaag

SEQ ID NO: 9044 - RNA, 22 nt, Human
gggcuccgcccuuggcugagcu

SEQ ID NO: 9045 - RNA, 22 nt, Human
gggcugugcugaguaggaggug

SEQ ID NO: 9046 - RNA, 22 nt, Human
gggcuguggagccgcgagggcu

SEQ ID NO: 9047 - RNA, 22 nt, Human
gggcuguuugcauauguuuaua

SEQ ID NO: 9048 - RNA, 22 nt, Human
gggcuuaaggccagugugcuuu

SEQ ID NO: 9049 - RNA, 22 nt, Human
gggcuucucugaucaauauuuc

SEQ ID NO: 9050 - RNA, 22 nt, Human
gggcuucucuuaugcuaacugg

SEQ ID NO: 9051 - RNA, 19 nt, Human
gggcuucugggaucaagag

SEQ ID NO: 9052 - RNA, 22 nt, Human
gggcuucuguuccuuucacuug

SEQ ID NO: 9053 - RNA, 22 nt, Human
gggcuucuugcaggggcaacau

SEQ ID NO: 9054 - RNA, 22 nt, Human
gggcuugcuuaaggucacccgg

SEQ ID NO: 9055 - RNA, 20 nt, Human
gggcuuggaggacucgaggg

SEQ ID NO: 9056 - RNA, 22 nt, Human
gggcuuggaguaggcugaugaa

SEQ ID NO: 9057 - RNA, 22 nt, Human
gggcuugguggagagaaugcug

SEQ ID NO: 9058 - RNA, 19 nt, Human
gggcuuuacuccaaguggg

SEQ ID NO: 9059 - RNA, 23 nt, Human
ggggaaagaccaugcuugaggac

SEQ ID NO: 9060 - RNA, 22 nt, Human
ggggaaauuguggcugacagug

SEQ ID NO: 9061 - RNA, 22 nt, Human
ggggaagaaaucuggguucuuc

SEQ ID NO: 9062 - RNA, 22 nt, Human
ggggaagaaugcucucuagaga

SEQ ID NO: 9063 - RNA, 22 nt, Human
ggggaagucggagccugagcac

SEQ ID NO: 9064 - RNA, 22 nt, Human
ggggacagucgaucuagugauu

SEQ ID NO: 9065 - RNA, 22 nt, Human
ggggacaguuaaagaccaagac

SEQ ID NO: 9066 - RNA, 22 nt, Human
ggggacccucaggacugcgucu

SEQ ID NO: 9067 - RNA, 22 nt, Human
ggggaccugggcuucaaggguu

SEQ ID NO: 9068 - RNA, 22 nt, Human
ggggaccuuuccauuucugaga

SEQ ID NO: 9069 - RNA, 22 nt, Human
ggggacgggacuuagcaugagu

SEQ ID NO: 9070 - RNA, 22 nt, Human
ggggacugaggcacugaaggug

SEQ ID NO: 9071 - RNA, 22 nt, Human
ggggacugccuuccacagacac

SEQ ID NO: 9072 - RNA, 19 nt, Human
ggggagaacuagagacagc

SEQ ID NO: 9073 - RNA, 22 nt, Human
ggggagcuugguuauucaugca

SEQ ID NO: 9074 - RNA, 22 nt, Human
ggggaggaagcuggaacacggg

SEQ ID NO: 9075 - RNA, 22 nt, Human
ggggaggagccauguaacuagu

SEQ ID NO: 9076 - RNA, 22 nt, Human
ggggaggccaguggaccguccc

SEQ ID NO: 9077 - RNA, 22 nt, Human
ggggagugacgcagggccauag

SEQ ID NO: 9078 - RNA, 22 nt, Human
ggggaguguuuucaugggcuug

SEQ ID NO: 9079 - RNA, 22 nt, Human
ggggauggaauguaguagugau

SEQ ID NO: 9080 - RNA, 22 nt, Human
ggggcacacuuuugguagauau

SEQ ID NO: 9081 - RNA, 22 nt, Human
ggggcaccuccucuuggcaauu

SEQ ID NO: 9082 - RNA, 22 nt, Human
ggggcacuuuacugccucaucu

SEQ ID NO: 9083 - RNA, 22 nt, Human
ggggcagcuaccggaaguaggg

SEQ ID NO: 9084 - RNA, 22 nt, Human
ggggcaggagguguucucuuuu

SEQ ID NO: 9085 - RNA, 22 nt, Human
ggggccacuggcaggaccuugg

SEQ ID NO: 9086 - RNA, 22 nt, Human
ggggccccucggacacgugcgg

SEQ ID NO: 9087 - RNA, 19 nt, Human
ggggcccggggucugcgag

SEQ ID NO: 9088 - RNA, 22 nt, Human
ggggcccuuguggcugcaggcc

SEQ ID NO: 9089 - RNA, 15 nt, Human
ggugucugcagugug

SEQ ID NO: 9090 - RNA, 22 nt, Human
ggugucuguugccuccugguua

SEQ ID NO: 9091 - RNA, 22 nt, Human
ggugugaauuuugaccuuuuaa

SEQ ID NO: 9092 - RNA, 22 nt, Human
ggugugacucgcccucagggac

SEQ ID NO: 9093 - RNA, 22 nt, Human
ggugugauuaugacaugugacu

SEQ ID NO: 9094 - RNA, 22 nt, Human
ggugugcaggcuaucacagaca

SEQ ID NO: 9095 - RNA, 22 nt, Human
ggugugcuaagagcacuuucaa

SEQ ID NO: 9096 - RNA, 22 nt, Human
gguguggcaguggaccugugaa

SEQ ID NO: 9097 - RNA, 22 nt, Human
ggugugggcccugaugucagca

SEQ ID NO: 9098 - RNA, 19 nt, Human
ggugugugcuggggccugu

SEQ ID NO: 9099 - RNA, 22 nt, Human
gguguuaacuuguuuaugacaa

SEQ ID NO: 9100 - RNA, 22 nt, Human
gguguucaaaugaacacaugca

SEQ ID NO: 9101 - RNA, 22 nt, Human
gguuaaaacugauauuaugggu

SEQ ID NO: 9102 - RNA, 22 nt, Human
gguuaaaaucuaaaaugugacu

SEQ ID NO: 9103 - RNA, 22 nt, Human
gguuaaggcuuuacagucaaac

SEQ ID NO: 9104 - RNA, 19 nt, Human
gguuaauguuaggauacuu

SEQ ID NO: 9105 - RNA, 22 nt, Human
gguuauuguggagaaguuccgg

SEQ ID NO: 9106 - RNA, 22 nt, Human
gguucacacuaagcuuaagugg

SEQ ID NO: 9107 - RNA, 22 nt, Human
gguucacauauugagaguauuc

SEQ ID NO: 9108 - RNA, 22 nt, Human
gguucagggcuaccagugggug

SEQ ID NO: 9109 - RNA, 22 nt, Human
gguucaguuuacauuaaaaucu

SEQ ID NO: 9110 - RNA, 22 nt, Human
gguuccccaggcggcccuugga

SEQ ID NO: 9111 - RNA, 22 nt, Human
gguucccggaucuccgaguccc

SEQ ID NO: 9112 - RNA, 19 nt, Human
gguuccucacgcuaagggc

SEQ ID NO: 9113 - RNA, 23 nt, Human
gguuccugagcagggaucuggaa

SEQ ID NO: 9114 - RNA, 22 nt, Human
gguuccugauagauuccuuuug

SEQ ID NO: 9115 - RNA, 22 nt, Human
gguuccuggcagauguagggcu

SEQ ID NO: 9116 - RNA, 22 nt, Human
gguuccuguacuuagcuaugua

SEQ ID NO: 9117 - RNA, 22 nt, Human
gguuccugugccucuagcuggc

SEQ ID NO: 9118 - RNA, 22 nt, Human
gguucuaggucuggggauaaug

SEQ ID NO: 9119 - RNA, 22 nt, Human
gguucuccuugagugucccagg

SEQ ID NO: 9120 - RNA, 22 nt, Human
gguugaaucauucuuugcaccg

SEQ ID NO: 9121 - RNA, 22 nt, Human
gguugcauuucucaguggaaua

SEQ ID NO: 9122 - RNA, 23 nt, Human
gguuggcuguacccaggcucccu

SEQ ID NO: 9123 - RNA, 22 nt, Human
gguuuaaugggugaaggcauga

SEQ ID NO: 9124 - RNA, 22 nt, Human
gguuuaauuaccugcaucucaa

SEQ ID NO: 9125 - RNA, 22 nt, Human
gguuuacucguaguggcgguuu

SEQ ID NO: 9126 - RNA, 22 nt, Human
gguuucaaaguggacaguuagu

SEQ ID NO: 9127 - RNA, 22 nt, Human
gguuucaacuaaaucaagaagg

SEQ ID NO: 9128 - RNA, 22 nt, Human
gguuucaacuucaaccucucca

SEQ ID NO: 9129 - RNA, 22 nt, Human
gguuucaacuuuugugaggaau

SEQ ID NO: 9130 - RNA, 22 nt, Human
gguuuccaagugguugaaaagu

SEQ ID NO: 9131 - RNA, 22 nt, Human
gguuuccaggagaagagauuug

SEQ ID NO: 9132 - RNA, 22 nt, Human
gguuucucuagggcugaccagu

SEQ ID NO: 9133 - RNA, 22 nt, Human
gguuugcacgauauuuccaugg

SEQ ID NO: 9134 - RNA, 22 nt, Human
gguuugcauucugaaaggcuca

SEQ ID NO: 9135 - RNA, 22 nt, Human
gguuuucaaagaggcauuucau

SEQ ID NO: 9136 - RNA, 22 nt, Human
guaaaaaggccaagcccuugug

SEQ ID NO: 9137 - RNA, 22 nt, Human
guaaaaggucaaggccaagucu

SEQ ID NO: 9138 - RNA, 20 nt, Human
guaaaauauggucuuugggu

SEQ ID NO: 9139 - RNA, 22 nt, Human
guaaaauucuagcaucugaaag

SEQ ID NO: 9140 - RNA, 22 nt, Human
guaaacaauagcauugccugau

SEQ ID NO: 9141 - RNA, 22 nt, Human
guaaacacuacaaaucaaggcu

SEQ ID NO: 9142 - RNA, 22 nt, Human
guaaacaggaauguggucaugg

SEQ ID NO: 9143 - RNA, 22 nt, Human
guaaacaucgacccaacagggg

SEQ ID NO: 9144 - RNA, 22 nt, Human
guaaacaugcuguguacucagc

SEQ ID NO: 9145 - RNA, 22 nt, Human
guaaacauuuucaucugugccc

SEQ ID NO: 9146 - RNA, 22 nt, Human
guaaagcagguaguugggacac

SEQ ID NO: 9147 - RNA, 16 nt, Human
guaaaggcagggaauu

SEQ ID NO: 9148 - RNA, 22 nt, Human
guaaaguucuauuugaauuuag

SEQ ID NO: 9149 - RNA, 22 nt, Human
guaaauauucccucgguuccua

SEQ ID NO: 9150 - RNA, 22 nt, Human
guaaaugugaaugucauuuagc

SEQ ID NO: 9151 - RNA, 22 nt, Human
guaaaugugacuccaccugagu

SEQ ID NO: 9152 - RNA, 22 nt, Human
guaaaugugcuucuuuuaacuu

SEQ ID NO: 9153 - RNA, 22 nt, Human
guaaauguugcauuuaugggua

SEQ ID NO: 9154 - RNA, 20 nt, Human
ucccacugggccucaguuuc

SEQ ID NO: 9155 - RNA, 22 nt, Human
ucccacugucugucuugcugca

SEQ ID NO: 9156 - RNA, 22 nt, Human
ucccacugugccuguuguaauc

SEQ ID NO: 9157 - RNA, 22 nt, Human
ucccagaagagaugccacuuga

SEQ ID NO: 9158 - RNA, 22 nt, Human
ucccagaagugaaauuucuaga

SEQ ID NO: 9159 - RNA, 22 nt, Human
ucccagaaucuuuggaagagca

SEQ ID NO: 9160 - RNA, 22 nt, Human
ucccagagacaucauuucuccg

SEQ ID NO: 9161 - RNA, 22 nt, Human
ucccagagccaagcuauggaug

SEQ ID NO: 9162 - RNA, 22 nt, Human
ucccagaggacuguuggugcua

SEQ ID NO: 9163 - RNA, 22 nt, Human
ucccagaggucucugcugguuc

SEQ ID NO: 9164 - RNA, 22 nt, Human
ucccagagucagagguggggcc

SEQ ID NO: 9165 - RNA, 22 nt, Human
ucccagcagggccgaccagccu

SEQ ID NO: 9166 - RNA, 22 nt, Human
ucccagcagucagagcuaugug

SEQ ID NO: 9167 - RNA, 22 nt, Human
ucccagccauuccuuuaggugu

SEQ ID NO: 9168 - RNA, 22 nt, Human
ucccagcccagauuugugugac

SEQ ID NO: 9169 - RNA, 22 nt, Human
ucccagcccagguaugaugaua

SEQ ID NO: 9170 - RNA, 23 nt, Human
ucccagccucuucucuugcauac

SEQ ID NO: 9171 - RNA, 22 nt, Human
ucccagccuuaucuccccuggc

SEQ ID NO: 9172 - RNA, 22 nt, Human
ucccagccuuccuuguggugaa

SEQ ID NO: 9173 - RNA, 22 nt, Human
ucccagccuuucuuuucugcug

SEQ ID NO: 9174 - RNA, 22 nt, Human
ucccagcuacucuagaggcuga

SEQ ID NO: 9175 - RNA, 22 nt, Human
ucccagcucacauaugguaacu

SEQ ID NO: 9176 - RNA, 22 nt, Human
ucccagcugagauugagcaagg

SEQ ID NO: 9177 - RNA, 21 nt, Human
ucccagcugggucagugcugc

SEQ ID NO: 9178 - RNA, 19 nt, Human
ucccaggaaccuuuuauuu

SEQ ID NO: 9179 - RNA, 22 nt, Human
ucccaggaagaucccagggacc

SEQ ID NO: 9180 - RNA, 22 nt, Human
ucccaggaauccguccucuaga

SEQ ID NO: 9181 - RNA, 22 nt, Human
ucccaggacaggccacauggaa

SEQ ID NO: 9182 - RNA, 22 nt, Human
ucccaggauguuuauggcuggu

SEQ ID NO: 9183 - RNA, 22 nt, Human
ucccaggcaaaggcagcucauu

SEQ ID NO: 9184 - RNA, 22 nt, Human
ucccaggcagcuucuuucauca

SEQ ID NO: 9185 - RNA, 22 nt, Human
ucccaggcaggugacaggggga

SEQ ID NO: 9186 - RNA, 16 nt, Human
ucccaggccaggugga

SEQ ID NO: 9187 - RNA, 22 nt, Human
ucccaggcgccugguggggagc

SEQ ID NO: 9188 - RNA, 22 nt, Human
ucccaggcuaccagugagguca

SEQ ID NO: 9189 - RNA, 22 nt, Human
ucccaggcuggggccaggugac

SEQ ID NO: 9190 - RNA, 23 nt, Human
ucccagggaaggugagcgaggcu

SEQ ID NO: 9191 - RNA, 22 nt, Human
ucccagggacugggcuaggcuu

SEQ ID NO: 9192 - RNA, 22 nt, Human
ucccagggcuuuucucaugcuu

SEQ ID NO: 9193 - RNA, 22 nt, Human
ucccagucuagagccggauugg

SEQ ID NO: 9194 - RNA, 22 nt, Human
ucccagugcuacagacagggca

SEQ ID NO: 9195 - RNA, 22 nt, Human
ucccagugcugcuaaagaggua

SEQ ID NO: 9196 - RNA, 22 nt, Human
ucccaguggcuucauaaggcag

SEQ ID NO: 9197 - RNA, 22 nt, Human
ucccauauaugcaaaaauguaa

SEQ ID NO: 9198 - RNA, 18 nt, Human
ucccaucauccucuccag

SEQ ID NO: 9199 - RNA, 22 nt, Human
ucccaugugacucagcugccug

SEQ ID NO: 9200 - RNA, 22 nt, Human
ucccauguguuccucuagucua

SEQ ID NO: 9201 - RNA, 22 nt, Human
ucccauguuagguguuucuguu

SEQ ID NO: 9202 - RNA, 22 nt, Human
ucccauuuauuaauuaguuugc

SEQ ID NO: 9203 - RNA, 22 nt, Human
ucccauuucacaacaaaacugg

SEQ ID NO: 9204 - RNA, 22 nt, Human
uccccaaguaaagauccugaga

SEQ ID NO: 9205 - RNA, 22 nt, Human
gucaccagcaccaaugccacau

SEQ ID NO: 9206 - RNA, 22 nt, Human
gucaccaggucugaugcagcca

SEQ ID NO: 9207 - RNA, 22 nt, Human
gucaccagucccagcuccugaa

SEQ ID NO: 9208 - RNA, 22 nt, Human
gucaccauggauaagaaucacu

SEQ ID NO: 9209 - RNA, 22 nt, Human
gucacccugcuggcuguucagc

SEQ ID NO: 9210 - RNA, 18 nt, Human
gucaccuggaucagauua

SEQ ID NO: 9211 - RNA, 22 nt, Human
gucacuguauccagguuccagc

SEQ ID NO: 9212 - RNA, 17 nt, Human
gucacugucuaaugaag

SEQ ID NO: 9213 - RNA, 18 nt, Human
gucacuguguuucugagc

SEQ ID NO: 9214 - RNA, 22 nt, Human
gucacuuuacacuccuacuaaa

SEQ ID NO: 9215 - RNA, 22 nt, Human
gucacuuugaagcuguuuuuag

SEQ ID NO: 9216 - RNA, 22 nt, Human
gucacuuuuaagggccuuuucu

SEQ ID NO: 9217 - RNA, 22 nt, Human
gucagaaaacuucccuuugagu

SEQ ID NO: 9218 - RNA, 22 nt, Human
gucagaagcauuuguggcugaa

SEQ ID NO: 9219 - RNA, 22 nt, Human
gucagacacauuucuuucagug

SEQ ID NO: 9220 - RNA, 22 nt, Human
gucagagauggcaugaaagauu

SEQ ID NO: 9221 - RNA, 22 nt, Human
gucagagcuggaggcaaguucu

SEQ ID NO: 9222 - RNA, 18 nt, Human
gucagaggauggggaaau

SEQ ID NO: 9223 - RNA, 22 nt, Human
gucagaugauacacuguuguca

SEQ ID NO: 9224 - RNA, 22 nt, Human
gucagcaaaaaauuuaugugag

SEQ ID NO: 9225 - RNA, 19 nt, Human
gucagcaccauggacaggg

SEQ ID NO: 9226 - RNA, 21 nt, Human
gucagcagauccagcacuugu

SEQ ID NO: 9227 - RNA, 22 nt, Human
gucagcagcauguuuaaucaaa

SEQ ID NO: 9228 - RNA, 17 nt, Human
gucagcagcuugcuugu

SEQ ID NO: 9229 - RNA, 22 nt, Human
gucagcaggguccccuugagug

SEQ ID NO: 9230 - RNA, 22 nt, Human
gucagcaguggcagcucccggg

SEQ ID NO: 9231 - RNA, 22 nt, Human
gucagcagugucagcucugggg

SEQ ID NO: 9232 - RNA, 22 nt, Human
gucagcaugagcaagggcugac

SEQ ID NO: 9233 - RNA, 22 nt, Human
gucagcuaugucuguuguugag

SEQ ID NO: 9234 - RNA, 22 nt, Human
gucagcucagcaggugggagug

SEQ ID NO: 9235 - RNA, 22 nt, Human
gucagcuccuagcaccccccaa

SEQ ID NO: 9236 - RNA, 19 nt, Human
gucagcuggaacucugaaa

SEQ ID NO: 9237 - RNA, 22 nt, Human
gucagcugggcaucugcagaug

SEQ ID NO: 9238 - RNA, 22 nt, Human
gucagcugucuccccagagugg

SEQ ID NO: 9239 - RNA, 22 nt, Human
gucagcuucccuuugguuuauu

SEQ ID NO: 9240 - RNA, 22 nt, Human
gucaggaaaaauugauaauuuu

SEQ ID NO: 9241 - RNA, 22 nt, Human
gucaggaagcaagguugggcau

SEQ ID NO: 9242 - RNA, 22 nt, Human
gucaggaaguggcauuggagaa

SEQ ID NO: 9243 - RNA, 22 nt, Human
gucaggagagaucaggacagca

SEQ ID NO: 9244 - RNA, 22 nt, Human
gucaggauuggggucaugaguc

SEQ ID NO: 9245 - RNA, 22 nt, Human
gucaggauuuacaaacuucagu

SEQ ID NO: 9246 - RNA, 19 nt, Human
gucaggcacgugagagcau

SEQ ID NO: 9247 - RNA, 18 nt, Human
gucaggcaugaaucuggg

SEQ ID NO: 9248 - RNA, 22 nt, Human
gucaggccaauacucuccagca

SEQ ID NO: 9249 - RNA, 22 nt, Human
gucaggcugccagucuuuauug

SEQ ID NO: 9250 - RNA, 22 nt, Human
gucaggggaugugcugguggcc

SEQ ID NO: 9251 - RNA, 22 nt, Human
gucaggucuuggaagauaggcu

SEQ ID NO: 9252 - RNA, 22 nt, Human
gucaguaggaaccuagggucaa

SEQ ID NO: 9253 - RNA, 22 nt, Human
gucagugguagggcuaguucag

SEQ ID NO: 9254 - RNA, 22 nt, Human
gucagugugagauaaucuugga

SEQ ID NO: 9255 - RNA, 22 nt, Human
gucaguguuuaacaaccagcuc

SEQ ID NO: 9256 - RNA, 22 nt, Human
gucaguuauucaauugguuuaa

SEQ ID NO: 9257 - RNA, 22 nt, Human
gucauaaaaggaccaccuauug

SEQ ID NO: 9258 - RNA, 22 nt, Human
gucauaaagacagaaacauucc

SEQ ID NO: 9259 - RNA, 22 nt, Human
gucauaggcauggauguggguu

SEQ ID NO: 9260 - RNA, 22 nt, Human
gucauauagguaggauucagcu

SEQ ID NO: 9261 - RNA, 22 nt, Human
gucaucauuuuuagcauauggg

SEQ ID NO: 9262 - RNA, 22 nt, Human
gucaucuucgcagagugauuuu

SEQ ID NO: 9263 - RNA, 22 nt, Human
gucaugccagcggagcucggga

SEQ ID NO: 9264 - RNA, 22 nt, Human
guccuugguaugaccaagguuu

SEQ ID NO: 9265 - RNA, 22 nt, Human
gucguggagcucacagugugcc

SEQ ID NO: 9266 - RNA, 22 nt, Human
gucuaaacacaaugcaagaagu

SEQ ID NO: 9267 - RNA, 22 nt, Human
gucuaaacuuuacagagucaag

SEQ ID NO: 9268 - RNA, 22 nt, Human
gucuaaagcccuuagaauagua

SEQ ID NO: 9269 - RNA, 22 nt, Human
gucuagaaaaugccgagggaug

SEQ ID NO: 9270 - RNA, 22 nt, Human
gucuagaaauagguuucagaaa

SEQ ID NO: 9271 - RNA, 19 nt, Human
gucuagaacauuguaggug

SEQ ID NO: 9272 - RNA, 22 nt, Human
gucuagaauugcuuggcagaug

SEQ ID NO: 9273 - RNA, 22 nt, Human
gucuagcacaucaucucacugc

SEQ ID NO: 9274 - RNA, 22 nt, Human
gucuauaagcaggggaaaacuu

SEQ ID NO: 9275 - RNA, 22 nt, Human
gucucaagggggaacucacugu

SEQ ID NO: 9276 - RNA, 20 nt, Human
gucucagaauggauuugcau

SEQ ID NO: 9277 - RNA, 22 nt, Human
gucucagaccacccucuuuggc

SEQ ID NO: 9278 - RNA, 18 nt, Human
gucucaggaguggcacgu

SEQ ID NO: 9279 - RNA, 22 nt, Human
gucucaguuugaagugaugcca

SEQ ID NO: 9280 - RNA, 20 nt, Human
gucuccacuggggguuaacc

SEQ ID NO: 9281 - RNA, 22 nt, Human
gucuccagaagccuagacagcc

SEQ ID NO: 9282 - RNA, 22 nt, Human
gucuccagaauucuugggaggg

SEQ ID NO: 9283 - RNA, 22 nt, Human
gucuccagauauccuacacaac

SEQ ID NO: 9284 - RNA, 22 nt, Human
gucuccagggacacacuagccg

SEQ ID NO: 9285 - RNA, 22 nt, Human
gucuccaguuacagcagccagg

SEQ ID NO: 9286 - RNA, 22 nt, Human
gucuccuccaguaggaaguggc

SEQ ID NO: 9287 - RNA, 22 nt, Human
gucuccugccacacucaguccc

SEQ ID NO: 9288 - RNA, 22 nt, Human
gucuccugcccccggugcuugg

SEQ ID NO: 9289 - RNA, 22 nt, Human
gucuccuggaaauaugcccaua

SEQ ID NO: 9290 - RNA, 22 nt, Human
gucuccuggccuccaguuucuc

SEQ ID NO: 9291 - RNA, 22 nt, Human
gucuccuuguggaucucaagga

SEQ ID NO: 9292 - RNA, 22 nt, Human
gucucucaaaacuagaagagaa

SEQ ID NO: 9293 - RNA, 22 nt, Human
gucucugugguacguuucaucc

SEQ ID NO: 9294 - RNA, 22 nt, Human
gucucugugucugagagagccc

SEQ ID NO: 9295 - RNA, 22 nt, Human
gucucuuagucucauuuucugc

SEQ ID NO: 9296 - RNA, 22 nt, Human
gucucuuaugggcaggagcaca

SEQ ID NO: 9297 - RNA, 22 nt, Human
gucucuucuuugccgguccugc

SEQ ID NO: 9298 - RNA, 22 nt, Human
gucugaaaauaugauuuugccu

SEQ ID NO: 9299 - RNA, 22 nt, Human
gucugaaacgcauuguuaucga

SEQ ID NO: 9300 - RNA, 22 nt, Human
gucugacaccuagaguccagga

SEQ ID NO: 9301 - RNA, 22 nt, Human
gucugagacccacucccagaga

SEQ ID NO: 9302 - RNA, 22 nt, Human
gucugagacuuuuucugugugg

SEQ ID NO: 9303 - RNA, 22 nt, Human
gucugagcacccuggccuguca

SEQ ID NO: 9304 - RNA, 22 nt, Human
gucugaggaagaugcaggggga

SEQ ID NO: 9305 - RNA, 20 nt, Human
gucugaggagcagugggaaa

SEQ ID NO: 9306 - RNA, 22 nt, Human
gucugaggcgaggccugagaac

SEQ ID NO: 9307 - RNA, 22 nt, Human
gucugcccaucuccgggcgggg

SEQ ID NO: 9308 - RNA, 22 nt, Human
gucugcccugagcucccagugc

SEQ ID NO: 9309 - RNA, 22 nt, Human
gucugcccugcagacaugccuc

SEQ ID NO: 9310 - RNA, 22 nt, Human
gucugcccuuccucuccacgau

SEQ ID NO: 9311 - RNA, 22 nt, Human
gucugcccuuggccugggacuu

SEQ ID NO: 9312 - RNA, 22 nt, Human
gucugccugucuggaugacaga

SEQ ID NO: 9313 - RNA, 22 nt, Human
gucugcugcagucguggcucua

SEQ ID NO: 9314 - RNA, 22 nt, Human
gucugcuguggguccccaggag

SEQ ID NO: 9315 - RNA, 22 nt, Human
gucuggaaagguauuugucuca

SEQ ID NO: 9316 - RNA, 22 nt, Human
gucuggaaauuaagaggagguu

SEQ ID NO: 9317 - RNA, 22 nt, Human
gucuggaaccaagacguguagc

SEQ ID NO: 9318 - RNA, 22 nt, Human
gucuggagacuugggucaucaa

SEQ ID NO: 9319 - RNA, 22 nt, Human
gucuggagagcugagcagaguu

SEQ ID NO: 9320 - RNA, 22 nt, Human
gucuggaggaggaagaaggcac

SEQ ID NO: 9321 - RNA, 22 nt, Human
gucuggaggagggcucugcggc

SEQ ID NO: 9322 - RNA, 22 nt, Human
gucuggagggaagagaugucag

SEQ ID NO: 9323 - RNA, 22 nt, Human
ggggccuccagcacuaggcagc

SEQ ID NO: 9324 - RNA, 22 nt, Human
ggggccuuuucugaauguggaa

SEQ ID NO: 9325 - RNA, 22 nt, Human
ggggcgccccgagggugcgcac

SEQ ID NO: 9326 - RNA, 22 nt, Human
ggggcucaguucggacagccug

SEQ ID NO: 9327 - RNA, 22 nt, Human
ggggcucugcucugagccgugu

SEQ ID NO: 9328 - RNA, 22 nt, Human
ggggcugaaccuggaggugguc

SEQ ID NO: 9329 - RNA, 22 nt, Human
ggggcugagucagugggaagag

SEQ ID NO: 9330 - RNA, 22 nt, Human
ggggcugcucccaccccugagg

SEQ ID NO: 9331 - RNA, 22 nt, Human
ggggcugcugguauuuccaguu

SEQ ID NO: 9332 - RNA, 22 nt, Human
ggggcuggcucacuaagagacu

SEQ ID NO: 9333 - RNA, 22 nt, Human
ggggcuguugaaguuaguugag

SEQ ID NO: 9334 - RNA, 22 nt, Human
ggggcuuccagcgcccgccggu

SEQ ID NO: 9335 - RNA, 22 nt, Human
gggggaagaaagaacauggcau

SEQ ID NO: 9336 - RNA, 22 nt, Human
gggggaagacugggcuagugau

SEQ ID NO: 9337 - RNA, 22 nt, Human
gggggacuaacuggauccugga

SEQ ID NO: 9338 - RNA, 22 nt, Human
gggggacuggaccguccugggu

SEQ ID NO: 9339 - RNA, 22 nt, Human
gggggagagacgagcggcucug

SEQ ID NO: 9340 - RNA, 22 nt, Human
gggggagcuaguccagcugagg

SEQ ID NO: 9341 - RNA, 22 nt, Human
gggggaugcucaggaggcugcu

SEQ ID NO: 9342 - RNA, 22 nt, Human
gggggccuuauucaucugccag

SEQ ID NO: 9343 - RNA, 22 nt, Human
gggggcgccgccgcucaucuca

SEQ ID NO: 9344 - RNA, 22 nt, Human
gggggcggagcacgugaccacg

SEQ ID NO: 9345 - RNA, 23 nt, Human
gggggcgugucauggagggccac

SEQ ID NO: 9346 - RNA, 22 nt, Human
gggggcugaucauuuacugggc

SEQ ID NO: 9347 - RNA, 22 nt, Human
gggggcuggacuuucccacaca

SEQ ID NO: 9348 - RNA, 22 nt, Human
ggggggcagcuguccuggccau

SEQ ID NO: 9349 - RNA, 22 nt, Human
ggggggugcugaucaguggagc

SEQ ID NO: 9350 - RNA, 22 nt, Human
ggggguaggcagacaaggacau

SEQ ID NO: 9351 - RNA, 22 nt, Human
gggggugacgauggcagcuggu

SEQ ID NO: 9352 - RNA, 16 nt, Human
gggggugagagagagu

SEQ ID NO: 9353 - RNA, 22 nt, Human
gggguccuggaggccagcugga

SEQ ID NO: 9354 - RNA, 22 nt, Human
ggggucugcgccacugucugcg

SEQ ID NO: 9355 - RNA, 22 nt, Human
ggggugagugcucagccccgga

SEQ ID NO: 9356 - RNA, 19 nt, Human
ggggugcuagggagggauc

SEQ ID NO: 9357 - RNA, 22 nt, Human
gggguggagcuaaaugucuacu

SEQ ID NO: 9358 - RNA, 22 nt, Human
gggguggaucaggcaggcccag

SEQ ID NO: 9359 - RNA, 22 nt, Human
ggggugggcgugcagggacacc

SEQ ID NO: 9360 - RNA, 22 nt, Human
gggguguggacggcugugccag

SEQ ID NO: 9361 - RNA, 20 nt, Human
ggguaaaaggcaguguugca

SEQ ID NO: 9362 - RNA, 22 nt, Human
ggguaauuggaaauauuaauag

SEQ ID NO: 9363 - RNA, 22 nt, Human
ggguaauuggggccuugcagug

SEQ ID NO: 9364 - RNA, 22 nt, Human
ggguaggagaggugucugugug

SEQ ID NO: 9365 - RNA, 22 nt, Human
ggguagggugacuuaggcuggc

SEQ ID NO: 9366 - RNA, 22 nt, Human
ggguaguguggucucugggcug

SEQ ID NO: 9367 - RNA, 22 nt, Human
ggguaguuuaauuaggaagaaa

SEQ ID NO: 9368 - RNA, 22 nt, Human
ggguaugauagggaggugaaau

SEQ ID NO: 9369 - RNA, 22 nt, Human
gggucagagccguaacaggacu

SEQ ID NO: 9370 - RNA, 22 nt, Human
gggucagcgauuucaggggcag

SEQ ID NO: 9371 - RNA, 22 nt, Human
gggucaggccucaaggugggcu

SEQ ID NO: 9372 - RNA, 22 nt, Human
gggucaggcuagcccagacuuc

SEQ ID NO: 9373 - RNA, 22 nt, Human
guaaaggcucugauaaguacug

SEQ ID NO: 9374 - RNA, 22 nt, Human
guaaaguucuacuagaaucaac

SEQ ID NO: 9375 - RNA, 22 nt, Human
guaaauauuaaaggcugcuaga

SEQ ID NO: 9376 - RNA, 22 nt, Human
guaaaucauaaaauuugagcuc

SEQ ID NO: 9377 - RNA, 22 nt, Human
guaaaucccauccuuucucugg

SEQ ID NO: 9378 - RNA, 22 nt, Human
guaacaaacgguuccaagaugc

SEQ ID NO: 9379 - RNA, 22 nt, Human
guaacacagaaaugaaauucca

SEQ ID NO: 9380 - RNA, 22 nt, Human
guaacacucuaaagggaugcac

SEQ ID NO: 9381 - RNA, 22 nt, Human
guaacacuggcaccgucucaca

SEQ ID NO: 9382 - RNA, 19 nt, Human
guaacagcucuggguucac

SEQ ID NO: 9383 - RNA, 22 nt, Human
guaacaguuuggguuccaauug

SEQ ID NO: 9384 - RNA, 22 nt, Human
guaacauuauucaugagauaca

SEQ ID NO: 9385 - RNA, 22 nt, Human
guaacauucuagaaacuuaaca

SEQ ID NO: 9386 - RNA, 22 nt, Human
guaaccuggaaguuuagggaag

SEQ ID NO: 9387 - RNA, 22 nt, Human
guaacgaauaaacaagugauaa

SEQ ID NO: 9388 - RNA, 22 nt, Human
guaacugguuuucuucccucuc

SEQ ID NO: 9389 - RNA, 22 nt, Human
guaacuuaccauuguagcauca

SEQ ID NO: 9390 - RNA, 22 nt, Human
guaagaggaucaaggcggugca

SEQ ID NO: 9391 - RNA, 22 nt, Human
guaagauuuaaaauagcaauug

SEQ ID NO: 9392 - RNA, 22 nt, Human
guaagcacaugugugugcaugg

SEQ ID NO: 9393 - RNA, 22 nt, Human
guaagcauucauugucuguaua

SEQ ID NO: 9394 - RNA, 22 nt, Human
guaagccugagaaacaccaccu

SEQ ID NO: 9395 - RNA, 22 nt, Human
guaagccuggaauuuuugacuu

SEQ ID NO: 9396 - RNA, 19 nt, Human
guaagggcuaauggacuau

SEQ ID NO: 9397 - RNA, 22 nt, Human
guaaguaauaagugcucaauaa

SEQ ID NO: 9398 - RNA, 22 nt, Human
guaaguuacucuugggcuauuu

SEQ ID NO: 9399 - RNA, 22 nt, Human
guaauaccuuucuaacacuuga

SEQ ID NO: 9400 - RNA, 22 nt, Human
guaauagaugaaacaaugugga

SEQ ID NO: 9401 - RNA, 22 nt, Human
guaauccaaaguaacauuaaac

SEQ ID NO: 9402 - RNA, 23 nt, Human
guaaugaugggaauuuacuuaga

SEQ ID NO: 9403 - RNA, 22 nt, Human
guaaugcuuuugauacagggac

SEQ ID NO: 9404 - RNA, 22 nt, Human
guaauuacauuaggguaaauaa

SEQ ID NO: 9405 - RNA, 22 nt, Human
guaauugaacauuaaguugaag

SEQ ID NO: 9406 - RNA, 22 nt, Human
guacaaaugaaaauagaccacu

SEQ ID NO: 9407 - RNA, 22 nt, Human
guacaaauugauacagguuuuc

SEQ ID NO: 9408 - RNA, 19 nt, Human
guacaacaaugcugagcau

SEQ ID NO: 9409 - RNA, 22 nt, Human
guacaaguguauuuggcuugau

SEQ ID NO: 9410 - RNA, 22 nt, Human
guacaauagucccuguuuggau

SEQ ID NO: 9411 - RNA, 22 nt, Human
guacaauuauuuaaauggugaa

SEQ ID NO: 9412 - RNA, 21 nt, Human
guacacacagguggaugggcu

SEQ ID NO: 9413 - RNA, 22 nt, Human
guacacacuauguauuguacac

SEQ ID NO: 9414 - RNA, 22 nt, Human
guacacacuauuuaaaguguuu

SEQ ID NO: 9415 - RNA, 22 nt, Human
guacacauugucuguuuacuuc

SEQ ID NO: 9416 - RNA, 22 nt, Human
guacacuauuaaaccugcucau

SEQ ID NO: 9417 - RNA, 22 nt, Human
guacacucccccugugaaguug

SEQ ID NO: 9418 - RNA, 22 nt, Human
guacacuugucuugaacagccu

SEQ ID NO: 9419 - RNA, 22 nt, Human
guacagaaaguacccauagaag

SEQ ID NO: 9420 - RNA, 22 nt, Human
guacagauuaauaauauacuga

SEQ ID NO: 9421 - RNA, 22 nt, Human
guacaggucuuaucuccuagga

SEQ ID NO: 9422 - RNA, 22 nt, Human
guacagucuucuuaaugcuuuu

SEQ ID NO: 9423 - RNA, 22 nt, Human
guacaguggaggucuguguuca

SEQ ID NO: 9424 - RNA, 22 nt, Human
guacaugcagauuauagcuaau

SEQ ID NO: 9425 - RNA, 22 nt, Human
guacauucaugguuccaccagg

SEQ ID NO: 9426 - RNA, 22 nt, Human
guacauucuguggacuuggaca

SEQ ID NO: 9427 - RNA, 22 nt, Human
guacauuuauuuuugcagcaua

SEQ ID NO: 9428 - RNA, 22 nt, Human
guacauuucaguuuccuuaaga

SEQ ID NO: 9429 - RNA, 22 nt, Human
guacauuucucccaacacuaaa

SEQ ID NO: 9430 - RNA, 22 nt, Human
guacauuuuacuuuguuugaau

SEQ ID NO: 9431 - RNA, 22 nt, Human
guaccauaaugagucucuuaaa

SEQ ID NO: 9432 - RNA, 22 nt, Human
guaccaugagcaucauguuuuu

SEQ ID NO: 9433 - RNA, 22 nt, Human
guacgugcaugcacgugugccu

SEQ ID NO: 9434 - RNA, 22 nt, Human
guacuauagguaauguagacca

SEQ ID NO: 9435 - RNA, 22 nt, Human
guacuucuggccaggcuggcca

SEQ ID NO: 9436 - RNA, 22 nt, Human
guacuucuuuagucaauaugua

SEQ ID NO: 9437 - RNA, 22 nt, Human
guacuuuagaguaaaauagacc

SEQ ID NO: 9438 - RNA, 22 nt, Human
guacuuuguuaccauagcucca

SEQ ID NO: 9439 - RNA, 22 nt, Human
guagaaauauuuaucucugaga

SEQ ID NO: 9440 - RNA, 22 nt, Human
guagaaaugguguguuucuucu

SEQ ID NO: 9441 - RNA, 22 nt, Human
guagaagugaugucauguuaua

SEQ ID NO: 9442 - RNA, 22 nt, Human
guagacagaaagcggaaucaua

SEQ ID NO: 9443 - RNA, 22 nt, Human
guagacagcaaccaaaccaggu

SEQ ID NO: 9444 - RNA, 22 nt, Human
guagaggcugaaaucugagggc

SEQ ID NO: 9445 - RNA, 22 nt, Human
guagagucaggacggcaauucu

SEQ ID NO: 9446 - RNA, 22 nt, Human
guagaguugaguagugguaaca

SEQ ID NO: 9447 - RNA, 22 nt, Human
guagauaaggauugauuuuuau

SEQ ID NO: 9448 - RNA, 22 nt, Human
guagauuccaguggucuguguc

SEQ ID NO: 9449 - RNA, 22 nt, Human
guagcaacuguagcccaaauuc

SEQ ID NO: 9450 - RNA, 22 nt, Human
guagcacaugauuuugauaugu

SEQ ID NO: 9451 - RNA, 22 nt, Human
guagcagguauucuggugugag

SEQ ID NO: 9452 - RNA, 22 nt, Human
guagcuacuuagagccguucuu

SEQ ID NO: 9453 - RNA, 22 nt, Human
guagcugauauuagcaaugagu

SEQ ID NO: 9454 - RNA, 22 nt, Human
guacauaaaauacugccaugua

SEQ ID NO: 9455 - RNA, 22 nt, Human
guacauaaaggaggcucuuugc

SEQ ID NO: 9456 - RNA, 22 nt, Human
guacauaauuuucagccaguuu

SEQ ID NO: 9457 - RNA, 22 nt, Human
guacauauggcacaugcuauuu

SEQ ID NO: 9458 - RNA, 22 nt, Human
guacauauuacagacaaagcuu

SEQ ID NO: 9459 - RNA, 22 nt, Human
guacaugauuccccauaaaaag

SEQ ID NO: 9460 - RNA, 22 nt, Human
guacauguaugagauaugugua

SEQ ID NO: 9461 - RNA, 22 nt, Human
guacaugucaaaaaaugcauaa

SEQ ID NO: 9462 - RNA, 22 nt, Human
guacaugugcacaacaugcaug

SEQ ID NO: 9463 - RNA, 22 nt, Human
guacaugugcacaaugugcagg

SEQ ID NO: 9464 - RNA, 22 nt, Human
guacauucagcuuagcacuucu

SEQ ID NO: 9465 - RNA, 22 nt, Human
guacauuucucuuguucuuauu

SEQ ID NO: 9466 - RNA, 22 nt, Human
guacauuuugagguuaaaacaa

SEQ ID NO: 9467 - RNA, 22 nt, Human
guaccagucucugugggcaccu

SEQ ID NO: 9468 - RNA, 22 nt, Human
guaccauuguuugaaguacuca

SEQ ID NO: 9469 - RNA, 22 nt, Human
guacccagugauuccuucuuca

SEQ ID NO: 9470 - RNA, 22 nt, Human
guacucucuugaaggccuuucu

SEQ ID NO: 9471 - RNA, 22 nt, Human
guacugaacuuaaaaauccccu

SEQ ID NO: 9472 - RNA, 22 nt, Human
guacuucuuaaauuaggaucaa

SEQ ID NO: 9473 - RNA, 22 nt, Human
guacuuuaaaucaauguagauu

SEQ ID NO: 9474 - RNA, 22 nt, Human
guagaaaaagcaguaagucuca

SEQ ID NO: 9475 - RNA, 22 nt, Human
guagaaaauuaggaugaggcuu

SEQ ID NO: 9476 - RNA, 22 nt, Human
guagaaauuccauuuacuuuga

SEQ ID NO: 9477 - RNA, 22 nt, Human
guagaauauaugguuaguauug

SEQ ID NO: 9478 - RNA, 22 nt, Human
guagaaucccaguggcuauauu

SEQ ID NO: 9479 - RNA, 22 nt, Human
guagacagguuauaaaucagug

SEQ ID NO: 9480 - RNA, 22 nt, Human
guagagcaggacuugagauguu

SEQ ID NO: 9481 - RNA, 22 nt, Human
guagaggcagaaacugaaggac

SEQ ID NO: 9482 - RNA, 22 nt, Human
guauaagguauguaaacuauuu

SEQ ID NO: 9483 - RNA, 22 nt, Human
guauacaacuauuguuggguaa

SEQ ID NO: 9484 - RNA, 22 nt, Human
guauacacugucuccucuaggu

SEQ ID NO: 9485 - RNA, 22 nt, Human
guauacaugugguaaaaugcac

SEQ ID NO: 9486 - RNA, 22 nt, Human
guauaggcauuuugauuagagu

SEQ ID NO: 9487 - RNA, 22 nt, Human
guauagguuuggcucucuccag

SEQ ID NO: 9488 - RNA, 22 nt, Human
guauauaagguaaagcgauugu

SEQ ID NO: 9489 - RNA, 22 nt, Human
guauauaucggcacuauuuuaa

SEQ ID NO: 9490 - RNA, 22 nt, Human
guauauauuggauaaaccagag

SEQ ID NO: 9491 - RNA, 21 nt, Human
guauaucagcagugaauucaa

SEQ ID NO: 9492 - RNA, 22 nt, Human
guauaucucuuacauacacaca

SEQ ID NO: 9493 - RNA, 19 nt, Human
guauauuuauauggcugua

SEQ ID NO: 9494 - RNA, 22 nt, Human
guaucacacuagaaugcauuca

SEQ ID NO: 9495 - RNA, 22 nt, Human
guauccacaauaaagcccuuug

SEQ ID NO: 9496 - RNA, 22 nt, Human
guaucgguuuauuuuugggaua

SEQ ID NO: 9497 - RNA, 22 nt, Human
guaucuagucaaugcuguucaa

SEQ ID NO: 9498 - RNA, 22 nt, Human
guaucuuuuacaccaggaaauu

SEQ ID NO: 9499 - RNA, 22 nt, Human
guaugcugccuacgaacaugca

SEQ ID NO: 9500 - RNA, 22 nt, Human
guaugucaccucuccuaagcac

SEQ ID NO: 9501 - RNA, 22 nt, Human
guauguguugaauucagggguc

SEQ ID NO: 9502 - RNA, 20 nt, Human
guauuacaggcuuagaacca

SEQ ID NO: 9503 - RNA, 22 nt, Human
guauuagcaagaguugugauuu

SEQ ID NO: 9504 - RNA, 20 nt, Human
guauuaggagguaaauguaa

SEQ ID NO: 9505 - RNA, 22 nt, Human
guauuaggagguggagccuuug

SEQ ID NO: 9506 - RNA, 20 nt, Human
guauuagguguuccucuuuc

SEQ ID NO: 9507 - RNA, 22 nt, Human
guauuagguuggugcaaaauug

SEQ ID NO: 9508 - RNA, 22 nt, Human
guauucaguuugauugucuaca

SEQ ID NO: 9509 - RNA, 22 nt, Human
guauucuuaaggauugagcaaa

SEQ ID NO: 9510 - RNA, 22 nt, Human
guauucuugaguggcaacuagg

SEQ ID NO: 9511 - RNA, 21 nt, Human
guauucuuuaugaagugaaaa

SEQ ID NO: 9512 - RNA, 22 nt, Human
guauuguauauuugcaaauaca

SEQ ID NO: 9513 - RNA, 22 nt, Human
guauuguauugggaugagcucu

SEQ ID NO: 9514 - RNA, 22 nt, Human
guauuucacauauggauaugcu

SEQ ID NO: 9515 - RNA, 23 nt, Human
guauuucagcauucucaguuaaa

SEQ ID NO: 9516 - RNA, 22 nt, Human
guauuuccuauagugagggccu

SEQ ID NO: 9517 - RNA, 22 nt, Human
guauuucuagaaaaugcagauu

SEQ ID NO: 9518 - RNA, 22 nt, Human
guauuucugguuaaaugugcua

SEQ ID NO: 9519 - RNA, 22 nt, Human
guauuucuuggaaauccuuuua

SEQ ID NO: 9520 - RNA, 22 nt, Human
guauuucuuuaucuggucagaa

SEQ ID NO: 9521 - RNA, 22 nt, Human
guauuugauagauuucaaagga

SEQ ID NO: 9522 - RNA, 22 nt, Human
guauuugcaaaucuaaaagaga

SEQ ID NO: 9523 - RNA, 22 nt, Human
gucaaagaaacgcaccuuacau

SEQ ID NO: 9524 - RNA, 22 nt, Human
gucaacaagguuugcuuaucuu

SEQ ID NO: 9525 - RNA, 22 nt, Human
gucaacuuuuucauagcucugc

SEQ ID NO: 9526 - RNA, 22 nt, Human
gucaagaugagaauucuuuuua

SEQ ID NO: 9527 - RNA, 20 nt, Human
gucaagucccuggggcagcu

SEQ ID NO: 9528 - RNA, 22 nt, Human
gucaaguuaagauaaggucaug

SEQ ID NO: 9529 - RNA, 22 nt, Human
gucaauauagguuucaaacaug

SEQ ID NO: 9530 - RNA, 22 nt, Human
gucaauuaguggcaauuucaua

SEQ ID NO: 9531 - RNA, 22 nt, Human
gucacaaaggugagggacauga

SEQ ID NO: 9532 - RNA, 22 nt, Human
gucacaaauccccucagcaacu

SEQ ID NO: 9533 - RNA, 22 nt, Human
gucacaauuauaggaacucaga

SEQ ID NO: 9534 - RNA, 22 nt, Human
gucacacaauaguaaguggucc

SEQ ID NO: 9535 - RNA, 22 nt, Human
gucacacagagcccugugcuca

SEQ ID NO: 9536 - RNA, 22 nt, Human
gucacacuagggccaaguggag

SEQ ID NO: 9537 - RNA, 22 nt, Human
gucacagaguuauuaauugugu

SEQ ID NO: 9538 - RNA, 22 nt, Human
gucacaggaagcagcaggcacu

SEQ ID NO: 9539 - RNA, 22 nt, Human
gucacaggcaguaacuaggacc

SEQ ID NO: 9540 - RNA, 22 nt, Human
gucaccauugcccacuccaugg

SEQ ID NO: 9541 - RNA, 22 nt, Human
gucacccugcuguuuguccauu

SEQ ID NO: 9542 - RNA, 22 nt, Human
gucacugccucuuaacuuuuuc

SEQ ID NO: 9543 - RNA, 22 nt, Human
gucacuggaauuacaggcaugc

SEQ ID NO: 9544 - RNA, 22 nt, Human
gucacuggggccacaugcagaa

SEQ ID NO: 9545 - RNA, 22 nt, Human
gucacuguuuccuauuauauuu

SEQ ID NO: 9546 - RNA, 22 nt, Human
gucacuuuggccucuacagcca

SEQ ID NO: 9547 - RNA, 22 nt, Human
gucagaaaaagcaaggcugggc

SEQ ID NO: 9548 - RNA, 22 nt, Human
gucagacugcacucaaggacag

SEQ ID NO: 9549 - RNA, 22 nt, Human
gucagagacaaacuuccucucu

SEQ ID NO: 9550 - RNA, 22 nt, Human
gucagagcugugcaaggcugag

SEQ ID NO: 9551 - RNA, 22 nt, Human
gucagauuaauagcaauaauaa

SEQ ID NO: 9552 - RNA, 22 nt, Human
gucagcaagaugaaucagcagg

SEQ ID NO: 9553 - RNA, 22 nt, Human
gucagcaaggaaaaugugucac

SEQ ID NO: 9554 - RNA, 22 nt, Human
gucagcaauucaagagcucuua

SEQ ID NO: 9555 - RNA, 22 nt, Human
gucagcuaauaggguguguguc

SEQ ID NO: 9556 - RNA, 22 nt, Human
gucagcuagaggaugugacauu

SEQ ID NO: 9557 - RNA, 22 nt, Human
gucagcucauccaucccggugg

SEQ ID NO: 9558 - RNA, 23 nt, Human
gucagcuugaccaguggagaguc

SEQ ID NO: 9559 - RNA, 22 nt, Human
gucaggaaaacccggguugacu

SEQ ID NO: 9560 - RNA, 22 nt, Human
gucaggacucugacccgucccg

SEQ ID NO: 9561 - RNA, 22 nt, Human
gucaggagagaccuguucuccu

SEQ ID NO: 9562 - RNA, 22 nt, Human
gucaggagaggccaucagcuuu

SEQ ID NO: 9563 - RNA, 21 nt, Human
gucaggagccgucuuacauuc

SEQ ID NO: 9564 - RNA, 22 nt, Human
gucaggaucaaauugaaguuau

SEQ ID NO: 9565 - RNA, 22 nt, Human
gucaggaugagggaugaggagu

SEQ ID NO: 9566 - RNA, 22 nt, Human
gucaggauuaaugggaguaugc

SEQ ID NO: 9567 - RNA, 22 nt, Human
ucgauagaauauacuagcugug

SEQ ID NO: 9568 - RNA, 22 nt, Human
ucgcauuuguuaaagcauguug

SEQ ID NO: 9569 - RNA, 22 nt, Human
ucgccucaucauccuaauuaca

SEQ ID NO: 9570 - RNA, 22 nt, Human
ucgcucaggcuugaguguagug

SEQ ID NO: 9571 - RNA, 22 nt, Human
ucggaaccgaccugggagcugg

SEQ ID NO: 9572 - RNA, 22 nt, Human
ucgggcuccugcacuuggagac

SEQ ID NO: 9573 - RNA, 22 nt, Human
ucggggucuuugacacgcucug

SEQ ID NO: 9574 - RNA, 22 nt, Human
ucgggugcuuuuagauauguag

SEQ ID NO: 9575 - RNA, 23 nt, Human
ucggugggcguggaggccgaggc

SEQ ID NO: 9576 - RNA, 22 nt, Human
ucgucaacuguagugacuuaga

SEQ ID NO: 9577 - RNA, 22 nt, Human
ucgucaucugaaggcugucaau

SEQ ID NO: 9578 - RNA, 22 nt, Human
ucguccugugcaccugccugca

SEQ ID NO: 9579 - RNA, 22 nt, Human
ucgugcuccuggugaggcucug

SEQ ID NO: 9580 - RNA, 22 nt, Human
ucguggagaggccauguggagg

SEQ ID NO: 9581 - RNA, 22 nt, Human
ucguggaucaccgcgucugugu

SEQ ID NO: 9582 - RNA, 22 nt, Human
ucguguguauucccucuccuuc

SEQ ID NO: 9583 - RNA, 22 nt, Human
ucguuaaaugcuaaaacugaca

SEQ ID NO: 9584 - RNA, 22 nt, Human
ucguuagccucgagaucuuugu

SEQ ID NO: 9585 - RNA, 22 nt, Human
ucguuauagaacauucuugggu

SEQ ID NO: 9586 - RNA, 22 nt, Human
ucguucuugucaguuuauaaag

SEQ ID NO: 9587 - RNA, 20 nt, Human
ucguuuauuugaaauugcuc

SEQ ID NO: 9588 - RNA, 22 nt, Human
ucguuuuaccaaauugaauguu

SEQ ID NO: 9589 - RNA, 22 nt, Human
ucuaaaaaagucuguucacuug

SEQ ID NO: 9590 - RNA, 19 nt, Human
ucuaaacacagggacaagc

SEQ ID NO: 9591 - RNA, 22 nt, Human
ucaagugagcguagcugaaugg

SEQ ID NO: 9592 - RNA, 22 nt, Human
ucaaguuucucucagauuaugg

SEQ ID NO: 9593 - RNA, 22 nt, Human
ucaauaaauagcuuggcucagc

SEQ ID NO: 9594 - RNA, 22 nt, Human
ucaauaaaucccucugacccug

SEQ ID NO: 9595 - RNA, 22 nt, Human
ucaauacauacaauguauagug

SEQ ID NO: 9596 - RNA, 22 nt, Human
ucaauacauguguguggauggu

SEQ ID NO: 9597 - RNA, 22 nt, Human
ucaauacucacaaagagauuuu

SEQ ID NO: 9598 - RNA, 22 nt, Human
ucaauagcauagcaauuaaugu

SEQ ID NO: 9599 - RNA, 22 nt, Human
ucaauauagcaguguacuugag

SEQ ID NO: 9600 - RNA, 22 nt, Human
ucaaucuguuccauuagaacau

SEQ ID NO: 9601 - RNA, 22 nt, Human
ucaaugaagagauuuaaaucau

SEQ ID NO: 9602 - RNA, 22 nt, Human
ucaaugauaucagcaggaugug

SEQ ID NO: 9603 - RNA, 22 nt, Human
ucaaugauuagaguuuagugug

SEQ ID NO: 9604 - RNA, 22 nt, Human
ucaaugcauaggagguggcaga

SEQ ID NO: 9605 - RNA, 19 nt, Human
ucaaugucuggccaauggu

SEQ ID NO: 9606 - RNA, 22 nt, Human
ucaaugucuucucaagucuuuu

SEQ ID NO: 9607 - RNA, 22 nt, Human
ucaauguucugauucuuuugca

SEQ ID NO: 9608 - RNA, 22 nt, Human
ucaauguuuggaaauccuuugu

SEQ ID NO: 9609 - RNA, 22 nt, Human
ucaauuacagcaaugacuguac

SEQ ID NO: 9610 - RNA, 22 nt, Human
ucaauuacuaaccaaauaaugu

SEQ ID NO: 9611 - RNA, 22 nt, Human
ucaauuauuugauaugaaaggg

SEQ ID NO: 9612 - RNA, 22 nt, Human
ucaauuauuuuggcuaugcuaa

SEQ ID NO: 9613 - RNA, 22 nt, Human
ucaauucaauugaacaguuacu

SEQ ID NO: 9614 - RNA, 22 nt, Human
ucaauucaauugcauuucugug

SEQ ID NO: 9615 - RNA, 22 nt, Human
ucaauucaguccaacaguaauu

SEQ ID NO: 9616 - RNA, 22 nt, Human
ucaauucauagaguugacacag

SEQ ID NO: 9617 - RNA, 22 nt, Human
ucaauucugcauacauuucacu

SEQ ID NO: 9618 - RNA, 20 nt, Human
ucaauuuucuacaacauuug

SEQ ID NO: 9619 - RNA, 22 nt, Human
ucacaaagagaauugugggugu

SEQ ID NO: 9620 - RNA, 22 nt, Human
ucacaaauguuugcaugugucu

SEQ ID NO: 9621 - RNA, 22 nt, Human
ucacaacucacagccaccggug

SEQ ID NO: 9622 - RNA, 21 nt, Human
ucacaacuuugaauuucaaua

SEQ ID NO: 9623 - RNA, 22 nt, Human
ucacaagacaagacaaauugca

SEQ ID NO: 9624 - RNA, 22 nt, Human
ucacaagacagaaaacauuuag

SEQ ID NO: 9625 - RNA, 22 nt, Human
ucacaagaguaaguucaugccu

SEQ ID NO: 9626 - RNA, 22 nt, Human
ucacaagauacaguuagaagca

SEQ ID NO: 9627 - RNA, 22 nt, Human
ucacaagauauuucaguccuuu

SEQ ID NO: 9628 - RNA, 22 nt, Human
ucacaagguucacuauaaauug

SEQ ID NO: 9629 - RNA, 22 nt, Human
ucacaauggcauaguauaaaau

SEQ ID NO: 9630 - RNA, 22 nt, Human
ucacaauugagauccucccacc

SEQ ID NO: 9631 - RNA, 22 nt, Human
ucacaauuguuuuuaggaucaa

SEQ ID NO: 9632 - RNA, 22 nt, Human
ucacacacauuugcugucugau

SEQ ID NO: 9633 - RNA, 21 nt, Human
ucacacacguuuccaagggca

SEQ ID NO: 9634 - RNA, 22 nt, Human
ucacacagugagcggggcucag

SEQ ID NO: 9635 - RNA, 22 nt, Human
ucacacaucucagguguuuaau

SEQ ID NO: 9636 - RNA, 20 nt, Human
ucacacaugguaagcuauga

SEQ ID NO: 9637 - RNA, 22 nt, Human
ucacacauucuagguauguuga

SEQ ID NO: 9638 - RNA, 22 nt, Human
ucacacauuguugcuuaaguug

SEQ ID NO: 9639 - RNA, 22 nt, Human
ucacaccaguuuccuuucaauu

SEQ ID NO: 9640 - RNA, 22 nt, Human
ucacaccuugcuggcugagugc

SEQ ID NO: 9641 - RNA, 22 nt, Human
ucacacgugagguucuauccug

SEQ ID NO: 9642 - RNA, 23 nt, Human
ucacacuaugaaguguguuaucc

SEQ ID NO: 9643 - RNA, 22 nt, Human
ucacacugugaagagacaagca

SEQ ID NO: 9644 - RNA, 20 nt, Human
ucacagaaacaaauagagaa

SEQ ID NO: 9645 - RNA, 22 nt, Human
ucacagaaauaagauaguuauu

SEQ ID NO: 9646 - RNA, 22 nt, Human
ucacagaaaucuguuuuuucua

SEQ ID NO: 9647 - RNA, 22 nt, Human
ucacagaagagcauuaagauga

SEQ ID NO: 9648 - RNA, 22 nt, Human
ucacagaaggcaucacagaaga

SEQ ID NO: 9649 - RNA, 22 nt, Human
ucacagaaguugaauuugcaug

SEQ ID NO: 9650 - RNA, 22 nt, Human
ucacagaauaaauugagaagac

SEQ ID NO: 9651 - RNA, 22 nt, Human
ucacagaaucucugauaagucu

SEQ ID NO: 9652 - RNA, 22 nt, Human
ucacagacauggugagguaaca

SEQ ID NO: 9653 - RNA, 22 nt, Human
ucacagacuggucagucaacuu

SEQ ID NO: 9654 - RNA, 18 nt, Human
ucacagacuuacugggcc

SEQ ID NO: 9655 - RNA, 22 nt, Human
ucacagcaaaagugugcagagc

SEQ ID NO: 9656 - RNA, 22 nt, Human
ucacagcaaaugcugcuucuca

SEQ ID NO: 9657 - RNA, 22 nt, Human
ucacagcauugaguguacuaga

SEQ ID NO: 9658 - RNA, 22 nt, Human
ucacagcauugucacaaggcug

SEQ ID NO: 9659 - RNA, 22 nt, Human
ucacagccuggacaguugccug

SEQ ID NO: 9660 - RNA, 22 nt, Human
ucacagcuauucucauguauuu

SEQ ID NO: 9661 - RNA, 22 nt, Human
ucacaggaagaggugucuaucu

SEQ ID NO: 9662 - RNA, 22 nt, Human
ucacaggagagcugaugcuggu

SEQ ID NO: 9663 - RNA, 22 nt, Human
ucacaggccuggggcagagggc

SEQ ID NO: 9664 - RNA, 22 nt, Human
ucacaggcuccagggccuggau

SEQ ID NO: 9665 - RNA, 22 nt, Human
ucacaggcuggucuccgaggac

SEQ ID NO: 9666 - RNA, 22 nt, Human
ucacagggauggaauagaaaua

SEQ ID NO: 9667 - RNA, 21 nt, Human
ucacaggucaaugugugaagg

SEQ ID NO: 9668 - RNA, 22 nt, Human
ucacaguaaauccagaagaaau

SEQ ID NO: 9669 - RNA, 22 nt, Human
ucacaguaacuuuguugcuuuu

SEQ ID NO: 9670 - RNA, 22 nt, Human
ucacaguacugugugacuugag

SEQ ID NO: 9671 - RNA, 22 nt, Human
ucacaguagacuucucaagagc

SEQ ID NO: 9672 - RNA, 22 nt, Human
ucacaguauagaguuauuuugg

SEQ ID NO: 9673 - RNA, 22 nt, Human
ucacaguaucacacaaggauua

SEQ ID NO: 9674 - RNA, 22 nt, Human
ucacaguaucuagaaaugaggg

SEQ ID NO: 9675 - RNA, 22 nt, Human
ucacaguauuggggguggagga

SEQ ID NO: 9676 - RNA, 22 nt, Human
ucacagugacagccaauguuuu

SEQ ID NO: 9677 - RNA, 22 nt, Human
ucacagugacuuacagagauug

SEQ ID NO: 9678 - RNA, 22 nt, Human
ucacagugagccaugucagaga

SEQ ID NO: 9679 - RNA, 22 nt, Human
ucacagugcaggaucaguuaau

SEQ ID NO: 9680 - RNA, 18 nt, Human
ucacagugcucuugccua

SEQ ID NO: 9681 - RNA, 16 nt, Human
ggcaccagugaacaca

SEQ ID NO: 9682 - RNA, 18 nt, Human
ggcaccucucuugccuua

SEQ ID NO: 9683 - RNA, 22 nt, Human
ggcaccugucugcucacaguga

SEQ ID NO: 9684 - RNA, 22 nt, Human
ggcacgugccuaaggagcaggc

SEQ ID NO: 9685 - RNA, 22 nt, Human
ggcacugagaggcucuuccuaa

SEQ ID NO: 9686 - RNA, 22 nt, Human
ggcacugagcgggcucugagcg

SEQ ID NO: 9687 - RNA, 22 nt, Human
ggcacugagcugccuuggggca

SEQ ID NO: 9688 - RNA, 22 nt, Human
ggcacugauaauguccucucuc

SEQ ID NO: 9689 - RNA, 20 nt, Human
ggcacuggaagcacacagga

SEQ ID NO: 9690 - RNA, 22 nt, Human
ggcacugggugagggucacugg

SEQ ID NO: 9691 - RNA, 22 nt, Human
ggcagaagacaggcaaaucaug

SEQ ID NO: 9692 - RNA, 22 nt, Human
ggcagaagugaugggauauaac

SEQ ID NO: 9693 - RNA, 22 nt, Human
ggcagaccucuccagccccaca

SEQ ID NO: 9694 - RNA, 22 nt, Human
ggcagacuuuuucucugaaggg

SEQ ID NO: 9695 - RNA, 23 nt, Human
ggcagagagcauggcuggggccc

SEQ ID NO: 9696 - RNA, 22 nt, Human
ggcagagcagccccaggguuug

SEQ ID NO: 9697 - RNA, 22 nt, Human
ggcagagcauucgauggaccug

SEQ ID NO: 9698 - RNA, 17 nt, Human
ggcagagcugacagggc

SEQ ID NO: 9699 - RNA, 22 nt, Human
ggcagagcuugcagugagccga

SEQ ID NO: 9700 - RNA, 22 nt, Human
aacaaguucuaccucacaaggu

SEQ ID NO: 9701 - RNA, 23 nt, Human
aacaauagagauaaagugagauc

SEQ ID NO: 9702 - RNA, 22 nt, Human
aacaauaggaccuuuauguucu

SEQ ID NO: 9703 - RNA, 22 nt, Human
aacaauaggagugaugcaguau

SEQ ID NO: 9704 - RNA, 22 nt, Human
aacaaucaaguuucuaaaugac

SEQ ID NO: 9705 - RNA, 20 nt, Human
aacaaucuagaagcuauucu

SEQ ID NO: 9706 - RNA, 22 nt, Human
aacaaucuguucgauagaaaau

SEQ ID NO: 9707 - RNA, 22 nt, Human
aacaaugcaguuaaugggaaga

SEQ ID NO: 9708 - RNA, 16 nt, Human
aacaaugccaauccag

SEQ ID NO: 9709 - RNA, 22 nt, Human
aacaaugccacauuaaguguau

SEQ ID NO: 9710 - RNA, 22 nt, Human
aacaaugccugaugaccuccug

SEQ ID NO: 9711 - RNA, 22 nt, Human
aacaaugcugaacugaggaaag

SEQ ID NO: 9712 - RNA, 22 nt, Human
aacaauguaaucuacucugcuc

SEQ ID NO: 9713 - RNA, 22 nt, Human
aacaauguccugugagaugaua

SEQ ID NO: 9714 - RNA, 22 nt, Human
aacaaugugauugaagcuagaa

SEQ ID NO: 9715 - RNA, 22 nt, Human
aacaauuacuaccaaggccugu

SEQ ID NO: 9716 - RNA, 22 nt, Human
aacacaaagaagcugcaggauc

SEQ ID NO: 9717 - RNA, 22 nt, Human
aacacagacauagugauuacag

SEQ ID NO: 9718 - RNA, 22 nt, Human
aacacagggacucccaggagaa

SEQ ID NO: 9719 - RNA, 22 nt, Human
aacacagguugcugggccucac

SEQ ID NO: 9720 - RNA, 22 nt, Human
aacacagguuugugguaaauaa

SEQ ID NO: 9721 - RNA, 22 nt, Human
aacacagucaguuccuggauca

SEQ ID NO: 9722 - RNA, 22 nt, Human
aacacaguccugcucacuuauu

SEQ ID NO: 9723 - RNA, 22 nt, Human
aacacauggcaagagcaggaaa

SEQ ID NO: 9724 - RNA, 22 nt, Human
aacacauggguguuuauuguac

SEQ ID NO: 9725 - RNA, 22 nt, Human
aacacauuggaagccaagaaug

SEQ ID NO: 9726 - RNA, 23 nt, Human
aacaccaaggcucagagagauaa

SEQ ID NO: 9727 - RNA, 22 nt, Human
aacaccagucccaagagaggcu

SEQ ID NO: 9728 - RNA, 22 nt, Human
aacaccuucuccuugcaggcca

SEQ ID NO: 9729 - RNA, 22 nt, Human
aacacugaaguagugaauacug

SEQ ID NO: 9730 - RNA, 20 nt, Human
aacacugagggcuacucuuc

SEQ ID NO: 9731 - RNA, 22 nt, Human
aacacuggaagggacaucaagu

SEQ ID NO: 9732 - RNA, 22 nt, Human
aacacuggacaggaggcuaggu

SEQ ID NO: 9733 - RNA, 22 nt, Human
aacacugucagccuuugaugga

SEQ ID NO: 9734 - RNA, 22 nt, Human
aacacugugcccacccuagucc

SEQ ID NO: 9735 - RNA, 20 nt, Human
aacacugugcgugguaggug

SEQ ID NO: 9736 - RNA, 22 nt, Human
aacacuguggucuuuucaguaa

SEQ ID NO: 9737 - RNA, 22 nt, Human
aacacuuagauuuuuaagguuu

SEQ ID NO: 9738 - RNA, 22 nt, Human
aacacuuuccguagguuuagua

SEQ ID NO: 9739 - RNA, 22 nt, Human
aacacuuucuauuauuaugguu

SEQ ID NO: 9740 - RNA, 22 nt, Human
aacacuuucuuccuugcucagg

SEQ ID NO: 9741 - RNA, 22 nt, Human
aacacuuuggaugcagaaccaa

SEQ ID NO: 9742 - RNA, 22 nt, Human
aacagaauaguugauguacagu

SEQ ID NO: 9743 - RNA, 22 nt, Human
aacagaauaucaaaagauuaug

SEQ ID NO: 9744 - RNA, 22 nt, Human
aacagacauauuuuuaauaugc

SEQ ID NO: 9745 - RNA, 22 nt, Human
aacagagaggccaccucagcag

SEQ ID NO: 9746 - RNA, 22 nt, Human
aacagagcucugcucucagauu

SEQ ID NO: 9747 - RNA, 22 nt, Human
aacagauuuaagaagccaaggu

SEQ ID NO: 9748 - RNA, 20 nt, Human
aacagcacacauucgcauua

SEQ ID NO: 9749 - RNA, 22 nt, Human
aacagcagaggagcgauggcug

SEQ ID NO: 9750 - RNA, 22 nt, Human
aacagcagcugccugaauuugc

SEQ ID NO: 9751 - RNA, 23 nt, Human
aacagcaggaugauagaggaggu

SEQ ID NO: 9752 - RNA, 22 nt, Human
aacagcagggacuugaauggaa

SEQ ID NO: 9753 - RNA, 22 nt, Human
aacagcaucaccccauaacauu

SEQ ID NO: 9754 - RNA, 22 nt, Human
aacagcaugcuggguaacauug

SEQ ID NO: 9755 - RNA, 22 nt, Human
aacagccugagagaacaaugau

SEQ ID NO: 9756 - RNA, 22 nt, Human
aacagcgacguccuccccaaca

SEQ ID NO: 9757 - RNA, 22 nt, Human
aacagcuaccuucucacugugc

SEQ ID NO: 9758 - RNA, 22 nt, Human
aacagcugcuucaguacuugaa

SEQ ID NO: 9759 - RNA, 22 nt, Human
aacagcugcuucuaucuuuuca

SEQ ID NO: 9760 - RNA, 22 nt, Human
aacagcuguauacuguagcugu

SEQ ID NO: 9761 - RNA, 22 nt, Human
aacagcugucugccuaucucug

SEQ ID NO: 9762 - RNA, 22 nt, Human
aacagcuuagaaauguugcuaa

SEQ ID NO: 9763 - RNA, 22 nt, Human
aacagcuugagacuggauaugc

SEQ ID NO: 9764 - RNA, 22 nt, Human
aacagcuuugagcaguucugua

SEQ ID NO: 9765 - RNA, 22 nt, Human
aacaggaaacaaguuguuagga

SEQ ID NO: 9766 - RNA, 22 nt, Human
aacaggaauugcaggcagaucu

SEQ ID NO: 9767 - RNA, 22 nt, Human
aacaggagaggggaauguagag

SEQ ID NO: 9768 - RNA, 22 nt, Human
aaaggcaagcauuuauauagga

SEQ ID NO: 9769 - RNA, 22 nt, Human
aaaggcaauuucuucuuccuga

SEQ ID NO: 9770 - RNA, 22 nt, Human
aaaggcacacacuccuuguuau

SEQ ID NO: 9771 - RNA, 22 nt, Human
aaaggcacugaucuuauccagu

SEQ ID NO: 9772 - RNA, 22 nt, Human
aaaggcagaguuguuggaggca

SEQ ID NO: 9773 - RNA, 22 nt, Human
aaaggcaggacugcagcauagg

SEQ ID NO: 9774 - RNA, 22 nt, Human
aaaggcaguggguauguggauc

SEQ ID NO: 9775 - RNA, 19 nt, Human
aaaggcaguggguggcgug

SEQ ID NO: 9776 - RNA, 22 nt, Human
aaaggcaugauuaauucugugu

SEQ ID NO: 9777 - RNA, 22 nt, Human
aaaggcaugcauggucugcucc

SEQ ID NO: 9778 - RNA, 22 nt, Human
aaaggcauguggucaaggcuca

SEQ ID NO: 9779 - RNA, 22 nt, Human
aaaggcuaauuaaccaccuggu

SEQ ID NO: 9780 - RNA, 22 nt, Human
aaaggcuauuuuuagauguuug

SEQ ID NO: 9781 - RNA, 22 nt, Human
aaaggcucagaugaggcccugg

SEQ ID NO: 9782 - RNA, 18 nt, Human
aaaggcugaauauagaag

SEQ ID NO: 9783 - RNA, 22 nt, Human
aaaggcuggaaacugaagauaa

SEQ ID NO: 9784 - RNA, 22 nt, Human
aaaggcuggauucagagaggug

SEQ ID NO: 9785 - RNA, 22 nt, Human
aaaggcuggggacugaggaagg

SEQ ID NO: 9786 - RNA, 22 nt, Human
aaaggcuuaacagaagaccuuu

SEQ ID NO: 9787 - RNA, 22 nt, Human
aaaggcuuguacagcagccuuc

SEQ ID NO: 9788 - RNA, 22 nt, Human
aaaggcuuuaaaauguacauau

SEQ ID NO: 9789 - RNA, 22 nt, Human
aaaggcuuuccagcgcgcggac

SEQ ID NO: 9790 - RNA, 22 nt, Human
aaaggcuuugagaaguccugca

SEQ ID NO: 9791 - RNA, 22 nt, Human
aaagggagcauggcugcaggga

SEQ ID NO: 9792 - RNA, 22 nt, Human
aaagggaggggcgauaagccgg

SEQ ID NO: 9793 - RNA, 22 nt, Human
aaagggcagaguucacuagaaa

SEQ ID NO: 9794 - RNA, 22 nt, Human
aaagggcugaugugacauagcu

SEQ ID NO: 9795 - RNA, 22 nt, Human
aaagggcugucaaauaagcaac

SEQ ID NO: 9796 - RNA, 22 nt, Human
aaagguaacugggguuuugcca

SEQ ID NO: 9797 - RNA, 22 nt, Human
aaagguaguacuucuagaaggg

SEQ ID NO: 9798 - RNA, 22 nt, Human
aaaggucauugaaaaggaggaa

SEQ ID NO: 9799 - RNA, 17 nt, Human
aaaggucgauaaggugg

SEQ ID NO: 9800 - RNA, 22 nt, Human
aaaggucuacaucacugaaaga

SEQ ID NO: 9801 - RNA, 22 nt, Human
aaaggucuuuauuggucagcca

SEQ ID NO: 9802 - RNA, 22 nt, Human
aaaggugacacucugccagcug

SEQ ID NO: 9803 - RNA, 22 nt, Human
aaagguguugccuuggagaccu

SEQ ID NO: 9804 - RNA, 22 nt, Human
aaagguuaagguguucaagaaa

SEQ ID NO: 9805 - RNA, 22 nt, Human
aaagguuugaggugggaagagg

SEQ ID NO: 9806 - RNA, 22 nt, Human
aaagguuugccgaccucugcuu

SEQ ID NO: 9807 - RNA, 22 nt, Human
aaagguuuucaucacagcaaga

SEQ ID NO: 9808 - RNA, 22 nt, Human
aaagguuuuuauuuauccugga

SEQ ID NO: 9809 - RNA, 22 nt, Human
aacugcaaucacuuuugcacca

SEQ ID NO: 9810 - RNA, 22 nt, Human
aacugcacuguucuuuucuaca

SEQ ID NO: 9811 - RNA, 22 nt, Human
aacugcaguuaccuuugcacca

SEQ ID NO: 9812 - RNA, 16 nt, Human
aacugcaugagugggu

SEQ ID NO: 9813 - RNA, 20 nt, Human
aacugccugcccagaggugg

SEQ ID NO: 9814 - RNA, 22 nt, Human
aacugccuggccaggcugcaac

SEQ ID NO: 9815 - RNA, 22 nt, Human
aacugcuuagugauggaugacc

SEQ ID NO: 9816 - RNA, 22 nt, Human
aacugcuuaucuuugguagaug

SEQ ID NO: 9817 - RNA, 22 nt, Human
aacugcuuguagugacuugccu

SEQ ID NO: 9818 - RNA, 22 nt, Human
aacuggaaccuuuuauucaguc

SEQ ID NO: 9819 - RNA, 21 nt, Human
aacuggcagaccaacuauggc

SEQ ID NO: 9820 - RNA, 22 nt, Human
aacuggcauaugaacuuguucu

SEQ ID NO: 9821 - RNA, 22 nt, Human
aacuggcugggaacaccuagag

SEQ ID NO: 9822 - RNA, 22 nt, Human
aacugguagaaagcaguaagug

SEQ ID NO: 9823 - RNA, 22 nt, Human
aacugguauggugagaagagag

SEQ ID NO: 9824 - RNA, 22 nt, Human
aacugguucucuuuugcuugug

SEQ ID NO: 9825 - RNA, 22 nt, Human
aacuguaagaaauaaaauucug

SEQ ID NO: 9826 - RNA, 22 nt, Human
aacuguauacaauugucagaca

SEQ ID NO: 9827 - RNA, 22 nt, Human
aacugucaucuuucaaggaaga

SEQ ID NO: 9828 - RNA, 22 nt, Human
aacugucuuaauaacaaaagcu

SEQ ID NO: 9829 - RNA, 23 nt, Human
aacugucuugcaagugugauacc

SEQ ID NO: 9830 - RNA, 22 nt, Human
aacuguggagauucggaaggua

SEQ ID NO: 9831 - RNA, 22 nt, Human
aacuguggcauguugaauuugu

SEQ ID NO: 9832 - RNA, 22 nt, Human
aacuguuacauaguuauagauc

SEQ ID NO: 9833 - RNA, 22 nt, Human
aacuguucuucauuuucaguau

SEQ ID NO: 9834 - RNA, 22 nt, Human
aacuguugcuuguaauaugugc

SEQ ID NO: 9835 - RNA, 22 nt, Human
aacuguuuggaacucuuccaca

SEQ ID NO: 9836 - RNA, 22 nt, Human
aacuuaaacaagcucccaaguu

SEQ ID NO: 9837 - RNA, 22 nt, Human
aacuuacaauguuagagucuca

SEQ ID NO: 9838 - RNA, 22 nt, Human
aacuuaguguaaugcaguacag

SEQ ID NO: 9839 - RNA, 22 nt, Human
aacuuaguuuaggguauugauu

SEQ ID NO: 9840 - RNA, 22 nt, Human
aacuucagggacagaaaagagc

SEQ ID NO: 9841 - RNA, 22 nt, Human
aacuucauuccuuuuuaugacu

SEQ ID NO: 9842 - RNA, 22 nt, Human
aacuucauuuauaaugucauua

SEQ ID NO: 9843 - RNA, 22 nt, Human
aacuuccaacccagaagccuaa

SEQ ID NO: 9844 - RNA, 22 nt, Human
aacuuccaccaaauaguauaua

SEQ ID NO: 9845 - RNA, 22 nt, Human
aacuuccagcuuucugucuaau

SEQ ID NO: 9846 - RNA, 22 nt, Human
aacuucugcuuuuacaggcagu

SEQ ID NO: 9847 - RNA, 22 nt, Human
aacuucuugguccugagcuguu

SEQ ID NO: 9848 - RNA, 22 nt, Human
aacuugaaacuguuccagaaaa

SEQ ID NO: 9849 - RNA, 22 nt, Human
aacuugaaguugcagaaaguac

SEQ ID NO: 9850 - RNA, 22 nt, Human
aacuugaaugagaacuuuugcc

SEQ ID NO: 9851 - RNA, 22 nt, Human
aacuugcagacaccugucucaa

SEQ ID NO: 9852 - RNA, 22 nt, Human
aacuugccaagagcuuugcuag

SEQ ID NO: 9853 - RNA, 22 nt, Human
aacuugcuuauauuauuacauu

SEQ ID NO: 9854 - RNA, 22 nt, Human
aacuugguaaauugugucagau

SEQ ID NO: 9855 - RNA, 22 nt, Human
aacuugguaccaccuucugaag

SEQ ID NO: 9856 - RNA, 22 nt, Human
aacuuguuagaaaugcagaauc

SEQ ID NO: 9857 - RNA, 22 nt, Human
aacuuguuucuuccauucaaca

SEQ ID NO: 9858 - RNA, 22 nt, Human
aacuuuaaaaaauaugucuguu

SEQ ID NO: 9859 - RNA, 23 nt, Human
aacuuuacuauuuugaauaaugc

SEQ ID NO: 9860 - RNA, 21 nt, Human
aacuuuagaaagacugggaag

SEQ ID NO: 9861 - RNA, 22 nt, Human
aacuuuaucggaacagguacuc

SEQ ID NO: 9862 - RNA, 22 nt, Human
aacuuucuagagaugaguucgg

SEQ ID NO: 9863 - RNA, 22 nt, Human
aacuuucuccagugccaacuau

SEQ ID NO: 9864 - RNA, 20 nt, Human
aacuuucucccauuggacug

SEQ ID NO: 9865 - RNA, 22 nt, Human
aacuuucucuacggcauuuguu

SEQ ID NO: 9866 - RNA, 22 nt, Human
aacuuucuguuacguccccaga

SEQ ID NO: 9867 - RNA, 22 nt, Human
aacuuucuuucacagaaguauc

SEQ ID NO: 9868 - RNA, 22 nt, Human
aacuuucuuugcaucuaaguuu

SEQ ID NO: 9869 - RNA, 22 nt, Human
aacuuugaggucacugaauucc

SEQ ID NO: 9870 - RNA, 22 nt, Human
aacuuugcauaacuaacuacag

SEQ ID NO: 9871 - RNA, 21 nt, Human
aacuuugcuuaacugugugga

SEQ ID NO: 9872 - RNA, 22 nt, Human
aacuuugggccuaaguacuguu

SEQ ID NO: 9873 - RNA, 22 nt, Human
aacuuuguguguuuaauauggc

SEQ ID NO: 9874 - RNA, 22 nt, Human
aacuuuuacaaauugucaucau

SEQ ID NO: 9875 - RNA, 22 nt, Human
aacuuuuguccgaucuccugga

SEQ ID NO: 9876 - RNA, 22 nt, Human
aacuuuuucugggauggagggu

SEQ ID NO: 9877 - RNA, 22 nt, Human
aagaaaacaaugacuugccagc

SEQ ID NO: 9878 - RNA, 20 nt, Human
aagaaaacgucuucagggga

SEQ ID NO: 9879 - RNA, 22 nt, Human
aagaaaccuagucuggagcagc

SEQ ID NO: 9880 - RNA, 22 nt, Human
aagaaacugaaaguggcuucau

SEQ ID NO: 9881 - RNA, 22 nt, Human
aagaaagagaucacuccuccau

SEQ ID NO: 9882 - RNA, 22 nt, Human
aagaaagggcuauuguucucca

SEQ ID NO: 9883 - RNA, 22 nt, Human
aagaaagugaugagcuacagau

SEQ ID NO: 9884 - RNA, 22 nt, Human
aagaaauauugggccuuauaaa

SEQ ID NO: 9885 - RNA, 22 nt, Human
aagaaaucugauauuuguuuca

SEQ ID NO: 9886 - RNA, 22 nt, Human
aagaaaugcacacaacugcugg

SEQ ID NO: 9887 - RNA, 22 nt, Human
aaaguuagcauucucucuugcu

SEQ ID NO: 9888 - RNA, 22 nt, Human
aaaguuaguuucuuauaugucu

SEQ ID NO: 9889 - RNA, 22 nt, Human
aaaguucauugaugacugaggu

SEQ ID NO: 9890 - RNA, 22 nt, Human
aaaguuccuuuuauagacauga

SEQ ID NO: 9891 - RNA, 23 nt, Human
aaaguucuagaaugacuuccugu

SEQ ID NO: 9892 - RNA, 22 nt, Human
aaaguucuccuggauugugcug

SEQ ID NO: 9893 - RNA, 22 nt, Human
aaaguucucuaugguguaaaaa

SEQ ID NO: 9894 - RNA, 22 nt, Human
aaaguucugaugcugaucaaag

SEQ ID NO: 9895 - RNA, 22 nt, Human
aaaguucuggagaaaauaauga

SEQ ID NO: 9896 - RNA, 22 nt, Human
aaaguucuucauuuuuauugga

SEQ ID NO: 9897 - RNA, 22 nt, Human
aaaguucuuuuucuauaaaucc

SEQ ID NO: 9898 - RNA, 19 nt, Human
aaaguugagaaacaaugga

SEQ ID NO: 9899 - RNA, 22 nt, Human
aaaguugcagguggugagaggu

SEQ ID NO: 9900 - RNA, 22 nt, Human
aaaguugcagugaaauaaggcu

SEQ ID NO: 9901 - RNA, 22 nt, Human
aaaguugcuguccuagcuggcu

SEQ ID NO: 9902 - RNA, 22 nt, Human
aaaguuuaggcuuugaaaccag

SEQ ID NO: 9903 - RNA, 22 nt, Human
aaaguuuaguguccucuaccac

SEQ ID NO: 9904 - RNA, 22 nt, Human
aaaguuuccaaguuacaccauu

SEQ ID NO: 9905 - RNA, 22 nt, Human
aaaguuugaaugauauauuagu

SEQ ID NO: 9906 - RNA, 22 nt, Human
aaaguuugcaauuuauguuaau

SEQ ID NO: 9907 - RNA, 22 nt, Human
aaaguuuuagaacuaggaagca

SEQ ID NO: 9908 - RNA, 22 nt, Human
aaaguuuuagcuguccaguucc

SEQ ID NO: 9909 - RNA, 19 nt, Human
aaaguuuuauucucauuug

SEQ ID NO: 9910 - RNA, 22 nt, Human
aaauaaagguccacuuuagggc

SEQ ID NO: 9911 - RNA, 22 nt, Human
aaauaacuugguuucaucagag

SEQ ID NO: 9912 - RNA, 22 nt, Human
aaauaagaggacagauguuugg

SEQ ID NO: 9913 - RNA, 22 nt, Human
aaauaagcacuuaacuguauca

SEQ ID NO: 9914 - RNA, 22 nt, Human
aaauaaguaguuuaguguugug

SEQ ID NO: 9915 - RNA, 22 nt, Human
aaauaagugugggccagucaaa

SEQ ID NO: 9916 - RNA, 22 nt, Human
aaauaauguuaggccuuugcuc

SEQ ID NO: 9917 - RNA, 22 nt, Human
aaauacagauucugacucagag

SEQ ID NO: 9918 - RNA, 22 nt, Human
aaauguaccuugauaguuuggu

SEQ ID NO: 9919 - RNA, 22 nt, Human
aaauguaguauguugcauguau

SEQ ID NO: 9920 - RNA, 22 nt, Human
aaauguauccuacuuccugagu

SEQ ID NO: 9921 - RNA, 22 nt, Human
aaaugucaaggugauagaugca

SEQ ID NO: 9922 - RNA, 22 nt, Human
aaauguccugagauucaacuua

SEQ ID NO: 9923 - RNA, 22 nt, Human
aaaugucugagacuucugaacu

SEQ ID NO: 9924 - RNA, 22 nt, Human
aaaugucuguaggggcugcagg

SEQ ID NO: 9925 - RNA, 23 nt, Human
aaaugucuucuagcucuugagaa

SEQ ID NO: 9926 - RNA, 22 nt, Human
aaaugucuuuaucucauguaac

SEQ ID NO: 9927 - RNA, 22 nt, Human
aaaugugacagaugcaguacag

SEQ ID NO: 9928 - RNA, 22 nt, Human
aaaugugcuucuuacucucaau

SEQ ID NO: 9929 - RNA, 22 nt, Human
aaaugugcuugugaucagcugu

SEQ ID NO: 9930 - RNA, 22 nt, Human
aaauguguauaugaaacaugau

SEQ ID NO: 9931 - RNA, 22 nt, Human
aaaugugucaguuucauucucu

SEQ ID NO: 9932 - RNA, 22 nt, Human
aaaugugugcacaaagacagcu

SEQ ID NO: 9933 - RNA, 21 nt, Human
aaauguguuccauaaugcuuu

SEQ ID NO: 9934 - RNA, 22 nt, Human
aaauguguuccuuugcuacaga

SEQ ID NO: 9935 - RNA, 22 nt, Human
aaauguucaccagauccaugac

SEQ ID NO: 9936 - RNA, 22 nt, Human
aaauguuccggguaaggagaaa

SEQ ID NO: 9937 - RNA, 22 nt, Human
aaauguuucuacuugugagcau

SEQ ID NO: 9938 - RNA, 22 nt, Human
aaauuacagaucaccaaugcau

SEQ ID NO: 9939 - RNA, 22 nt, Human
aaauuacagccuuggguagcuu

SEQ ID NO: 9940 - RNA, 22 nt, Human
aaauuagaaauacuuucaaagc

SEQ ID NO: 9941 - RNA, 22 nt, Human
aaauuagucgguuuaggaauuu

SEQ ID NO: 9942 - RNA, 22 nt, Human
aaauuauuaaacagugggaugc

SEQ ID NO: 9943 - RNA, 22 nt, Human
aaauuauuaguuaaguugggca

SEQ ID NO: 9944 - RNA, 22 nt, Human
aaauucaaugaucacuggcuca

SEQ ID NO: 9945 - RNA, 22 nt, Human
aaauucacaagagcauugccug

SEQ ID NO: 9946 - RNA, 22 nt, Human
aaauucacuugccugcuuagcu

SEQ ID NO: 9947 - RNA, 22 nt, Human
aaauucagcagugaaaugcccc

SEQ ID NO: 9948 - RNA, 22 nt, Human
aaauuccagaaacucaguauau

SEQ ID NO: 9949 - RNA, 22 nt, Human
aaauuccauuuugugacuauuc

SEQ ID NO: 9950 - RNA, 22 nt, Human
aaauucucaagugauccuguug

SEQ ID NO: 9951 - RNA, 19 nt, Human
aaauucugacagucuuuua

SEQ ID NO: 9952 - RNA, 22 nt, Human
aaauugaaugauuaagugguga

SEQ ID NO: 9953 - RNA, 22 nt, Human
aaauugauuaaaguccgugcuu

SEQ ID NO: 9954 - RNA, 22 nt, Human
aaauugcauucaggaugcagga

SEQ ID NO: 9955 - RNA, 22 nt, Human
aaauugcauugagcugcuuauu

SEQ ID NO: 9956 - RNA, 22 nt, Human
aaauugccugaguaugucacau

SEQ ID NO: 9957 - RNA, 22 nt, Human
aaauugcucuuuaaaaguacug

SEQ ID NO: 9958 - RNA, 22 nt, Human
aaauugcugacacuugaccauu

SEQ ID NO: 9959 - RNA, 22 nt, Human
aaauuggaugcacauuuagaaa

SEQ ID NO: 9960 - RNA, 22 nt, Human
aaauuggauugggagaauguga

SEQ ID NO: 9961 - RNA, 22 nt, Human
aaauugucaguuaucugggaua

SEQ ID NO: 9962 - RNA, 22 nt, Human
aaauugucauuucugugcccua

SEQ ID NO: 9963 - RNA, 22 nt, Human
aaauuguccuuuuaagaaacag

SEQ ID NO: 9964 - RNA, 22 nt, Human
aaauugugucucaggcaguggu

SEQ ID NO: 9965 - RNA, 20 nt, Human
aaauuguguuugugagcucc

SEQ ID NO: 9966 - RNA, 22 nt, Human
aaauuguugaucuacaguaagg

SEQ ID NO: 9967 - RNA, 22 nt, Human
aaauuuaaggaggugcucacuu

SEQ ID NO: 9968 - RNA, 22 nt, Human
aaauuucaguuggaaugagcuc

SEQ ID NO: 9969 - RNA, 22 nt, Human
aaauuucuaagcagccacuucc

SEQ ID NO: 9970 - RNA, 22 nt, Human
aaauuucuggaagugucagagu

SEQ ID NO: 9971 - RNA, 22 nt, Human
aaauuucuguuguuuugagcca

SEQ ID NO: 9972 - RNA, 22 nt, Human
aaauuugccagaucaauucuga

SEQ ID NO: 9973 - RNA, 22 nt, Human
aaauuuguauuccuuuuccgua

SEQ ID NO: 9974 - RNA, 22 nt, Human
aaauuuguucaaugucuauuug

SEQ ID NO: 9975 - RNA, 22 nt, Human
aaauuuucucucuaagacuuaa

SEQ ID NO: 9976 - RNA, 22 nt, Human
aaauuuuguauucuaguucuag

SEQ ID NO: 9977 - RNA, 22 nt, Human
aacaaaacauuugucuuguuuc

SEQ ID NO: 9978 - RNA, 22 nt, Human
aacaaacaaacauuuugucauc

SEQ ID NO: 9979 - RNA, 22 nt, Human
aacaaacaguuaaguguggaug

SEQ ID NO: 9980 - RNA, 22 nt, Human
aacaaagaagacugguuauuuu

SEQ ID NO: 9981 - RNA, 22 nt, Human
aacaaagcccugcccaagagcu

SEQ ID NO: 9982 - RNA, 22 nt, Human
aacaaaguacuuuucagugcuu

SEQ ID NO: 9983 - RNA, 22 nt, Human
aacaaaguguacuuccauacug

SEQ ID NO: 9984 - RNA, 22 nt, Human
aacaaauggggccuuguaugaa

SEQ ID NO: 9985 - RNA, 22 nt, Human
aacaaauuaguugcaagacugg

SEQ ID NO: 9986 - RNA, 22 nt, Human
aacaacaacggagaaaggguug

SEQ ID NO: 9987 - RNA, 22 nt, Human
aacaaccaaaaagaugaaugua

SEQ ID NO: 9988 - RNA, 22 nt, Human
aacaacuugcguucagagaugu

SEQ ID NO: 9989 - RNA, 22 nt, Human
aacaagaagagagggacguaau

SEQ ID NO: 9990 - RNA, 22 nt, Human
aacaagaauaagugguuucugg

SEQ ID NO: 9991 - RNA, 22 nt, Human
aacaagagacucuguuccagaa

SEQ ID NO: 9992 - RNA, 22 nt, Human
aacaaggcugguaucuuaaaga

SEQ ID NO: 9993 - RNA, 19 nt, Human
aacaaguaggaauggaaga

SEQ ID NO: 9994 - RNA, 22 nt, Human
aacaagucuaagagaauggcag

SEQ ID NO: 9995 - RNA, 22 nt, Human
aacaaguuagauuuugugucuu

SEQ ID NO: 9996 - RNA, 22 nt, Human
aacaaguucuaagugucuacuu

SEQ ID NO: 9997 - RNA, 22 nt, Human
aacaauaacuagacaugccaug

SEQ ID NO: 9998 - RNA, 22 nt, Human
aacaauaauugcgguucucuau

SEQ ID NO: 9999 - RNA, 22 nt, Human
aacaauaggcuauaugcuaggc

SEQ ID NO: 10000 - RNA, 23 nt, Human
aacaauagguuuuggcagaauag

SEQ ID NO: 10001 - RNA, 22 nt, Human
aacaaugcuugccaagugugau

SEQ ID NO: 10002 - RNA, 22 nt, Human
aacaaugugaagugcuguucag

SEQ ID NO: 10003 - RNA, 22 nt, Human
aacacaaucuuccaguuugcug

SEQ ID NO: 10004 - RNA, 20 nt, Human
aacacacugguggcaucagg

SEQ ID NO: 10005 - RNA, 22 nt, Human
aaaugucuacuucccaucugua

SEQ ID NO: 10006 - RNA, 22 nt, Human
aaaugucucuauugccucuggu

SEQ ID NO: 10007 - RNA, 22 nt, Human
aaaugucuuucuucugcuacgu

SEQ ID NO: 10008 - RNA, 23 nt, Human
aaaugugagggaaaaucuuucug

SEQ ID NO: 10009 - RNA, 22 nt, Human
aaaugugaguuauagcaauaga

SEQ ID NO: 10010 - RNA, 22 nt, Human
aaaugugcaugagucagaagug

SEQ ID NO: 10011 - RNA, 22 nt, Human
aaaugugcucauuuauaaaagu

SEQ ID NO: 10012 - RNA, 22 nt, Human
aaauguguuucgaaaacuggug

SEQ ID NO: 10013 - RNA, 22 nt, Human
aaauguguuucuuugugaaugg

SEQ ID NO: 10014 - RNA, 22 nt, Human
aaauguuagguuguacugaguc

SEQ ID NO: 10015 - RNA, 22 nt, Human
aaauguucccaauaugaagcug

SEQ ID NO: 10016 - RNA, 22 nt, Human
aaauguucuaaauuacauguga

SEQ ID NO: 10017 - RNA, 22 nt, Human
aaauguucuacuuugauaauua

SEQ ID NO: 10018 - RNA, 22 nt, Human
aaauguuuugcucccauguggu

SEQ ID NO: 10019 - RNA, 22 nt, Human
aaauuagaccagggcuccugga

SEQ ID NO: 10020 - RNA, 22 nt, Human
aaauuagaccaguucaggucca

SEQ ID NO: 10021 - RNA, 22 nt, Human
aaauuagauaugugugagacuc

SEQ ID NO: 10022 - RNA, 22 nt, Human
aaauuagaucaguggauuuucu

SEQ ID NO: 10023 - RNA, 22 nt, Human
aaauuagucauguuguauuacu

SEQ ID NO: 10024 - RNA, 22 nt, Human
aaauuagugcaccagguugaag

SEQ ID NO: 10025 - RNA, 22 nt, Human
aaauuauucucauguguuucuu

SEQ ID NO: 10026 - RNA, 23 nt, Human
aaauuauugcucuucaauugccu

SEQ ID NO: 10027 - RNA, 22 nt, Human
aagcaguaaugagguacuauuu

SEQ ID NO: 10028 - RNA, 22 nt, Human
aagcagugacucucagaggcag

SEQ ID NO: 10029 - RNA, 22 nt, Human
aagcagugauaagagcuaccau

SEQ ID NO: 10030 - RNA, 22 nt, Human
aagcagugaugcauacagcugu

SEQ ID NO: 10031 - RNA, 22 nt, Human
aagcaguuuuucaacuguuuag

SEQ ID NO: 10032 - RNA, 22 nt, Human
aagcauaacuugcugcacauag

SEQ ID NO: 10033 - RNA, 22 nt, Human
aagcauauauuuuauauguugu

SEQ ID NO: 10034 - RNA, 22 nt, Human
aagcaucaacacuauauugaug

SEQ ID NO: 10035 - RNA, 22 nt, Human
aagcaucuauauuccacuguga

SEQ ID NO: 10036 - RNA, 22 nt, Human
aagcaucuccucaucauuuggg

SEQ ID NO: 10037 - RNA, 22 nt, Human
aagcaucuguaaagacccuuau

SEQ ID NO: 10038 - RNA, 23 nt, Human
aagcaucuuuuccuagcuccauc

SEQ ID NO: 10039 - RNA, 22 nt, Human
aagcauggagcaauagaaugac

SEQ ID NO: 10040 - RNA, 22 nt, Human
aagcauggcuguucuagcuaua

SEQ ID NO: 10041 - RNA, 22 nt, Human
aagcaugggaggccuggaggag

SEQ ID NO: 10042 - RNA, 22 nt, Human
aagcauguacaaugagugucuc

SEQ ID NO: 10043 - RNA, 23 nt, Human
aagcauucgccuucacccuccuc

SEQ ID NO: 10044 - RNA, 22 nt, Human
aagcauuucagguagagauauu

SEQ ID NO: 10045 - RNA, 22 nt, Human
aagcauuugguucugaagacuc

SEQ ID NO: 10046 - RNA, 22 nt, Human
aagcauuugugaaauucagaug

SEQ ID NO: 10047 - RNA, 22 nt, Human
aagcauuuuucacagcaacagc

SEQ ID NO: 10048 - RNA, 22 nt, Human
aagccaaaggcuccagugaccu

SEQ ID NO: 10049 - RNA, 22 nt, Human
aagccaaauaauguagguacau

SEQ ID NO: 10050 - RNA, 22 nt, Human
aagccaauggauugguugcuuu

SEQ ID NO: 10051 - RNA, 22 nt, Human
aagccacuguuuuggagugcuu

SEQ ID NO: 10052 - RNA, 22 nt, Human
aagccacuuucagcugucucag

SEQ ID NO: 10053 - RNA, 18 nt, Human
aagccagagaccacugcc

SEQ ID NO: 10054 - RNA, 22 nt, Human
aagccagaguuuuugagaacuu

SEQ ID NO: 10055 - RNA, 22 nt, Human
aagccagcauuuucccauuccu

SEQ ID NO: 10056 - RNA, 22 nt, Human
aagccaggaagagagccuucac

SEQ ID NO: 10057 - RNA, 22 nt, Human
aagccaggaagggagcuguccc

SEQ ID NO: 10058 - RNA, 22 nt, Human
aagccaggcaugcuuggacagu

SEQ ID NO: 10059 - RNA, 22 nt, Human
aagccagggguugguaugcuau

SEQ ID NO: 10060 - RNA, 18 nt, Human
aagccaggucaagauaag

SEQ ID NO: 10061 - RNA, 22 nt, Human
aagccagguguugugguaagag

SEQ ID NO: 10062 - RNA, 22 nt, Human
aagccagguguuuaggccagcg

SEQ ID NO: 10063 - RNA, 22 nt, Human
aagccagguuccauggaggagc

SEQ ID NO: 10064 - RNA, 22 nt, Human
aagccaguguggucugcccauu

SEQ ID NO: 10065 - RNA, 22 nt, Human
aagccaucuuguuuauauguua

SEQ ID NO: 10066 - RNA, 22 nt, Human
aagccaugguagaaaacucagu

SEQ ID NO: 10067 - RNA, 22 nt, Human
aagccauuuguuguccuucagg

SEQ ID NO: 10068 - RNA, 22 nt, Human
aagcccagaaucaagucuacug

SEQ ID NO: 10069 - RNA, 22 nt, Human
aagcccagcucugccugcucug

SEQ ID NO: 10070 - RNA, 22 nt, Human
aagcccaguaccuucagugagg

SEQ ID NO: 10071 - RNA, 23 nt, Human
aagccccaaggaacuuccuggga

SEQ ID NO: 10072 - RNA, 22 nt, Human
aagcccucagagccucuuugac

SEQ ID NO: 10073 - RNA, 22 nt, Human
aagcccucauuagccauagccc

SEQ ID NO: 10074 - RNA, 22 nt, Human
aagcccugaccugagaguccgu

SEQ ID NO: 10075 - RNA, 22 nt, Human
aagcccugauaggaaaaugcug

SEQ ID NO: 10076 - RNA, 22 nt, Human
aagcccuggaacuuuccuagcc

SEQ ID NO: 10077 - RNA, 22 nt, Human
aagcccuggcccaaccuugauu

SEQ ID NO: 10078 - RNA, 22 nt, Human
aagcccuggcucagcucaccag

SEQ ID NO: 10079 - RNA, 22 nt, Human
aagcccugggguugcacaaggc

SEQ ID NO: 10080 - RNA, 22 nt, Human
aagccggcugggccgaggcugc

SEQ ID NO: 10081 - RNA, 22 nt, Human
aagccuaaaugaugcuauuaug

SEQ ID NO: 10082 - RNA, 22 nt, Human
aagccugagccaugcuuuacug

SEQ ID NO: 10083 - RNA, 22 nt, Human
aagccugaggguguugcuagau

SEQ ID NO: 10084 - RNA, 22 nt, Human
aagccugcuuuguuccacagca

SEQ ID NO: 10085 - RNA, 22 nt, Human
aagccuguguuucugcuagucu

SEQ ID NO: 10086 - RNA, 22 nt, Human
aagccuuccugagugcaaggcc

SEQ ID NO: 10087 - RNA, 23 nt, Human
aagccuuguggaggcucucauuu

SEQ ID NO: 10088 - RNA, 22 nt, Human
aagcguuggccuccccugauga

SEQ ID NO: 10089 - RNA, 19 nt, Human
aagcguuucccacuugcuu

SEQ ID NO: 10090 - RNA, 22 nt, Human
aagcuacaguuuacccaugguu

SEQ ID NO: 10091 - RNA, 22 nt, Human
aagcuagaugacguuauuuuuu

SEQ ID NO: 10092 - RNA, 22 nt, Human
aagcuauagaguguaagaugau

SEQ ID NO: 10093 - RNA, 22 nt, Human
aagcucagaguagcucagcguc

SEQ ID NO: 10094 - RNA, 22 nt, Human
aagcucaggcuggaccuggcuu

SEQ ID NO: 10095 - RNA, 22 nt, Human
aagcucagugaugccuccaggg

SEQ ID NO: 10096 - RNA, 22 nt, Human
aagcucaugggugcuguacuuu

SEQ ID NO: 10097 - RNA, 18 nt, Human
aagcucuuaaaugguuca

SEQ ID NO: 10098 - RNA, 22 nt, Human
aagcucuuuccacuaaaccacu

SEQ ID NO: 10099 - RNA, 22 nt, Human
aagcucuuuucaccauuaaagu

SEQ ID NO: 10100 - RNA, 22 nt, Human
aagcugaagacacagcuccagu

SEQ ID NO: 10101 - RNA, 22 nt, Human
aagcugaagaugccagugggag

SEQ ID NO: 10102 - RNA, 22 nt, Human
aagcugaggcccauggcaaggu

SEQ ID NO: 10103 - RNA, 22 nt, Human
aagcugaggcuccccugaggga

SEQ ID NO: 10104 - RNA, 22 nt, Human
aagcugauuccacuuuuuccac

SEQ ID NO: 10105 - RNA, 22 nt, Human
aagcugauucuaaaauuuauua

SEQ ID NO: 10106 - RNA, 22 nt, Human
aagcugcaugaaguugaguaga

SEQ ID NO: 10107 - RNA, 22 nt, Human
aagcugccugccacgcuagaua

SEQ ID NO: 10108 - RNA, 22 nt, Human
aagcugccuuccaugugaggaa

SEQ ID NO: 10109 - RNA, 22 nt, Human
aagcugcuggugacugggcuga

SEQ ID NO: 10110 - RNA, 22 nt, Human
aagcugcuuugucaggaauaug

SEQ ID NO: 10111 - RNA, 20 nt, Human
aagcuggaagaccagcauug

SEQ ID NO: 10112 - RNA, 22 nt, Human
aagcuggacauuguagggggga

SEQ ID NO: 10113 - RNA, 22 nt, Human
aagcuggacucugccauuuacu

SEQ ID NO: 10114 - RNA, 22 nt, Human
aagcuggagaguuucacagaug

SEQ ID NO: 10115 - RNA, 22 nt, Human
aagcuggaggcugagaucacca

SEQ ID NO: 10116 - RNA, 23 nt, Human
aagcuggcugggagcagaaggga

SEQ ID NO: 10117 - RNA, 22 nt, Human
aagcugggagggagcccagagu

SEQ ID NO: 10118 - RNA, 22 nt, Human
aagcuggggacucagaccccau

SEQ ID NO: 10119 - RNA, 20 nt, Human
aagcuggguaggagaggagc

SEQ ID NO: 10120 - RNA, 22 nt, Human
aagcuguacuuagcauugacuc

SEQ ID NO: 10121 - RNA, 22 nt, Human
aagcuguagcuuuucaaaacgu

SEQ ID NO: 10122 - RNA, 20 nt, Human
aagcugucagagguggacag

SEQ ID NO: 10123 - RNA, 22 nt, Human
aagcugucagugucaggcuaaa

SEQ ID NO: 10124 - RNA, 22 nt, Human
aagcugugagcuggaugcucca

SEQ ID NO: 10125 - RNA, 22 nt, Human
aagcuguucugaaucaguaagu

SEQ ID NO: 10126 - RNA, 22 nt, Human
aagcuucaaugagauaauuguu

SEQ ID NO: 10127 - RNA, 23 nt, Human
aagcuuccuugacuggccccuag

SEQ ID NO: 10128 - RNA, 23 nt, Human
aagcuucuagggugggcaagaug

SEQ ID NO: 10129 - RNA, 23 nt, Human
aagcuucuaucucugcagaagga

SEQ ID NO: 10130 - RNA, 22 nt, Human
aagcuugauuguagucuagaca

SEQ ID NO: 10131 - RNA, 22 nt, Human
aagcuuuaaggaauuuuaugga

SEQ ID NO: 10132 - RNA, 22 nt, Human
aagcuuucagagcagaauguga

SEQ ID NO: 10133 - RNA, 22 nt, Human
aagcuuugacuacugccucuug

SEQ ID NO: 10134 - RNA, 22 nt, Human
aagcuuuugacuugguagggaa

SEQ ID NO: 10135 - RNA, 21 nt, Human
aaggaaaagcuuggucucuga

SEQ ID NO: 10136 - RNA, 22 nt, Human
aaggccugggaguacugggaca

SEQ ID NO: 10137 - RNA, 22 nt, Human
aaggccuuaaagcucucuccag

SEQ ID NO: 10138 - RNA, 22 nt, Human
aaggccuucuaccaaggcuggg

SEQ ID NO: 10139 - RNA, 22 nt, Human
aaggccuucucuugugucugug

SEQ ID NO: 10140 - RNA, 22 nt, Human
aaggccuugguucugagcaaua

SEQ ID NO: 10141 - RNA, 22 nt, Human
aaggcgacacaggcagcaggcc

SEQ ID NO: 10142 - RNA, 22 nt, Human
aaggcuccacccucauggaugc

SEQ ID NO: 10143 - RNA, 22 nt, Human
aaggcugaaagaccuugaaccu

SEQ ID NO: 10144 - RNA, 22 nt, Human
aagaggcaucucagcuuccucu

SEQ ID NO: 10145 - RNA, 22 nt, Human
aagaggccacagcugacagcac

SEQ ID NO: 10146 - RNA, 22 nt, Human
aagaggccucaccucacugccc

SEQ ID NO: 10147 - RNA, 22 nt, Human
aagaggccuuggucugaccuga

SEQ ID NO: 10148 - RNA, 22 nt, Human
aagaggcgcuccucacuuccua

SEQ ID NO: 10149 - RNA, 22 nt, Human
aagaggcuggaggauacugcgc

SEQ ID NO: 10150 - RNA, 22 nt, Human
aagaggcuggcauugaugguag

SEQ ID NO: 10151 - RNA, 22 nt, Human
aagaggcuuauagucuuccugu

SEQ ID NO: 10152 - RNA, 22 nt, Human
aagagggaaauuguuggcugcu

SEQ ID NO: 10153 - RNA, 22 nt, Human
aagagggguggucugugaggau

SEQ ID NO: 10154 - RNA, 22 nt, Human
aagaggugccagggguuuugua

SEQ ID NO: 10155 - RNA, 22 nt, Human
aagaguaaaugucuaauuagga

SEQ ID NO: 10156 - RNA, 19 nt, Human
aagagucacaggcagcccu

SEQ ID NO: 10157 - RNA, 22 nt, Human
aagagucagcuucuguaugggu

SEQ ID NO: 10158 - RNA, 22 nt, Human
aagagucuuauaguguaauuaa

SEQ ID NO: 10159 - RNA, 22 nt, Human
aagaguggagcuggaaaguggg

SEQ ID NO: 10160 - RNA, 22 nt, Human
aagaguucucagaaacgugggu

SEQ ID NO: 10161 - RNA, 22 nt, Human
aagaguuuaugauauaacaugu

SEQ ID NO: 10162 - RNA, 22 nt, Human
aagaguuucugauucaguaggu

SEQ ID NO: 10163 - RNA, 22 nt, Human
aagaguuugucagaucugcacg

SEQ ID NO: 10164 - RNA, 22 nt, Human
aagaguuuuagacaaacugauu

SEQ ID NO: 10165 - RNA, 22 nt, Human
aagauacacggucaacucucaa

SEQ ID NO: 10166 - RNA, 22 nt, Human
aagauacaucauucaggaguga

SEQ ID NO: 10167 - RNA, 22 nt, Human
aagauacauuguuuuugguagu

SEQ ID NO: 10168 - RNA, 22 nt, Human
aagauacauuuucuucagagaa

SEQ ID NO: 10169 - RNA, 22 nt, Human
aagauacugaugauguaggcua

SEQ ID NO: 10170 - RNA, 22 nt, Human
aagauauaauaacuguugucau

SEQ ID NO: 10171 - RNA, 22 nt, Human
aagauauacuauuaaguaccau

SEQ ID NO: 10172 - RNA, 22 nt, Human
aagauaugaggucaccugcugg

SEQ ID NO: 10173 - RNA, 22 nt, Human
aagauauuuuagaacauucacu

SEQ ID NO: 10174 - RNA, 22 nt, Human
aagaucaagugcuggcaguguu

SEQ ID NO: 10175 - RNA, 22 nt, Human
aagauccaggcaaaaguuggaa

SEQ ID NO: 10176 - RNA, 22 nt, Human
aagauccaugagggcagagauu

SEQ ID NO: 10177 - RNA, 22 nt, Human
aagauccaugggaauguuuggc

SEQ ID NO: 10178 - RNA, 22 nt, Human
aagaugaaaauuuacugugaug

SEQ ID NO: 10179 - RNA, 22 nt, Human
aagaugacuauuuaucuguaag

SEQ ID NO: 10180 - RNA, 22 nt, Human
aagaugauagaucugucaaugu

SEQ ID NO: 10181 - RNA, 22 nt, Human
aagauggcugcagcaauuccaa

SEQ ID NO: 10182 - RNA, 22 nt, Human
aagaugguaaggcagcuggcag

SEQ ID NO: 10183 - RNA, 22 nt, Human
aagaugguuucuguagguuuau

SEQ ID NO: 10184 - RNA, 22 nt, Human
aagauguaucuuuccuuuaauu

SEQ ID NO: 10185 - RNA, 22 nt, Human
aagaugugaaauugucucuggg

SEQ ID NO: 10186 - RNA, 22 nt, Human
aagaugugaacagaaccacagg

SEQ ID NO: 10187 - RNA, 22 nt, Human
aagaugugcuaucaacuggaga

SEQ ID NO: 10188 - RNA, 22 nt, Human
aagauguuacucaaccaggaua

SEQ ID NO: 10189 - RNA, 22 nt, Human
aagauguuagaggucaugcaga

SEQ ID NO: 10190 - RNA, 22 nt, Human
aagauguuaggaaaguuagggu

SEQ ID NO: 10191 - RNA, 22 nt, Human
aagauguuauugucuuccuugc

SEQ ID NO: 10192 - RNA, 22 nt, Human
aagauguugggugccuccggaa

SEQ ID NO: 10193 - RNA, 22 nt, Human
aagauguugucguuagugauga

SEQ ID NO: 10194 - RNA, 22 nt, Human
aagauguuuagauuuauacaau

SEQ ID NO: 10195 - RNA, 22 nt, Human
aagauuauuuaagacaggaacc

SEQ ID NO: 10196 - RNA, 22 nt, Human
aagauucucacugcucaacuuu

SEQ ID NO: 10197 - RNA, 22 nt, Human
aagauucucagaaaaaggcuau

SEQ ID NO: 10198 - RNA, 22 nt, Human
aagauucucccugagauauuua

SEQ ID NO: 10199 - RNA, 18 nt, Human
aagauucugcuucucucu

SEQ ID NO: 10200 - RNA, 22 nt, Human
aagauucuuaaauuuguuucuc

SEQ ID NO: 10201 - RNA, 22 nt, Human
aagauucuuugaggauuuuacu

SEQ ID NO: 10202 - RNA, 22 nt, Human
aagauuguuuuggaugcuaacu

SEQ ID NO: 10203 - RNA, 22 nt, Human
aagauuuagggccaguuuacau

SEQ ID NO: 10204 - RNA, 17 nt, Human
aagauuucauuagcuga

SEQ ID NO: 10205 - RNA, 22 nt, Human
aagauuuccuggauguaauucc

SEQ ID NO: 10206 - RNA, 22 nt, Human
aagauuucugcuccugagagaa

SEQ ID NO: 10207 - RNA, 22 nt, Human
aagauuugguaucagaagaccu

SEQ ID NO: 10208 - RNA, 22 nt, Human
aagauuuucagugccuaaaaca

SEQ ID NO: 10209 - RNA, 22 nt, Human
aagauuuucucaacuguauuug

SEQ ID NO: 10210 - RNA, 22 nt, Human
aagcaaauuggaugucugugag

SEQ ID NO: 10211 - RNA, 22 nt, Human
aagcaacuccuaggaggaaagg

SEQ ID NO: 10212 - RNA, 22 nt, Human
aagcaagacagaaguuacugcc

SEQ ID NO: 10213 - RNA, 22 nt, Human
aagcaagcaguguggaauuuua

SEQ ID NO: 10214 - RNA, 22 nt, Human
aagcaagcuguuggcaauaggg

SEQ ID NO: 10215 - RNA, 22 nt, Human
aagcaaggcaaccuauguccag

SEQ ID NO: 10216 - RNA, 22 nt, Human
aagcaaggccggaaggaaacuc

SEQ ID NO: 10217 - RNA, 20 nt, Human
aagcaauauagugcaaaugu

SEQ ID NO: 10218 - RNA, 22 nt, Human
aagcaauucagcaaaccuagaa

SEQ ID NO: 10219 - RNA, 22 nt, Human
aagcaauugguuuuaguaaaau

SEQ ID NO: 10220 - RNA, 22 nt, Human
aagcacaaugaacaucuuagau

SEQ ID NO: 10221 - RNA, 22 nt, Human
aagcacacaucucuggcugggu

SEQ ID NO: 10222 - RNA, 22 nt, Human
aagcacaccucccuggcaggag

SEQ ID NO: 10223 - RNA, 22 nt, Human
aagcacagaaaaggagcaugga

SEQ ID NO: 10224 - RNA, 22 nt, Human
aagcacagaugcaagggggacc

SEQ ID NO: 10225 - RNA, 22 nt, Human
aagcacagauugcugcauccau

SEQ ID NO: 10226 - RNA, 22 nt, Human
aagcacagcuggaacagcagga

SEQ ID NO: 10227 - RNA, 22 nt, Human
aagcacaggggaaauaaguugu

SEQ ID NO: 10228 - RNA, 22 nt, Human
aagcacauacauaauaaagucc

SEQ ID NO: 10229 - RNA, 22 nt, Human
aagcacaucauguuguucagac

SEQ ID NO: 10230 - RNA, 22 nt, Human
aagcacaucucaaacuucaucu

SEQ ID NO: 10231 - RNA, 22 nt, Human
aagcacaucuccugugcagaac

SEQ ID NO: 10232 - RNA, 22 nt, Human
aagcacauuaaggaacauugaa

SEQ ID NO: 10233 - RNA, 22 nt, Human
aagcacauuauagcuaucuagg

SEQ ID NO: 10234 - RNA, 22 nt, Human
aagcacauuguacauuugugcu

SEQ ID NO: 10235 - RNA, 22 nt, Human
aagcacauuuuccagcagcucu

SEQ ID NO: 10236 - RNA, 22 nt, Human
aagcaccucuaugauugcuuuu

SEQ ID NO: 10237 - RNA, 22 nt, Human
aagcaccugcaccggucgccuu

SEQ ID NO: 10238 - RNA, 22 nt, Human
aagcacuaggacuucagucucu

SEQ ID NO: 10239 - RNA, 22 nt, Human
aagcacugagcacaguggcuga

SEQ ID NO: 10240 - RNA, 22 nt, Human
aagcacugaggaaaaauuugau

SEQ ID NO: 10241 - RNA, 22 nt, Human
aagcacuggguauagcaaugau

SEQ ID NO: 10242 - RNA, 22 nt, Human
aagcacuguacaaaugucacuu

SEQ ID NO: 10243 - RNA, 22 nt, Human
aagcacuugcuuagaugugguu

SEQ ID NO: 10244 - RNA, 22 nt, Human
aagcacuuuaugucaauguccu

SEQ ID NO: 10245 - RNA, 22 nt, Human
aguuucauauuaccaugucacc

SEQ ID NO: 10246 - RNA, 22 nt, Human
aguuucauguagccauauuuac

SEQ ID NO: 10247 - RNA, 22 nt, Human
aguuucauugagauguuugcua

SEQ ID NO: 10248 - RNA, 21 nt, Human
aguuuccucaacugcagaagg

SEQ ID NO: 10249 - RNA, 22 nt, Human
aguuuccucaucuguaaaauga

SEQ ID NO: 10250 - RNA, 22 nt, Human
aguuuccuuggauucaauuugg

SEQ ID NO: 10251 - RNA, 22 nt, Human
aguuucucuagagucuuugaaa

SEQ ID NO: 10252 - RNA, 22 nt, Human
aguuucucucaguauagaauag

SEQ ID NO: 10253 - RNA, 22 nt, Human
aguuucuuauucuuaguuaugu

SEQ ID NO: 10254 - RNA, 22 nt, Human
aguuugaagcaaaauugaggaa

SEQ ID NO: 10255 - RNA, 22 nt, Human
aguuugaaggaguugaaucacc

SEQ ID NO: 10256 - RNA, 22 nt, Human
aguuugcagauuauauuagugu

SEQ ID NO: 10257 - RNA, 22 nt, Human
aguuugcugaugaagaaaauuu

SEQ ID NO: 10258 - RNA, 23 nt, Human
aguuuguaaagaaauauuugcac

SEQ ID NO: 10259 - RNA, 22 nt, Human
aguuuuaaaugauggugguggu

SEQ ID NO: 10260 - RNA, 22 nt, Human
aguuuuauaaaggcaccucagu

SEQ ID NO: 10261 - RNA, 21 nt, Human
aguuuuauauuauaagcuaaa

SEQ ID NO: 10262 - RNA, 22 nt, Human
aguuuuaucuguaagcuguuca

SEQ ID NO: 10263 - RNA, 22 nt, Human
aguuuuauuaaauccacagaag

SEQ ID NO: 10264 - RNA, 22 nt, Human
aguuuuauugucccagagguga

SEQ ID NO: 10265 - RNA, 22 nt, Human
aguuuucagaaauugcgaccca

SEQ ID NO: 10266 - RNA, 20 nt, Human
aguuuucagcagaacaccca

SEQ ID NO: 10267 - RNA, 22 nt, Human
aguuuucugaccccugcucuau

SEQ ID NO: 10268 - RNA, 22 nt, Human
aguuuucugccucuggaugcgu

SEQ ID NO: 10269 - RNA, 22 nt, Human
aguuuugaaaugaaauguaguu

SEQ ID NO: 10270 - RNA, 22 nt, Human
aguuuugauacuuucucuucau

SEQ ID NO: 10271 - RNA, 17 nt, Human
aguuuugauauaauggc

SEQ ID NO: 10272 - RNA, 21 nt, Human
aguuuuuacucuuaacugugg

SEQ ID NO: 10273 - RNA, 22 nt, Human
aguuuuuccugauuuuacagaa

SEQ ID NO: 10274 - RNA, 23 nt, Human
aguuuuucugcaugguucuguau

SEQ ID NO: 10275 - RNA, 22 nt, Human
aguuuuugagaauuuacuaugu

SEQ ID NO: 10276 - RNA, 22 nt, Human
auaaaaacugacccauccuuug

SEQ ID NO: 10277 - RNA, 22 nt, Human
auaaaaccaaagcagcaguguu

SEQ ID NO: 10278 - RNA, 20 nt, Human
auaaaacucuaaucuggccu

SEQ ID NO: 10279 - RNA, 22 nt, Human
auaaaagaucccuucugagcuc

SEQ ID NO: 10280 - RNA, 22 nt, Human
auaaaaguaggaccaacuuaca

SEQ ID NO: 10281 - RNA, 22 nt, Human
auaaaaguucaagagaguacag

SEQ ID NO: 10282 - RNA, 22 nt, Human
auaaaaguuuccaaucaugccu

SEQ ID NO: 10283 - RNA, 22 nt, Human
auaaaaugguaaacgaagcuga

SEQ ID NO: 10284 - RNA, 22 nt, Human
auaaaaugucuccacugggcuc

SEQ ID NO: 10285 - RNA, 22 nt, Human
auaaacagaguaguugcuacug

SEQ ID NO: 10286 - RNA, 22 nt, Human
auaaacagcauaaaauacgcuu

SEQ ID NO: 10287 - RNA, 22 nt, Human
auaaacaguagagaaagguggu

SEQ ID NO: 10288 - RNA, 22 nt, Human
auaaaccuaugcuaagcugugg

SEQ ID NO: 10289 - RNA, 22 nt, Human
auaaacuaauugggguauaguu

SEQ ID NO: 10290 - RNA, 22 nt, Human
auaaacucaugccaagaaauga

SEQ ID NO: 10291 - RNA, 22 nt, Human
auaaacucugccucagaagagc

SEQ ID NO: 10292 - RNA, 22 nt, Human
auaaacugugcuggaugaugag

SEQ ID NO: 10293 - RNA, 22 nt, Human
auaaagacaugcuuacuugccc

SEQ ID NO: 10294 - RNA, 22 nt, Human
auaaagaggauguauuuacagc

SEQ ID NO: 10295 - RNA, 22 nt, Human
auaaagauuucuuuuucucuac

SEQ ID NO: 10296 - RNA, 22 nt, Human
auaaagcauacuuuguaugacu

SEQ ID NO: 10297 - RNA, 22 nt, Human
auaaagccuuucuguuuucagg

SEQ ID NO: 10298 - RNA, 22 nt, Human
auaaagcuucugagucuagauc

SEQ ID NO: 10299 - RNA, 22 nt, Human
auaaaguagccacuggaaagcu

SEQ ID NO: 10300 - RNA, 22 nt, Human
auaaaguagcuuucagugccaa

SEQ ID NO: 10301 - RNA, 22 nt, Human
auaaagucaaggcauuuuauga

SEQ ID NO: 10302 - RNA, 22 nt, Human
auaaagucauuaugaagaucua

SEQ ID NO: 10303 - RNA, 22 nt, Human
auaaagucauuucaaaaguuga

SEQ ID NO: 10304 - RNA, 22 nt, Human
auaaauagugugucauaaaguc

SEQ ID NO: 10305 - RNA, 22 nt, Human
auaaauaucacuguugucccuc

SEQ ID NO: 10306 - RNA, 22 nt, Human
auaaaugaacauucacagagcu

SEQ ID NO: 10307 - RNA, 22 nt, Human
auaaaugauucagcaggaaaua

SEQ ID NO: 10308 - RNA, 22 nt, Human
auaaaugccucagaaucauccc

SEQ ID NO: 10309 - RNA, 22 nt, Human
auaaauggcuuucauuccuagg

SEQ ID NO: 10310 - RNA, 22 nt, Human
auaaaugugaauuagagcuuug

SEQ ID NO: 10311 - RNA, 22 nt, Human
auaaauguuuguugaaugaaua

SEQ ID NO: 10312 - RNA, 22 nt, Human
auaaauuaugaauggcccuuuu

SEQ ID NO: 10313 - RNA, 22 nt, Human
auaaauucaaagcauuuaggac

SEQ ID NO: 10314 - RNA, 22 nt, Human
auaacagauacucucugugagg

SEQ ID NO: 10315 - RNA, 22 nt, Human
auaacagaugugaagugcuaau

SEQ ID NO: 10316 - RNA, 22 nt, Human
auaacagguugaauccgaaugu

SEQ ID NO: 10317 - RNA, 22 nt, Human
auaacauggaguuugucauuua

SEQ ID NO: 10318 - RNA, 22 nt, Human
auaacccucuggauaggacagg

SEQ ID NO: 10319 - RNA, 23 nt, Human
auaacugagccgaggcuuaagaa

SEQ ID NO: 10320 - RNA, 22 nt, Human
auaacuuaaugggucaugcucu

SEQ ID NO: 10321 - RNA, 22 nt, Human
auaacuuauuagauuggagcug

SEQ ID NO: 10322 - RNA, 22 nt, Human
auaacuucaguuucuguguccu

SEQ ID NO: 10323 - RNA, 22 nt, Human
auaagaauaauuaaguuagucc

SEQ ID NO: 10324 - RNA, 22 nt, Human
auaagcuugauguaacuaacca

SEQ ID NO: 10325 - RNA, 22 nt, Human
auaagcuuuuaaagcuacuuug

SEQ ID NO: 10326 - RNA, 22 nt, Human
auaaggaaaauuggagaaauug

SEQ ID NO: 10327 - RNA, 22 nt, Human
auaaggacacccuucucuuuac

SEQ ID NO: 10328 - RNA, 22 nt, Human
auaaggacuugaauuagacauu

SEQ ID NO: 10329 - RNA, 22 nt, Human
auaaggcagaaaugauucuagu

SEQ ID NO: 10330 - RNA, 19 nt, Human
auaaggcaggaggaaauuu

SEQ ID NO: 10331 - RNA, 22 nt, Human
auaaggcagucccuuaacaagg

SEQ ID NO: 10332 - RNA, 19 nt, Human
auaaggcagugacuuuuuu

SEQ ID NO: 10333 - RNA, 22 nt, Human
auaaggcauauagucacuuuuu

SEQ ID NO: 10334 - RNA, 22 nt, Human
auaagguuaggauuauaguguu

SEQ ID NO: 10335 - RNA, 22 nt, Human
auaagugcccaaaaugaaagga

SEQ ID NO: 10336 - RNA, 22 nt, Human
auaauaacaaugccagaugccu

SEQ ID NO: 10337 - RNA, 23 nt, Human
auaauaacgucugucuugucucu

SEQ ID NO: 10338 - RNA, 22 nt, Human
auaauaauacugugcaauggau

SEQ ID NO: 10339 - RNA, 22 nt, Human
auaauagcauuagguuuaugca

SEQ ID NO: 10340 - RNA, 22 nt, Human
auaauauuugcauuacugugau

SEQ ID NO: 10341 - RNA, 22 nt, Human
auaaucaaaguccuaugacauc

SEQ ID NO: 10342 - RNA, 22 nt, Human
auaaucagaauucaugaaagau

SEQ ID NO: 10343 - RNA, 22 nt, Human
auaauccauuaauuaaugacca

SEQ ID NO: 10344 - RNA, 22 nt, Human
auaaucugagcuauuucaugag

SEQ ID NO: 10345 - RNA, 22 nt, Human
auaaugaaucagcauaggguga

SEQ ID NO: 10346 - RNA, 22 nt, Human
auaaugaaugcagaguuauuuu

SEQ ID NO: 10347 - RNA, 23 nt, Human
auaaugcaaguggugguaaucug

SEQ ID NO: 10348 - RNA, 22 nt, Human
auaaugcaccuuugaguauggc

SEQ ID NO: 10349 - RNA, 22 nt, Human
auaauggcaugacaguuauaua

SEQ ID NO: 10350 - RNA, 22 nt, Human
auaaugugaagauaaugcaaga

SEQ ID NO: 10351 - RNA, 22 nt, Human
auaauuacauuauacuguuaga

SEQ ID NO: 10352 - RNA, 22 nt, Human
aggaauggugcucagcagaaau

SEQ ID NO: 10353 - RNA, 22 nt, Human
aggaauguaguuugaguagaaa

SEQ ID NO: 10354 - RNA, 22 nt, Human
aggcagugccuggaccccagcu

SEQ ID NO: 10355 - RNA, 22 nt, Human
aggcaguggaugucaggaaugg

SEQ ID NO: 10356 - RNA, 23 nt, Human
aggcagugggggccacuuugcuu

SEQ ID NO: 10357 - RNA, 20 nt, Human
aggcaguuagaaggagauga

SEQ ID NO: 10358 - RNA, 22 nt, Human
aggccaaguagccgcuguccua

SEQ ID NO: 10359 - RNA, 22 nt, Human
aggccaaguuacuugggaaagc

SEQ ID NO: 10360 - RNA, 22 nt, Human
aggccacauugugauucccgca

SEQ ID NO: 10361 - RNA, 20 nt, Human
aggccacugaaugccaauca

SEQ ID NO: 10362 - RNA, 22 nt, Human
aggccagaaaugucagggagug

SEQ ID NO: 10363 - RNA, 22 nt, Human
aggccagaagccagaaaugcuu

SEQ ID NO: 10364 - RNA, 22 nt, Human
aggccagacuuuggccaaaucc

SEQ ID NO: 10365 - RNA, 22 nt, Human
aggccagagaggggaccagccu

SEQ ID NO: 10366 - RNA, 22 nt, Human
aggccagaguuaaggagaacag

SEQ ID NO: 10367 - RNA, 17 nt, Human
aggccagaugaggcaag

SEQ ID NO: 10368 - RNA, 22 nt, Human
aggccagcaccagagucaagaa

SEQ ID NO: 10369 - RNA, 22 nt, Human
aggccagcaugcaguucuaagg

SEQ ID NO: 10370 - RNA, 22 nt, Human
aggccagccuuguaaaugccuc

SEQ ID NO: 10371 - RNA, 22 nt, Human
aggccagcgcugcuagcucccg

SEQ ID NO: 10372 - RNA, 22 nt, Human
aggccaggaccauuagcccaga

SEQ ID NO: 10373 - RNA, 22 nt, Human
aggccagggcacugcucuuuag

SEQ ID NO: 10374 - RNA, 22 nt, Human
aggccagguggucaugcuugcu

SEQ ID NO: 10375 - RNA, 22 nt, Human
aggccagugccuuuccagggcu

SEQ ID NO: 10376 - RNA, 22 nt, Human
aggccaguuuuuggagggaaac

SEQ ID NO: 10377 - RNA, 22 nt, Human
aggcccagcuugaagugggaag

SEQ ID NO: 10378 - RNA, 21 nt, Human
aggcccagcuuuccucuugcu

SEQ ID NO: 10379 - RNA, 22 nt, Human
aggcccaguagucgacggcgcu

SEQ ID NO: 10380 - RNA, 22 nt, Human
aggcccaguagugcugccuuua

SEQ ID NO: 10381 - RNA, 22 nt, Human
aggcccauaguagcucugggca

SEQ ID NO: 10382 - RNA, 20 nt, Human
aggccccaggaaacucucag

SEQ ID NO: 10383 - RNA, 22 nt, Human
aggccccaucaggaaggaggcc

SEQ ID NO: 10384 - RNA, 22 nt, Human
aggcccugaagucggccccuca

SEQ ID NO: 10385 - RNA, 22 nt, Human
aggcccugagaaaaucccugca

SEQ ID NO: 10386 - RNA, 22 nt, Human
aggcccugcaggaagcaggaug

SEQ ID NO: 10387 - RNA, 22 nt, Human
aggcccugcauuguacugaggg

SEQ ID NO: 10388 - RNA, 23 nt, Human
aggcccugccugucccucuuuuu

SEQ ID NO: 10389 - RNA, 22 nt, Human
aggcccugcggaaaugaucauu

SEQ ID NO: 10390 - RNA, 18 nt, Human
aggcccuggccucgaaca

SEQ ID NO: 10391 - RNA, 22 nt, Human
aggcccugggagcagagaugca

SEQ ID NO: 10392 - RNA, 22 nt, Human
aggcccuuaggaccccugcgug

SEQ ID NO: 10393 - RNA, 22 nt, Human
aggccgaaguggaugggcaucu

SEQ ID NO: 10394 - RNA, 22 nt, Human
aggccucacacaacagaugcau

SEQ ID NO: 10395 - RNA, 22 nt, Human
aggccucaguuuccccaguugu

SEQ ID NO: 10396 - RNA, 22 nt, Human
aggccuccagccacaugccagu

SEQ ID NO: 10397 - RNA, 17 nt, Human
aggccucccuccaggcc

SEQ ID NO: 10398 - RNA, 22 nt, Human
aggccucucuccuuggcuugua

SEQ ID NO: 10399 - RNA, 22 nt, Human
aggccucugagcagcacucaug

SEQ ID NO: 10400 - RNA, 22 nt, Human
aggccucuguuccccauguuuu

SEQ ID NO: 10401 - RNA, 22 nt, Human
aggccucuucagggagcaugga

SEQ ID NO: 10402 - RNA, 22 nt, Human
aggccucuugucuuccucacau

SEQ ID NO: 10403 - RNA, 20 nt, Human
aggccugagagaugacuggg

SEQ ID NO: 10404 - RNA, 22 nt, Human
aggccugagcagaggaguggac

SEQ ID NO: 10405 - RNA, 22 nt, Human
aggccugaggaccagauaaaug

SEQ ID NO: 10406 - RNA, 18 nt, Human
aggccugcccagcacugu

SEQ ID NO: 10407 - RNA, 22 nt, Human
aggccugccuggaucacacaga

SEQ ID NO: 10408 - RNA, 22 nt, Human
aggccuggguguucaccagaag

SEQ ID NO: 10409 - RNA, 22 nt, Human
aggccuguuggcgugggcucua

SEQ ID NO: 10410 - RNA, 22 nt, Human
aggccuugggccauagucuccu

SEQ ID NO: 10411 - RNA, 22 nt, Human
aggcgagaggcuugggcuagua

SEQ ID NO: 10412 - RNA, 22 nt, Human
aggcgcacaggguguugaugug

SEQ ID NO: 10413 - RNA, 22 nt, Human
aggcgcagaaggccaggggccu

SEQ ID NO: 10414 - RNA, 22 nt, Human
aggcgcagacauacagggucug

SEQ ID NO: 10415 - RNA, 22 nt, Human
aggcgcugaguaggcaaggagg

SEQ ID NO: 10416 - RNA, 22 nt, Human
aggcgcugcaugugaaggaguu

SEQ ID NO: 10417 - RNA, 22 nt, Human
aggcgcugcgcuggggccagaa

SEQ ID NO: 10418 - RNA, 22 nt, Human
aggcgcugugcuuggggcugga

SEQ ID NO: 10419 - RNA, 22 nt, Human
aggcggguuuaggacaaugcuu

SEQ ID NO: 10420 - RNA, 22 nt, Human
aggcuaaaagagaaucauuuag

SEQ ID NO: 10421 - RNA, 22 nt, Human
aggcuaagaggccuucagauac

SEQ ID NO: 10422 - RNA, 22 nt, Human
aggcuaauauuuaugaaaccaa

SEQ ID NO: 10423 - RNA, 22 nt, Human
aggcuacaauaauucccaugca

SEQ ID NO: 10424 - RNA, 22 nt, Human
aggcuacagauacagaggcuac

SEQ ID NO: 10425 - RNA, 22 nt, Human
aggcuacaggagacgccaggag

SEQ ID NO: 10426 - RNA, 22 nt, Human
aggcuacuucuagagggacaau

SEQ ID NO: 10427 - RNA, 22 nt, Human
aggcuagacuuuggcgaagcac

SEQ ID NO: 10428 - RNA, 22 nt, Human
aggcuagauagagggucaucuu

SEQ ID NO: 10429 - RNA, 22 nt, Human
aggcuagcaaugggagaugagu

SEQ ID NO: 10430 - RNA, 22 nt, Human
aggcuagcuuuggcucaguaaa

SEQ ID NO: 10431 - RNA, 22 nt, Human
aggcuaggccuugcccuggaac

SEQ ID NO: 10432 - RNA, 22 nt, Human
aggcuaggggcagugccagcau

SEQ ID NO: 10433 - RNA, 22 nt, Human
aggcuaguaucaucuacuuuug

SEQ ID NO: 10434 - RNA, 22 nt, Human
aggcuaucagauagaaugaagg

SEQ ID NO: 10435 - RNA, 22 nt, Human
aggcucaagcacugauauuuuu

SEQ ID NO: 10436 - RNA, 16 nt, Human
aggcucagaggcugga

SEQ ID NO: 10437 - RNA, 20 nt, Human
aggcucagauacccagggaa

SEQ ID NO: 10438 - RNA, 20 nt, Human
aggcucagcugagcucuugg

SEQ ID NO: 10439 - RNA, 22 nt, Human
aggcucaggaggagcugccgga

SEQ ID NO: 10440 - RNA, 22 nt, Human
aggcucagucccggcccgcgcc

SEQ ID NO: 10441 - RNA, 22 nt, Human
aggcucagugauguaaaauaua

SEQ ID NO: 10442 - RNA, 22 nt, Human
aggcucagugcaaaucauucug

SEQ ID NO: 10443 - RNA, 22 nt, Human
aggcucaguucuguggugagcc

SEQ ID NO: 10444 - RNA, 22 nt, Human
aggcucauccccacaaagcaaa

SEQ ID NO: 10445 - RNA, 22 nt, Human
aggcuccaaauuaccaagcucu

SEQ ID NO: 10446 - RNA, 22 nt, Human
aggcuccaccccgccagaccuu

SEQ ID NO: 10447 - RNA, 22 nt, Human
aggcuccagcagccagaggaag

SEQ ID NO: 10448 - RNA, 22 nt, Human
aggcuccaugguucucccucag

SEQ ID NO: 10449 - RNA, 22 nt, Human
aggcuccauuuuccugcagcug

SEQ ID NO: 10450 - RNA, 21 nt, Human
aggcucccagaaaugggcauc

SEQ ID NO: 10451 - RNA, 22 nt, Human
aggcuccucggggcugacggcg

SEQ ID NO: 10452 - RNA, 22 nt, Human
aggcuccugcaggugaggugcu

SEQ ID NO: 10453 - RNA, 22 nt, Human
aggcuccuucacagcacucgcc

SEQ ID NO: 10454 - RNA, 22 nt, Human
aggcuccuuguucaucauccau

SEQ ID NO: 10455 - RNA, 22 nt, Human
aggcucucaauaugauccaguc

SEQ ID NO: 10456 - RNA, 22 nt, Human
aggcucucacuauccuccuagc

SEQ ID NO: 10457 - RNA, 22 nt, Human
aggcucucuagaaacugugccu

SEQ ID NO: 10458 - RNA, 22 nt, Human
aggcucugaaggagaaccuguu

SEQ ID NO: 10459 - RNA, 22 nt, Human
aggcucugacgucacacguggc

SEQ ID NO: 10460 - RNA, 22 nt, Human
aggcucugaucagguggcugug

SEQ ID NO: 10461 - RNA, 22 nt, Human
aggcucugcaguccaucccgug

SEQ ID NO: 10462 - RNA, 20 nt, Human
aggcucugcauuucugagug

SEQ ID NO: 10463 - RNA, 22 nt, Human
agguggcagccgagacauaagg

SEQ ID NO: 10464 - RNA, 22 nt, Human
agguggcauuuacaccauggga

SEQ ID NO: 10465 - RNA, 22 nt, Human
agguggccaauaaauguuggag

SEQ ID NO: 10466 - RNA, 23 nt, Human
agguggccaccagaauguuaagg

SEQ ID NO: 10467 - RNA, 22 nt, Human
agguggccccaggccucugcca

SEQ ID NO: 10468 - RNA, 22 nt, Human
agguggcuaugaggaugcaguc

SEQ ID NO: 10469 - RNA, 22 nt, Human
agguggcucugacagcucuggu

SEQ ID NO: 10470 - RNA, 22 nt, Human
agguggcugaagagugggugag

SEQ ID NO: 10471 - RNA, 22 nt, Human
agguggcugguccaggcugcag

SEQ ID NO: 10472 - RNA, 22 nt, Human
agguggcuucuggccaggugug

SEQ ID NO: 10473 - RNA, 22 nt, Human
aggugggaacccagcagggccc

SEQ ID NO: 10474 - RNA, 22 nt, Human
aggugggacccguggggugcga

SEQ ID NO: 10475 - RNA, 21 nt, Human
aggugggagaccauguagguc

SEQ ID NO: 10476 - RNA, 22 nt, Human
aggugggcacaccucccuucuc

SEQ ID NO: 10477 - RNA, 22 nt, Human
aggugggcacuccgcucgaggu

SEQ ID NO: 10478 - RNA, 21 nt, Human
aggugggcagguggaguggcc

SEQ ID NO: 10479 - RNA, 22 nt, Human
aggugggcggaucacaagguca

SEQ ID NO: 10480 - RNA, 22 nt, Human
agguggggaguauauguaauug

SEQ ID NO: 10481 - RNA, 22 nt, Human
agguggggccaaaugcuacagu

SEQ ID NO: 10482 - RNA, 22 nt, Human
agguggggcccaccaauuugca

SEQ ID NO: 10483 - RNA, 22 nt, Human
aggugggguucagucucagccg

SEQ ID NO: 10484 - RNA, 23 nt, Human
agguggucuuguggaugcugcaa

SEQ ID NO: 10485 - RNA, 22 nt, Human
agguggugaugacagaagacag

SEQ ID NO: 10486 - RNA, 22 nt, Human
agguguccggcugcauaaucuu

SEQ ID NO: 10487 - RNA, 20 nt, Human
agguguccuguagcuugagu

SEQ ID NO: 10488 - RNA, 22 nt, Human
aggugugcaggaugaaccccuc

SEQ ID NO: 10489 - RNA, 22 nt, Human
agguguggcuugaagucucuau

SEQ ID NO: 10490 - RNA, 22 nt, Human
aggugugggaaacgggugaccu

SEQ ID NO: 10491 - RNA, 17 nt, Human
agguguggucaagggag

SEQ ID NO: 10492 - RNA, 22 nt, Human
agguguguauaaacauacauau

SEQ ID NO: 10493 - RNA, 19 nt, Human
agguuacaggugucacaga

SEQ ID NO: 10494 - RNA, 22 nt, Human
agguuacagucaucucagaauc

SEQ ID NO: 10495 - RNA, 22 nt, Human
agguuaggaaccaguguuugac

SEQ ID NO: 10496 - RNA, 22 nt, Human
agguuaguaugacacgguuaua

SEQ ID NO: 10497 - RNA, 22 nt, Human
agguuagugcugaaaugacaug

SEQ ID NO: 10498 - RNA, 22 nt, Human
agguuauugcucuccaaguuca

SEQ ID NO: 10499 - RNA, 22 nt, Human
agguucaaaugcaagagaugcu

SEQ ID NO: 10500 - RNA, 22 nt, Human
agguucagacgcauaauaggca

SEQ ID NO: 10501 - RNA, 22 nt, Human
agguucagaugacuuuuaugcu

SEQ ID NO: 10502 - RNA, 23 nt, Human
agguucaggagauggaggaacaa

SEQ ID NO: 10503 - RNA, 22 nt, Human
agguucaguaaauguuaguuga

SEQ ID NO: 10504 - RNA, 22 nt, Human
agguucagucuuuggaccccuc

SEQ ID NO: 10505 - RNA, 22 nt, Human
agguuccaagaaaucaucagug

SEQ ID NO: 10506 - RNA, 20 nt, Human
agguuccagccacaaccagc

SEQ ID NO: 10507 - RNA, 22 nt, Human
agguucuggcauugcucaguaa

SEQ ID NO: 10508 - RNA, 22 nt, Human
agguucuuggugagcauuuggu

SEQ ID NO: 10509 - RNA, 22 nt, Human
agguucuugguguccagauuuc

SEQ ID NO: 10510 - RNA, 22 nt, Human
agguuggcugcucuuuuccuaa

SEQ ID NO: 10511 - RNA, 20 nt, Human
agguuuauauuuagaggugu

SEQ ID NO: 10512 - RNA, 22 nt, Human
agguuuaugaguuuggaagggg

SEQ ID NO: 10513 - RNA, 17 nt, Human
agguuuaugguauuuga

SEQ ID NO: 10514 - RNA, 22 nt, Human
agguuuauuaaguaaauagagc

SEQ ID NO: 10515 - RNA, 22 nt, Human
agguuuauuauguagcauuauu

SEQ ID NO: 10516 - RNA, 22 nt, Human
agguuuccagcaggccauagau

SEQ ID NO: 10517 - RNA, 22 nt, Human
agguuucuccuuuaaagcaugg

SEQ ID NO: 10518 - RNA, 22 nt, Human
agguuucugcuguccuccuucu

SEQ ID NO: 10519 - RNA, 22 nt, Human
agguuucuggaaagguuuugcu

SEQ ID NO: 10520 - RNA, 21 nt, Human
agguuucugugagcagagcag

SEQ ID NO: 10521 - RNA, 22 nt, Human
agguuugggaguagaaaucaga

SEQ ID NO: 10522 - RNA, 22 nt, Human
agguuuguuuauguaucauugg

SEQ ID NO: 10523 - RNA, 22 nt, Human
aguaaaaauaugcuuguggcua

SEQ ID NO: 10524 - RNA, 22 nt, Human
aguaaaaucuuaagcacagugg

SEQ ID NO: 10525 - RNA, 22 nt, Human
aguaaacauagaauguucuucc

SEQ ID NO: 10526 - RNA, 22 nt, Human
aguaaacauuucagauuuauuu

SEQ ID NO: 10527 - RNA, 23 nt, Human
aguaaagcaauuguuggcgagag

SEQ ID NO: 10528 - RNA, 22 nt, Human
aguaaagcggugucacagaaug

SEQ ID NO: 10529 - RNA, 22 nt, Human
aguaaaucagaccucauuaugu

SEQ ID NO: 10530 - RNA, 22 nt, Human
aguaaaugaaagcaauuuuaga

SEQ ID NO: 10531 - RNA, 22 nt, Human
aguaaaugauuauuuugccaac

SEQ ID NO: 10532 - RNA, 22 nt, Human
aguaaauggugguuuuuaucau

SEQ ID NO: 10533 - RNA, 22 nt, Human
aguaaauuauuuagcuuccaga

SEQ ID NO: 10534 - RNA, 22 nt, Human
aguaacaaagugggagaaugau

SEQ ID NO: 10535 - RNA, 22 nt, Human
aguaacaaaugcaucugggcau

SEQ ID NO: 10536 - RNA, 22 nt, Human
aguaacacuauuuucauaugua

SEQ ID NO: 10537 - RNA, 22 nt, Human
aguaacauuuagcuucucacug

SEQ ID NO: 10538 - RNA, 22 nt, Human
aguaacuuaagcaauuguguau

SEQ ID NO: 10539 - RNA, 22 nt, Human
aguaaguaccuccacuugauug

SEQ ID NO: 10540 - RNA, 22 nt, Human
aguaaguuccaguuucauuaug

SEQ ID NO: 10541 - RNA, 22 nt, Human
aguaauaauagcuguaaagugc

SEQ ID NO: 10542 - RNA, 22 nt, Human
aguaauagagauuuuaaugucc

SEQ ID NO: 10543 - RNA, 22 nt, Human
aguaauagugaaucgacuauga

SEQ ID NO: 10544 - RNA, 22 nt, Human
aguaaucaaauuaagcuaauug

SEQ ID NO: 10545 - RNA, 22 nt, Human
aguaaucugauuuuauagcuau

SEQ ID NO: 10546 - RNA, 22 nt, Human
aguaaugauuauguacagaaug

SEQ ID NO: 10547 - RNA, 22 nt, Human
aguaauggguugaaauuuaguu

SEQ ID NO: 10548 - RNA, 22 nt, Human
aguaaugugccugaaauacuug

SEQ ID NO: 10549 - RNA, 22 nt, Human
aguaauuuguuauaaagcaaua

SEQ ID NO: 10550 - RNA, 22 nt, Human
aguacaaacuguuucaaaguag

SEQ ID NO: 10551 - RNA, 22 nt, Human
aguacaaauuauagcgcuugga

SEQ ID NO: 10552 - RNA, 22 nt, Human
aguacacaguagacuuucucau

SEQ ID NO: 10553 - RNA, 22 nt, Human
aguacacuaugguaacuggagu

SEQ ID NO: 10554 - RNA, 22 nt, Human
aguacagauuucugggcccuac

SEQ ID NO: 10555 - RNA, 22 nt, Human
aguacauacuucaaauguacuu

SEQ ID NO: 10556 - RNA, 22 nt, Human
aguacauuuuucaguggggagu

SEQ ID NO: 10557 - RNA, 22 nt, Human
aguaccaucucugccucugccu

SEQ ID NO: 10558 - RNA, 22 nt, Human
aguaccauuauccaguaaagga

SEQ ID NO: 10559 - RNA, 22 nt, Human
aguacuuuagcauaaagcaguu

SEQ ID NO: 10560 - RNA, 22 nt, Human
aguagaauaauuggauuacagu

SEQ ID NO: 10561 - RNA, 22 nt, Human
aguagaaucccuugcaaugucc

SEQ ID NO: 10562 - RNA, 22 nt, Human
aguagcaauguuugagaagcac

SEQ ID NO: 10563 - RNA, 22 nt, Human
aguagcacaauuuugucccuaa

SEQ ID NO: 10564 - RNA, 19 nt, Human
aguagcagaaagugcagug

SEQ ID NO: 10565 - RNA, 22 nt, Human
aguagcagaguuggacuaugca

SEQ ID NO: 10566 - RNA, 22 nt, Human
aguagcaugugcacaguaauuu

SEQ ID NO: 10567 - RNA, 22 nt, Human
aguaggaggcgggagcaugaag

SEQ ID NO: 10568 - RNA, 22 nt, Human
aguaggauaagagccuguccaa

SEQ ID NO: 10569 - RNA, 22 nt, Human
aguaggaugcuuuauaugaaag

SEQ ID NO: 10570 - RNA, 20 nt, Human
aguaggcaaaggaaagaucu

SEQ ID NO: 10571 - RNA, 18 nt, Human
aguaggcacugugggguu

SEQ ID NO: 10572 - RNA, 23 nt, Human
agggguggucaguacccgcagug

SEQ ID NO: 10573 - RNA, 22 nt, Human
aggguauguuuuuaucuacugu

SEQ ID NO: 10574 - RNA, 22 nt, Human
agggucaacaggagucaagaug

SEQ ID NO: 10575 - RNA, 22 nt, Human
agggucaacauuucauugauuc

SEQ ID NO: 10576 - RNA, 22 nt, Human
agggucaccugcuugccagggc

SEQ ID NO: 10577 - RNA, 22 nt, Human
agggucaguagugaugcgugaa

SEQ ID NO: 10578 - RNA, 22 nt, Human
agggucagugaugagggagccc

SEQ ID NO: 10579 - RNA, 22 nt, Human
agggucaguucugugagguguu

SEQ ID NO: 10580 - RNA, 22 nt, Human
aggguccacuuggacauugauc

SEQ ID NO: 10581 - RNA, 22 nt, Human
aggguccauguuuccaguuaau

SEQ ID NO: 10582 - RNA, 22 nt, Human
agggucccgucccucugcaccc

SEQ ID NO: 10583 - RNA, 22 nt, Human
agggucucuggagagcugagga

SEQ ID NO: 10584 - RNA, 22 nt, Human
agggucugacaaugugacuuag

SEQ ID NO: 10585 - RNA, 20 nt, Human
agggucuggcccuguuccuu

SEQ ID NO: 10586 - RNA, 22 nt, Human
agggucuguauuucuggcaagc

SEQ ID NO: 10587 - RNA, 22 nt, Human
agggucuguggaugcaucuggg

SEQ ID NO: 10588 - RNA, 22 nt, Human
agggugacuuugggcaaguuac

SEQ ID NO: 10589 - RNA, 23 nt, Human
agggugagcaagcuauggagacc

SEQ ID NO: 10590 - RNA, 22 nt, Human
aggguggagggagucccugagc

SEQ ID NO: 10591 - RNA, 22 nt, Human
aggguggcaguuacuggagcaa

SEQ ID NO: 10592 - RNA, 22 nt, Human
aggguggcugaguagauggaag

SEQ ID NO: 10593 - RNA, 22 nt, Human
aggguggcugugaagugcuugg

SEQ ID NO: 10594 - RNA, 22 nt, Human
agggugguggcgaugaggacau

SEQ ID NO: 10595 - RNA, 20 nt, Human
agggugugggccuuagccau

SEQ ID NO: 10596 - RNA, 22 nt, Human
aggguucugccagugucuugag

SEQ ID NO: 10597 - RNA, 22 nt, Human
aggguugccucugagugcuccg

SEQ ID NO: 10598 - RNA, 22 nt, Human
agguaaacaggagaaaaugaga

SEQ ID NO: 10599 - RNA, 22 nt, Human
agguaaagacugcaaggagaau

SEQ ID NO: 10600 - RNA, 22 nt, Human
agguaaggagucccaaccaucc

SEQ ID NO: 10601 - RNA, 22 nt, Human
agguaagggcugcgacuauaag

SEQ ID NO: 10602 - RNA, 22 nt, Human
agguaaugcaacuacuuugcua

SEQ ID NO: 10603 - RNA, 22 nt, Human
agguaaugcauauaaagugcuu

SEQ ID NO: 10604 - RNA, 22 nt, Human
agguacaaaagaguauaugaga

SEQ ID NO: 10605 - RNA, 22 nt, Human
agguacaguagacagacaguua

SEQ ID NO: 10606 - RNA, 22 nt, Human
agguacauaggaaaguggagcu

SEQ ID NO: 10607 - RNA, 22 nt, Human
agguacaucuauggggauagaa

SEQ ID NO: 10608 - RNA, 21 nt, Human
agguaccaaaagccugcauga

SEQ ID NO: 10609 - RNA, 22 nt, Human
agguaccaaaagccuuuuucug

SEQ ID NO: 10610 - RNA, 22 nt, Human
agguagaagagcaaggaauaac

SEQ ID NO: 10611 - RNA, 22 nt, Human
agguagaaggaccagaauuuau

SEQ ID NO: 10612 - RNA, 22 nt, Human
agguagagcuccaguagaaaau

SEQ ID NO: 10613 - RNA, 22 nt, Human
agguagcuaaaacaggcuuuug

SEQ ID NO: 10614 - RNA, 22 nt, Human
agguauagaauugaaaggguuu

SEQ ID NO: 10615 - RNA, 19 nt, Human
agguauuugggagauauau

SEQ ID NO: 10616 - RNA, 22 nt, Human
aggucaagauucuacauuugua

SEQ ID NO: 10617 - RNA, 22 nt, Human
aggucaaggcugcagugagcug

SEQ ID NO: 10618 - RNA, 22 nt, Human
aggucaagggagcugagggcca

SEQ ID NO: 10619 - RNA, 22 nt, Human
aggucacagcuuucucgugagg

SEQ ID NO: 10620 - RNA, 22 nt, Human
aggucacguccugugaugucau

SEQ ID NO: 10621 - RNA, 22 nt, Human
aggucacuuccugucuggauaa

SEQ ID NO: 10622 - RNA, 22 nt, Human
aggucagagcaauguauugcuu

SEQ ID NO: 10623 - RNA, 23 nt, Human
aggucagcaggcaaggaaauggc

SEQ ID NO: 10624 - RNA, 22 nt, Human
aggucagcaggccaggggcgaa

SEQ ID NO: 10625 - RNA, 21 nt, Human
agggagcauguuagcuuucga

SEQ ID NO: 10626 - RNA, 22 nt, Human
agggagcauugugacauaucac

SEQ ID NO: 10627 - RNA, 22 nt, Human
agggagccagaguugggagcuc

SEQ ID NO: 10628 - RNA, 22 nt, Human
agggagcucacaguccaguaga

SEQ ID NO: 10629 - RNA, 22 nt, Human
agggagcuguggucagcucagu

SEQ ID NO: 10630 - RNA, 22 nt, Human
agggagcuuccgaacuacagcu

SEQ ID NO: 10631 - RNA, 22 nt, Human
agggagcuucuggccucagccu

SEQ ID NO: 10632 - RNA, 22 nt, Human
agggagcuuuaccccagaucac

SEQ ID NO: 10633 - RNA, 22 nt, Human
agggagcuuucagguagcuuaa

SEQ ID NO: 10634 - RNA, 22 nt, Human
agggaggaccaaugugugguua

SEQ ID NO: 10635 - RNA, 22 nt, Human
agggaggcaggaaaguugucug

SEQ ID NO: 10636 - RNA, 19 nt, Human
agggagguagcauuggaaa

SEQ ID NO: 10637 - RNA, 22 nt, Human
agggaggucuggcugcccugag

SEQ ID NO: 10638 - RNA, 22 nt, Human
agggaggucuuugaggggcuua

SEQ ID NO: 10639 - RNA, 20 nt, Human
agggaggugcugggccugag

SEQ ID NO: 10640 - RNA, 22 nt, Human
agggagucaacacaguaauguu

SEQ ID NO: 10641 - RNA, 22 nt, Human
agggaguguaaauggugcucag

SEQ ID NO: 10642 - RNA, 22 nt, Human
agggaguguuacauaauggguu

SEQ ID NO: 10643 - RNA, 19 nt, Human
agggaguuuauauuugcac

SEQ ID NO: 10644 - RNA, 18 nt, Human
agggaguuuuagggaagg

SEQ ID NO: 10645 - RNA, 22 nt, Human
agggaucaguagggacggcagc

SEQ ID NO: 10646 - RNA, 22 nt, Human
agggaugacucuuggcugauuc

SEQ ID NO: 10647 - RNA, 22 nt, Human
agggauggagugcggcccggac

SEQ ID NO: 10648 - RNA, 22 nt, Human
agggaugggaacuccuccagca

SEQ ID NO: 10649 - RNA, 18 nt, Human
agggauguaugcuggugg

SEQ ID NO: 10650 - RNA, 22 nt, Human
agggauguuaguugugagcuca

SEQ ID NO: 10651 - RNA, 22 nt, Human
agggauguucauuuuguggcug

SEQ ID NO: 10652 - RNA, 22 nt, Human
agggcaaguugagugugcgugg

SEQ ID NO: 10653 - RNA, 22 nt, Human
agggcaauccagccagcugauc

SEQ ID NO: 10654 - RNA, 22 nt, Human
agggcaauggacuacaaaaggu

SEQ ID NO: 10655 - RNA, 22 nt, Human
agggcacaagacucugagcccc

SEQ ID NO: 10656 - RNA, 22 nt, Human
agggcacagccuaaagccuaug

SEQ ID NO: 10657 - RNA, 22 nt, Human
agggcacccucucugcaguacc

SEQ ID NO: 10658 - RNA, 22 nt, Human
agggcaccuguuuuagcuuggu

SEQ ID NO: 10659 - RNA, 23 nt, Human
agggcacuguuggguguugagga

SEQ ID NO: 10660 - RNA, 22 nt, Human
agggcacuuccucugggucccu

SEQ ID NO: 10661 - RNA, 22 nt, Human
agggcacuuuacccauagcuug

SEQ ID NO: 10662 - RNA, 22 nt, Human
agggcagagaaauguaguugag

SEQ ID NO: 10663 - RNA, 22 nt, Human
agggcagagagaugaaugggau

SEQ ID NO: 10664 - RNA, 22 nt, Human
agggcagagauuaauuaagaca

SEQ ID NO: 10665 - RNA, 22 nt, Human
agggcagagcacugaauuggga

SEQ ID NO: 10666 - RNA, 22 nt, Human
agggcagcaaaguuugaccuca

SEQ ID NO: 10667 - RNA, 22 nt, Human
agggcagcaauuugguuccugg

SEQ ID NO: 10668 - RNA, 22 nt, Human
agggcagcagcugucccugaga

SEQ ID NO: 10669 - RNA, 22 nt, Human
agggcagccaugagccuucagg

SEQ ID NO: 10670 - RNA, 22 nt, Human
agggcagcccuucugggagggc

SEQ ID NO: 10671 - RNA, 22 nt, Human
agggcagcggugcuuguguuau

SEQ ID NO: 10672 - RNA, 22 nt, Human
agggcagcugugagccacugug

SEQ ID NO: 10673 - RNA, 22 nt, Human
agggcaguucaacuucauagug

SEQ ID NO: 10674 - RNA, 22 nt, Human
agggcaucagguauuuuaugcu

SEQ ID NO: 10675 - RNA, 22 nt, Human
agggcaucucuaacagucuccu

SEQ ID NO: 10676 - RNA, 22 nt, Human
agggccaaguccaggaccucgg

SEQ ID NO: 10677 - RNA, 22 nt, Human
agggccaccagagcagggcagu

SEQ ID NO: 10678 - RNA, 19 nt, Human
agggccacggggagguauu

SEQ ID NO: 10679 - RNA, 23 nt, Human
agggccacugggaaggauuacug

SEQ ID NO: 10680 - RNA, 22 nt, Human
agggccagcugcagaauuagca

SEQ ID NO: 10681 - RNA, 22 nt, Human
agucuuuacuaaacagaccacc

SEQ ID NO: 10682 - RNA, 22 nt, Human
agucuuuccugcuugacuguuc

SEQ ID NO: 10683 - RNA, 21 nt, Human
agucuuugauaaagacaaagu

SEQ ID NO: 10684 - RNA, 19 nt, Human
agucuuugccuggggccuu

SEQ ID NO: 10685 - RNA, 22 nt, Human
agucuuuuauucaaggcuaagu

SEQ ID NO: 10686 - RNA, 22 nt, Human
agugaaaagaugcauuucucug

SEQ ID NO: 10687 - RNA, 22 nt, Human
agugaaauaaagcugccuaugg

SEQ ID NO: 10688 - RNA, 22 nt, Human
agugaaaucagguuuugacugc

SEQ ID NO: 10689 - RNA, 22 nt, Human
agugaaauccuggucaacaggu

SEQ ID NO: 10690 - RNA, 22 nt, Human
agugaaaugauaguguaaauac

SEQ ID NO: 10691 - RNA, 22 nt, Human
agugaaaugauucugagcaaga

SEQ ID NO: 10692 - RNA, 22 nt, Human
agugaaauugcuguaagaggaa

SEQ ID NO: 10693 - RNA, 22 nt, Human
agugaaauuuguuuagauaggu

SEQ ID NO: 10694 - RNA, 19 nt, Human
agugaacacaaagagaagg

SEQ ID NO: 10695 - RNA, 22 nt, Human
agugaaccaggcugcgucccug

SEQ ID NO: 10696 - RNA, 22 nt, Human
agugaagauauacuguuguccu

SEQ ID NO: 10697 - RNA, 22 nt, Human
agugaagcccauuuuuagcugu

SEQ ID NO: 10698 - RNA, 22 nt, Human
agugaagccccgaugcguuuug

SEQ ID NO: 10699 - RNA, 22 nt, Human
agugaaggaaacaauugguuga

SEQ ID NO: 10700 - RNA, 20 nt, Human
agugaauagagacauugccc

SEQ ID NO: 10701 - RNA, 22 nt, Human
agugaauuagccuauuuguaaa

SEQ ID NO: 10702 - RNA, 22 nt, Human
agugaauuuaaaacacugagga

SEQ ID NO: 10703 - RNA, 22 nt, Human
agugacaaagauucuccuuguu

SEQ ID NO: 10704 - RNA, 22 nt, Human
agugacagggaaaaugacacug

SEQ ID NO: 10705 - RNA, 22 nt, Human
agugacagggaaggauaggauu

SEQ ID NO: 10706 - RNA, 22 nt, Human
agugacaucaugucagcaaagu

SEQ ID NO: 10707 - RNA, 22 nt, Human
agugacaugcucucaggcauaa

SEQ ID NO: 10708 - RNA, 22 nt, Human
agugaccaucuaacgccuguga

SEQ ID NO: 10709 - RNA, 22 nt, Human
agugaccgaggcacuuggcaac

SEQ ID NO: 10710 - RNA, 22 nt, Human
agugacuacuggauuuguuucu

SEQ ID NO: 10711 - RNA, 22 nt, Human
agugacugacaccuguaauccc

SEQ ID NO: 10712 - RNA, 22 nt, Human
agugacugggcagggcagggcc

SEQ ID NO: 10713 - RNA, 22 nt, Human
agugacugguuuugacaggaau

SEQ ID NO: 10714 - RNA, 22 nt, Human
agugagacaguggacucugcau

SEQ ID NO: 10715 - RNA, 22 nt, Human
agugagcaguacuuacuccugc

SEQ ID NO: 10716 - RNA, 22 nt, Human
agugagcuaugaucauguuacu

SEQ ID NO: 10717 - RNA, 22 nt, Human
agugaggcaaagugagaggcag

SEQ ID NO: 10718 - RNA, 22 nt, Human
agugagggacuccaugacuccu

SEQ ID NO: 10719 - RNA, 22 nt, Human
agugaguggacccugcaaggaa

SEQ ID NO: 10720 - RNA, 22 nt, Human
agugaguggguuacagauggga

SEQ ID NO: 10721 - RNA, 22 nt, Human
agugaguugaacauugauaaug

SEQ ID NO: 10722 - RNA, 22 nt, Human
agugaucagcuugaaguaguuu

SEQ ID NO: 10723 - RNA, 22 nt, Human
agugaugccacacaaugcuuug

SEQ ID NO: 10724 - RNA, 22 nt, Human
agugauggugagugagaagcuc

SEQ ID NO: 10725 - RNA, 22 nt, Human
agugauguaacaaacagaguua

SEQ ID NO: 10726 - RNA, 23 nt, Human
agugaugucacccacagacaagg

SEQ ID NO: 10727 - RNA, 22 nt, Human
agugaugugggagaguauagcu

SEQ ID NO: 10728 - RNA, 22 nt, Human
agugauuaaagcuaggauaaaa

SEQ ID NO: 10729 - RNA, 22 nt, Human
agugauugaguguuagcagucu

SEQ ID NO: 10730 - RNA, 22 nt, Human
agugauuuacuaccauauuggg

SEQ ID NO: 10731 - RNA, 20 nt, Human
agugauuuaucuuuuuccac

SEQ ID NO: 10732 - RNA, 22 nt, Human
agugauuuggcggcagaguuag

SEQ ID NO: 10733 - RNA, 22 nt, Human
agugauuuugucagcuucugca

SEQ ID NO: 10734 - RNA, 22 nt, Human
agugcaaaaaaguguugugaca

SEQ ID NO: 10735 - RNA, 22 nt, Human
agugcaaagaaaucagcuuugu

SEQ ID NO: 10736 - RNA, 22 nt, Human
agugcaaagcagccuguacacc

SEQ ID NO: 10737 - RNA, 22 nt, Human
agugcaaagggaucagauuggg

SEQ ID NO: 10738 - RNA, 22 nt, Human
agugcaacagaagcaggcuggc

SEQ ID NO: 10739 - RNA, 22 nt, Human
agugcacuggcaccaucucagc

SEQ ID NO: 10740 - RNA, 22 nt, Human
agugcacuuuugggggauguua

SEQ ID NO: 10741 - RNA, 22 nt, Human
agugcagacugaaaugaccuuc

SEQ ID NO: 10742 - RNA, 19 nt, Human
agugcagggagcacccuca

SEQ ID NO: 10743 - RNA, 22 nt, Human
agugcagguuaaggaacuggcc

SEQ ID NO: 10744 - RNA, 22 nt, Human
agugcauauaugaagaguauga

SEQ ID NO: 10745 - RNA, 22 nt, Human
agugcaugccuuccuguggaug

SEQ ID NO: 10746 - RNA, 22 nt, Human
agugcauguaucuacagucaca

SEQ ID NO: 10747 - RNA, 22 nt, Human
agugcauguccaguaguuuaug

SEQ ID NO: 10748 - RNA, 22 nt, Human
agugcauucaguauucauaggc

SEQ ID NO: 10749 - RNA, 22 nt, Human
agugcauucuccaucaucuagg

SEQ ID NO: 10750 - RNA, 22 nt, Human
agugcauuugggguaguggaag

SEQ ID NO: 10751 - RNA, 19 nt, Human
agugcauuuuauguuucaa

SEQ ID NO: 10752 - RNA, 22 nt, Human
agugccagcuccacacagcagc

SEQ ID NO: 10753 - RNA, 22 nt, Human
agugccauggaggaacagaugc

SEQ ID NO: 10754 - RNA, 22 nt, Human
agugccauguaguccagcagaa

SEQ ID NO: 10755 - RNA, 22 nt, Human
agugcccaguuagguuggagca

SEQ ID NO: 10756 - RNA, 22 nt, Human
agugcccuuuacaacuucuuga

SEQ ID NO: 10757 - RNA, 22 nt, Human
agugcguggaccccuggcugcu

SEQ ID NO: 10758 - RNA, 22 nt, Human
agugcuaaugugcaauauagag

SEQ ID NO: 10759 - RNA, 22 nt, Human
agugcucacucuccacagugcc

SEQ ID NO: 10760 - RNA, 22 nt, Human
agugcucccuagaguugugcaa

SEQ ID NO: 10761 - RNA, 22 nt, Human
agugcuccucagaagaguugga

SEQ ID NO: 10762 - RNA, 23 nt, Human
agugcugaauugaaagcuccagg

SEQ ID NO: 10763 - RNA, 22 nt, Human
agugcugacucugggcacagug

SEQ ID NO: 10764 - RNA, 22 nt, Human
agugcugaggaaggggcccauu

SEQ ID NO: 10765 - RNA, 22 nt, Human
agugcugaggccauacuccaua

SEQ ID NO: 10766 - RNA, 22 nt, Human
agugcuggauuacaggcgugag

SEQ ID NO: 10767 - RNA, 22 nt, Human
agugcuggcccauagcugcugg

SEQ ID NO: 10768 - RNA, 22 nt, Human
agugcugucaguuuuauagaua

SEQ ID NO: 10769 - RNA, 22 nt, Human
agugcugucccgacaacugagg

SEQ ID NO: 10770 - RNA, 22 nt, Human
agugcuucuuaaaccuuucuac

SEQ ID NO: 10771 - RNA, 22 nt, Human
agugcuuuagcauccaacuguc

SEQ ID NO: 10772 - RNA, 22 nt, Human
agugcuuucccugaaaccuucc

SEQ ID NO: 10773 - RNA, 22 nt, Human
agugcuuugaacgaaaggcuga

SEQ ID NO: 10774 - RNA, 22 nt, Human
agugcuuugaauguucugggca

SEQ ID NO: 10775 - RNA, 22 nt, Human
agugcuuuguaguuucauugug

SEQ ID NO: 10776 - RNA, 18 nt, Human
aguggaaaacaaauacac

SEQ ID NO: 10777 - RNA, 22 nt, Human
aguggcuggaauugcaggugcg

SEQ ID NO: 10778 - RNA, 22 nt, Human
aguggcuggacgacaaggguga

SEQ ID NO: 10779 - RNA, 19 nt, Human
aguggcugggcagaagcaa

SEQ ID NO: 10780 - RNA, 22 nt, Human
aguggcuguaggcuaugagaga

SEQ ID NO: 10781 - RNA, 22 nt, Human
aguggcuguaucagucaacccu

SEQ ID NO: 10782 - RNA, 22 nt, Human
aguggcuguccuggcucuaacu

SEQ ID NO: 10783 - RNA, 22 nt, Human
aguggcugucuuccaaaaucug

SEQ ID NO: 10784 - RNA, 22 nt, Human
aguggcuguucauuuuacacaa

SEQ ID NO: 10785 - RNA, 22 nt, Human
aguggcuucauuucugccagaa

SEQ ID NO: 10786 - RNA, 22 nt, Human
aguggcuuuuuaguggcagaug

SEQ ID NO: 10787 - RNA, 22 nt, Human
agugggaaacuggagagacuuc

SEQ ID NO: 10788 - RNA, 22 nt, Human
agugggaauuuucucccaggga

SEQ ID NO: 10789 - RNA, 22 nt, Human
agugggacaguguagagcguca

SEQ ID NO: 10790 - RNA, 22 nt, Human
aguggcaaugggaguggagaca

SEQ ID NO: 10791 - RNA, 22 nt, Human
aguggcaauguagagagugauc

SEQ ID NO: 10792 - RNA, 22 nt, Human
aguggcaauugacaacaaagga

SEQ ID NO: 10793 - RNA, 22 nt, Human
aguggcacaauuuugacucccc

SEQ ID NO: 10794 - RNA, 22 nt, Human
aguggcagagcaggugcuggaa

SEQ ID NO: 10795 - RNA, 22 nt, Human
aguggcagagcugggauuuggg

SEQ ID NO: 10796 - RNA, 22 nt, Human
aguggcagagcugugucuugaa

SEQ ID NO: 10797 - RNA, 22 nt, Human
aguggcagagucaggguuugga

SEQ ID NO: 10798 - RNA, 16 nt, Human
aguggcagauaauacc

SEQ ID NO: 10799 - RNA, 22 nt, Human
aguggcaggaaaguggaagaga

SEQ ID NO: 10800 - RNA, 22 nt, Human
aguggcaggcagaagcuucuca

SEQ ID NO: 10801 - RNA, 20 nt, Human
aguggcagggaaauggaaag

SEQ ID NO: 10802 - RNA, 22 nt, Human
aguggcagggcuggcugcugca

SEQ ID NO: 10803 - RNA, 22 nt, Human
aguggcaucaacuuuaucugua

SEQ ID NO: 10804 - RNA, 20 nt, Human
aguggccacugcagagaugc

SEQ ID NO: 10805 - RNA, 22 nt, Human
aguggcugaagcaucaaaggca

SEQ ID NO: 10806 - RNA, 22 nt, Human
aguggcugaauauauuuuacua

SEQ ID NO: 10807 - RNA, 22 nt, Human
aguggcugagugacugugacuc

SEQ ID NO: 10808 - RNA, 20 nt, Human
aguggcugauggaaagaagc

SEQ ID NO: 10809 - RNA, 22 nt, Human
aguggcugccaagagcaaugcu

SEQ ID NO: 10810 - RNA, 22 nt, Human
aguggcugccaagauauaauuc

SEQ ID NO: 10811 - RNA, 23 nt, Human
aguggcuggacagacuuuccugg

SEQ ID NO: 10812 - RNA, 22 nt, Human
aguggcugguaguuacugagca

SEQ ID NO: 10813 - RNA, 22 nt, Human
aguggcuggucuaaggucacag

SEQ ID NO: 10814 - RNA, 22 nt, Human
aguggcuguuccaggugaggac

SEQ ID NO: 10815 - RNA, 22 nt, Human
aguggcuguuuauaggugggua

SEQ ID NO: 10816 - RNA, 22 nt, Human
aguggcuuaucugggacagcua

SEQ ID NO: 10817 - RNA, 22 nt, Human
aguggcuuauguuuagaaucau

SEQ ID NO: 10818 - RNA, 22 nt, Human
aguggcuugcucugccucagcc

SEQ ID NO: 10819 - RNA, 22 nt, Human
aguggcuuggcugcacuacagg

SEQ ID NO: 10820 - RNA, 22 nt, Human
aguggcuuuucuugcuucuggc

SEQ ID NO: 10821 - RNA, 22 nt, Human
agugggaccggugcuauuccag

SEQ ID NO: 10822 - RNA, 22 nt, Human
agugggagauaacuuaacagcu

SEQ ID NO: 10823 - RNA, 16 nt, Human
agugggaggagaaaga

SEQ ID NO: 10824 - RNA, 22 nt, Human
agugggcaaaacagcucagagc

SEQ ID NO: 10825 - RNA, 22 nt, Human
agugggcagugcgcucggaugc

SEQ ID NO: 10826 - RNA, 22 nt, Human
agugggcauaugaagucucaag

SEQ ID NO: 10827 - RNA, 22 nt, Human
agugggcugagcuugcugggug

SEQ ID NO: 10828 - RNA, 22 nt, Human
aguggggaguuuccagaugugu

SEQ ID NO: 10829 - RNA, 22 nt, Human
aguggggcggacaggaccagga

SEQ ID NO: 10830 - RNA, 22 nt, Human
agugggggccaacgagggcagc

SEQ ID NO: 10831 - RNA, 22 nt, Human
aguggggucuccuccagccccc

SEQ ID NO: 10832 - RNA, 22 nt, Human
agugggugauaagaccaaggag

SEQ ID NO: 10833 - RNA, 22 nt, Human
agugggugggugucugacaguu

SEQ ID NO: 10834 - RNA, 20 nt, Human
aguggguguaaguuauugcc

SEQ ID NO: 10835 - RNA, 22 nt, Human
agugguaagggcauaggcacug

SEQ ID NO: 10836 - RNA, 22 nt, Human
aguggucugccugccucagccu

SEQ ID NO: 10837 - RNA, 22 nt, Human
aguggugaugacagcaguuucu

SEQ ID NO: 10838 - RNA, 22 nt, Human
aguggugaugucucuauuauug

SEQ ID NO: 10839 - RNA, 22 nt, Human
agugguggagagaugaggacac

SEQ ID NO: 10840 - RNA, 22 nt, Human
agugguggagccaggaaaugug

SEQ ID NO: 10841 - RNA, 22 nt, Human
aguggugucgugggaguggaag

SEQ ID NO: 10842 - RNA, 22 nt, Human
agugguuacucaagcaaaucuc

SEQ ID NO: 10843 - RNA, 22 nt, Human
aguguacacuaaaugaauacaa

SEQ ID NO: 10844 - RNA, 22 nt, Human
aguguacaguucuaugaauuuc

SEQ ID NO: 10845 - RNA, 22 nt, Human
aguguaggugagggccuggguu

SEQ ID NO: 10846 - RNA, 22 nt, Human
aguguaugaguuucaguucuuc

SEQ ID NO: 10847 - RNA, 22 nt, Human
aguguauggaauuagcucccuu

SEQ ID NO: 10848 - RNA, 22 nt, Human
aguguauuugucuggcuucucc

SEQ ID NO: 10849 - RNA, 19 nt, Human
aguguauuuuuuucuguag

SEQ ID NO: 10850 - RNA, 22 nt, Human
agugucaacugucuacagggag

SEQ ID NO: 10851 - RNA, 22 nt, Human
agugucaagguugagaaacccu

SEQ ID NO: 10852 - RNA, 22 nt, Human
agugucaagugaggagggaaag

SEQ ID NO: 10853 - RNA, 22 nt, Human
agugucaaugccaacaguauau

SEQ ID NO: 10854 - RNA, 22 nt, Human
agugucaaugcucuguuaaaaa

SEQ ID NO: 10855 - RNA, 22 nt, Human
agugucacagacccaaucagga

SEQ ID NO: 10856 - RNA, 22 nt, Human
agugucaucgugaaaacauagc

SEQ ID NO: 10857 - RNA, 22 nt, Human
agugucaugaaucaaagauuau

SEQ ID NO: 10858 - RNA, 22 nt, Human
aguguccaacucagcuugucaa

SEQ ID NO: 10859 - RNA, 22 nt, Human
aguguccccucugaggagugag

SEQ ID NO: 10860 - RNA, 22 nt, Human
aguguccuagcaagccgguccu

SEQ ID NO: 10861 - RNA, 22 nt, Human
aguguccucaggcuuuguuccu

SEQ ID NO: 10862 - RNA, 22 nt, Human
aguguccucuauuaugacuuua

SEQ ID NO: 10863 - RNA, 22 nt, Human
aguguccuggcaaggguuucag

SEQ ID NO: 10864 - RNA, 22 nt, Human
aguguccuggggcccuaaggcc

SEQ ID NO: 10865 - RNA, 22 nt, Human
aguguccuuguuauuacugcuc

SEQ ID NO: 10866 - RNA, 22 nt, Human
agugucugaaggauuuggcuuc

SEQ ID NO: 10867 - RNA, 22 nt, Human
agugucugagccagaauuagaa

SEQ ID NO: 10868 - RNA, 22 nt, Human
agugucugaucaguugacuaga

SEQ ID NO: 10869 - RNA, 22 nt, Human
agugucugcucagacagcuaca

SEQ ID NO: 10870 - RNA, 22 nt, Human
agugucugggcucccuuggagc

SEQ ID NO: 10871 - RNA, 22 nt, Human
agugucugugaugaggucagga

SEQ ID NO: 10872 - RNA, 22 nt, Human
agugucuguuguucagaacucu

SEQ ID NO: 10873 - RNA, 22 nt, Human
agugucuuacaugaauugauuu

SEQ ID NO: 10874 - RNA, 22 nt, Human
agugucuuacucccucaggcac

SEQ ID NO: 10875 - RNA, 22 nt, Human
agugucuuuagcaaguuuaguc

SEQ ID NO: 10876 - RNA, 22 nt, Human
agugugacauaagagcccugga

SEQ ID NO: 10877 - RNA, 22 nt, Human
agugugagaacggacuaauaaa

SEQ ID NO: 10878 - RNA, 22 nt, Human
agugugagauuaaaccgaauca

SEQ ID NO: 10879 - RNA, 22 nt, Human
agugugagggguucuuugauau

SEQ ID NO: 10880 - RNA, 22 nt, Human
agugugaguaauugagucuguc

SEQ ID NO: 10881 - RNA, 20 nt, Human
agugugcauuuagagucugc

SEQ ID NO: 10882 - RNA, 22 nt, Human
agugugcucugguugccaugcu

SEQ ID NO: 10883 - RNA, 22 nt, Human
aguguggcugcguagggcucuc

SEQ ID NO: 10884 - RNA, 22 nt, Human
agugugggccacgcagcugagc

SEQ ID NO: 10885 - RNA, 22 nt, Human
agugugggcccccagguuagcc

SEQ ID NO: 10886 - RNA, 22 nt, Human
agugugggggcuuuggugucac

SEQ ID NO: 10887 - RNA, 22 nt, Human
agugugggugagggaggcccuc

SEQ ID NO: 10888 - RNA, 22 nt, Human
aguguggguuuuauggagcccu

SEQ ID NO: 10889 - RNA, 22 nt, Human
aguguggucgggagcgcggggc

SEQ ID NO: 10890 - RNA, 17 nt, Human
aguguguaacuugugua

SEQ ID NO: 10891 - RNA, 22 nt, Human
aguguguagcaauaugcuggca

SEQ ID NO: 10892 - RNA, 23 nt, Human
aguguguauugcugagggcagcu

SEQ ID NO: 10893 - RNA, 22 nt, Human
agugugucaguugaaagagauu

SEQ ID NO: 10894 - RNA, 18 nt, Human
agugugugcccuuucagg

SEQ ID NO: 10895 - RNA, 22 nt, Human
caaaggcaggugcugaauauuc

SEQ ID NO: 10896 - RNA, 22 nt, Human
caaaggcaugugaguauaugug

SEQ ID NO: 10897 - RNA, 22 nt, Human
caaaggcucaguaaaucuuugu

SEQ ID NO: 10898 - RNA, 22 nt, Human
caaagggcauuuuagugaacug

SEQ ID NO: 10899 - RNA, 22 nt, Human
augacaucaacaguggugcugu

SEQ ID NO: 10900 - RNA, 22 nt, Human
augacaugaccugguagagaca

SEQ ID NO: 10901 - RNA, 22 nt, Human
augacaugauugccauuugaua

SEQ ID NO: 10902 - RNA, 22 nt, Human
augacauugaauauguuaacua

SEQ ID NO: 10903 - RNA, 22 nt, Human
augacauuuauacagugagcuu

SEQ ID NO: 10904 - RNA, 22 nt, Human
augaccaguuuccccacugucc

SEQ ID NO: 10905 - RNA, 22 nt, Human
augaccccuaaaauuuacuguc

SEQ ID NO: 10906 - RNA, 22 nt, Human
augaccugaggccuuacucuag

SEQ ID NO: 10907 - RNA, 22 nt, Human
augacucagaagauauuuucca

SEQ ID NO: 10908 - RNA, 22 nt, Human
augacucuccagagcugcagau

SEQ ID NO: 10909 - RNA, 22 nt, Human
augacuuuuaaaagcugguacu

SEQ ID NO: 10910 - RNA, 22 nt, Human
augagaaugcauucauguuuug

SEQ ID NO: 10911 - RNA, 22 nt, Human
augagacacaugugacuucuuu

SEQ ID NO: 10912 - RNA, 22 nt, Human
augagacaugacuucaggccuu

SEQ ID NO: 10913 - RNA, 22 nt, Human
augagcaagagcuauguacaga

SEQ ID NO: 10914 - RNA, 19 nt, Human
augagcaauaguuuuaauc

SEQ ID NO: 10915 - RNA, 22 nt, Human
augagcauccagaacagugccu

SEQ ID NO: 10916 - RNA, 22 nt, Human
augagcccagaaaucucccuuu

SEQ ID NO: 10917 - RNA, 22 nt, Human
augagcuuccagacaaaggcau

SEQ ID NO: 10918 - RNA, 22 nt, Human
augagcuugguccagcaggcuu

SEQ ID NO: 10919 - RNA, 22 nt, Human
augaggagcccucauuuagguu

SEQ ID NO: 10920 - RNA, 22 nt, Human
augaggagcuccuugaaaugag

SEQ ID NO: 10921 - RNA, 22 nt, Human
augaggagucaaggagucggag

SEQ ID NO: 10922 - RNA, 22 nt, Human
augaggaugggaagggagccaa

SEQ ID NO: 10923 - RNA, 22 nt, Human
augaggcaaggcuggccguguu

SEQ ID NO: 10924 - RNA, 22 nt, Human
augaggcaaucaugguccaguu

SEQ ID NO: 10925 - RNA, 22 nt, Human
augaggcacguguuacuggccu

SEQ ID NO: 10926 - RNA, 22 nt, Human
augaggcagcacaugggauugu

SEQ ID NO: 10927 - RNA, 22 nt, Human
augaggcaggaaaggcguaucu

SEQ ID NO: 10928 - RNA, 22 nt, Human
augaggccacaguuauagauuu

SEQ ID NO: 10929 - RNA, 22 nt, Human
augaggccagggugccaugaaa

SEQ ID NO: 10930 - RNA, 22 nt, Human
augaggccuaucuuggcagagg

SEQ ID NO: 10931 - RNA, 22 nt, Human
augaggcucucaggggagcugu

SEQ ID NO: 10932 - RNA, 22 nt, Human
augagggaagcucacgugucca

SEQ ID NO: 10933 - RNA, 22 nt, Human
auauugcagggacagucuggau

SEQ ID NO: 10934 - RNA, 22 nt, Human
auauugcauggcuuugcugguu

SEQ ID NO: 10935 - RNA, 22 nt, Human
auauugcuagccuaugaguuca

SEQ ID NO: 10936 - RNA, 22 nt, Human
auauuguacuaggguuacaugu

SEQ ID NO: 10937 - RNA, 22 nt, Human
auauuguugacuauaagaguaa

SEQ ID NO: 10938 - RNA, 22 nt, Human
auauuuaacuggucccaauaua

SEQ ID NO: 10939 - RNA, 22 nt, Human
auauuuagauaaaaaugggcuu

SEQ ID NO: 10940 - RNA, 22 nt, Human
auauuuagcucauuuccagugc

SEQ ID NO: 10941 - RNA, 22 nt, Human
auauuuauaaggcaggcaagua

SEQ ID NO: 10942 - RNA, 22 nt, Human
auauuucagcuuuacuuaggaa

SEQ ID NO: 10943 - RNA, 20 nt, Human
auauuucagguagugugccc

SEQ ID NO: 10944 - RNA, 22 nt, Human
auauuucagguuuugcaggccg

SEQ ID NO: 10945 - RNA, 23 nt, Human
auauuuccagguuagugagguaa

SEQ ID NO: 10946 - RNA, 21 nt, Human
auauuucucauaagguuaugg

SEQ ID NO: 10947 - RNA, 22 nt, Human
auauuucuccaaauguuuucaa

SEQ ID NO: 10948 - RNA, 20 nt, Human
auauuucuuaagaacuuuca

SEQ ID NO: 10949 - RNA, 22 nt, Human
auauuucuugagcaccugguau

SEQ ID NO: 10950 - RNA, 22 nt, Human
auauuuggaaagaaaaucauug

SEQ ID NO: 10951 - RNA, 22 nt, Human
auauuuguaguggguaagaagu

SEQ ID NO: 10952 - RNA, 22 nt, Human
auauuuucacugaaccaaagua

SEQ ID NO: 10953 - RNA, 22 nt, Human
auauuuuccgaacuugagguag

SEQ ID NO: 10954 - RNA, 22 nt, Human
auauuuuggggugaugugcauc

SEQ ID NO: 10955 - RNA, 22 nt, Human
aucaaaacccagacaggcugga

SEQ ID NO: 10956 - RNA, 22 nt, Human
aucaaaaccuugacuuuuaaug

SEQ ID NO: 10957 - RNA, 20 nt, Human
aucaaaauccuauugagguu

SEQ ID NO: 10958 - RNA, 22 nt, Human
aucaaagagcuugacaauccua

SEQ ID NO: 10959 - RNA, 23 nt, Human
aucaaaggauguagagaagaagc

SEQ ID NO: 10960 - RNA, 22 nt, Human
aucaaaguaucucaauauggua

SEQ ID NO: 10961 - RNA, 22 nt, Human
aucaaagugaaaagugcugaug

SEQ ID NO: 10962 - RNA, 23 nt, Human
aucaaaguggaaaucaauuaucu

SEQ ID NO: 10963 - RNA, 22 nt, Human
aucaacauaaagaaguccucag

SEQ ID NO: 10964 - RNA, 22 nt, Human
aucaacaugacaggagaagaga

SEQ ID NO: 10965 - RNA, 22 nt, Human
aucaacaugugagagcaccagu

SEQ ID NO: 10966 - RNA, 22 nt, Human
aucaagcauauauaaaacugca

SEQ ID NO: 10967 - RNA, 22 nt, Human
aucaagcuggcauauguaguuc

SEQ ID NO: 10968 - RNA, 22 nt, Human
aucaaguucugucacauuuguc

SEQ ID NO: 10969 - RNA, 22 nt, Human
aucaauaucagaucagacagga

SEQ ID NO: 10970 - RNA, 22 nt, Human
aucaaugcuugccaaauggaag

SEQ ID NO: 10971 - RNA, 22 nt, Human
aucaauguuuugauagcccaga

SEQ ID NO: 10972 - RNA, 22 nt, Human
aucacacagagcauuaggggcc

SEQ ID NO: 10973 - RNA, 22 nt, Human
aucacagagauugcuuuuaaaa

SEQ ID NO: 10974 - RNA, 22 nt, Human
aucacagcacaccugacaugua

SEQ ID NO: 10975 - RNA, 22 nt, Human
aucacaggcuauguggguuuug

SEQ ID NO: 10976 - RNA, 22 nt, Human
aucacagugccuucguaaauuu

SEQ ID NO: 10977 - RNA, 22 nt, Human
aucacaguguagaccuuuuaaa

SEQ ID NO: 10978 - RNA, 22 nt, Human
aucacaguuacucaaauaauga

SEQ ID NO: 10979 - RNA, 22 nt, Human
aucacaguuuuaccauuuggua

SEQ ID NO: 10980 - RNA, 22 nt, Human
aucacauauaugcaccaagaca

SEQ ID NO: 10981 - RNA, 22 nt, Human
aucacauauuuaagaaacaugu

SEQ ID NO: 10982 - RNA, 22 nt, Human
aucacauucuuucaaagcaguc

SEQ ID NO: 10983 - RNA, 22 nt, Human
aucacauugccagugauuaccc

SEQ ID NO: 10984 - RNA, 22 nt, Human
aucacauuguuagcauagacug

SEQ ID NO: 10985 - RNA, 22 nt, Human
aucaccaaggcuuuaggaauuu

SEQ ID NO: 10986 - RNA, 22 nt, Human
aucaccaggcaaaaugucagag

SEQ ID NO: 10987 - RNA, 22 nt, Human
aucaccaguaaguuuucaguuu

SEQ ID NO: 10988 - RNA, 22 nt, Human
aucacccaagcuggagugcagu

SEQ ID NO: 10989 - RNA, 22 nt, Human
aucacgugcugagaguguuauu

SEQ ID NO: 10990 - RNA, 21 nt, Human
aucacugaaugccuucaagga

SEQ ID NO: 10991 - RNA, 22 nt, Human
aucacugagcuucagugcuggc

SEQ ID NO: 10992 - RNA, 22 nt, Human
aucacuggagugaaaggcaaac

SEQ ID NO: 10993 - RNA, 22 nt, Human
aucacugucgucaucugagauu

SEQ ID NO: 10994 - RNA, 22 nt, Human
aucacuguggcccaaaaccuca

SEQ ID NO: 10995 - RNA, 22 nt, Human
aucacuguguauguauaugcag

SEQ ID NO: 10996 - RNA, 22 nt, Human
aucagaaaauacccaguguuua

SEQ ID NO: 10997 - RNA, 22 nt, Human
aucagaacaaaagaacaguuua

SEQ ID NO: 10998 - RNA, 22 nt, Human
aucagaauaauuagauuucaga

SEQ ID NO: 10999 - RNA, 22 nt, Human
aucagaauacuaucaacaguga

SEQ ID NO: 11000 - RNA, 21 nt, Human
aucagaaucucuagauuugga

SEQ ID NO: 11001 - RNA, 22 nt, Human
aucagaaugcagccagcaguua

SEQ ID NO: 11002 - RNA, 22 nt, Human
aucagaauguuuuggugugcuc

SEQ ID NO: 11003 - RNA, 22 nt, Human
aucagaccauccagcguggaug

SEQ ID NO: 11004 - RNA, 22 nt, Human
aucagacucagaaaugacgugg

SEQ ID NO: 11005 - RNA, 22 nt, Human
aucagagacaaaaccagcacuu

SEQ ID NO: 11006 - RNA, 22 nt, Human
aucagagauggcuccagugcuc

SEQ ID NO: 11007 - RNA, 22 nt, Human
aucagagauuguaguaugugca

SEQ ID NO: 11008 - RNA, 22 nt, Human
auccugagguacugcagggccg

SEQ ID NO: 11009 - RNA, 22 nt, Human
auccugaguucucagagucucc

SEQ ID NO: 11010 - RNA, 22 nt, Human
auccugcaggggguuuuauuca

SEQ ID NO: 11011 - RNA, 22 nt, Human
auccugcugcuguggacuucuc

SEQ ID NO: 11012 - RNA, 22 nt, Human
auccugcuuguuacuuauagag

SEQ ID NO: 11013 - RNA, 22 nt, Human
auccugggaagcugacauugaa

SEQ ID NO: 11014 - RNA, 22 nt, Human
auccugggaaguggccuccucc

SEQ ID NO: 11015 - RNA, 22 nt, Human
auccuggguuugugaguuuaug

SEQ ID NO: 11016 - RNA, 22 nt, Human
auccugucaucauaguacuuga

SEQ ID NO: 11017 - RNA, 22 nt, Human
auccugucuaugaguagauaau

SEQ ID NO: 11018 - RNA, 22 nt, Human
auccugucucuacccaucggcu

SEQ ID NO: 11019 - RNA, 22 nt, Human
auccugugaggauaagcccuug

SEQ ID NO: 11020 - RNA, 22 nt, Human
auccugugcaaugacugcaucu

SEQ ID NO: 11021 - RNA, 22 nt, Human
auccuguuugguugucugccuu

SEQ ID NO: 11022 - RNA, 22 nt, Human
auccuguuugucacuagaaaau

SEQ ID NO: 11023 - RNA, 20 nt, Human
auccuuaaagagaauuucua

SEQ ID NO: 11024 - RNA, 22 nt, Human
auccuuaagaaaguuuucuaua

SEQ ID NO: 11025 - RNA, 22 nt, Human
auccuuaauuuccugggccuca

SEQ ID NO: 11026 - RNA, 21 nt, Human
auccuuagcacuuagaagagu

SEQ ID NO: 11027 - RNA, 22 nt, Human
auccuuccagaguuauucucaa

SEQ ID NO: 11028 - RNA, 22 nt, Human
auccuugaaugacucugcccuc

SEQ ID NO: 11029 - RNA, 22 nt, Human
auccuuggauccuguguuccug

SEQ ID NO: 11030 - RNA, 22 nt, Human
auccuuggaugugucuuuuugu

SEQ ID NO: 11031 - RNA, 20 nt, Human
auccuuggcagaauccagga

SEQ ID NO: 11032 - RNA, 22 nt, Human
auccuugggucucuggaaauug

SEQ ID NO: 11033 - RNA, 22 nt, Human
aucguuaaucuugugugucaac

SEQ ID NO: 11034 - RNA, 22 nt, Human
aucguuuacccugagugauugc

SEQ ID NO: 11035 - RNA, 22 nt, Human
aucuaaaaugugguuaguuggu

SEQ ID NO: 11036 - RNA, 22 nt, Human
aucuaaacuauaguaccuaguc

SEQ ID NO: 11037 - RNA, 19 nt, Human
aucuaagagaugggggaaa

SEQ ID NO: 11038 - RNA, 22 nt, Human
aucuaagaguuaacaucaagaa

SEQ ID NO: 11039 - RNA, 22 nt, Human
aucuaagauuuugcuaagauca

SEQ ID NO: 11040 - RNA, 22 nt, Human
aucuacacuauaacagaaugcu

SEQ ID NO: 11041 - RNA, 22 nt, Human
aucuacagcugucugcacagua

SEQ ID NO: 11042 - RNA, 22 nt, Human
aucuacauaaaacgaauacaua

SEQ ID NO: 11043 - RNA, 22 nt, Human
aucuacauguugauuuaaagaa

SEQ ID NO: 11044 - RNA, 22 nt, Human
aucuacccacugaacacaauau

SEQ ID NO: 11045 - RNA, 22 nt, Human
aucuagaacaauuauugucaca

SEQ ID NO: 11046 - RNA, 22 nt, Human
aucuagaacuuaaagucaguca

SEQ ID NO: 11047 - RNA, 21 nt, Human
aucuagaaucucucuccccac

SEQ ID NO: 11048 - RNA, 22 nt, Human
aucuagcaccaaacuagcuuuu

SEQ ID NO: 11049 - RNA, 22 nt, Human
aucuaggauuugaaugcacagu

SEQ ID NO: 11050 - RNA, 22 nt, Human
aucauuacuccuguaaaauugu

SEQ ID NO: 11051 - RNA, 23 nt, Human
aucauuacuuugauaccuuuucu

SEQ ID NO: 11052 - RNA, 22 nt, Human
aucauuagaccaaacuagagcu

SEQ ID NO: 11053 - RNA, 22 nt, Human
aucauuaguuguggaauucuug

SEQ ID NO: 11054 - RNA, 22 nt, Human
aucauucaaaugauuuggaggu

SEQ ID NO: 11055 - RNA, 22 nt, Human
aucauucaagugcucuaaaaug

SEQ ID NO: 11056 - RNA, 22 nt, Human
aucauucuaguccuuauggucu

SEQ ID NO: 11057 - RNA, 22 nt, Human
aucauucuauuguugagcugcc

SEQ ID NO: 11058 - RNA, 22 nt, Human
aucauugaauauaagugcuauu

SEQ ID NO: 11059 - RNA, 22 nt, Human
aucauugaguaaaaugaauaca

SEQ ID NO: 11060 - RNA, 19 nt, Human
aucauugaucuucaccccu

SEQ ID NO: 11061 - RNA, 22 nt, Human
aucauuuaguggggcauuggaa

SEQ ID NO: 11062 - RNA, 18 nt, Human
auccaaaaagauggaagu

SEQ ID NO: 11063 - RNA, 22 nt, Human
auccaaagauggaaagaacuuu

SEQ ID NO: 11064 - RNA, 22 nt, Human
auccaaaggugacacagaauac

SEQ ID NO: 11065 - RNA, 22 nt, Human
auccaaaguagauuaagucaca

SEQ ID NO: 11066 - RNA, 22 nt, Human
auccaacaggacaaagaaagga

SEQ ID NO: 11067 - RNA, 18 nt, Human
auccaacuaucgcucauu

SEQ ID NO: 11068 - RNA, 22 nt, Human
auccacaggguguguuaagaug

SEQ ID NO: 11069 - RNA, 22 nt, Human
auccacaggucauguaaugugg

SEQ ID NO: 11070 - RNA, 22 nt, Human
auccacagugcagcaagggccc

SEQ ID NO: 11071 - RNA, 22 nt, Human
auccacauuuaggucucuaaaa

SEQ ID NO: 11072 - RNA, 22 nt, Human
auccacucccuaacaccauguu

SEQ ID NO: 11073 - RNA, 22 nt, Human
auccacuugccacuguauaguu

SEQ ID NO: 11074 - RNA, 22 nt, Human
auccagaaugucuugcuggaga

SEQ ID NO: 11075 - RNA, 22 nt, Human
auccagaguaauacagaaugca

SEQ ID NO: 11076 - RNA, 22 nt, Human
auccagcacuuguucaugugaa

SEQ ID NO: 11077 - RNA, 22 nt, Human
auccagccaguguggaugacuu

SEQ ID NO: 11078 - RNA, 22 nt, Human
auccaggaaggauggcauugag

SEQ ID NO: 11079 - RNA, 22 nt, Human
auccaggguguggagagagcuc

SEQ ID NO: 11080 - RNA, 22 nt, Human
auccaguucuuggaagcacagg

SEQ ID NO: 11081 - RNA, 22 nt, Human
auccaucccaucuucaccaggg

SEQ ID NO: 11082 - RNA, 22 nt, Human
auccaucuugauguaauagcca

SEQ ID NO: 11083 - RNA, 23 nt, Human
auccaugcuuaaguaaucauuug

SEQ ID NO: 11084 - RNA, 22 nt, Human
auccauucuaugugaaaugucc

SEQ ID NO: 11085 - RNA, 22 nt, Human
auccauuuccuccacuauaaag

SEQ ID NO: 11086 - RNA, 22 nt, Human
auccauuuuaacuguuagugca

SEQ ID NO: 11087 - RNA, 22 nt, Human
auccauuuucucucuguggggu

SEQ ID NO: 11088 - RNA, 22 nt, Human
aucccagauagugacccucagg

SEQ ID NO: 11089 - RNA, 22 nt, Human
aucccagauggaggcuggucac

SEQ ID NO: 11090 - RNA, 22 nt, Human
auccccagggagugagcugucu

SEQ ID NO: 11091 - RNA, 22 nt, Human
aucccucucugcaugacugugu

SEQ ID NO: 11092 - RNA, 20 nt, Human
aucccucuuccuagaguccc

SEQ ID NO: 11093 - RNA, 23 nt, Human
auccuauauaaccuuggaggcug

SEQ ID NO: 11094 - RNA, 22 nt, Human
auccucagaccucagcaaagcc

SEQ ID NO: 11095 - RNA, 22 nt, Human
auccucucuguuuucguguaug

SEQ ID NO: 11096 - RNA, 22 nt, Human
auccugaggaaggugcagagau

SEQ ID NO: 11097 - RNA, 22 nt, Human
auccugaguuccugccucuaaa

SEQ ID NO: 11098 - RNA, 22 nt, Human
auccuggacaguuuccccuauu

SEQ ID NO: 11099 - RNA, 22 nt, Human
auccuggcccagguguggaggg

SEQ ID NO: 11100 - RNA, 22 nt, Human
auccuggcccucaugaccccuu

SEQ ID NO: 11101 - RNA, 22 nt, Human
auccuggcgccacacggcucua

SEQ ID NO: 11102 - RNA, 18 nt, Human
auccugggagcagacagc

SEQ ID NO: 11103 - RNA, 22 nt, Human
auccugggcaaaguaugcuguc

SEQ ID NO: 11104 - RNA, 22 nt, Human
auccugggcagugugucacucu

SEQ ID NO: 11105 - RNA, 22 nt, Human
auccugggcaguuuugagugcu

SEQ ID NO: 11106 - RNA, 22 nt, Human
auccugucuuuguuuuaaauau

SEQ ID NO: 11107 - RNA, 22 nt, Human
auccuguguugcuacuggagga

SEQ ID NO: 11108 - RNA, 22 nt, Human
auccuuaauuuacuugcaucuu

SEQ ID NO: 11109 - RNA, 22 nt, Human
auccuuagaagggagugaggac

SEQ ID NO: 11110 - RNA, 22 nt, Human
auccuuaguuaagaacaggagu

SEQ ID NO: 11111 - RNA, 22 nt, Human
auccuucaaaaggaauagcagg

SEQ ID NO: 11112 - RNA, 22 nt, Human
auccuucaaggggcugacagcu

SEQ ID NO: 11113 - RNA, 22 nt, Human
auccuucaauuagaaccaauug

SEQ ID NO: 11114 - RNA, 22 nt, Human
auccuucaggaaaccauccuca

SEQ ID NO: 11115 - RNA, 22 nt, Human
auccuuccuucauuugacaggu

SEQ ID NO: 11116 - RNA, 22 nt, Human
auccuucuaccuaggacuauuu

SEQ ID NO: 11117 - RNA, 22 nt, Human
aucuggauagguuguuuugcau

SEQ ID NO: 11118 - RNA, 22 nt, Human
aucuggcuauugacauguuaua

SEQ ID NO: 11119 - RNA, 20 nt, Human
aucuggcucagauccugcag

SEQ ID NO: 11120 - RNA, 22 nt, Human
aucuggcucuuccuggaguucc

SEQ ID NO: 11121 - RNA, 22 nt, Human
aucuggcugcugugcuuaagcu

SEQ ID NO: 11122 - RNA, 22 nt, Human
aucuggcuuaccuagggugccu

SEQ ID NO: 11123 - RNA, 22 nt, Human
aucuggcuuuuaccccacggcc

SEQ ID NO: 11124 - RNA, 22 nt, Human
aucuggcuuuuacugaauugcu

SEQ ID NO: 11125 - RNA, 22 nt, Human
aucugggagcggagguugcagu

SEQ ID NO: 11126 - RNA, 22 nt, Human
aucugggagucuuggcucugcu

SEQ ID NO: 11127 - RNA, 22 nt, Human
aucugggccuguucccucaccu

SEQ ID NO: 11128 - RNA, 22 nt, Human
aucugggucugaagauaaugau

SEQ ID NO: 11129 - RNA, 22 nt, Human
aucuguaaagauaaucauaugu

SEQ ID NO: 11130 - RNA, 22 nt, Human
aucuguaaauaaaaagggaggu

SEQ ID NO: 11131 - RNA, 22 nt, Human
aucuguaaaugcaaauguagcu

SEQ ID NO: 11132 - RNA, 22 nt, Human
aucuguaacaucaguagcagaa

SEQ ID NO: 11133 - RNA, 22 nt, Human
aucugucccugguccaagauuu

SEQ ID NO: 11134 - RNA, 22 nt, Human
aucugucuaugauauagucugu

SEQ ID NO: 11135 - RNA, 22 nt, Human
aucugucuggaggccuggcaug

SEQ ID NO: 11136 - RNA, 22 nt, Human
aucugucuuuuauucaugagcu

SEQ ID NO: 11137 - RNA, 22 nt, Human
aucugugagaaaggcuugugcu

SEQ ID NO: 11138 - RNA, 22 nt, Human
aucuguggauaugaccuuccug

SEQ ID NO: 11139 - RNA, 22 nt, Human
aucuguggcuggugagaggcag

SEQ ID NO: 11140 - RNA, 22 nt, Human
aucuguucuugugucaguaauu

SEQ ID NO: 11141 - RNA, 23 nt, Human
aucuguugugccucuuauaugua

SEQ ID NO: 11142 - RNA, 22 nt, Human
aucuguuguuuguuugcuaaag

SEQ ID NO: 11143 - RNA, 22 nt, Human
aucuguuuaauucauuuucaca

SEQ ID NO: 11144 - RNA, 21 nt, Human
aucuuaaaaggucuuaacuuu

SEQ ID NO: 11145 - RNA, 22 nt, Human
aucuuaaucgaguccaugaaaa

SEQ ID NO: 11146 - RNA, 23 nt, Human
aucuuacauauuuagcaccugaa

SEQ ID NO: 11147 - RNA, 22 nt, Human
aucuuaccucuuccucugcauu

SEQ ID NO: 11148 - RNA, 22 nt, Human
aucuucaacuugaucauuugaa

SEQ ID NO: 11149 - RNA, 22 nt, Human
aucuucaguuuucagugagcca

SEQ ID NO: 11150 - RNA, 22 nt, Human
aucuuccaagcucccuggugua

SEQ ID NO: 11151 - RNA, 22 nt, Human
aucuuccuucacuuucucccac

SEQ ID NO: 11152 - RNA, 22 nt, Human
aucuuccuuugccaugggauag

SEQ ID NO: 11153 - RNA, 22 nt, Human
aucuucugggcagugaaaauug

SEQ ID NO: 11154 - RNA, 22 nt, Human
aucuucuggucaaauuuuugca

SEQ ID NO: 11155 - RNA, 20 nt, Human
aucuucuuggccagcuugcu

SEQ ID NO: 11156 - RNA, 22 nt, Human
aucuugauuccauuaucuuugu

SEQ ID NO: 11157 - RNA, 22 nt, Human
aucuugcauuugcuaaaaugca

SEQ ID NO: 11158 - RNA, 20 nt, Human
aucuugggacagggcacaug

SEQ ID NO: 11159 - RNA, 22 nt, Human
aucuugugugaugaugagaaag

SEQ ID NO: 11160 - RNA, 22 nt, Human
aucuuguuaaaaugcagauucu

SEQ ID NO: 11161 - RNA, 22 nt, Human
aucuuguuauaagagauaaugg

SEQ ID NO: 11162 - RNA, 22 nt, Human
aucuuguucucccuuguucuua

SEQ ID NO: 11163 - RNA, 22 nt, Human
aucuuuaauuuggaucagggcc

SEQ ID NO: 11164 - RNA, 22 nt, Human
aucuuuagcauuacuuuauuca

SEQ ID NO: 11165 - RNA, 22 nt, Human
augcauauuucuugggcuuacc

SEQ ID NO: 11166 - RNA, 22 nt, Human
augcaucaccgaguugcccacc

SEQ ID NO: 11167 - RNA, 23 nt, Human
augcaucaugaaaacuagagagc

SEQ ID NO: 11168 - RNA, 22 nt, Human
augcaucauggaaaacucaguu

SEQ ID NO: 11169 - RNA, 20 nt, Human
augcaucugguaucuuuccu

SEQ ID NO: 11170 - RNA, 22 nt, Human
augcaucuuaucaaaaauuaua

SEQ ID NO: 11171 - RNA, 22 nt, Human
augcaugagcuuugugauccug

SEQ ID NO: 11172 - RNA, 22 nt, Human
augcaugcuucuuauaguacuu

SEQ ID NO: 11173 - RNA, 22 nt, Human
augcauggucugaagucaaccu

SEQ ID NO: 11174 - RNA, 22 nt, Human
augcaugucagcugugcccaug

SEQ ID NO: 11175 - RNA, 22 nt, Human
augcaugugcauggcucuaucu

SEQ ID NO: 11176 - RNA, 21 nt, Human
augcauguuacaguauaugcc

SEQ ID NO: 11177 - RNA, 22 nt, Human
augcauugcucaacagaauaca

SEQ ID NO: 11178 - RNA, 22 nt, Human
augcauugucaggcaauuucau

SEQ ID NO: 11179 - RNA, 21 nt, Human
augccaaacuucuucugcccu

SEQ ID NO: 11180 - RNA, 22 nt, Human
augccaaauucucagccucuuu

SEQ ID NO: 11181 - RNA, 22 nt, Human
augccaaauuucuuucuguucu

SEQ ID NO: 11182 - RNA, 22 nt, Human
augccagaagccaaaaaauauu

SEQ ID NO: 11183 - RNA, 22 nt, Human
augccagaaggcagaauuuauc

SEQ ID NO: 11184 - RNA, 22 nt, Human
augccagaccauccaguuggga

SEQ ID NO: 11185 - RNA, 22 nt, Human
augcccagaacccccuggaugg

SEQ ID NO: 11186 - RNA, 22 nt, Human
augcccccaucucuguuggcuc

SEQ ID NO: 11187 - RNA, 22 nt, Human
augcccugagcaggccuucaag

SEQ ID NO: 11188 - RNA, 22 nt, Human
augcccugcugccaucuggccg

SEQ ID NO: 11189 - RNA, 22 nt, Human
augcccuggggcuaccucugag

SEQ ID NO: 11190 - RNA, 20 nt, Human
augcccuguccucuucuguu

SEQ ID NO: 11191 - RNA, 18 nt, Human
augcccuguugacuucag

SEQ ID NO: 11192 - RNA, 22 nt, Human
augccuccucaaaucugccaca

SEQ ID NO: 11193 - RNA, 22 nt, Human
augccugguaugaagcaaggaa

SEQ ID NO: 11194 - RNA, 22 nt, Human
augccuguaaaacagcacccag

SEQ ID NO: 11195 - RNA, 22 nt, Human
augccuuauuguaaucuuucca

SEQ ID NO: 11196 - RNA, 22 nt, Human
augccuuuuuaucauggaugau

SEQ ID NO: 11197 - RNA, 22 nt, Human
augcguguaggaacagugucua

SEQ ID NO: 11198 - RNA, 22 nt, Human
augcuaaacuaugaucauuuuc

SEQ ID NO: 11199 - RNA, 22 nt, Human
augcuaaagggguaggccuccu

SEQ ID NO: 11200 - RNA, 22 nt, Human
augcuaaauucagacaggguua

SEQ ID NO: 11201 - RNA, 22 nt, Human
augcuaauuccaugagcacagg

SEQ ID NO: 11202 - RNA, 22 nt, Human
augcuacacuccgcgaaaaugu

SEQ ID NO: 11203 - RNA, 22 nt, Human
augcuacagagauagguugggu

SEQ ID NO: 11204 - RNA, 22 nt, Human
augcuagaagggagcacuaugu

SEQ ID NO: 11205 - RNA, 22 nt, Human
augcuauacauaugacaucaca

SEQ ID NO: 11206 - RNA, 22 nt, Human
augcuauguaacuggcagauag

SEQ ID NO: 11207 - RNA, 22 nt, Human
augcuauguuugguguuggaga

SEQ ID NO: 11208 - RNA, 22 nt, Human
augcuauuaauauccagucuga

SEQ ID NO: 11209 - RNA, 22 nt, Human
augcuauuccagaauguaaauu

SEQ ID NO: 11210 - RNA, 22 nt, Human
augcucagggcacacucuggac

SEQ ID NO: 11211 - RNA, 17 nt, Human
augcuccauucagaagc

SEQ ID NO: 11212 - RNA, 18 nt, Human
augcuccuaucucugagc

SEQ ID NO: 11213 - RNA, 22 nt, Human
augcuccucgagugucucacag

SEQ ID NO: 11214 - RNA, 22 nt, Human
augcucugaugcuguuaaaugu

SEQ ID NO: 11215 - RNA, 22 nt, Human
augcugaagaaucacagggacu

SEQ ID NO: 11216 - RNA, 22 nt, Human
augcugaagagagaacuacuca

SEQ ID NO: 11217 - RNA, 22 nt, Human
augcugaagagugcacaggcua

SEQ ID NO: 11218 - RNA, 22 nt, Human
augcugaaggccauccugcauc

SEQ ID NO: 11219 - RNA, 22 nt, Human
augcugagaaacagacguguug

SEQ ID NO: 11220 - RNA, 22 nt, Human
augcugagauaaggcuuuaguc

SEQ ID NO: 11221 - RNA, 22 nt, Human
augcugagugagugaaacccag

SEQ ID NO: 11222 - RNA, 22 nt, Human
augcugaugcugcuuuugcccu

SEQ ID NO: 11223 - RNA, 22 nt, Human
augcugcagcugcaggaucaga

SEQ ID NO: 11224 - RNA, 22 nt, Human
augcugccuccucuucagccgc

SEQ ID NO: 11225 - RNA, 22 nt, Human
augcuguagaucuuagccucua

SEQ ID NO: 11226 - RNA, 22 nt, Human
aaggcugaguaaaacagagaac

SEQ ID NO: 11227 - RNA, 22 nt, Human
aaggcugcuuuuaacaugcaua

SEQ ID NO: 11228 - RNA, 22 nt, Human
aaggcugguuuccuugauguuu

SEQ ID NO: 11229 - RNA, 22 nt, Human
aaggcuguccaggagaaaauag

SEQ ID NO: 11230 - RNA, 22 nt, Human
aaggcugucuuuuccucuuccc

SEQ ID NO: 11231 - RNA, 22 nt, Human
aaggcugugguucuauacagaa

SEQ ID NO: 11232 - RNA, 22 nt, Human
aaggcugugucagaagcucccu

SEQ ID NO: 11233 - RNA, 22 nt, Human
aaggcuucuggagcuugcuggc

SEQ ID NO: 11234 - RNA, 22 nt, Human
aaggcuucuuaugcaauuguuu

SEQ ID NO: 11235 - RNA, 22 nt, Human
aaggcuucuuuaguguccuaau

SEQ ID NO: 11236 - RNA, 22 nt, Human
aaggcuugauauuuacagucuu

SEQ ID NO: 11237 - RNA, 22 nt, Human
aaggcuuggaccagcuacagug

SEQ ID NO: 11238 - RNA, 22 nt, Human
aaggcuuggucuagucaugcca

SEQ ID NO: 11239 - RNA, 22 nt, Human
aaggcuuguguguucagugagg

SEQ ID NO: 11240 - RNA, 22 nt, Human
aaggcuuguugaguaucuacug

SEQ ID NO: 11241 - RNA, 22 nt, Human
aaggcuuuccuguaggaagaca

SEQ ID NO: 11242 - RNA, 22 nt, Human
aaggaaagacauauaaaugacu

SEQ ID NO: 11243 - RNA, 22 nt, Human
aaggaaagcugugguucugaga

SEQ ID NO: 11244 - RNA, 22 nt, Human
aaggaaaggaugagcaugcauu

SEQ ID NO: 11245 - RNA, 22 nt, Human
aaggaaccucuaagccucuguu

SEQ ID NO: 11246 - RNA, 22 nt, Human
aaggaaccugggaaccuaucau

SEQ ID NO: 11247 - RNA, 22 nt, Human
aaggaacuaaauaguucuggaa

SEQ ID NO: 11248 - RNA, 22 nt, Human
aaggaagagcaaagaauuaugu

SEQ ID NO: 11249 - RNA, 22 nt, Human
aaggaagaugaaaguacugcua

SEQ ID NO: 11250 - RNA, 16 nt, Human
aaggaaugucauucug

SEQ ID NO: 11251 - RNA, 22 nt, Human
aaggaauucccuuucugacaga

SEQ ID NO: 11252 - RNA, 22 nt, Human
aaggaauucuagaagguuuugu

SEQ ID NO: 11253 - RNA, 22 nt, Human
aaggacagagagccauuccaga

SEQ ID NO: 11254 - RNA, 22 nt, Human
aaggacagguuggggcuucagg

SEQ ID NO: 11255 - RNA, 22 nt, Human
aaggaccaguuuugcagaauug

SEQ ID NO: 11256 - RNA, 22 nt, Human
aaggagaaggcaucauucaagu

SEQ ID NO: 11257 - RNA, 22 nt, Human
aaggagaagucuguugagauug

SEQ ID NO: 11258 - RNA, 22 nt, Human
aaggagacauuugcagagcacc

SEQ ID NO: 11259 - RNA, 22 nt, Human
aaggagcgcuuagggggcagaa

SEQ ID NO: 11260 - RNA, 22 nt, Human
aaggagcuaugcauaacugauc

SEQ ID NO: 11261 - RNA, 22 nt, Human
aaggagcucccggcagaccagg

SEQ ID NO: 11262 - RNA, 17 nt, Human
aaggagcugagagaugg

SEQ ID NO: 11263 - RNA, 22 nt, Human
aaggagcugggagggacacaug

SEQ ID NO: 11264 - RNA, 22 nt, Human
aaggagcuuucauuacagccuu

SEQ ID NO: 11265 - RNA, 22 nt, Human
aaggaggaaaauauuguugcug

SEQ ID NO: 11266 - RNA, 22 nt, Human
aaggagucugggccauucagag

SEQ ID NO: 11267 - RNA, 22 nt, Human
aaggagugcugaaaggaagcgg

SEQ ID NO: 11268 - RNA, 22 nt, Human
aaggauagucacauuuuuaugu

SEQ ID NO: 11269 - RNA, 22 nt, Human
aaggaucauaguaaacauugau

SEQ ID NO: 11270 - RNA, 23 nt, Human
aaggaucucugagaucauggcuu

SEQ ID NO: 11271 - RNA, 22 nt, Human
aaggaucugacagacuauagaa

SEQ ID NO: 11272 - RNA, 22 nt, Human
aaggauuuguccaaagucacac

SEQ ID NO: 11273 - RNA, 22 nt, Human
aaggcaaaagaggugucaucac

SEQ ID NO: 11274 - RNA, 22 nt, Human
aaggcaaauguguucuuuuagu

SEQ ID NO: 11275 - RNA, 22 nt, Human
aaggcaaggccaagccaucagu

SEQ ID NO: 11276 - RNA, 22 nt, Human
aaggcaaguuuuaguuuucugg

SEQ ID NO: 11277 - RNA, 22 nt, Human
aaggcaauauugaguuucccuu

SEQ ID NO: 11278 - RNA, 22 nt, Human
aaggcaaugcuaagagguuugg

SEQ ID NO: 11279 - RNA, 22 nt, Human
aaggcaauguuagcaacauaau

SEQ ID NO: 11280 - RNA, 22 nt, Human
aaggcaauugcaguuuuugcca

SEQ ID NO: 11281 - RNA, 22 nt, Human
aaggcaauuggcuuguauaaga

SEQ ID NO: 11282 - RNA, 22 nt, Human
aaggcacacaguuagauagagc

SEQ ID NO: 11283 - RNA, 22 nt, Human
aaggcacuagcagaauuaguga

SEQ ID NO: 11284 - RNA, 22 nt, Human
aaggcacucauucaaggagaua

SEQ ID NO: 11285 - RNA, 22 nt, Human
aaggcacugaaaaauugugugu

SEQ ID NO: 11286 - RNA, 22 nt, Human
aaggcacugacugugcagggga

SEQ ID NO: 11287 - RNA, 22 nt, Human
aaggcacugagccagccgucuc

SEQ ID NO: 11288 - RNA, 22 nt, Human
aaggcagaaagggaugugagug

SEQ ID NO: 11289 - RNA, 19 nt, Human
aaggcagaaguuggauaug

SEQ ID NO: 11290 - RNA, 22 nt, Human
aaggcagagauauucuugaucu

SEQ ID NO: 11291 - RNA, 22 nt, Human
aaggcagauaagaauucagcaa

SEQ ID NO: 11292 - RNA, 22 nt, Human
aaggcagcacagcaacugcuca

SEQ ID NO: 11293 - RNA, 22 nt, Human
aaggcagcagaggaaaggugcu

SEQ ID NO: 11294 - RNA, 22 nt, Human
aaggcagccauagcaccaucca

SEQ ID NO: 11295 - RNA, 22 nt, Human
aaggcagccaugugcuuugggu

SEQ ID NO: 11296 - RNA, 22 nt, Human
aaggcaggagcuguaucuuauu

SEQ ID NO: 11297 - RNA, 22 nt, Human
aaggcaggaugggaaaagauuu

SEQ ID NO: 11298 - RNA, 22 nt, Human
aaggcagggaaaguggauuagg

SEQ ID NO: 11299 - RNA, 22 nt, Human
aaggcaguacuuuauguccaua

SEQ ID NO: 11300 - RNA, 22 nt, Human
aaggcagucaaagcagacuucu

SEQ ID NO: 11301 - RNA, 22 nt, Human
aaggcauuaccuaaguuuggga

SEQ ID NO: 11302 - RNA, 22 nt, Human
aaggcauuuguuggauuucuca

SEQ ID NO: 11303 - RNA, 22 nt, Human
aaggccacacuugcuggccagc

SEQ ID NO: 11304 - RNA, 22 nt, Human
aaggccaccaccagcgaggggg

SEQ ID NO: 11305 - RNA, 22 nt, Human
aaggccagauucacuuuacaau

SEQ ID NO: 11306 - RNA, 22 nt, Human
aaggccagauucucucuagggg

SEQ ID NO: 11307 - RNA, 22 nt, Human
aaggccagcuuguagggcuggu

SEQ ID NO: 11308 - RNA, 22 nt, Human
aaggccagggaugccagcucgg

SEQ ID NO: 11309 - RNA, 22 nt, Human
aaggccaggggcuggcgccucc

SEQ ID NO: 11310 - RNA, 22 nt, Human
aaggccaucuacuuacggaauu

SEQ ID NO: 11311 - RNA, 22 nt, Human
aaggccaugcacauccuaggca

SEQ ID NO: 11312 - RNA, 22 nt, Human
aaggcccagggauuggagguca

SEQ ID NO: 11313 - RNA, 22 nt, Human
aaggcccucaugcgucagagcc

SEQ ID NO: 11314 - RNA, 22 nt, Human
aaggcccuggaugguuuugaga

SEQ ID NO: 11315 - RNA, 22 nt, Human
aaggcccuggcaggaagcagga

SEQ ID NO: 11316 - RNA, 22 nt, Human
aaggcccuuuagcagaggaggg

SEQ ID NO: 11317 - RNA, 18 nt, Human
aaggccuagucccucucu

SEQ ID NO: 11318 - RNA, 22 nt, Human
aaggccuugccgaaggaugcca

SEQ ID NO: 11319 - RNA, 22 nt, Human
aaggccuugccugacagcacca

SEQ ID NO: 11320 - RNA, 22 nt, Human
aaggccuuucuagcuuugugcu

SEQ ID NO: 11321 - RNA, 22 nt, Human
aaggccuuugccccgauacagg

SEQ ID NO: 11322 - RNA, 22 nt, Human
aaggcuaaauucuguacugcau

SEQ ID NO: 11323 - RNA, 22 nt, Human
aaggcuagagagguauucaagu

SEQ ID NO: 11324 - RNA, 22 nt, Human
aaggcuauaucucaauacuauu

SEQ ID NO: 11325 - RNA, 22 nt, Human
aaggcuaucuggccuccuugcc

SEQ ID NO: 11326 - RNA, 22 nt, Human
aaggcuauguguuaaggcagau

SEQ ID NO: 11327 - RNA, 22 nt, Human
aaggcucuggguuucauaggug

SEQ ID NO: 11328 - RNA, 22 nt, Human
aaggcucuugaguggugauagu

SEQ ID NO: 11329 - RNA, 22 nt, Human
aaggcucuuggagugaaugcag

SEQ ID NO: 11330 - RNA, 22 nt, Human
aaggcugaccaguuuacacuuu

SEQ ID NO: 11331 - RNA, 22 nt, Human
aaggcugauuagacugauagcu

SEQ ID NO: 11332 - RNA, 22 nt, Human
aaggcugggaaacaugcaggcc

SEQ ID NO: 11333 - RNA, 22 nt, Human
aaggcuggguuugggaugugau

SEQ ID NO: 11334 - RNA, 19 nt, Human
aaggcugguaccauagguu

SEQ ID NO: 11335 - RNA, 22 nt, Human
aagucauagucgggaaagacau

SEQ ID NO: 11336 - RNA, 22 nt, Human
aagucaucacuccucugaacuu

SEQ ID NO: 11337 - RNA, 22 nt, Human
aagucauuaucucuucuaaucu

SEQ ID NO: 11338 - RNA, 22 nt, Human
aagucauucuauuucucuaugu

SEQ ID NO: 11339 - RNA, 22 nt, Human
aagucauugguagcuugauagg

SEQ ID NO: 11340 - RNA, 22 nt, Human
aaguccaccagucagacuagga

SEQ ID NO: 11341 - RNA, 22 nt, Human
aaguccagaccugaggcccuca

SEQ ID NO: 11342 - RNA, 17 nt, Human
aaguccagccugcagcu

SEQ ID NO: 11343 - RNA, 22 nt, Human
aaguccaggcuggcguagaguc

SEQ ID NO: 11344 - RNA, 22 nt, Human
aaguccagggaucaaaguaggc

SEQ ID NO: 11345 - RNA, 22 nt, Human
aaguccagguccucauuccauc

SEQ ID NO: 11346 - RNA, 22 nt, Human
aaguccagugaaauagaaugca

SEQ ID NO: 11347 - RNA, 22 nt, Human
aaguccagugcuuuagauucca

SEQ ID NO: 11348 - RNA, 22 nt, Human
aaguccaguuucauuugagguc

SEQ ID NO: 11349 - RNA, 22 nt, Human
aaguccaguuuuuccagguggu

SEQ ID NO: 11350 - RNA, 22 nt, Human
aaguccaucucugccccacaca

SEQ ID NO: 11351 - RNA, 18 nt, Human
aaguccauggguuuggga

SEQ ID NO: 11352 - RNA, 17 nt, Human
aagucccagcuaacaca

SEQ ID NO: 11353 - RNA, 22 nt, Human
aagucccuggugcuggcugcgc

SEQ ID NO: 11354 - RNA, 22 nt, Human
aagucccugugggguggaggcu

SEQ ID NO: 11355 - RNA, 22 nt, Human
aaguccuggauauuaaauugau

SEQ ID NO: 11356 - RNA, 18 nt, Human
aaguccuuccuuugcuuu

SEQ ID NO: 11357 - RNA, 22 nt, Human
aaguccuuguauacagaaucaa

SEQ ID NO: 11358 - RNA, 22 nt, Human
aaguccuuuaauaucacauagu

SEQ ID NO: 11359 - RNA, 22 nt, Human
aagucucagaaaacuagugugg

SEQ ID NO: 11360 - RNA, 22 nt, Human
aaggcuuugugggcugcaggca

SEQ ID NO: 11361 - RNA, 22 nt, Human
aaggcuuuuaaacugucaagga

SEQ ID NO: 11362 - RNA, 22 nt, Human
aaggcuuuuaacuacuguuuua

SEQ ID NO: 11363 - RNA, 22 nt, Human
aagggaaacuuucacaaugucc

SEQ ID NO: 11364 - RNA, 22 nt, Human
aagggaaauccucagcccagga

SEQ ID NO: 11365 - RNA, 22 nt, Human
aagggagccaagaaagcagggc

SEQ ID NO: 11366 - RNA, 22 nt, Human
aagggagcuuaggagaucaggc

SEQ ID NO: 11367 - RNA, 22 nt, Human
aagggagguaaagcuauuuaaa

SEQ ID NO: 11368 - RNA, 22 nt, Human
aagggcagcuauuaucgucauc

SEQ ID NO: 11369 - RNA, 22 nt, Human
aagggcaggaaaagauggaugu

SEQ ID NO: 11370 - RNA, 22 nt, Human
aagggcaggagaagacggauau

SEQ ID NO: 11371 - RNA, 22 nt, Human
aagggccacaugccauuuaaaa

SEQ ID NO: 11372 - RNA, 22 nt, Human
aagggccuccuggggagccugg

SEQ ID NO: 11373 - RNA, 22 nt, Human
aagggcggacagggcacauuuc

SEQ ID NO: 11374 - RNA, 22 nt, Human
aagggcuccaagagguagcugg

SEQ ID NO: 11375 - RNA, 22 nt, Human
aagggcucccaacucaucuuuu

SEQ ID NO: 11376 - RNA, 22 nt, Human
aagggcucccugccugaggugg

SEQ ID NO: 11377 - RNA, 22 nt, Human
aagggcucugcugucucucccc

SEQ ID NO: 11378 - RNA, 22 nt, Human
aagggcucuguugccauuucag

SEQ ID NO: 11379 - RNA, 22 nt, Human
aagggcugagcacagugagcca

SEQ ID NO: 11380 - RNA, 22 nt, Human
aagggcuggaauaucucuuaga

SEQ ID NO: 11381 - RNA, 22 nt, Human
aagggcuggaucucucugagca

SEQ ID NO: 11382 - RNA, 22 nt, Human
aagggcuggccacauucugggu

SEQ ID NO: 11383 - RNA, 22 nt, Human
aagggcugggucugguuaaccc

SEQ ID NO: 11384 - RNA, 22 nt, Human
aagggcuggucuagaaagggag

SEQ ID NO: 11385 - RNA, 22 nt, Human
aagggcuuaggauuuugcugug

SEQ ID NO: 11386 - RNA, 22 nt, Human
aaggggccucacagaugggcuu

SEQ ID NO: 11387 - RNA, 22 nt, Human
aagggggcgaagacgugauuga

SEQ ID NO: 11388 - RNA, 22 nt, Human
aaggggugcuguuggaaaccca

SEQ ID NO: 11389 - RNA, 22 nt, Human
aaggguccaaggcuuugcguuu

SEQ ID NO: 11390 - RNA, 22 nt, Human
aagggucuuagagguucauuuu

SEQ ID NO: 11391 - RNA, 22 nt, Human
aagggugcauugcgcggggcug

SEQ ID NO: 11392 - RNA, 22 nt, Human
aaggguggauuucugagcucua

SEQ ID NO: 11393 - RNA, 22 nt, Human
aaggguguugaucagagaggau

SEQ ID NO: 11394 - RNA, 22 nt, Human
aaggguuaguuggauuauuuau

SEQ ID NO: 11395 - RNA, 22 nt, Human
aaggguugaagauaaauaaggu

SEQ ID NO: 11396 - RNA, 22 nt, Human
aaggguugcaaggucagaggaa

SEQ ID NO: 11397 - RNA, 22 nt, Human
aagguacaggguauuagauuau

SEQ ID NO: 11398 - RNA, 22 nt, Human
aagguauagcuugcauacagaa

SEQ ID NO: 11399 - RNA, 22 nt, Human
aagguauuauugucuauguacu

SEQ ID NO: 11400 - RNA, 22 nt, Human
aagguauuggucuggucuuccu

SEQ ID NO: 11401 - RNA, 22 nt, Human
aagguauuuucuaauguauacu

SEQ ID NO: 11402 - RNA, 22 nt, Human
aaggucuauggagaagacugag

SEQ ID NO: 11403 - RNA, 22 nt, Human
aaggucucuguugagaacauuu

SEQ ID NO: 11404 - RNA, 22 nt, Human
aaggucugaguuuugccaggcc

SEQ ID NO: 11405 - RNA, 22 nt, Human
aaggugcucacgggcucaggga

SEQ ID NO: 11406 - RNA, 22 nt, Human
aaggugggguccugucaucuga

SEQ ID NO: 11407 - RNA, 22 nt, Human
aagguggugaguacaguuaggu

SEQ ID NO: 11408 - RNA, 22 nt, Human
aaggugguuguaggcuggucug

SEQ ID NO: 11409 - RNA, 22 nt, Human
aaggugucaaacuagaagaugu

SEQ ID NO: 11410 - RNA, 22 nt, Human
aaggugucaggcuugggaaagu

SEQ ID NO: 11411 - RNA, 22 nt, Human
aaggugugaacugauucauugg

SEQ ID NO: 11412 - RNA, 22 nt, Human
aagguuaguaauauuucuauau

SEQ ID NO: 11413 - RNA, 22 nt, Human
aagguuuauuaaaaguugaugg

SEQ ID NO: 11414 - RNA, 22 nt, Human
aagguuuccagugauauugugg

SEQ ID NO: 11415 - RNA, 22 nt, Human
aagguuuuuuuccaguaucucu

SEQ ID NO: 11416 - RNA, 22 nt, Human
aaguaaaacacacaguccaccg

SEQ ID NO: 11417 - RNA, 22 nt, Human
aaguaaaagcuuuaccaugcgc

SEQ ID NO: 11418 - RNA, 22 nt, Human
aaguaaaccacagagaagccac

SEQ ID NO: 11419 - RNA, 22 nt, Human
aaguaaauaucuguagucuuua

SEQ ID NO: 11420 - RNA, 22 nt, Human
aaguaaauaucuguuuauagca

SEQ ID NO: 11421 - RNA, 22 nt, Human
aaguaacacauguuacuucugc

SEQ ID NO: 11422 - RNA, 22 nt, Human
aaguaacagcaucaagucucaa

SEQ ID NO: 11423 - RNA, 22 nt, Human
aaguaaggccuucuugagcaug

SEQ ID NO: 11424 - RNA, 22 nt, Human
aaguacaaauuuugaagagcuu

SEQ ID NO: 11425 - RNA, 22 nt, Human
aaguacaccuuuggaguccacg

SEQ ID NO: 11426 - RNA, 22 nt, Human
aaguacagaaauagcaggugca

SEQ ID NO: 11427 - RNA, 23 nt, Human
aaguacauauauuuagauaguga

SEQ ID NO: 11428 - RNA, 22 nt, Human
aaguacaucaaauguuuggcua

SEQ ID NO: 11429 - RNA, 22 nt, Human
aaguacaugcuguaaugauugg

SEQ ID NO: 11430 - RNA, 22 nt, Human
aaguacauggaggauagcugcu

SEQ ID NO: 11431 - RNA, 22 nt, Human
aaguacauguugcucaacagcc

SEQ ID NO: 11432 - RNA, 22 nt, Human
aaguacauguuguucaaaagcc

SEQ ID NO: 11433 - RNA, 23 nt, Human
aaguaccuacacauuauuucaga

SEQ ID NO: 11434 - RNA, 22 nt, Human
aaguacuaaggcuauuaugaug

SEQ ID NO: 11435 - RNA, 22 nt, Human
aaguagacuuuugcaucaagga

SEQ ID NO: 11436 - RNA, 22 nt, Human
aaguagcagggauuacaggugu

SEQ ID NO: 11437 - RNA, 22 nt, Human
aaguagcauuccaugguauaga

SEQ ID NO: 11438 - RNA, 22 nt, Human
aaguaggaauccgaaugaguag

SEQ ID NO: 11439 - RNA, 22 nt, Human
aaguaguuaguccgccugcucu

SEQ ID NO: 11440 - RNA, 22 nt, Human
aaguauauuuuuugaagcauau

SEQ ID NO: 11441 - RNA, 22 nt, Human
aaguaucugggagauuugcuuu

SEQ ID NO: 11442 - RNA, 22 nt, Human
aaguaucuuggaaaacucuucu

SEQ ID NO: 11443 - RNA, 22 nt, Human
aaguaugaaucaaagacuaucu

SEQ ID NO: 11444 - RNA, 22 nt, Human
aaguucaaguguaaucuuuauu

SEQ ID NO: 11445 - RNA, 22 nt, Human
aaguucagccugguuuuaaugc

SEQ ID NO: 11446 - RNA, 22 nt, Human
aaguucaucaaagaguaaauau

SEQ ID NO: 11447 - RNA, 18 nt, Human
aaguuccacaagagaucu

SEQ ID NO: 11448 - RNA, 22 nt, Human
aaguuccuaaagucagggguca

SEQ ID NO: 11449 - RNA, 22 nt, Human
aaguuccuauauccaaauacag

SEQ ID NO: 11450 - RNA, 22 nt, Human
aaguuccucaaauaaaacauga

SEQ ID NO: 11451 - RNA, 22 nt, Human
aaguuccucuucucugcaggga

SEQ ID NO: 11452 - RNA, 22 nt, Human
aaguuccuguuacuccccagaa

SEQ ID NO: 11453 - RNA, 22 nt, Human
aaguucuaauuuugcauucagg

SEQ ID NO: 11454 - RNA, 22 nt, Human
aaguucuacagcuucgcaggca

SEQ ID NO: 11455 - RNA, 22 nt, Human
aaguucuagagguugauuuggu

SEQ ID NO: 11456 - RNA, 22 nt, Human
aaguucuauagucuuucuacua

SEQ ID NO: 11457 - RNA, 23 nt, Human
aaguucuauuagugcuggucuag

SEQ ID NO: 11458 - RNA, 22 nt, Human
aaguucuugaagacuuuaaaua

SEQ ID NO: 11459 - RNA, 22 nt, Human
aaguucuugauaaguccacugu

SEQ ID NO: 11460 - RNA, 22 nt, Human
aaguugaagcaugaaccaaggu

SEQ ID NO: 11461 - RNA, 22 nt, Human
aaguugaucaaguagcgaguuc

SEQ ID NO: 11462 - RNA, 19 nt, Human
aaguugaucauuuugacag

SEQ ID NO: 11463 - RNA, 22 nt, Human
aaguugauggcgucuuugagau

SEQ ID NO: 11464 - RNA, 22 nt, Human
aaguugcuuuccggcgggcagg

SEQ ID NO: 11465 - RNA, 22 nt, Human
aaguuuagauauagguauucug

SEQ ID NO: 11466 - RNA, 22 nt, Human
aaguuuagcuugagauggaaag

SEQ ID NO: 11467 - RNA, 20 nt, Human
aaguuuaggggaaagugaca

SEQ ID NO: 11468 - RNA, 22 nt, Human
aaguuuagugaaacucuagggg

SEQ ID NO: 11469 - RNA, 22 nt, Human
aaguuuaguggugguguuccau

SEQ ID NO: 11470 - RNA, 22 nt, Human
aaguuuauuaauugacuugugc

SEQ ID NO: 11471 - RNA, 21 nt, Human
aaguuucucccuaauuguugc

SEQ ID NO: 11472 - RNA, 20 nt, Human
aaguuucugguuuauaucuu

SEQ ID NO: 11473 - RNA, 22 nt, Human
aaguuucuguaugcucuucugu

SEQ ID NO: 11474 - RNA, 22 nt, Human
aaguuucuuuauuagcuugucc

SEQ ID NO: 11475 - RNA, 22 nt, Human
aaguuugagaagcuuauagaua

SEQ ID NO: 11476 - RNA, 22 nt, Human
aaguuugaugaguuucuggagg

SEQ ID NO: 11477 - RNA, 21 nt, Human
aaguuuggaagaaagcaaggg

SEQ ID NO: 11478 - RNA, 22 nt, Human
aaguuuggaaugauagagaccu

SEQ ID NO: 11479 - RNA, 22 nt, Human
aaguuuggaggucacuggucuu

SEQ ID NO: 11480 - RNA, 22 nt, Human
aaguuuggccaaggagacaugg

SEQ ID NO: 11481 - RNA, 22 nt, Human
aaguuugguccuucuaagaaga

SEQ ID NO: 11482 - RNA, 22 nt, Human
aaguuuguagcuggaugucugu

SEQ ID NO: 11483 - RNA, 22 nt, Human
aaguuuguguaguuuagcaucc

SEQ ID NO: 11484 - RNA, 22 nt, Human
aaguuuguucagggcuuacauu

SEQ ID NO: 11485 - RNA, 22 nt, Human
aaguuuuauuggcuauagcacu

SEQ ID NO: 11486 - RNA, 22 nt, Human
aaguuuuccuguguccaagaug

SEQ ID NO: 11487 - RNA, 22 nt, Human
aaguuuuucacauugcuguugu

SEQ ID NO: 11488 - RNA, 22 nt, Human
aauaaacugcucaauugcauca

SEQ ID NO: 11489 - RNA, 22 nt, Human
aauaaagacaaacaggggagcc

SEQ ID NO: 11490 - RNA, 22 nt, Human
aauaaagccuuauugauuuuac

SEQ ID NO: 11491 - RNA, 22 nt, Human
aauagcauaagaugucaaauag

SEQ ID NO: 11492 - RNA, 22 nt, Human
aauagcauccuaaaacauacuu

SEQ ID NO: 11493 - RNA, 22 nt, Human
aauagcauccuguaucucuucc

SEQ ID NO: 11494 - RNA, 22 nt, Human
aauagcaugcauccugcauaga

SEQ ID NO: 11495 - RNA, 22 nt, Human
aauagcauguaaguuuaaaaga

SEQ ID NO: 11496 - RNA, 21 nt, Human
aauagcauucaggaugggcuc

SEQ ID NO: 11497 - RNA, 22 nt, Human
aauagcugauuaauguacuacc

SEQ ID NO: 11498 - RNA, 22 nt, Human
aauagcugcauaaaguauagaa

SEQ ID NO: 11499 - RNA, 17 nt, Human
aauagcugcucagagag

SEQ ID NO: 11500 - RNA, 22 nt, Human
aauagcugggaggcacauucau

SEQ ID NO: 11501 - RNA, 22 nt, Human
aauaggaagcaccaaauucucc

SEQ ID NO: 11502 - RNA, 22 nt, Human
aauaggcucaaauguucuucuc

SEQ ID NO: 11503 - RNA, 22 nt, Human
aauaguacaaucuacagacaua

SEQ ID NO: 11504 - RNA, 22 nt, Human
aauaguguuguucacucaggag

SEQ ID NO: 11505 - RNA, 22 nt, Human
aauaguuaagcaacuuuuucca

SEQ ID NO: 11506 - RNA, 22 nt, Human
aauaguuuuauaggugggauua

SEQ ID NO: 11507 - RNA, 22 nt, Human
aauauaaugcuguuuuaugcca

SEQ ID NO: 11508 - RNA, 20 nt, Human
aauauaauucucugaauuua

SEQ ID NO: 11509 - RNA, 22 nt, Human
aauauacuauacuacuuucugg

SEQ ID NO: 11510 - RNA, 22 nt, Human
aauauagauuuacucaagagaa

SEQ ID NO: 11511 - RNA, 22 nt, Human
aauauaguguuagcucauuuga

SEQ ID NO: 11512 - RNA, 22 nt, Human
aauauaguucuagaaauauuuu

SEQ ID NO: 11513 - RNA, 22 nt, Human
aauauauagaaguacccguugu

SEQ ID NO: 11514 - RNA, 22 nt, Human
aauauaugaccaggaaguucug

SEQ ID NO: 11515 - RNA, 22 nt, Human
aauaucagcucugucacuuacu

SEQ ID NO: 11516 - RNA, 21 nt, Human
aauauccaaaugauuagaucu

SEQ ID NO: 11517 - RNA, 22 nt, Human
aauauccacacugugucccugc

SEQ ID NO: 11518 - RNA, 22 nt, Human
aauauccauugggagcaaaugg

SEQ ID NO: 11519 - RNA, 22 nt, Human
aauaucuucuaaggauagaacu

SEQ ID NO: 11520 - RNA, 22 nt, Human
aauaugaguuugccuuuccugc

SEQ ID NO: 11521 - RNA, 22 nt, Human
aauaugaugccaaauugcuaca

SEQ ID NO: 11522 - RNA, 22 nt, Human
aauaugcaaagcguguuaucug

SEQ ID NO: 11523 - RNA, 22 nt, Human
aauauggcuccauuccuuuagg

SEQ ID NO: 11524 - RNA, 22 nt, Human
aauauguugagucuaucuuuau

SEQ ID NO: 11525 - RNA, 22 nt, Human
aauauuaguuucucaagagaga

SEQ ID NO: 11526 - RNA, 22 nt, Human
aauauuauacagucaaccucuu

SEQ ID NO: 11527 - RNA, 22 nt, Human
aauauucauuugcagaagaagu

SEQ ID NO: 11528 - RNA, 23 nt, Human
aauauuccugccauuaaugacuc

SEQ ID NO: 11529 - RNA, 22 nt, Human
aauauuuaugacaggaaguagc

SEQ ID NO: 11530 - RNA, 22 nt, Human
aauauuucguugcguggcuaga

SEQ ID NO: 11531 - RNA, 22 nt, Human
aauauuuguuaguguuuuaaug

SEQ ID NO: 11532 - RNA, 22 nt, Human
aaucaaccauauauuugauggg

SEQ ID NO: 11533 - RNA, 22 nt, Human
aaucaacugagcccugguucuc

SEQ ID NO: 11534 - RNA, 22 nt, Human
aaucaacuguuuccacagggag

SEQ ID NO: 11535 - RNA, 22 nt, Human
aaucaagaaaaugaggauucuu

SEQ ID NO: 11536 - RNA, 22 nt, Human
aaucaagaauaaguuguaaagc

SEQ ID NO: 11537 - RNA, 22 nt, Human
aaucaagagcugacuauauuuu

SEQ ID NO: 11538 - RNA, 22 nt, Human
aaucacaaacgaauugauggaa

SEQ ID NO: 11539 - RNA, 22 nt, Human
aaucacaaauuuagacagagcu

SEQ ID NO: 11540 - RNA, 22 nt, Human
aaucacaguuaguaagggagaa

SEQ ID NO: 11541 - RNA, 22 nt, Human
aaucacaugugggucuuguagc

SEQ ID NO: 11542 - RNA, 22 nt, Human
aaucacauuaagcccuguucag

SEQ ID NO: 11543 - RNA, 22 nt, Human
aaucacauuacagcauaucugu

SEQ ID NO: 11544 - RNA, 22 nt, Human
aaucacauugaaucugcuaccu

SEQ ID NO: 11545 - RNA, 22 nt, Human
aaucacauuuacauugcuaauu

SEQ ID NO: 11546 - RNA, 23 nt, Human
aaucaccagcagccaaugugcag

SEQ ID NO: 11547 - RNA, 22 nt, Human
aaucaccaucucucuugucccc

SEQ ID NO: 11548 - RNA, 22 nt, Human
aaucacuuagaacccaggaagu

SEQ ID NO: 11549 - RNA, 23 nt, Human
aaucacuucccuccaaauggauu

SEQ ID NO: 11550 - RNA, 22 nt, Human
aaucacuuguaaggaauucaau

SEQ ID NO: 11551 - RNA, 20 nt, Human
aaucacuuuguacaggaagc

SEQ ID NO: 11552 - RNA, 22 nt, Human
aaucacuuuucucuaauguagc

SEQ ID NO: 11553 - RNA, 22 nt, Human
aaugugaaaccgcacagaauaa

SEQ ID NO: 11554 - RNA, 22 nt, Human
aaugugaacuuugucauguaac

SEQ ID NO: 11555 - RNA, 22 nt, Human
aaugugaucgcuuuagaagcuu

SEQ ID NO: 11556 - RNA, 22 nt, Human
aaugugauuuucucacucccuu

SEQ ID NO: 11557 - RNA, 22 nt, Human
aaugugcagaugaauaaacaaa

SEQ ID NO: 11558 - RNA, 22 nt, Human
aaugugcuccaauugucuacuu

SEQ ID NO: 11559 - RNA, 23 nt, Human
aaugugcuguauucauuucugga

SEQ ID NO: 11560 - RNA, 17 nt, Human
aauguggaaguacaugc

SEQ ID NO: 11561 - RNA, 22 nt, Human
aauguggaaucauggacuuuau

SEQ ID NO: 11562 - RNA, 22 nt, Human
aauguggcauugucauuauugg

SEQ ID NO: 11563 - RNA, 22 nt, Human
aauguggggaagccauggcuga

SEQ ID NO: 11564 - RNA, 22 nt, Human
aauguguaaaagguuuucuuca

SEQ ID NO: 11565 - RNA, 22 nt, Human
aauguguaaaugaggagucuug

SEQ ID NO: 11566 - RNA, 22 nt, Human
aauguguacaugacagauagaa

SEQ ID NO: 11567 - RNA, 22 nt, Human
aauguguagauguugcauuccu

SEQ ID NO: 11568 - RNA, 22 nt, Human
aaugugucauuucccacaggug

SEQ ID NO: 11569 - RNA, 22 nt, Human
aaugugugaacacuaaugcaac

SEQ ID NO: 11570 - RNA, 21 nt, Human
aaugugugcuauuuaucuuuu

SEQ ID NO: 11571 - RNA, 22 nt, Human
aauguguuaguauugauuuguc

SEQ ID NO: 11572 - RNA, 22 nt, Human
aauguguucacaggaaauacag

SEQ ID NO: 11573 - RNA, 22 nt, Human
aauguuacaguuuuaauucuga

SEQ ID NO: 11574 - RNA, 22 nt, Human
aauguuacauaacccauugucc

SEQ ID NO: 11575 - RNA, 22 nt, Human
aauguuagauuccuccaccuag

SEQ ID NO: 11576 - RNA, 22 nt, Human
aauguuaguaacuugaguauuu

SEQ ID NO: 11577 - RNA, 22 nt, Human
aauguucagaggacaauauaaa

SEQ ID NO: 11578 - RNA, 22 nt, Human
aauguucagcuuucuuacuuaa

SEQ ID NO: 11579 - RNA, 22 nt, Human
aauguucagggcagcccugcua

SEQ ID NO: 11580 - RNA, 20 nt, Human
aauguucaguaauuguuuua

SEQ ID NO: 11581 - RNA, 22 nt, Human
aauguucaguaucugguccacc

SEQ ID NO: 11582 - RNA, 22 nt, Human
aauguucagucucaagagugau

SEQ ID NO: 11583 - RNA, 22 nt, Human
aauguuccacagauauagcaug

SEQ ID NO: 11584 - RNA, 22 nt, Human
aauguugcagagugauugucca

SEQ ID NO: 11585 - RNA, 19 nt, Human
aauguuuaagagaaaaagg

SEQ ID NO: 11586 - RNA, 22 nt, Human
aauguuucauucuugcccauug

SEQ ID NO: 11587 - RNA, 22 nt, Human
aauguuucauuuaguugucucc

SEQ ID NO: 11588 - RNA, 22 nt, Human
aauguuucguaaauugucuaug

SEQ ID NO: 11589 - RNA, 22 nt, Human
aauguuugccugacuagagugg

SEQ ID NO: 11590 - RNA, 22 nt, Human
aauguuuucucugugaacacau

SEQ ID NO: 11591 - RNA, 22 nt, Human
aauguuuugcauuaguuuucua

SEQ ID NO: 11592 - RNA, 22 nt, Human
aauguuuuuuggucugaugaau

SEQ ID NO: 11593 - RNA, 22 nt, Human
aauuaaaugacaggggaagaug

SEQ ID NO: 11594 - RNA, 23 nt, Human
aauuaaauugcuagauccagggc

SEQ ID NO: 11595 - RNA, 22 nt, Human
aauuaacaaauguagcugugau

SEQ ID NO: 11596 - RNA, 22 nt, Human
aauuaauggaaaguaaggaagg

SEQ ID NO: 11597 - RNA, 22 nt, Human
aauuacacagggaucacuuuuu

SEQ ID NO: 11598 - RNA, 22 nt, Human
aauuacugucuguaaagggaau

SEQ ID NO: 11599 - RNA, 22 nt, Human
aauuacuuaacucucugggccu

SEQ ID NO: 11600 - RNA, 22 nt, Human
aauuagaaucuuauuuggggaa

SEQ ID NO: 11601 - RNA, 22 nt, Human
aauuagacuaauuuuacaaggg

SEQ ID NO: 11602 - RNA, 22 nt, Human
aauuagagaucaguucuuugac

SEQ ID NO: 11603 - RNA, 22 nt, Human
aauuagaguggcgagugauuua

SEQ ID NO: 11604 - RNA, 22 nt, Human
aauuagcagcauauucugcgau

SEQ ID NO: 11605 - RNA, 22 nt, Human
aauuaggaaauucagccauuuu

SEQ ID NO: 11606 - RNA, 22 nt, Human
aaucucuuuggcucaaggaucc

SEQ ID NO: 11607 - RNA, 22 nt, Human
aaucugaaaguauggagcagua

SEQ ID NO: 11608 - RNA, 22 nt, Human
aaucugaagggagauacaugua

SEQ ID NO: 11609 - RNA, 22 nt, Human
aaucugagggaacuugaacucc

SEQ ID NO: 11610 - RNA, 21 nt, Human
aaucugcuucccugugacuug

SEQ ID NO: 11611 - RNA, 22 nt, Human
aaucuggagagucaucucugac

SEQ ID NO: 11612 - RNA, 22 nt, Human
aaucuggcauuugagaguagga

SEQ ID NO: 11613 - RNA, 15 nt, Human
aaucuggcggcaagu

SEQ ID NO: 11614 - RNA, 22 nt, Human
aaucugucguaguaaaaagcag

SEQ ID NO: 11615 - RNA, 22 nt, Human
aaucuguuaagaacagaaaugu

SEQ ID NO: 11616 - RNA, 22 nt, Human
aaucuguuccugaggcaccaga

SEQ ID NO: 11617 - RNA, 22 nt, Human
aaucuguucuacucuauucaga

SEQ ID NO: 11618 - RNA, 22 nt, Human
aaucuguuuccauuagagucau

SEQ ID NO: 11619 - RNA, 22 nt, Human
aaucuguuuguuuacaccuuuu

SEQ ID NO: 11620 - RNA, 22 nt, Human
aaucuguuuuugaaacuuugua

SEQ ID NO: 11621 - RNA, 22 nt, Human
aaucuuacaccgaauuuaaacu

SEQ ID NO: 11622 - RNA, 22 nt, Human
aaucuuagguuuggcuucaucu

SEQ ID NO: 11623 - RNA, 22 nt, Human
aaucuucacucuuaacugugca

SEQ ID NO: 11624 - RNA, 22 nt, Human
aaucuugaguaucagaccaaga

SEQ ID NO: 11625 - RNA, 22 nt, Human
aaucuuggaaguguccacuggu

SEQ ID NO: 11626 - RNA, 22 nt, Human
aaucuuucccuauuaaaugugg

SEQ ID NO: 11627 - RNA, 22 nt, Human
aaucuuuuucacaagaaagcac

SEQ ID NO: 11628 - RNA, 22 nt, Human
aaugaaaauuggacccuagaac

SEQ ID NO: 11629 - RNA, 22 nt, Human
aaugaaacuaguagaaucuuug

SEQ ID NO: 11630 - RNA, 22 nt, Human
aaugaaacucgaaauaaucaca

SEQ ID NO: 11631 - RNA, 22 nt, Human
aaugaaacuguauauagacugu

SEQ ID NO: 11632 - RNA, 18 nt, Human
aaugaaauguacaccuuu

SEQ ID NO: 11633 - RNA, 22 nt, Human
aaugaacaacuugauuuuugcc

SEQ ID NO: 11634 - RNA, 22 nt, Human
aaugaacaagaaagacuuugag

SEQ ID NO: 11635 - RNA, 22 nt, Human
aaugaacacauguggucaguuu

SEQ ID NO: 11636 - RNA, 22 nt, Human
aaugaacacuuagccuuucuau

SEQ ID NO: 11637 - RNA, 22 nt, Human
aaugaacagauacacauaggca

SEQ ID NO: 11638 - RNA, 23 nt, Human
aaugaacugagaaucuguacagu

SEQ ID NO: 11639 - RNA, 22 nt, Human
aaugaacuggaucaggguuucu

SEQ ID NO: 11640 - RNA, 22 nt, Human
aaugaacuguguuaacugaaua

SEQ ID NO: 11641 - RNA, 22 nt, Human
aaugaagaaauggacaucuuua

SEQ ID NO: 11642 - RNA, 22 nt, Human
aaugaagacacaucuuucucau

SEQ ID NO: 11643 - RNA, 22 nt, Human
aaugaagauaaaaugggaugga

SEQ ID NO: 11644 - RNA, 22 nt, Human
aaugaagccagcugggaugcga

SEQ ID NO: 11645 - RNA, 22 nt, Human
aaugaauaacaauccucuggag

SEQ ID NO: 11646 - RNA, 22 nt, Human
aaugacagccagauucuucucu

SEQ ID NO: 11647 - RNA, 22 nt, Human
aaugacaguguugggccagaug

SEQ ID NO: 11648 - RNA, 22 nt, Human
aaugacauggagcaucuuuuca

SEQ ID NO: 11649 - RNA, 22 nt, Human
aaugacucugcugcagagacac

SEQ ID NO: 11650 - RNA, 22 nt, Human
aaugacugaagcaauugcagug

SEQ ID NO: 11651 - RNA, 22 nt, Human
aaugagaagccuagguguacug

SEQ ID NO: 11652 - RNA, 20 nt, Human
aaugagaugacuuagaggaa

SEQ ID NO: 11653 - RNA, 22 nt, Human
aaugagggggaugggaaagugu

SEQ ID NO: 11654 - RNA, 22 nt, Human
aaugaggugaggaaggccucag

SEQ ID NO: 11655 - RNA, 19 nt, Human
aaugaguuccaugaaaaga

SEQ ID NO: 11656 - RNA, 22 nt, Human
aaugauaagacaugaguagagg

SEQ ID NO: 11657 - RNA, 22 nt, Human
aaugauacauauguaucguuag

SEQ ID NO: 11658 - RNA, 22 nt, Human
aaugauccuacacauggaauuc

SEQ ID NO: 11659 - RNA, 22 nt, Human
aaugauccuuguuguuuaacca

SEQ ID NO: 11660 - RNA, 22 nt, Human
aaugaucuggcucaggauauca

SEQ ID NO: 11661 - RNA, 22 nt, Human
aaugaugagaacuggaguaauu

SEQ ID NO: 11662 - RNA, 22 nt, Human
aauagcuuggacccauugcuuu

SEQ ID NO: 11663 - RNA, 22 nt, Human
aauaggacuuugguccuagcuc

SEQ ID NO: 11664 - RNA, 22 nt, Human
aauaggcagcuuagcaggggcu

SEQ ID NO: 11665 - RNA, 22 nt, Human
aauagguagccagauauauaaa

SEQ ID NO: 11666 - RNA, 22 nt, Human
aauaguagucgccuuuuguaag

SEQ ID NO: 11667 - RNA, 22 nt, Human
aauaguccuuaguaagcuguga

SEQ ID NO: 11668 - RNA, 22 nt, Human
aauagucucucccacaccaucc

SEQ ID NO: 11669 - RNA, 22 nt, Human
aauagugcugcuguggacaugg

SEQ ID NO: 11670 - RNA, 22 nt, Human
aauaguguauuuuucaaaauua

SEQ ID NO: 11671 - RNA, 22 nt, Human
aauaguucuagcucagaagcuc

SEQ ID NO: 11672 - RNA, 22 nt, Human
aauaguugugaaucaggacuag

SEQ ID NO: 11673 - RNA, 22 nt, Human
aauauaaauuccugggcccagc

SEQ ID NO: 11674 - RNA, 22 nt, Human
aauauaacacagauggccuguu

SEQ ID NO: 11675 - RNA, 21 nt, Human
aauauaugcaaugcuuucugc

SEQ ID NO: 11676 - RNA, 22 nt, Human
aauauauuugaaucaggaacaa

SEQ ID NO: 11677 - RNA, 22 nt, Human
aauaucacaggaggagaccaag

SEQ ID NO: 11678 - RNA, 22 nt, Human
aauaucagaauguaaugguccu

SEQ ID NO: 11679 - RNA, 22 nt, Human
aauaucaggaugcaaagcugug

SEQ ID NO: 11680 - RNA, 22 nt, Human
aauaucuagccuuuagcagcuu

SEQ ID NO: 11681 - RNA, 22 nt, Human
aauaucuggagaugcuuuuugu

SEQ ID NO: 11682 - RNA, 22 nt, Human
aauaucuguggccauacaauuu

SEQ ID NO: 11683 - RNA, 22 nt, Human
aauaucuuggcccaacuccaga

SEQ ID NO: 11684 - RNA, 22 nt, Human
aauaugcauuaacuguguacau

SEQ ID NO: 11685 - RNA, 22 nt, Human
aauaugucugcuaauuguuucu

SEQ ID NO: 11686 - RNA, 22 nt, Human
aauaugugggugcuaaucaaaa

SEQ ID NO: 11687 - RNA, 22 nt, Human
aauauguucaaaauagaucacu

SEQ ID NO: 11688 - RNA, 22 nt, Human
aauauuaauagaagggguucua

SEQ ID NO: 11689 - RNA, 22 nt, Human
aauauugagaaccagcauguuu

SEQ ID NO: 11690 - RNA, 22 nt, Human
aauauuguuucaagaucacaga

SEQ ID NO: 11691 - RNA, 22 nt, Human
aauauuucaaaaggaaacacag

SEQ ID NO: 11692 - RNA, 22 nt, Human
aauauuuccaaggccugucagg

SEQ ID NO: 11693 - RNA, 22 nt, Human
aauauuuuugaggcccuguuau

SEQ ID NO: 11694 - RNA, 22 nt, Human
aaucaaaaccuacagagguaau

SEQ ID NO: 11695 - RNA, 22 nt, Human
aaucaacaggaugugcauugua

SEQ ID NO: 11696 - RNA, 22 nt, Human
aaucaacauuguuuuaagucaa

SEQ ID NO: 11697 - RNA, 22 nt, Human
aaucaagaggcgauggauggaa

SEQ ID NO: 11698 - RNA, 22 nt, Human
aaucaagucaaccaucaugugc

SEQ ID NO: 11699 - RNA, 22 nt, Human
aaucacaaaugcaaguugucac

SEQ ID NO: 11700 - RNA, 22 nt, Human
aaucacaauuacuuuugcacca

SEQ ID NO: 11701 - RNA, 22 nt, Human
aaucacagaaggcagucuucua

SEQ ID NO: 11702 - RNA, 22 nt, Human
aaucacagccacaaccuggggg

SEQ ID NO: 11703 - RNA, 22 nt, Human
aaucacaucacugagaaugagg

SEQ ID NO: 11704 - RNA, 22 nt, Human
aaucacaugaaaacuguguguu

SEQ ID NO: 11705 - RNA, 22 nt, Human
aaucacuuugcacucuuauuug

SEQ ID NO: 11706 - RNA, 22 nt, Human
aaucagaacgcucgaucuucgg

SEQ ID NO: 11707 - RNA, 22 nt, Human
aaucagaacuccuaccacagag

SEQ ID NO: 11708 - RNA, 15 nt, Human
aaucagaaguguggc

SEQ ID NO: 11709 - RNA, 22 nt, Human
aaucagaaucaguugacacagc

SEQ ID NO: 11710 - RNA, 22 nt, Human
aaucagaauuuguccccugagu

SEQ ID NO: 11711 - RNA, 23 nt, Human
aaucagcaugcucuguggcuggc

SEQ ID NO: 11712 - RNA, 22 nt, Human
aaucagcuaaauaaacuaguca

SEQ ID NO: 11713 - RNA, 22 nt, Human
aaucaggaaacuaucaacacau

SEQ ID NO: 11714 - RNA, 21 nt, Human
aaucaggaaguguguguccug

SEQ ID NO: 11715 - RNA, 22 nt, Human
aaucaggacugugccaaaccua

SEQ ID NO: 11716 - RNA, 22 nt, Human
aaucaggagcuagggggcaaug

SEQ ID NO: 11717 - RNA, 21 nt, Human
aaucaguacauacugcacauc

SEQ ID NO: 11718 - RNA, 22 nt, Human
aaucaguauugguauagaauga

SEQ ID NO: 11719 - RNA, 22 nt, Human
aaucagugcaaaggagagggua

SEQ ID NO: 11720 - RNA, 22 nt, Human
aaucaguuagaaggaagagaau

SEQ ID NO: 11721 - RNA, 22 nt, Human
aaucaguuguucacucugaaaa

SEQ ID NO: 11722 - RNA, 22 nt, Human
aaucauaauucaaauaagcuua

SEQ ID NO: 11723 - RNA, 22 nt, Human
aauguuucaauuaagucuuuua

SEQ ID NO: 11724 - RNA, 22 nt, Human
aauguuugaacuuugcauauuu

SEQ ID NO: 11725 - RNA, 22 nt, Human
aauguuugagcaucuacaugcu

SEQ ID NO: 11726 - RNA, 22 nt, Human
aauguuuggcuagauagaugga

SEQ ID NO: 11727 - RNA, 22 nt, Human
aauguuuucugacugcuaacuu

SEQ ID NO: 11728 - RNA, 22 nt, Human
aauuaaaagauaacccaugagu

SEQ ID NO: 11729 - RNA, 22 nt, Human
aauuaaaggucauguuaaaggg

SEQ ID NO: 11730 - RNA, 22 nt, Human
aauuaacuaauuugguacaaga

SEQ ID NO: 11731 - RNA, 22 nt, Human
aauuacaaauguagacucucau

SEQ ID NO: 11732 - RNA, 21 nt, Human
aauuacagauggaauuacaga

SEQ ID NO: 11733 - RNA, 22 nt, Human
aauuacagucggagcagcacug

SEQ ID NO: 11734 - RNA, 22 nt, Human
aauuaccaggauuuuucaguau

SEQ ID NO: 11735 - RNA, 22 nt, Human
aauuaccaucgucaaaucauau

SEQ ID NO: 11736 - RNA, 22 nt, Human
aauuacugaugccuguguucca

SEQ ID NO: 11737 - RNA, 22 nt, Human
aauuacugggucugagauuaau

SEQ ID NO: 11738 - RNA, 22 nt, Human
aauuacugucuccugcuggugu

SEQ ID NO: 11739 - RNA, 22 nt, Human
aauuagaagggaguuauugaua

SEQ ID NO: 11740 - RNA, 22 nt, Human
aauuagagaucgcaauaacggg

SEQ ID NO: 11741 - RNA, 22 nt, Human
aauuagcauuucccauauaaau

SEQ ID NO: 11742 - RNA, 22 nt, Human
aauuagcugucaaugaggaucu

SEQ ID NO: 11743 - RNA, 22 nt, Human
aauuaggaaaugagaguauuug

SEQ ID NO: 11744 - RNA, 22 nt, Human
aauuaggcaaauuaauuucucu

SEQ ID NO: 11745 - RNA, 22 nt, Human
aauuagggaaaauuuacuugua

SEQ ID NO: 11746 - RNA, 22 nt, Human
aauuagggagccaucauaaggu

SEQ ID NO: 11747 - RNA, 19 nt, Human
aauuagggagucgguuaag

SEQ ID NO: 11748 - RNA, 22 nt, Human
aauuaggggaggacguaucaua

SEQ ID NO: 11749 - RNA, 21 nt, Human
aauuagggugccucuuauaau

SEQ ID NO: 11750 - RNA, 22 nt, Human
aauuaguaaccuaauuccaucu

SEQ ID NO: 11751 - RNA, 22 nt, Human
aauuauacaugaaggcauuaua

SEQ ID NO: 11752 - RNA, 22 nt, Human
aauuauccaccuuugcaugauu

SEQ ID NO: 11753 - RNA, 23 nt, Human
aauuaucuauuucaaauuuagca

SEQ ID NO: 11754 - RNA, 22 nt, Human
aauuauggaauuuuuagagaag

SEQ ID NO: 11755 - RNA, 22 nt, Human
aauuauguagccauaugaaaca

SEQ ID NO: 11756 - RNA, 22 nt, Human
aauuauuuaacuccuuuggaga

SEQ ID NO: 11757 - RNA, 22 nt, Human
aauucaaagccgcuugggaauc

SEQ ID NO: 11758 - RNA, 23 nt, Human
aauucaaauucagugugacuagg

SEQ ID NO: 11759 - RNA, 22 nt, Human
aauucaaauuugaguuugugau

SEQ ID NO: 11760 - RNA, 22 nt, Human
aauucaaggaucuguuaaaucu

SEQ ID NO: 11761 - RNA, 22 nt, Human
aauucaaugguuuuuaggauau

SEQ ID NO: 11762 - RNA, 22 nt, Human
aauucacaauguguagucaugc

SEQ ID NO: 11763 - RNA, 22 nt, Human
aauucacaggagguauuugucc

SEQ ID NO: 11764 - RNA, 22 nt, Human
aauucacaggaucacaggagag

SEQ ID NO: 11765 - RNA, 22 nt, Human
aauucacuguuccuucugcuuu

SEQ ID NO: 11766 - RNA, 22 nt, Human
aauucacuugugcacgcuaugg

SEQ ID NO: 11767 - RNA, 22 nt, Human
aauucagagacucauucuggag

SEQ ID NO: 11768 - RNA, 22 nt, Human
aauucaguugugucugaccucg

SEQ ID NO: 11769 - RNA, 22 nt, Human
aauucauauggauaugcuagua

SEQ ID NO: 11770 - RNA, 22 nt, Human
aauuccaaauguuuucaaucca

SEQ ID NO: 11771 - RNA, 22 nt, Human
acacauguauaugcuugugugu

SEQ ID NO: 11772 - RNA, 22 nt, Human
acacauguauguuuuguauuug

SEQ ID NO: 11773 - RNA, 19 nt, Human
acacauguguguuaugugc

SEQ ID NO: 11774 - RNA, 22 nt, Human
acacauuauaggcaaucaaaag

SEQ ID NO: 11775 - RNA, 21 nt, Human
acacauuaugagcauagacuc

SEQ ID NO: 11776 - RNA, 22 nt, Human
acacauucuuuaaaugucuguu

SEQ ID NO: 11777 - RNA, 22 nt, Human
acacauuuagcaccagguuuau

SEQ ID NO: 11778 - RNA, 22 nt, Human
acacauuucuaaauuuuuaccg

SEQ ID NO: 11779 - RNA, 22 nt, Human
acacauuuuggcuagguggaga

SEQ ID NO: 11780 - RNA, 23 nt, Human
acacauuuuucccguucugaggu

SEQ ID NO: 11781 - RNA, 22 nt, Human
acaccaggucccgucuguaccu

SEQ ID NO: 11782 - RNA, 22 nt, Human
acaccaugaugagugauguagc

SEQ ID NO: 11783 - RNA, 22 nt, Human
acacccagcugggccaccucca

SEQ ID NO: 11784 - RNA, 22 nt, Human
acacccagcuuuugaaugcccu

SEQ ID NO: 11785 - RNA, 22 nt, Human
acaccugggucagugugacagu

SEQ ID NO: 11786 - RNA, 22 nt, Human
acaccuggucuuugcaugagca

SEQ ID NO: 11787 - RNA, 23 nt, Human
acaccugugcuguagucacuaca

SEQ ID NO: 11788 - RNA, 22 nt, Human
acaccuuugugaagugaugaug

SEQ ID NO: 11789 - RNA, 22 nt, Human
acacuaaucuuuuauuugguuu

SEQ ID NO: 11790 - RNA, 22 nt, Human
acacuaaugagaaaggaauuaa

SEQ ID NO: 11791 - RNA, 22 nt, Human
acacuacagggagaagacucac

SEQ ID NO: 11792 - RNA, 22 nt, Human
acacuagcuauuaacuucacau

SEQ ID NO: 11793 - RNA, 22 nt, Human
acacuagucucuucuugacuug

SEQ ID NO: 11794 - RNA, 22 nt, Human
acacuaguggaaauugauuugu

SEQ ID NO: 11795 - RNA, 22 nt, Human
acacucuucucacagucaguuu

SEQ ID NO: 11796 - RNA, 22 nt, Human
acacucuugcauuaccugaaua

SEQ ID NO: 11797 - RNA, 22 nt, Human
acacugaauaauugagaguuga

SEQ ID NO: 11798 - RNA, 22 nt, Human
acacugaaucagaaauuguugg

SEQ ID NO: 11799 - RNA, 19 nt, Human
acacugaauguagaauugg

SEQ ID NO: 11800 - RNA, 21 nt, Human
acacugacaaccauccacgag

SEQ ID NO: 11801 - RNA, 22 nt, Human
acacugacaccugcccucaggu

SEQ ID NO: 11802 - RNA, 22 nt, Human
acacugacgcuugacagucacc

SEQ ID NO: 11803 - RNA, 22 nt, Human
acacugacugggacagaagacc

SEQ ID NO: 11804 - RNA, 22 nt, Human
acacugagcugagcauucuugu

SEQ ID NO: 11805 - RNA, 22 nt, Human
acacugcagauguaauuugagu

SEQ ID NO: 11806 - RNA, 21 nt, Human
acacugcuguagcauauuggg

SEQ ID NO: 11807 - RNA, 22 nt, Human
acacuggaccauuuaaacuuga

SEQ ID NO: 11808 - RNA, 22 nt, Human
acacuggagauggaccucacaa

SEQ ID NO: 11809 - RNA, 22 nt, Human
acacuggagcuucuagcccacg

SEQ ID NO: 11810 - RNA, 22 nt, Human
acacugguugguugaauuuacu

SEQ ID NO: 11811 - RNA, 22 nt, Human
acacugguuguuaauaguaaca

SEQ ID NO: 11812 - RNA, 22 nt, Human
acacuguaaacaucucaagcac

SEQ ID NO: 11813 - RNA, 23 nt, Human
acacugucucauggauagacugc

SEQ ID NO: 11814 - RNA, 22 nt, Human
acacugugacaaaggcuguucu

SEQ ID NO: 11815 - RNA, 22 nt, Human
acacugugagcugaagggcugc

SEQ ID NO: 11816 - RNA, 21 nt, Human
acacugugucauaaugcuuaa

SEQ ID NO: 11817 - RNA, 22 nt, Human
acacuguguggucucucucgga

SEQ ID NO: 11818 - RNA, 14 nt, Human
acacuguguuuaga

SEQ ID NO: 11819 - RNA, 22 nt, Human
acacuguuccugaaauuguuau

SEQ ID NO: 11820 - RNA, 22 nt, Human
acacuguucuuugcacugagaa

SEQ ID NO: 11821 - RNA, 23 nt, Human
acacuucacccauugugauagga

SEQ ID NO: 11822 - RNA, 22 nt, Human
acacuucagcaguaugcuuggg

SEQ ID NO: 11823 - RNA, 22 nt, Human
acacuucauagcaagguuggag

SEQ ID NO: 11824 - RNA, 22 nt, Human
acacuucucauuugauacuaac

SEQ ID NO: 11825 - RNA, 22 nt, Human
acacuucucuuugaagaacaau

SEQ ID NO: 11826 - RNA, 22 nt, Human
acacuucuuugucaccugcuuc

SEQ ID NO: 11827 - RNA, 22 nt, Human
acacuugauaggucaaaucagu

SEQ ID NO: 11828 - RNA, 22 nt, Human
acacuuggagcaacacuuaugg

SEQ ID NO: 11829 - RNA, 22 nt, Human
acacuuguguugaaagcuguua

SEQ ID NO: 11830 - RNA, 22 nt, Human
acacuuuacagaauguuuugau

SEQ ID NO: 11831 - RNA, 22 nt, Human
acacuuuacucuuacaccauug

SEQ ID NO: 11832 - RNA, 22 nt, Human
acacuuuaucucaucucagaca

SEQ ID NO: 11833 - RNA, 22 nt, Human
acacuuuaugucuagaucuggg

SEQ ID NO: 11834 - RNA, 23 nt, Human
acacuuucaaauaugcacagagc

SEQ ID NO: 11835 - RNA, 22 nt, Human
acacuuucuggagcugcacaua

SEQ ID NO: 11836 - RNA, 22 nt, Human
acacuuuuguuugaagucucca

SEQ ID NO: 11837 - RNA, 22 nt, Human
acagaaagaagguguauuugag

SEQ ID NO: 11838 - RNA, 22 nt, Human
acagaaauauagaagguaggaa

SEQ ID NO: 11839 - RNA, 22 nt, Human
acagaaauauucguggugcuug

SEQ ID NO: 11840 - RNA, 22 nt, Human
aauuuguuuucaagucacugga

SEQ ID NO: 11841 - RNA, 22 nt, Human
aauuuuacaagaaggccucgua

SEQ ID NO: 11842 - RNA, 22 nt, Human
aauuuuacuucccucaguguag

SEQ ID NO: 11843 - RNA, 22 nt, Human
aauuuuaugccuugcacguugg

SEQ ID NO: 11844 - RNA, 22 nt, Human
aauuuuccauccaaaguaacau

SEQ ID NO: 11845 - RNA, 22 nt, Human
aauuuucuaaggugaugaucug

SEQ ID NO: 11846 - RNA, 22 nt, Human
aauuuucugaugaugaagcacg

SEQ ID NO: 11847 - RNA, 22 nt, Human
acaaaaagcuccauuacugucc

SEQ ID NO: 11848 - RNA, 22 nt, Human
acaaaaauuagcugggcauggu

SEQ ID NO: 11849 - RNA, 22 nt, Human
acaaaauuuuuagacaaggcuu

SEQ ID NO: 11850 - RNA, 22 nt, Human
acaaacagaguugaaaaauagg

SEQ ID NO: 11851 - RNA, 22 nt, Human
acaaacagcuaacauauguuaa

SEQ ID NO: 11852 - RNA, 22 nt, Human
acaaacuucccagacaagcucc

SEQ ID NO: 11853 - RNA, 22 nt, Human
acaaagacgggauaagguuugg

SEQ ID NO: 11854 - RNA, 22 nt, Human
acaaagauaagucagaaaguca

SEQ ID NO: 11855 - RNA, 22 nt, Human
acaaagcucuggaaggcucguc

SEQ ID NO: 11856 - RNA, 22 nt, Human
acaaaggcaggauugacuuagu

SEQ ID NO: 11857 - RNA, 22 nt, Human
acaaaguaagggcuaaugagca

SEQ ID NO: 11858 - RNA, 22 nt, Human
acaaaguaggcagugggcugga

SEQ ID NO: 11859 - RNA, 22 nt, Human
acaaaguaggucaucaaagcuc

SEQ ID NO: 11860 - RNA, 22 nt, Human
acaaagucucuaauaaucuucu

SEQ ID NO: 11861 - RNA, 22 nt, Human
acaaagucugaaaccugaggca

SEQ ID NO: 11862 - RNA, 19 nt, Human
acaaagugcgugcucuuuu

SEQ ID NO: 11863 - RNA, 22 nt, Human
acaaagugugcggagcccaggg

SEQ ID NO: 11864 - RNA, 22 nt, Human
acaaaguuaacaguuggauagu

SEQ ID NO: 11865 - RNA, 22 nt, Human
acaaaguuugugguauuccaag

SEQ ID NO: 11866 - RNA, 16 nt, Human
acaaauacaacugcug

SEQ ID NO: 11867 - RNA, 22 nt, Human
acaaaugagaauguagacagag

SEQ ID NO: 11868 - RNA, 19 nt, Human
acaaaugauguugcacuga

SEQ ID NO: 11869 - RNA, 22 nt, Human
acaaaugauuuuccaagccagu

SEQ ID NO: 11870 - RNA, 18 nt, Human
acaaaugugucacaggaa

SEQ ID NO: 11871 - RNA, 22 nt, Human
acaaauuaccauggaauuuggg

SEQ ID NO: 11872 - RNA, 22 nt, Human
acaaauuauagaaaauugagcu

SEQ ID NO: 11873 - RNA, 22 nt, Human
acaaauucuacaaucauaugau

SEQ ID NO: 11874 - RNA, 22 nt, Human
acaaauucuuucugccuauugg

SEQ ID NO: 11875 - RNA, 22 nt, Human
acaaauugaccgcaagauucau

SEQ ID NO: 11876 - RNA, 20 nt, Human
acaaauuggcagaaugacaa

SEQ ID NO: 11877 - RNA, 19 nt, Human
acaaauuguccucaucaag

SEQ ID NO: 11878 - RNA, 22 nt, Human
acaacaaaaugaggaagugguc

SEQ ID NO: 11879 - RNA, 22 nt, Human
acaacaaagacacuugaaauga

SEQ ID NO: 11880 - RNA, 22 nt, Human
acagguccucaagucagcuggg

SEQ ID NO: 11881 - RNA, 22 nt, Human
acaggugaaguauuacacuaag

SEQ ID NO: 11882 - RNA, 22 nt, Human
acaggugagggagcuuugugcc

SEQ ID NO: 11883 - RNA, 22 nt, Human
acagguggacacagcagcaguc

SEQ ID NO: 11884 - RNA, 22 nt, Human
acagguggaggcuuuaggaggu

SEQ ID NO: 11885 - RNA, 22 nt, Human
acagguggcauaggcaguuuga

SEQ ID NO: 11886 - RNA, 22 nt, Human
acagguggcuuauuggcugauu

SEQ ID NO: 11887 - RNA, 22 nt, Human
acaggugguaaaauggacuguc

SEQ ID NO: 11888 - RNA, 22 nt, Human
acaggugguagaguggaaagag

SEQ ID NO: 11889 - RNA, 22 nt, Human
acaggugugagaacaugccuug

SEQ ID NO: 11890 - RNA, 22 nt, Human
acagguguguucccggaaagcc

SEQ ID NO: 11891 - RNA, 22 nt, Human
acagguguugaaugaugucaca

SEQ ID NO: 11892 - RNA, 22 nt, Human
acagguuugcugcuguuuuagg

SEQ ID NO: 11893 - RNA, 22 nt, Human
acagguuuuuguggauauaugu

SEQ ID NO: 11894 - RNA, 22 nt, Human
acaguaaaaagccuuagaauuu

SEQ ID NO: 11895 - RNA, 22 nt, Human
acaguaaaacauuuuuauuagg

SEQ ID NO: 11896 - RNA, 21 nt, Human
acaguaaauucccugcaaaga

SEQ ID NO: 11897 - RNA, 22 nt, Human
acaguaacaaauggccugagga

SEQ ID NO: 11898 - RNA, 22 nt, Human
acaguaagcgggguuggagggc

SEQ ID NO: 11899 - RNA, 22 nt, Human
acaguaauuaaaauggaucugc

SEQ ID NO: 11900 - RNA, 22 nt, Human
acaguacaagcaugauacauaa

SEQ ID NO: 11901 - RNA, 22 nt, Human
acaguacagcuaaugucauuag

SEQ ID NO: 11902 - RNA, 22 nt, Human
acaguacauaauccugagucug

SEQ ID NO: 11903 - RNA, 22 nt, Human
acaguacuaagugcucacauga

SEQ ID NO: 11904 - RNA, 22 nt, Human
acaguacugcuguucuuguccu

SEQ ID NO: 11905 - RNA, 22 nt, Human
acaguagacccuggauaaacau

SEQ ID NO: 11906 - RNA, 22 nt, Human
acaguagagcauuuguuuugau

SEQ ID NO: 11907 - RNA, 22 nt, Human
acaguagaguaaaagggagccu

SEQ ID NO: 11908 - RNA, 22 nt, Human
acaguagaguaaaugguuagau

SEQ ID NO: 11909 - RNA, 22 nt, Human
acaguaguacacaucuaugucc

SEQ ID NO: 11910 - RNA, 22 nt, Human
acaguagucucaggaauaggca

SEQ ID NO: 11911 - RNA, 22 nt, Human
acaguauacauugauuaggacc

SEQ ID NO: 11912 - RNA, 22 nt, Human
acagucaagaaauggcagagcc

SEQ ID NO: 11913 - RNA, 22 nt, Human
acagucaaugagugagugaaug

SEQ ID NO: 11914 - RNA, 22 nt, Human
acagucaguaucccaggcaaau

SEQ ID NO: 11915 - RNA, 19 nt, Human
acaguccagcuguuuguac

SEQ ID NO: 11916 - RNA, 22 nt, Human
acaguccuaagauaauugucuc

SEQ ID NO: 11917 - RNA, 22 nt, Human
acaguccuagcugcaaagaagu

SEQ ID NO: 11918 - RNA, 22 nt, Human
acaguccuuguguggaacauua

SEQ ID NO: 11919 - RNA, 22 nt, Human
acagucuacaaagugaugugug

SEQ ID NO: 11920 - RNA, 22 nt, Human
acagucuacuugagcuuguaua

SEQ ID NO: 11921 - RNA, 22 nt, Human
acagucuaggccuaggucaaaa

SEQ ID NO: 11922 - RNA, 21 nt, Human
acagucuccccagaucucucc

SEQ ID NO: 11923 - RNA, 22 nt, Human
acagucucuugcuugaauacua

SEQ ID NO: 11924 - RNA, 22 nt, Human
acagucucuuggaauuuucaga

SEQ ID NO: 11925 - RNA, 22 nt, Human
acagucugcaggcaaguucuac

SEQ ID NO: 11926 - RNA, 22 nt, Human
acagucugccucucagagcagc

SEQ ID NO: 11927 - RNA, 19 nt, Human
acagucuuacaaaugucca

SEQ ID NO: 11928 - RNA, 22 nt, Human
acagucuuuaauuucuuugugg

SEQ ID NO: 11929 - RNA, 22 nt, Human
acagugaaaagaauauuagaau

SEQ ID NO: 11930 - RNA, 22 nt, Human
acagugaaaauucuauugauuu

SEQ ID NO: 11931 - RNA, 23 nt, Human
acagugaaacacgcaguaagagu

SEQ ID NO: 11932 - RNA, 22 nt, Human
acagugaaugagaauggagaaa

SEQ ID NO: 11933 - RNA, 22 nt, Human
acagugacacucaggugggaug

SEQ ID NO: 11934 - RNA, 21 nt, Human
acagugagaaauaaauggaaa

SEQ ID NO: 11935 - RNA, 17 nt, Human
acagugagaagucaucu

SEQ ID NO: 11936 - RNA, 22 nt, Human
acagugaggaagcagcugugcu

SEQ ID NO: 11937 - RNA, 22 nt, Human
acagugaucuuuuaguuggaac

SEQ ID NO: 11938 - RNA, 22 nt, Human
acagugaugagggaauuuugug

SEQ ID NO: 11939 - RNA, 22 nt, Human
acagugaugccgggcgagaaug

SEQ ID NO: 11940 - RNA, 22 nt, Human
acagugauuauuaguugguggu

SEQ ID NO: 11941 - RNA, 22 nt, Human
acagugauuggcacugauucag

SEQ ID NO: 11942 - RNA, 22 nt, Human
acagugauugguuuggggguga

SEQ ID NO: 11943 - RNA, 18 nt, Human
acagugauuguucuaugc

SEQ ID NO: 11944 - RNA, 22 nt, Human
acagugauuuuuucgagcagaa

SEQ ID NO: 11945 - RNA, 22 nt, Human
acagugcaaacccucgggaaag

SEQ ID NO: 11946 - RNA, 22 nt, Human
acagugcaaacuuuugucuccu

SEQ ID NO: 11947 - RNA, 22 nt, Human
acagugcagugugaugaguauu

SEQ ID NO: 11948 - RNA, 22 nt, Human
acagugcauaaaaacaacuuuu

SEQ ID NO: 11949 - RNA, 19 nt, Human
acagugcaugggaccuggu

SEQ ID NO: 11950 - RNA, 22 nt, Human
acagugcauuauugcugaaugc

SEQ ID NO: 11951 - RNA, 22 nt, Human
acagugcccuaugaacagcucu

SEQ ID NO: 11952 - RNA, 22 nt, Human
acagugcuaaugaugccaagau

SEQ ID NO: 11953 - RNA, 22 nt, Human
acagugcuuagcacagaguaga

SEQ ID NO: 11954 - RNA, 19 nt, Human
acagugcuucugagugagg

SEQ ID NO: 11955 - RNA, 22 nt, Human
acagugcuuggcacacaguaau

SEQ ID NO: 11956 - RNA, 22 nt, Human
acagugcuuuuguuccucuccu

SEQ ID NO: 11957 - RNA, 22 nt, Human
acaguggaagaagcacugaacu

SEQ ID NO: 11958 - RNA, 22 nt, Human
acaguggaagcaugaugcuauc

SEQ ID NO: 11959 - RNA, 22 nt, Human
acaguggaauuuguagaugugu

SEQ ID NO: 11960 - RNA, 22 nt, Human
acaguggagaagcaaaugcagu

SEQ ID NO: 11961 - RNA, 22 nt, Human
acaguggaguugggguagcccu

SEQ ID NO: 11962 - RNA, 22 nt, Human
acaguguacuagguacauguuc

SEQ ID NO: 11963 - RNA, 22 nt, Human
acaguguauaaaaucuuaaaga

SEQ ID NO: 11964 - RNA, 22 nt, Human
acagugucaugucguguucccc

SEQ ID NO: 11965 - RNA, 22 nt, Human
acaguguccccagcucugugag

SEQ ID NO: 11966 - RNA, 17 nt, Human
acagugucuaugaaaug

SEQ ID NO: 11967 - RNA, 16 nt, Human
acagugucucaagcac

SEQ ID NO: 11968 - RNA, 22 nt, Human
acagugucugacacguaggaag

SEQ ID NO: 11969 - RNA, 23 nt, Human
acagugucugcugcaagauaucu

SEQ ID NO: 11970 - RNA, 16 nt, Human
acagugugcuaagcau

SEQ ID NO: 11971 - RNA, 21 nt, Human
acagugugcuucucucccucc

SEQ ID NO: 11972 - RNA, 22 nt, Human
acagugugggacauuaggaaau

SEQ ID NO: 11973 - RNA, 22 nt, Human
acaguguggggugagauggaac

SEQ ID NO: 11974 - RNA, 22 nt, Human
acaaauagaaaaucuggauugg

SEQ ID NO: 11975 - RNA, 22 nt, Human
acaaaucuguuuuauagacuuu

SEQ ID NO: 11976 - RNA, 22 nt, Human
acaaaugacuauuugguacagg

SEQ ID NO: 11977 - RNA, 22 nt, Human
acaaaugacucaaacaccacuu

SEQ ID NO: 11978 - RNA, 22 nt, Human
acaaaugauuaucacagaggag

SEQ ID NO: 11979 - RNA, 20 nt, Human
acaaaugcauucugugacau

SEQ ID NO: 11980 - RNA, 22 nt, Human
acaaaugccauauauaaauucu

SEQ ID NO: 11981 - RNA, 22 nt, Human
acaaauggaagguguucucuuc

SEQ ID NO: 11982 - RNA, 22 nt, Human
acaaauggagaaacugaggccc

SEQ ID NO: 11983 - RNA, 22 nt, Human
acaaauguggacauggauaaug

SEQ ID NO: 11984 - RNA, 22 nt, Human
acaaauguuacauaaguuugga

SEQ ID NO: 11985 - RNA, 22 nt, Human
acaaauugccccauuuugaacu

SEQ ID NO: 11986 - RNA, 19 nt, Human
acaaauuggcaaaaugcaa

SEQ ID NO: 11987 - RNA, 22 nt, Human
acaaauuguugcuucaugaaug

SEQ ID NO: 11988 - RNA, 22 nt, Human
acaaauuucauaggcaaauuuu

SEQ ID NO: 11989 - RNA, 22 nt, Human
acacuguuccacacuaagaagg

SEQ ID NO: 11990 - RNA, 22 nt, Human
acacuuaacuucugagaauaaa

SEQ ID NO: 11991 - RNA, 22 nt, Human
acacuuauuucuugucuaacca

SEQ ID NO: 11992 - RNA, 22 nt, Human
acacuucaaagggugacuugau

SEQ ID NO: 11993 - RNA, 20 nt, Human
acacuucauuugcagcagcu

SEQ ID NO: 11994 - RNA, 18 nt, Human
acacuuccugguggugug

SEQ ID NO: 11995 - RNA, 22 nt, Human
acacuucuauucccugcacaaa

SEQ ID NO: 11996 - RNA, 22 nt, Human
acacuugccaugcugcacacug

SEQ ID NO: 11997 - RNA, 22 nt, Human
acacuuuaguaugaagagguag

SEQ ID NO: 11998 - RNA, 22 nt, Human
acacuuugauagauaaugcagg

SEQ ID NO: 11999 - RNA, 22 nt, Human
acacuuuguccuuuuucauugu

SEQ ID NO: 12000 - RNA, 22 nt, Human
acacuuuuagcuaugaguuaau

SEQ ID NO: 12001 - RNA, 22 nt, Human
acagaaaaaugagggagcugga

SEQ ID NO: 12002 - RNA, 22 nt, Human
acagaaaaguuuacuuuugcuc

SEQ ID NO: 12003 - RNA, 22 nt, Human
acagaaacccagaaaaccucuc

SEQ ID NO: 12004 - RNA, 22 nt, Human
acagaaagaugauuugaaaugg

SEQ ID NO: 12005 - RNA, 23 nt, Human
acagaaaguucugcuggacagag

SEQ ID NO: 12006 - RNA, 23 nt, Human
acagaaaucauuuguaagguacc

SEQ ID NO: 12007 - RNA, 19 nt, Human
acagaaauuaguuauuuuc

SEQ ID NO: 12008 - RNA, 22 nt, Human
acagaaauucugggacagaaaa

SEQ ID NO: 12009 - RNA, 22 nt, Human
acagaaauugcuaauagcucau

SEQ ID NO: 12010 - RNA, 22 nt, Human
acagaaauugggcaaauggaag

SEQ ID NO: 12011 - RNA, 22 nt, Human
acagaacagaggguuuuagaau

SEQ ID NO: 12012 - RNA, 22 nt, Human
acagaacugagaauucucuauc

SEQ ID NO: 12013 - RNA, 22 nt, Human
acagaacugcaggaggaaaagc

SEQ ID NO: 12014 - RNA, 22 nt, Human
acagaacugggaaaugcacaua

SEQ ID NO: 12015 - RNA, 22 nt, Human
acagaacuuccagggaacauac

SEQ ID NO: 12016 - RNA, 22 nt, Human
acagaagaaagggagguuuugc

SEQ ID NO: 12017 - RNA, 22 nt, Human
acagaagcaaaagcaggaucuu

SEQ ID NO: 12018 - RNA, 22 nt, Human
acagaagcaaagacucaggcaa

SEQ ID NO: 12019 - RNA, 22 nt, Human
acagaagcagccgucacagaua

SEQ ID NO: 12020 - RNA, 19 nt, Human
acagaagcauagaaaagga

SEQ ID NO: 12021 - RNA, 22 nt, Human
acagaagugaguggcaagaacu

SEQ ID NO: 12022 - RNA, 21 nt, Human
acagaaguggcuuggucucag

SEQ ID NO: 12023 - RNA, 22 nt, Human
acagaagugucuuuuucauuca

SEQ ID NO: 12024 - RNA, 22 nt, Human
acagaaguguugaaguuuucau

SEQ ID NO: 12025 - RNA, 22 nt, Human
acagaaguuucaaguaagaagu

SEQ ID NO: 12026 - RNA, 22 nt, Human
acagaauaacucuugcuugagu

SEQ ID NO: 12027 - RNA, 22 nt, Human
acagaauaagguuuaucucucc

SEQ ID NO: 12028 - RNA, 22 nt, Human
acagaauaguagcuuaaaguca

SEQ ID NO: 12029 - RNA, 22 nt, Human
acagaauauuuuauuuagauca

SEQ ID NO: 12030 - RNA, 22 nt, Human
acagaaugcagagaugcccaga

SEQ ID NO: 12031 - RNA, 22 nt, Human
acagaauuaacauuugaugaau

SEQ ID NO: 12032 - RNA, 22 nt, Human
acagaauugauggaaaucucag

SEQ ID NO: 12033 - RNA, 22 nt, Human
acagaauuuaaagcucuagacu

SEQ ID NO: 12034 - RNA, 23 nt, Human
acagacaacacugaugagagaaa

SEQ ID NO: 12035 - RNA, 22 nt, Human
acagacaaguaguucagacaag

SEQ ID NO: 12036 - RNA, 22 nt, Human
acagacagacagauugcauaug

SEQ ID NO: 12037 - RNA, 22 nt, Human
acagacagauuuugucugaugu

SEQ ID NO: 12038 - RNA, 22 nt, Human
acagacauauuuggcccauagc

SEQ ID NO: 12039 - RNA, 22 nt, Human
acagacauggaccaagcacugu

SEQ ID NO: 12040 - RNA, 22 nt, Human
acagacauucauauccucggua

SEQ ID NO: 12041 - RNA, 23 nt, Human
acagacauuguacaucuuguuuu

SEQ ID NO: 12042 - RNA, 22 nt, Human
acagacgggacaacgugcagcu

SEQ ID NO: 12043 - RNA, 22 nt, Human
acagacugaagauauuuccccc

SEQ ID NO: 12044 - RNA, 22 nt, Human
acagacuggagugagagaaaua

SEQ ID NO: 12045 - RNA, 23 nt, Human
acagacuguauucaaaguaggac

SEQ ID NO: 12046 - RNA, 22 nt, Human
acagacugugaguaugcauagu

SEQ ID NO: 12047 - RNA, 22 nt, Human
acagagaccuggccuugcuuug

SEQ ID NO: 12048 - RNA, 22 nt, Human
acagagacuuggagcaggcuga

SEQ ID NO: 12049 - RNA, 22 nt, Human
acagagagaggcccgaggcugc

SEQ ID NO: 12050 - RNA, 22 nt, Human
acagagagcugugauugaguua

SEQ ID NO: 12051 - RNA, 22 nt, Human
acagagagguaaaauauauagu

SEQ ID NO: 12052 - RNA, 20 nt, Human
acagagaucagcugaugggc

SEQ ID NO: 12053 - RNA, 23 nt, Human
acagagaucuugacuuguaugga

SEQ ID NO: 12054 - RNA, 22 nt, Human
acagagaugagucaacacagcu

SEQ ID NO: 12055 - RNA, 22 nt, Human
acagagaugggaacauucaggu

SEQ ID NO: 12056 - RNA, 22 nt, Human
acagagauguggaugagggauu

SEQ ID NO: 12057 - RNA, 22 nt, Human
acagagcaauaacagggagagg

SEQ ID NO: 12058 - RNA, 22 nt, Human
acagagcacugcccugugccgc

SEQ ID NO: 12059 - RNA, 22 nt, Human
acagagcagguccagaagugcc

SEQ ID NO: 12060 - RNA, 21 nt, Human
acagagcauaaugguguggca

SEQ ID NO: 12061 - RNA, 22 nt, Human
acagagcccuuccuugcaccau

SEQ ID NO: 12062 - RNA, 22 nt, Human
acagagccuccaggagugcugg

SEQ ID NO: 12063 - RNA, 17 nt, Human
acagagcuacauauucu

SEQ ID NO: 12064 - RNA, 22 nt, Human
acagagcuuaauucaggagcuu

SEQ ID NO: 12065 - RNA, 18 nt, Human
acagaggcagacauguau

SEQ ID NO: 12066 - RNA, 22 nt, Human
acagaggccaugagcugccacc

SEQ ID NO: 12067 - RNA, 22 nt, Human
acagaggcugaucuucaagccc

SEQ ID NO: 12068 - RNA, 22 nt, Human
acagaggcugcgcuugggaacg

SEQ ID NO: 12069 - RNA, 23 nt, Human
acagaggcuuaaaugaguggcag

SEQ ID NO: 12070 - RNA, 22 nt, Human
acagaggguguggaggaagacg

SEQ ID NO: 12071 - RNA, 23 nt, Human
acagagguccaaacaguauaagc

SEQ ID NO: 12072 - RNA, 17 nt, Human
acagagguuauacagac

SEQ ID NO: 12073 - RNA, 22 nt, Human
acagagguuuccauugagguuu

SEQ ID NO: 12074 - RNA, 20 nt, Human
acagaguagaacauaugcca

SEQ ID NO: 12075 - RNA, 21 nt, Human
acagaguaguugaaacagaga

SEQ ID NO: 12076 - RNA, 22 nt, Human
acagaguauuggaaaggcagug

SEQ ID NO: 12077 - RNA, 22 nt, Human
acagagucauucacugaugaag

SEQ ID NO: 12078 - RNA, 22 nt, Human
acagagucgccuuguagcuggc

SEQ ID NO: 12079 - RNA, 22 nt, Human
acagagucucagggaugaaagc

SEQ ID NO: 12080 - RNA, 22 nt, Human
acagaguuuauguguguacaaa

SEQ ID NO: 12081 - RNA, 22 nt, Human
acagauaauacauugugcuaca

SEQ ID NO: 12082 - RNA, 22 nt, Human
acagauaauuagcauaaaugcu

SEQ ID NO: 12083 - RNA, 22 nt, Human
acagauaguauguaaauuaagc

SEQ ID NO: 12084 - RNA, 22 nt, Human
acagauauaaacuauaguagug

SEQ ID NO: 12085 - RNA, 22 nt, Human
acagauauuuaagagcuuuugu

SEQ ID NO: 12086 - RNA, 23 nt, Human
acagaucaucucgaaacaacuau

SEQ ID NO: 12087 - RNA, 22 nt, Human
acagauccugguuacagccauu

SEQ ID NO: 12088 - RNA, 22 nt, Human
acagaucucaaagccuggaccc

SEQ ID NO: 12089 - RNA, 23 nt, Human
acagugugguggacaaggagcag

SEQ ID NO: 12090 - RNA, 22 nt, Human
acaguguguccuaaaggucugg

SEQ ID NO: 12091 - RNA, 22 nt, Human
acaguguucaaaccacuaggcu

SEQ ID NO: 12092 - RNA, 22 nt, Human
acaguguucacuuaacaaugga

SEQ ID NO: 12093 - RNA, 22 nt, Human
acaguguuccuuuguugugacu

SEQ ID NO: 12094 - RNA, 22 nt, Human
acaguguucuugauauuacagu

SEQ ID NO: 12095 - RNA, 22 nt, Human
acaguguucuuggcgcugagug

SEQ ID NO: 12096 - RNA, 22 nt, Human
acaguguuuauguacagauugu

SEQ ID NO: 12097 - RNA, 22 nt, Human
acaguguuuuaugagaauuguu

SEQ ID NO: 12098 - RNA, 22 nt, Human
auggcuuugcucaaguuuagcc

SEQ ID NO: 12099 - RNA, 22 nt, Human
auggcuuuucacagaggguucu

SEQ ID NO: 12100 - RNA, 22 nt, Human
auggcuuuuuagacuuugguac

SEQ ID NO: 12101 - RNA, 22 nt, Human
augggaaagaagccacugccca

SEQ ID NO: 12102 - RNA, 22 nt, Human
augggaagguuuugagagcggg

SEQ ID NO: 12103 - RNA, 22 nt, Human
augggacaauuugaacacagug

SEQ ID NO: 12104 - RNA, 22 nt, Human
augggacagggcuggcuggucc

SEQ ID NO: 12105 - RNA, 22 nt, Human
augggagaaacaucaugaggca

SEQ ID NO: 12106 - RNA, 22 nt, Human
augggaggaugcucgggugcuc

SEQ ID NO: 12107 - RNA, 22 nt, Human
augggaggguggaaaggcucug

SEQ ID NO: 12108 - RNA, 22 nt, Human
augggaguccaacaucaaggac

SEQ ID NO: 12109 - RNA, 22 nt, Human
augggaguggaggaaaaaaguu

SEQ ID NO: 12110 - RNA, 22 nt, Human
augggaguuggguaaggaucau

SEQ ID NO: 12111 - RNA, 22 nt, Human
augggaguuuucucugaugcuc

SEQ ID NO: 12112 - RNA, 22 nt, Human
augggauaacaagaaggcugag

SEQ ID NO: 12113 - RNA, 22 nt, Human
augggaucuugcccugagggcu

SEQ ID NO: 12114 - RNA, 22 nt, Human
augggcaagggguaaggacacu

SEQ ID NO: 12115 - RNA, 21 nt, Human
augggcagaggcagagaggcu

SEQ ID NO: 12116 - RNA, 22 nt, Human
augggcaguuaggaggccagga

SEQ ID NO: 12117 - RNA, 22 nt, Human
augggcaugauauuaguaccua

SEQ ID NO: 12118 - RNA, 22 nt, Human
augggcucggcgcugcugggau

SEQ ID NO: 12119 - RNA, 22 nt, Human
augggcugacuaaugguaaacu

SEQ ID NO: 12120 - RNA, 22 nt, Human
augggcugagaaucaagaauau

SEQ ID NO: 12121 - RNA, 22 nt, Human
augggcuggccuuucccgcucu

SEQ ID NO: 12122 - RNA, 22 nt, Human
augggcugugagguccggcagg

SEQ ID NO: 12123 - RNA, 22 nt, Human
augggcugugggacccuggacc

SEQ ID NO: 12124 - RNA, 22 nt, Human
auggggaagagccagugagcug

SEQ ID NO: 12125 - RNA, 22 nt, Human
auggggcuagacaaccagugcc

SEQ ID NO: 12126 - RNA, 22 nt, Human
auggggcugaaacauggaagag

SEQ ID NO: 12127 - RNA, 22 nt, Human
augggggccugaacaggcaaaa

SEQ ID NO: 12128 - RNA, 22 nt, Human
augggggcggcugaagcccagg

SEQ ID NO: 12129 - RNA, 22 nt, Human
augguaaaagauauacugugca

SEQ ID NO: 12130 - RNA, 22 nt, Human
augguacagugcacugaaugga

SEQ ID NO: 12131 - RNA, 22 nt, Human
augguacauaguuuaaauaagg

SEQ ID NO: 12132 - RNA, 22 nt, Human
augguauuaagaacaauuccaa

SEQ ID NO: 12133 - RNA, 22 nt, Human
augguauuccuuuauguagaag

SEQ ID NO: 12134 - RNA, 22 nt, Human
augguauucucuaacucagcuu

SEQ ID NO: 12135 - RNA, 22 nt, Human
augguauugcaacaacugucau

SEQ ID NO: 12136 - RNA, 22 nt, Human
auggucacuucacccaugagcu

SEQ ID NO: 12137 - RNA, 22 nt, Human
auggucauaugcuaauucagga

SEQ ID NO: 12138 - RNA, 18 nt, Human
auggucucauacugggag

SEQ ID NO: 12139 - RNA, 22 nt, Human
auggucuuaggguaggcagcug

SEQ ID NO: 12140 - RNA, 22 nt, Human
auggucuucucaagcaacacug

SEQ ID NO: 12141 - RNA, 21 nt, Human
auggugagauacugggugugg

SEQ ID NO: 12142 - RNA, 22 nt, Human
auggugcuccugcaggaagcag

SEQ ID NO: 12143 - RNA, 22 nt, Human
augguggauuugugauucagcu

SEQ ID NO: 12144 - RNA, 22 nt, Human
auggugguagaagcacuaugug

SEQ ID NO: 12145 - RNA, 22 nt, Human
augguguagcaugugauaugac

SEQ ID NO: 12146 - RNA, 22 nt, Human
augguguugagucucucuucac

SEQ ID NO: 12147 - RNA, 22 nt, Human
augguuauuucauggaaaaauu

SEQ ID NO: 12148 - RNA, 22 nt, Human
augguugaagaccaguggaaaa

SEQ ID NO: 12149 - RNA, 22 nt, Human
augguugacccaugugaguuag

SEQ ID NO: 12150 - RNA, 22 nt, Human
augguuuaagggagaauauuga

SEQ ID NO: 12151 - RNA, 22 nt, Human
augguuuagcaacuuagggaaa

SEQ ID NO: 12152 - RNA, 22 nt, Human
augguuuaguuagggcuuuuca

SEQ ID NO: 12153 - RNA, 23 nt, Human
augguuuaugucacacuuuugau

SEQ ID NO: 12154 - RNA, 22 nt, Human
augguuuauuagcugcacaggc

SEQ ID NO: 12155 - RNA, 22 nt, Human
augguuucacaaacaaaagguu

SEQ ID NO: 12156 - RNA, 22 nt, Human
augguuuuauuucucuauagcu

SEQ ID NO: 12157 - RNA, 22 nt, Human
auguaaacaaagaucuuccugc

SEQ ID NO: 12158 - RNA, 22 nt, Human
auguaaacacucacugugcccc

SEQ ID NO: 12159 - RNA, 22 nt, Human
auguaaacucacauuuucuuca

SEQ ID NO: 12160 - RNA, 22 nt, Human
auguaaaguaaucugucgauca

SEQ ID NO: 12161 - RNA, 22 nt, Human
auguaaaguucaguacaguuuu

SEQ ID NO: 12162 - RNA, 22 nt, Human
auguaaauuguacugacacacg

SEQ ID NO: 12163 - RNA, 22 nt, Human
auguaacaaaugguauacaugu

SEQ ID NO: 12164 - RNA, 22 nt, Human
auguaacaggugaagcucugag

SEQ ID NO: 12165 - RNA, 22 nt, Human
auguaacauaugugaucgcauu

SEQ ID NO: 12166 - RNA, 22 nt, Human
auguaaccaccacacaaagcaa

SEQ ID NO: 12167 - RNA, 22 nt, Human
auguaagacuuuaagaaccuaa

SEQ ID NO: 12168 - RNA, 22 nt, Human
auguaagagucuaagauuguag

SEQ ID NO: 12169 - RNA, 22 nt, Human
auguaaggagccacaguggggg

SEQ ID NO: 12170 - RNA, 22 nt, Human
auguaagguucagaguauguga

SEQ ID NO: 12171 - RNA, 22 nt, Human
auguaauaggguaacauaacau

SEQ ID NO: 12172 - RNA, 22 nt, Human
auguacaagcuguuuuacugca

SEQ ID NO: 12173 - RNA, 22 nt, Human
auguacacacacaucuuugcgu

SEQ ID NO: 12174 - RNA, 22 nt, Human
auguacaccaggugaagaugaa

SEQ ID NO: 12175 - RNA, 22 nt, Human
auguacauaaaauguauaauga

SEQ ID NO: 12176 - RNA, 22 nt, Human
auguacaugugaauuuaggcaa

SEQ ID NO: 12177 - RNA, 22 nt, Human
auguacauguuuaagugaagga

SEQ ID NO: 12178 - RNA, 22 nt, Human
auguacauuauucgagugaugg

SEQ ID NO: 12179 - RNA, 21 nt, Human
auguacauucggcaacagaua

SEQ ID NO: 12180 - RNA, 22 nt, Human
auguaccagauguauguucuca

SEQ ID NO: 12181 - RNA, 22 nt, Human
auguagaaaguuauugucacug

SEQ ID NO: 12182 - RNA, 22 nt, Human
auguagaagcugacagugcugu

SEQ ID NO: 12183 - RNA, 22 nt, Human
auguaaaccgugcacucccagg

SEQ ID NO: 12184 - RNA, 22 nt, Human
auguaaaucaagcagugcuggu

SEQ ID NO: 12185 - RNA, 22 nt, Human
auguaacacccacuuuuauagc

SEQ ID NO: 12186 - RNA, 22 nt, Human
auguaacuuccucagggauggu

SEQ ID NO: 12187 - RNA, 23 nt, Human
auguaagaguuccaguuacuuug

SEQ ID NO: 12188 - RNA, 22 nt, Human
auguacaaaaugccacugaauu

SEQ ID NO: 12189 - RNA, 22 nt, Human
auguacaaucuaggguuugcau

SEQ ID NO: 12190 - RNA, 22 nt, Human
auguacaaucuaucacaagaag

SEQ ID NO: 12191 - RNA, 22 nt, Human
auguacaggucuuggcaaaggg

SEQ ID NO: 12192 - RNA, 22 nt, Human
auguacaguggaaacuaacaaa

SEQ ID NO: 12193 - RNA, 22 nt, Human
auguacauacugcauuuucaaa

SEQ ID NO: 12194 - RNA, 22 nt, Human
auguacauagcaucaucuagga

SEQ ID NO: 12195 - RNA, 22 nt, Human
auguacaucuuuauaacaagcu

SEQ ID NO: 12196 - RNA, 22 nt, Human
auguacauucuaaguaugugua

SEQ ID NO: 12197 - RNA, 22 nt, Human
auguacauuuguaguaauauca

SEQ ID NO: 12198 - RNA, 22 nt, Human
auguacauuuuccuaauguuuu

SEQ ID NO: 12199 - RNA, 19 nt, Human
auguaccauuugaaguucu

SEQ ID NO: 12200 - RNA, 22 nt, Human
auguaccucugcauuccugccu

SEQ ID NO: 12201 - RNA, 22 nt, Human
auguacuaaagaaauuugcagg

SEQ ID NO: 12202 - RNA, 22 nt, Human
auguacuaugcagucaacuguu

SEQ ID NO: 12203 - RNA, 20 nt, Human
auguacuccccacaagcaac

SEQ ID NO: 12204 - RNA, 22 nt, Human
auguagaaaguuauuuuacucu

SEQ ID NO: 12205 - RNA, 22 nt, Human
auguagaacagguuaaugacag

SEQ ID NO: 12206 - RNA, 22 nt, Human
auguagaauggugauuggcagg

SEQ ID NO: 12207 - RNA, 22 nt, Human
auuaaaugauggcaugucuuau

SEQ ID NO: 12208 - RNA, 22 nt, Human
auuaaauguuccuuaaauuaua

SEQ ID NO: 12209 - RNA, 22 nt, Human
auuaaauguuggcauauuuugu

SEQ ID NO: 12210 - RNA, 21 nt, Human
auuaacuuguuaaccuaaagu

SEQ ID NO: 12211 - RNA, 22 nt, Human
auuaagacugcccauguuuuua

SEQ ID NO: 12212 - RNA, 22 nt, Human
auuaagaucauuguagaagauu

SEQ ID NO: 12213 - RNA, 22 nt, Human
auuaagaugugggaaaauuuaa

SEQ ID NO: 12214 - RNA, 22 nt, Human
auuaagcuccaaguugcucuga

SEQ ID NO: 12215 - RNA, 22 nt, Human
auuaaggaagccuauucucucc

SEQ ID NO: 12216 - RNA, 22 nt, Human
auuaaggagggcugggcaugau

SEQ ID NO: 12217 - RNA, 22 nt, Human
auuaaggcacuugagcaugaug

SEQ ID NO: 12218 - RNA, 22 nt, Human
auuaaggugucaauguauuugg

SEQ ID NO: 12219 - RNA, 22 nt, Human
auuaagugacuaaaguaaugcu

SEQ ID NO: 12220 - RNA, 22 nt, Human
auuaauaucccccgccguucug

SEQ ID NO: 12221 - RNA, 22 nt, Human
auuaauaugagaaaguggcaga

SEQ ID NO: 12222 - RNA, 22 nt, Human
auuaauauugguucauuagcug

SEQ ID NO: 12223 - RNA, 22 nt, Human
auuaaugaaacuuugguuaagc

SEQ ID NO: 12224 - RNA, 22 nt, Human
auuaauguguagccaacuuaau

SEQ ID NO: 12225 - RNA, 22 nt, Human
auuaauugggaacuuguugaaa

SEQ ID NO: 12226 - RNA, 22 nt, Human
auuaauuuccaggcacugugcu

SEQ ID NO: 12227 - RNA, 22 nt, Human
auuaauuuuucugacagccaca

SEQ ID NO: 12228 - RNA, 22 nt, Human
auuacaacuaugugcucugcaa

SEQ ID NO: 12229 - RNA, 22 nt, Human
auuacaaguagacuaacuuuca

SEQ ID NO: 12230 - RNA, 22 nt, Human
auuacacacucaaguccuguua

SEQ ID NO: 12231 - RNA, 22 nt, Human
auuacacauagacauucguuca

SEQ ID NO: 12232 - RNA, 22 nt, Human
auuacacuaaugugacaacaau

SEQ ID NO: 12233 - RNA, 22 nt, Human
auuacacuuguucaucaucacc

SEQ ID NO: 12234 - RNA, 22 nt, Human
auuacagaaagcaauauugagu

SEQ ID NO: 12235 - RNA, 22 nt, Human
auuacagaaugcaguuccuuau

SEQ ID NO: 12236 - RNA, 21 nt, Human
auuacagcaguggccaaaugc

SEQ ID NO: 12237 - RNA, 22 nt, Human
auuacaguaacagcuacaaugc

SEQ ID NO: 12238 - RNA, 22 nt, Human
auuacaguucugcagguaguuu

SEQ ID NO: 12239 - RNA, 22 nt, Human
auuacaucaguugacaugugag

SEQ ID NO: 12240 - RNA, 22 nt, Human
auuaccacuuaaucaacauaug

SEQ ID NO: 12241 - RNA, 22 nt, Human
auuacccaggguaggaauuccu

SEQ ID NO: 12242 - RNA, 22 nt, Human
auuacccagucugugguauucu

SEQ ID NO: 12243 - RNA, 22 nt, Human
auuacucugucugccucugacc

SEQ ID NO: 12244 - RNA, 22 nt, Human
auuagaaaaacucaagggcucu

SEQ ID NO: 12245 - RNA, 22 nt, Human
auuagaaaccaagaggcaggcu

SEQ ID NO: 12246 - RNA, 22 nt, Human
auuagaagauagugauuucugc

SEQ ID NO: 12247 - RNA, 22 nt, Human
auuagaaugacagaaaugaggc

SEQ ID NO: 12248 - RNA, 22 nt, Human
auuagaauuaugcuugcuaaug

SEQ ID NO: 12249 - RNA, 22 nt, Human
auuagacaucauaugauucagc

SEQ ID NO: 12250 - RNA, 22 nt, Human
auuagagguacaaaccuucacu

SEQ ID NO: 12251 - RNA, 22 nt, Human
auuagcaagguucaugagaaga

SEQ ID NO: 12252 - RNA, 19 nt, Human
auuagcagacuuccuuuca

SEQ ID NO: 12253 - RNA, 22 nt, Human
auuagcagugccuugccugucu

SEQ ID NO: 12254 - RNA, 22 nt, Human
auuagcaugccaagcuuuuaga

SEQ ID NO: 12255 - RNA, 19 nt, Human
auuagcaugcuugaggaug

SEQ ID NO: 12256 - RNA, 22 nt, Human
auuagccuguugcauuuucacu

SEQ ID NO: 12257 - RNA, 22 nt, Human
auuagccuugguaagucuuuca

SEQ ID NO: 12258 - RNA, 22 nt, Human
auuagcuaggaaauuuuguguc

SEQ ID NO: 12259 - RNA, 22 nt, Human
auuagcugaccucuaaggagcc

SEQ ID NO: 12260 - RNA, 22 nt, Human
auuagcuuaucacacaagcugc

SEQ ID NO: 12261 - RNA, 22 nt, Human
auuagcuuauuguaaggugaaa

SEQ ID NO: 12262 - RNA, 22 nt, Human
auuagcuucaaagccaucaacc

SEQ ID NO: 12263 - RNA, 22 nt, Human
auuagcuucugaagcccuugaa

SEQ ID NO: 12264 - RNA, 22 nt, Human
auuagcuucugugcauggacuu

SEQ ID NO: 12265 - RNA, 20 nt, Human
auuagcuuggagacaguggc

SEQ ID NO: 12266 - RNA, 22 nt, Human
auuagcuuuggauucagaagau

SEQ ID NO: 12267 - RNA, 22 nt, Human
auuaggaaacugaaugucagaa

SEQ ID NO: 12268 - RNA, 22 nt, Human
auuaggaaguaaguaucacaag

SEQ ID NO: 12269 - RNA, 22 nt, Human
auuaggacacauacauguacag

SEQ ID NO: 12270 - RNA, 22 nt, Human
auuaggauuuuguccaaguagc

SEQ ID NO: 12271 - RNA, 22 nt, Human
auuaggcagacaacguagccgg

SEQ ID NO: 12272 - RNA, 22 nt, Human
auuaggcagggcaugguggcuc

SEQ ID NO: 12273 - RNA, 22 nt, Human
auuaggcauauaugcuuuuaau

SEQ ID NO: 12274 - RNA, 22 nt, Human
auuagggaaggauuuggccuga

SEQ ID NO: 12275 - RNA, 22 nt, Human
auuagguaagauaaagcagagg

SEQ ID NO: 12276 - RNA, 22 nt, Human
auuagguugugcuuuguggaca

SEQ ID NO: 12277 - RNA, 17 nt, Human
auuagguuuugucauga

SEQ ID NO: 12278 - RNA, 22 nt, Human
auuaguugaacaaguuaaguaa

SEQ ID NO: 12279 - RNA, 22 nt, Human
auuauagaggguuacaguuaau

SEQ ID NO: 12280 - RNA, 22 nt, Human
auuauagggaauucuagaaguc

SEQ ID NO: 12281 - RNA, 22 nt, Human
auuauccaacacccaguuacau

SEQ ID NO: 12282 - RNA, 22 nt, Human
auuaucuaggaauugacagaag

SEQ ID NO: 12283 - RNA, 22 nt, Human
auuaucucaagggauagcagau

SEQ ID NO: 12284 - RNA, 22 nt, Human
auuaugcuuaggaaaauaugaa

SEQ ID NO: 12285 - RNA, 22 nt, Human
auuauguagcuaaaaauugugu

SEQ ID NO: 12286 - RNA, 22 nt, Human
auuauguagguuaggugguugu

SEQ ID NO: 12287 - RNA, 22 nt, Human
auuauuaaagcuuaggucuuau

SEQ ID NO: 12288 - RNA, 22 nt, Human
auuauuagacuuauaugguagu

SEQ ID NO: 12289 - RNA, 22 nt, Human
auuauuagauucuuaauuguaa

SEQ ID NO: 12290 - RNA, 22 nt, Human
auuauuaggacuacugggguug

SEQ ID NO: 12291 - RNA, 20 nt, Human
auuauucauacaugugugac

SEQ ID NO: 12292 - RNA, 22 nt, Human
auuauucuuaaugcagggauua

SEQ ID NO: 12293 - RNA, 22 nt, Human
auuauucuuaugucaucauggc

SEQ ID NO: 12294 - RNA, 22 nt, Human
auuauugcaagcagugaaggga

SEQ ID NO: 12295 - RNA, 22 nt, Human
auuauugcaauuugacauucag

SEQ ID NO: 12296 - RNA, 22 nt, Human
auuauugccagcuauuacaaca

SEQ ID NO: 12297 - RNA, 22 nt, Human
auuauuggacacuucuucugca

SEQ ID NO: 12298 - RNA, 22 nt, Human
auuauuguacuuucaauaaggu

SEQ ID NO: 12299 - RNA, 22 nt, Human
auuauuguuagugacaggguga

SEQ ID NO: 12300 - RNA, 22 nt, Human
auguguauacuugugcuuacuc

SEQ ID NO: 12301 - RNA, 22 nt, Human
auguguauccaucugucuauuu

SEQ ID NO: 12302 - RNA, 22 nt, Human
auguguauuaguuaguuuaaug

SEQ ID NO: 12303 - RNA, 22 nt, Human
auguguauuuccaucgaucagc

SEQ ID NO: 12304 - RNA, 22 nt, Human
auguguccucuggcagguuuag

SEQ ID NO: 12305 - RNA, 22 nt, Human
auguguccugcugugucacaca

SEQ ID NO: 12306 - RNA, 22 nt, Human
auguguccuuauaagaagaaga

SEQ ID NO: 12307 - RNA, 22 nt, Human
auguguccuuguucccauucca

SEQ ID NO: 12308 - RNA, 22 nt, Human
augugucuaauuccaggagcac

SEQ ID NO: 12309 - RNA, 22 nt, Human
augugucuagauugcuguaccg

SEQ ID NO: 12310 - RNA, 22 nt, Human
augugucucuaaaauuuaguaa

SEQ ID NO: 12311 - RNA, 22 nt, Human
augugucugauggcccugaauu

SEQ ID NO: 12312 - RNA, 22 nt, Human
augugucugguuauugacaugc

SEQ ID NO: 12313 - RNA, 20 nt, Human
augugucuguaaacaacucu

SEQ ID NO: 12314 - RNA, 22 nt, Human
augugucuucuaagccaagccu

SEQ ID NO: 12315 - RNA, 22 nt, Human
augugucuucuguggguuugaa

SEQ ID NO: 12316 - RNA, 22 nt, Human
auuuuacuuaguguaaugucca

SEQ ID NO: 12317 - RNA, 22 nt, Human
auuuuagcaaaugcaagaugga

SEQ ID NO: 12318 - RNA, 22 nt, Human
auuuuaguaccucaaguaucca

SEQ ID NO: 12319 - RNA, 22 nt, Human
auuuuaguuuuagcauccaugc

SEQ ID NO: 12320 - RNA, 22 nt, Human
auuuucaagggagaggccucug

SEQ ID NO: 12321 - RNA, 22 nt, Human
auuuucaguugaaaaaguuggu

SEQ ID NO: 12322 - RNA, 22 nt, Human
auuuucaucauggguuuaacau

SEQ ID NO: 12323 - RNA, 22 nt, Human
auuuucaucgcuagguuggccu

SEQ ID NO: 12324 - RNA, 21 nt, Human
auuuucauuuccaggggagga

SEQ ID NO: 12325 - RNA, 22 nt, Human
auuuuccuccaugugagcaguu

SEQ ID NO: 12326 - RNA, 22 nt, Human
auuuucuaagccugucagacuu

SEQ ID NO: 12327 - RNA, 22 nt, Human
auuuucuauguuguaauuguua

SEQ ID NO: 12328 - RNA, 21 nt, Human
auuuucucuggaugaugguca

SEQ ID NO: 12329 - RNA, 22 nt, Human
auuuucuucucucccuggcugc

SEQ ID NO: 12330 - RNA, 22 nt, Human
auuuugaaaccaaguuauuucc

SEQ ID NO: 12331 - RNA, 22 nt, Human
auuuugaaauacuugaaggaaa

SEQ ID NO: 12332 - RNA, 18 nt, Human
auuuugaacaaugcugua

SEQ ID NO: 12333 - RNA, 22 nt, Human
auuuugacauugcggcauugcu

SEQ ID NO: 12334 - RNA, 22 nt, Human
auuuugauaaucauguuagaga

SEQ ID NO: 12335 - RNA, 22 nt, Human
auuuugauguaucuuuguagcu

SEQ ID NO: 12336 - RNA, 22 nt, Human
auuuugcuacaguugguggaaa

SEQ ID NO: 12337 - RNA, 22 nt, Human
auuuugcuggucugaauuacuu

SEQ ID NO: 12338 - RNA, 22 nt, Human
auuuugcuuuauguaaauaugu

SEQ ID NO: 12339 - RNA, 22 nt, Human
auuuuguuaaugucaccgugcu

SEQ ID NO: 12340 - RNA, 22 nt, Human
auuuguaauuucuuaucugugu

SEQ ID NO: 12341 - RNA, 22 nt, Human
auuuguaccauacuguuuauua

SEQ ID NO: 12342 - RNA, 22 nt, Human
auuuguaccaucugguauacag

SEQ ID NO: 12343 - RNA, 22 nt, Human
auuuguacucaggaauucugcu

SEQ ID NO: 12344 - RNA, 22 nt, Human
auuugucaaaacacagagaaca

SEQ ID NO: 12345 - RNA, 22 nt, Human
auuugucaacaggcauuuaggu

SEQ ID NO: 12346 - RNA, 22 nt, Human
auuugucacugagagaguuaga

SEQ ID NO: 12347 - RNA, 22 nt, Human
auuugucaguggaagugauuca

SEQ ID NO: 12348 - RNA, 22 nt, Human
auuugucauauauaauacucuu

SEQ ID NO: 12349 - RNA, 22 nt, Human
auuugucucugcacuuuacuca

SEQ ID NO: 12350 - RNA, 22 nt, Human
auuugucugcuugcugccuucc

SEQ ID NO: 12351 - RNA, 22 nt, Human
auuugucuuugagugcccugcu

SEQ ID NO: 12352 - RNA, 22 nt, Human
auuugugauaauuuguuacagc

SEQ ID NO: 12353 - RNA, 22 nt, Human
auuugugccaaauuauuucuaa

SEQ ID NO: 12354 - RNA, 22 nt, Human
auuuguuccacacauauuuacu

SEQ ID NO: 12355 - RNA, 22 nt, Human
auuuguucuucaugauccuguc

SEQ ID NO: 12356 - RNA, 20 nt, Human
auuuguuucuacucucugac

SEQ ID NO: 12357 - RNA, 22 nt, Human
auuuuaaggcuuauuuaaaggc

SEQ ID NO: 12358 - RNA, 22 nt, Human
auuuuaauaagauccauuuggu

SEQ ID NO: 12359 - RNA, 22 nt, Human
auuuuacauaaggaagguuuaa

SEQ ID NO: 12360 - RNA, 22 nt, Human
auuuuacuucauuugaaaugcc

SEQ ID NO: 12361 - RNA, 22 nt, Human
auuuuagcaguucucuaauuuc

SEQ ID NO: 12362 - RNA, 22 nt, Human
auuuucagaacauucauucacu

SEQ ID NO: 12363 - RNA, 22 nt, Human
auuuucagcccccacucguggc

SEQ ID NO: 12364 - RNA, 22 nt, Human
auuuuccagccuuucuagaacu

SEQ ID NO: 12365 - RNA, 22 nt, Human
auuuuccucaagccucuggaag

SEQ ID NO: 12366 - RNA, 22 nt, Human
auuuuccuucuaagaggaaggu

SEQ ID NO: 12367 - RNA, 22 nt, Human
auuuuccuuguggguuagcgaa

SEQ ID NO: 12368 - RNA, 22 nt, Human
auuuucugagcacgugacagca

SEQ ID NO: 12369 - RNA, 22 nt, Human
auuuucugguugagguuuaaca

SEQ ID NO: 12370 - RNA, 21 nt, Human
auuuucugugauagcugucuc

SEQ ID NO: 12371 - RNA, 18 nt, Human
auuuugaacugggaauau

SEQ ID NO: 12372 - RNA, 22 nt, Human
auuuugaagggaauugaaguuc

SEQ ID NO: 12373 - RNA, 22 nt, Human
auuuugaaucaccuuggaagaa

SEQ ID NO: 12374 - RNA, 23 nt, Human
auuuugccucuuggcugcuuagg

SEQ ID NO: 12375 - RNA, 22 nt, Human
auuuugcugcuaugccuugcaa

SEQ ID NO: 12376 - RNA, 22 nt, Human
auuuugcugugguacauuagga

SEQ ID NO: 12377 - RNA, 21 nt, Human
auuuuguacauagaauuuguc

SEQ ID NO: 12378 - RNA, 22 nt, Human
auuuugugaacccucaagcaau

SEQ ID NO: 12379 - RNA, 22 nt, Human
auuuuguggcagaugcagaacc

SEQ ID NO: 12380 - RNA, 22 nt, Human
auuuuguggguucugcugaugu

SEQ ID NO: 12381 - RNA, 22 nt, Human
auuuuguuauagaacucuguga

SEQ ID NO: 12382 - RNA, 22 nt, Human
auuuuguuuccuuuggaguaga

SEQ ID NO: 12383 - RNA, 23 nt, Human
auuuuuagccucucugagcugag

SEQ ID NO: 12384 - RNA, 22 nt, Human
auuuuucucucacacuuaccag

SEQ ID NO: 12385 - RNA, 22 nt, Human
auuuuucucuuuccacugagau

SEQ ID NO: 12386 - RNA, 22 nt, Human
auuuuuguauccccagcuccug

SEQ ID NO: 12387 - RNA, 22 nt, Human
auuuuuuauauaccaagguggg

SEQ ID NO: 12388 - RNA, 22 nt, Human
auuuuuucuguaaacuggccuu

SEQ ID NO: 12389 - RNA, 23 nt, Human
auuuuuugucuuuguaacuagau

SEQ ID NO: 12390 - RNA, 22 nt, Human
auuuuuuguuaacucaggauag

SEQ ID NO: 12391 - RNA, 22 nt, Human
caaaacauucucugcagcaggg

SEQ ID NO: 12392 - RNA, 22 nt, Human
caaaacugucuagagagagaag

SEQ ID NO: 12393 - RNA, 22 nt, Human
caaaaguaauggcgguuuuuac

SEQ ID NO: 12394 - RNA, 22 nt, Human
caaaaguaauuaugguuuuugc

SEQ ID NO: 12395 - RNA, 22 nt, Human
caaaaguaauugugguuuuugc

SEQ ID NO: 12396 - RNA, 22 nt, Human
caaaaguucucacccagacaug

SEQ ID NO: 12397 - RNA, 22 nt, Human
caaaauagauguuaaccuggaa

SEQ ID NO: 12398 - RNA, 22 nt, Human
caaacaauuugcauuuccuuag

SEQ ID NO: 12399 - RNA, 22 nt, Human
caaacauagugaagcaaugaca

SEQ ID NO: 12400 - RNA, 22 nt, Human
caaacauucaaguacaagucuu

SEQ ID NO: 12401 - RNA, 22 nt, Human
caaacauuuugagugguuucug

SEQ ID NO: 12402 - RNA, 22 nt, Human
caaaccacacucagcguaucgg

SEQ ID NO: 12403 - RNA, 22 nt, Human
caaaccuuguaaaugccaaacu

SEQ ID NO: 12404 - RNA, 22 nt, Human
caaacuauuuacaauggaauca

SEQ ID NO: 12405 - RNA, 22 nt, Human
caaacugagcaucagaaaguuu

SEQ ID NO: 12406 - RNA, 22 nt, Human
caaacugcaacaugaagugucc

SEQ ID NO: 12407 - RNA, 22 nt, Human
caaacuuugcaaaacuuacagu

SEQ ID NO: 12408 - RNA, 22 nt, Human
caaagaauagugagaagaugua

SEQ ID NO: 12409 - RNA, 22 nt, Human
caaagaaucacucaucuuuagc

SEQ ID NO: 12410 - RNA, 22 nt, Human
caaagacacgggaaacaacguu

SEQ ID NO: 12411 - RNA, 22 nt, Human
caaagaggugagaggagccuuu

SEQ ID NO: 12412 - RNA, 23 nt, Human
caaagaugauuggaacauggcuu

SEQ ID NO: 12413 - RNA, 22 nt, Human
caaagcaagggcugaagacucc

SEQ ID NO: 12414 - RNA, 22 nt, Human
caaagcagacgcaguaagggua

SEQ ID NO: 12415 - RNA, 20 nt, Human
caaagcaguaggauaaaaau

SEQ ID NO: 12416 - RNA, 22 nt, Human
caaagccaggcuuucuaaugua

SEQ ID NO: 12417 - RNA, 22 nt, Human
caaagcguccugccuccauuug

SEQ ID NO: 12418 - RNA, 22 nt, Human
caaagcuauaaauucagacaga

SEQ ID NO: 12419 - RNA, 22 nt, Human
caaagcuggacugcucaguuca

SEQ ID NO: 12420 - RNA, 22 nt, Human
caaaggagguaaugggugugag

SEQ ID NO: 12421 - RNA, 22 nt, Human
caaaggcaggucauggccacuu

SEQ ID NO: 12422 - RNA, 22 nt, Human
caaaggcaguuacugaaugaag

SEQ ID NO: 12423 - RNA, 22 nt, Human
caaaggccugagaacugagggg

SEQ ID NO: 12424 - RNA, 22 nt, Human
caaaggcugguagaaugagcca

SEQ ID NO: 12425 - RNA, 22 nt, Human
ccaagggcgccuccguuccccc

SEQ ID NO: 12426 - RNA, 22 nt, Human
ccaagggcucugacuugccugc

SEQ ID NO: 12427 - RNA, 22 nt, Human
ccaaggggccuuuagacacuau

SEQ ID NO: 12428 - RNA, 22 nt, Human
ccaagguuagaaaagguacuuu

SEQ ID NO: 12429 - RNA, 22 nt, Human
ccaagguuuauuuugauacauu

SEQ ID NO: 12430 - RNA, 22 nt, Human
ccaaguacagauuccuccacug

SEQ ID NO: 12431 - RNA, 22 nt, Human
ccaaguacucucaccaaagcuu

SEQ ID NO: 12432 - RNA, 22 nt, Human
ccaaguccucuaccauuccugg

SEQ ID NO: 12433 - RNA, 22 nt, Human
ccaagugauacacccgccucgg

SEQ ID NO: 12434 - RNA, 22 nt, Human
ccaauacuuagauuaaaauagu

SEQ ID NO: 12435 - RNA, 20 nt, Human
ccaaugcaguaucucguucc

SEQ ID NO: 12436 - RNA, 15 nt, Human
ccaaugucagaugcu

SEQ ID NO: 12437 - RNA, 22 nt, Human
ccacaagaugcaaacucuaaca

SEQ ID NO: 12438 - RNA, 22 nt, Human
ccacaaggccuguggggcugcu

SEQ ID NO: 12439 - RNA, 22 nt, Human
ccacaaguuucagcacccagag

SEQ ID NO: 12440 - RNA, 19 nt, Human
ccacacagugugcaauuua

SEQ ID NO: 12441 - RNA, 22 nt, Human
ccacacugaccagcugugagac

SEQ ID NO: 12442 - RNA, 22 nt, Human
ccacagaaccucagcuuugagc

SEQ ID NO: 12443 - RNA, 22 nt, Human
ccacagaagauggggagagugg

SEQ ID NO: 12444 - RNA, 22 nt, Human
ccacagagacaggguccuugcu

SEQ ID NO: 12445 - RNA, 19 nt, Human
ccacagagacuagaagaca

SEQ ID NO: 12446 - RNA, 22 nt, Human
ccacagagacucugcaggacug

SEQ ID NO: 12447 - RNA, 23 nt, Human
ccacagagcugccaauuccugug

SEQ ID NO: 12448 - RNA, 20 nt, Human
ccacagaggacagggcugug

SEQ ID NO: 12449 - RNA, 22 nt, Human
ccacagaguccgcauuugaggc

SEQ ID NO: 12450 - RNA, 22 nt, Human
ccacagcaccugcagccaguug

SEQ ID NO: 12451 - RNA, 19 nt, Human
ccacagccugcugucuucc

SEQ ID NO: 12452 - RNA, 22 nt, Human
ccacagcuagggcaaucugauu

SEQ ID NO: 12453 - RNA, 22 nt, Human
auuuuccuagucaugugcuucu

SEQ ID NO: 12454 - RNA, 22 nt, Human
auuuuccucugguuuccccaga

SEQ ID NO: 12455 - RNA, 22 nt, Human
auuuucucacaauccuaugggg

SEQ ID NO: 12456 - RNA, 22 nt, Human
auuuucucucaaaccuuaaaau

SEQ ID NO: 12457 - RNA, 22 nt, Human
auuuucuguaacuauuucuaua

SEQ ID NO: 12458 - RNA, 22 nt, Human
auuuucugugugcagauaaaua

SEQ ID NO: 12459 - RNA, 22 nt, Human
auuuugaaaagcauuugaguaa

SEQ ID NO: 12460 - RNA, 22 nt, Human
auuuugacugcauuacagaaca

SEQ ID NO: 12461 - RNA, 22 nt, Human
auuuuguugagguaauugucaa

SEQ ID NO: 12462 - RNA, 22 nt, Human
auuuuuaugacaaaccauccuc

SEQ ID NO: 12463 - RNA, 22 nt, Human
auuuuuccugcuggaucugcuc

SEQ ID NO: 12464 - RNA, 22 nt, Human
auuuuugcccugcaguacauaa

SEQ ID NO: 12465 - RNA, 22 nt, Human
auuuuuuagaaccuggccugau

SEQ ID NO: 12466 - RNA, 22 nt, Human
auuuuuuagccaagacucugca

SEQ ID NO: 12467 - RNA, 22 nt, Human
caaaaaacacagaugucugugu

SEQ ID NO: 12468 - RNA, 22 nt, Human
caaaaaacaccugugugaguau

SEQ ID NO: 12469 - RNA, 22 nt, Human
caaaaccuaaacagacugucca

SEQ ID NO: 12470 - RNA, 21 nt, Human
caaaagagacugauucuugga

SEQ ID NO: 12471 - RNA, 20 nt, Human
caaaagcaaugaaguuauga

SEQ ID NO: 12472 - RNA, 22 nt, Human
caaaagcagcaaguuuauaugu

SEQ ID NO: 12473 - RNA, 21 nt, Human
caaaaggauaggaaauuaggg

SEQ ID NO: 12474 - RNA, 22 nt, Human
caaaagggaguucucuggaagg

SEQ ID NO: 12475 - RNA, 22 nt, Human
caaaaguaauugcgguuuuugc

SEQ ID NO: 12476 - RNA, 22 nt, Human
caaaaugcaucugagaccaggc

SEQ ID NO: 12477 - RNA, 22 nt, Human
caaaauugauuguggugauggu

SEQ ID NO: 12478 - RNA, 22 nt, Human
caaacaucugcaccuugaccgg

SEQ ID NO: 12479 - RNA, 22 nt, Human
caaacauugggggcuucaacac

SEQ ID NO: 12480 - RNA, 22 nt, Human
caaacauuugacuucucucagg

SEQ ID NO: 12481 - RNA, 22 nt, Human
caaacauuuguuggaaccccug

SEQ ID NO: 12482 - RNA, 22 nt, Human
caaacauuuuaaauaagggaua

SEQ ID NO: 12483 - RNA, 22 nt, Human
caaacauuuucuacuuccagga

SEQ ID NO: 12484 - RNA, 22 nt, Human
caaaccaguaggaagucuauua

SEQ ID NO: 12485 - RNA, 22 nt, Human
caaaccugacuggggaugggcg

SEQ ID NO: 12486 - RNA, 23 nt, Human
caaaccuguuucucucaccuguc

SEQ ID NO: 12487 - RNA, 22 nt, Human
caaaccuuguuccagucaacuc

SEQ ID NO: 12488 - RNA, 22 nt, Human
caaacucuguaggacaguucaa

SEQ ID NO: 12489 - RNA, 22 nt, Human
caaacugaacacgaaagucuuu

SEQ ID NO: 12490 - RNA, 22 nt, Human
caaacugccaaugguuuuuaua

SEQ ID NO: 12491 - RNA, 22 nt, Human
caaacuggcuaugggaaucuug

SEQ ID NO: 12492 - RNA, 22 nt, Human
caaacuuacguagucuuacuac

SEQ ID NO: 12493 - RNA, 22 nt, Human
caaacuuacuguguuuaaagag

SEQ ID NO: 12494 - RNA, 22 nt, Human
caaacuuuuccuggaaaagauu

SEQ ID NO: 12495 - RNA, 22 nt, Human
caaacuuuugaggaguucagga

SEQ ID NO: 12496 - RNA, 22 nt, Human
caaagaagagauuuacagagcu

SEQ ID NO: 12497 - RNA, 22 nt, Human
caaagaaugagugaguacauaa

SEQ ID NO: 12498 - RNA, 22 nt, Human
caaagaguuuuuucauauaaug

SEQ ID NO: 12499 - RNA, 22 nt, Human
caaagauaugacauggaaaaug

SEQ ID NO: 12500 - RNA, 22 nt, Human
caaagaugcugauguuggauca

SEQ ID NO: 12501 - RNA, 22 nt, Human
caaagauuuuagaauuugcaau

SEQ ID NO: 12502 - RNA, 22 nt, Human
caaagcagaagguucuguggua

SEQ ID NO: 12503 - RNA, 22 nt, Human
caaagcagaccuuuacccuuua

SEQ ID NO: 12504 - RNA, 22 nt, Human
caaagcagagaacugucucauu

SEQ ID NO: 12505 - RNA, 22 nt, Human
caaagcagagccagagcuuguc

SEQ ID NO: 12506 - RNA, 22 nt, Human
caaagcaggcuugucaaauugc

SEQ ID NO: 12507 - RNA, 21 nt, Human
caaagccaggcaacucucucc

SEQ ID NO: 12508 - RNA, 22 nt, Human
caaagcucaugcucuuagccau

SEQ ID NO: 12509 - RNA, 22 nt, Human
caaaggaagcuccuugauggcg

SEQ ID NO: 12510 - RNA, 22 nt, Human
caaaggacccauaauuaaaacc

SEQ ID NO: 12511 - RNA, 22 nt, Human
caaaggcaacauauacuuguuu

SEQ ID NO: 12512 - RNA, 22 nt, Human
caaaggcaaucuuguucucugg

SEQ ID NO: 12513 - RNA, 22 nt, Human
caaaggcacacauaccuuucug

SEQ ID NO: 12514 - RNA, 22 nt, Human
caaaggcaucggcaauuaggga

SEQ ID NO: 12515 - RNA, 22 nt, Human
caaaggcuuccacugcauccuu

SEQ ID NO: 12516 - RNA, 22 nt, Human
caaagggcauggccugagcacu

SEQ ID NO: 12517 - RNA, 22 nt, Human
caaagggcggcugucggagggu

SEQ ID NO: 12518 - RNA, 22 nt, Human
caaagguaaagaucugcugugg

SEQ ID NO: 12519 - RNA, 22 nt, Human
caaagguaguauauauauuguu

SEQ ID NO: 12520 - RNA, 22 nt, Human
caaagguuggaaauguuuacca

SEQ ID NO: 12521 - RNA, 22 nt, Human
caaaguaacugccuuuccaauu

SEQ ID NO: 12522 - RNA, 22 nt, Human
caaaguauaguguaggauggca

SEQ ID NO: 12523 - RNA, 22 nt, Human
caaaguauauuggauugaaugg

SEQ ID NO: 12524 - RNA, 22 nt, Human
caaagucagccagcuaguaggu

SEQ ID NO: 12525 - RNA, 22 nt, Human
caaagucccagcugcuuagaga

SEQ ID NO: 12526 - RNA, 22 nt, Human
caaaguggcuggccgggagauc

SEQ ID NO: 12527 - RNA, 22 nt, Human
caaagugggugcccugaugcuc

SEQ ID NO: 12528 - RNA, 22 nt, Human
caaaguuaucaacugcaacauu

SEQ ID NO: 12529 - RNA, 22 nt, Human
caaauacuacgauucuugcagu

SEQ ID NO: 12530 - RNA, 22 nt, Human
caaauacuggguaaguuaauuu

SEQ ID NO: 12531 - RNA, 21 nt, Human
caaauagacauggcuagagga

SEQ ID NO: 12532 - RNA, 22 nt, Human
caaauagacuucaaucucuuga

SEQ ID NO: 12533 - RNA, 18 nt, Human
caaauagcaugauguccu

SEQ ID NO: 12534 - RNA, 22 nt, Human
cacugcaguuccccagugcgca

SEQ ID NO: 12535 - RNA, 22 nt, Human
cacugcccaccaaguggcuggu

SEQ ID NO: 12536 - RNA, 22 nt, Human
cacugcccuggggguugccauc

SEQ ID NO: 12537 - RNA, 22 nt, Human
cacugccuccccaggcuccaca

SEQ ID NO: 12538 - RNA, 22 nt, Human
cacugccuggaaggagagacau

SEQ ID NO: 12539 - RNA, 22 nt, Human
cacugccuucaccugcccuauc

SEQ ID NO: 12540 - RNA, 22 nt, Human
cacugcuucagucagagaaauu

SEQ ID NO: 12541 - RNA, 22 nt, Human
cacugcuugcaguaugagugga

SEQ ID NO: 12542 - RNA, 22 nt, Human
cacugcuuuucagacaguuauu

SEQ ID NO: 12543 - RNA, 22 nt, Human
cacugcuuuuucuccucacugg

SEQ ID NO: 12544 - RNA, 21 nt, Human
cacuggaauuuucugugacau

SEQ ID NO: 12545 - RNA, 22 nt, Human
cacuggauuuccaggaauacuc

SEQ ID NO: 12546 - RNA, 22 nt, Human
cacuggcaucuaagggugguag

SEQ ID NO: 12547 - RNA, 22 nt, Human
cacuggccuaagcgccucagcc

SEQ ID NO: 12548 - RNA, 22 nt, Human
cacuggggaaaacaggcuucuu

SEQ ID NO: 12549 - RNA, 22 nt, Human
cacuggggugggccugguagag

SEQ ID NO: 12550 - RNA, 22 nt, Human
cacugguacguagguuggggca

SEQ ID NO: 12551 - RNA, 21 nt, Human
cacugguagauggcccgcagg

SEQ ID NO: 12552 - RNA, 22 nt, Human
cacugguagcaguuaaguuagg

SEQ ID NO: 12553 - RNA, 22 nt, Human
cacugguaguuucagcaaccag

SEQ ID NO: 12554 - RNA, 22 nt, Human
cacugguguacaggagguaaaa

SEQ ID NO: 12555 - RNA, 22 nt, Human
cacuguaaagcgucacagggac

SEQ ID NO: 12556 - RNA, 21 nt, Human
cacuguauagcaggagaaaac

SEQ ID NO: 12557 - RNA, 22 nt, Human
cacuguaucuuuuccaaagucu

SEQ ID NO: 12558 - RNA, 22 nt, Human
cacuguauuauuaggaaugaca

SEQ ID NO: 12559 - RNA, 22 nt, Human
cacugucuauuaauauaacuua

SEQ ID NO: 12560 - RNA, 22 nt, Human
cacugucugcuucgacucuuca

SEQ ID NO: 12561 - RNA, 22 nt, Human
cacugucugggacauguggucu

SEQ ID NO: 12562 - RNA, 22 nt, Human
cacugucuucaguuucacugca

SEQ ID NO: 12563 - RNA, 22 nt, Human
cacuguggauacagaaauuagu

SEQ ID NO: 12564 - RNA, 22 nt, Human
cacugugggguuuggcuggaac

SEQ ID NO: 12565 - RNA, 22 nt, Human
cacugugggucccagacuggag

SEQ ID NO: 12566 - RNA, 22 nt, Human
cacugugguuauuaucacuguu

SEQ ID NO: 12567 - RNA, 22 nt, Human
cacuguuauuacuacuauacau

SEQ ID NO: 12568 - RNA, 22 nt, Human
cacuuaaaacuccuggaauugu

SEQ ID NO: 12569 - RNA, 22 nt, Human
cacuuaaaucuguugagaaaaa

SEQ ID NO: 12570 - RNA, 22 nt, Human
cacuuagagccagaugcauagu

SEQ ID NO: 12571 - RNA, 22 nt, Human
cacuuagauacuagaucacaaa

SEQ ID NO: 12572 - RNA, 22 nt, Human
cacuucaaauauggcuucauga

SEQ ID NO: 12573 - RNA, 22 nt, Human
cacuucaccacuaggcuauacu

SEQ ID NO: 12574 - RNA, 22 nt, Human
cacuucauugggaccagggcug

SEQ ID NO: 12575 - RNA, 23 nt, Human
cacuuccccuguggcgagccugc

SEQ ID NO: 12576 - RNA, 22 nt, Human
cacuugaagugaauugcucacc

SEQ ID NO: 12577 - RNA, 22 nt, Human
cacuugcagacuuugccugguu

SEQ ID NO: 12578 - RNA, 22 nt, Human
cacuuggaggcccccugugccc

SEQ ID NO: 12579 - RNA, 22 nt, Human
cacuuguagaggcauuauucca

SEQ ID NO: 12580 - RNA, 22 nt, Human
cacuuguugguggugaaaucac

SEQ ID NO: 12581 - RNA, 22 nt, Human
cacuuuaacucacauuucagcu

SEQ ID NO: 12582 - RNA, 22 nt, Human
cacuuuacccuuguuacucaug

SEQ ID NO: 12583 - RNA, 22 nt, Human
cacuuuauuauaaauuugagag

SEQ ID NO: 12584 - RNA, 22 nt, Human
cacuuucaaguuucagaggaua

SEQ ID NO: 12585 - RNA, 22 nt, Human
cacuuugugugggaucaggggu

SEQ ID NO: 12586 - RNA, 22 nt, Human
cacuuuguuuauugugcaguua

SEQ ID NO: 12587 - RNA, 22 nt, Human
cagaaaauaaacauuuguggaa

SEQ ID NO: 12588 - RNA, 22 nt, Human
cagaaaauaaaguuucuacgca

SEQ ID NO: 12589 - RNA, 22 nt, Human
cagaaacacuguauuuagggaa

SEQ ID NO: 12590 - RNA, 22 nt, Human
cagaaacaggcaacgugugcac

SEQ ID NO: 12591 - RNA, 22 nt, Human
cagaaacauguauaaaguugua

SEQ ID NO: 12592 - RNA, 22 nt, Human
cagaaaccugucuggaguggga

SEQ ID NO: 12593 - RNA, 22 nt, Human
cagaaacuagauuuagacacaa

SEQ ID NO: 12594 - RNA, 21 nt, Human
cagaaacuugcuuugccuucu

SEQ ID NO: 12595 - RNA, 20 nt, Human
cagaaagaagguagauuuuu

SEQ ID NO: 12596 - RNA, 22 nt, Human
cagaaagcaguugucaaugggc

SEQ ID NO: 12597 - RNA, 20 nt, Human
cagaaagcauguuccagggc

SEQ ID NO: 12598 - RNA, 22 nt, Human
cagaaagccaacuccaacuguc

SEQ ID NO: 12599 - RNA, 22 nt, Human
cagaaagccgacuuacaaugga

SEQ ID NO: 12600 - RNA, 22 nt, Human
cagaaagguaugugugccuuug

SEQ ID NO: 12601 - RNA, 22 nt, Human
cagaaauacccagcauuuggag

SEQ ID NO: 12602 - RNA, 21 nt, Human
cagaaauaugaaugaugguga

SEQ ID NO: 12603 - RNA, 23 nt, Human
cagaaaucugaaaucuagaaaug

SEQ ID NO: 12604 - RNA, 22 nt, Human
cacuguuuggcuccuguacuua

SEQ ID NO: 12605 - RNA, 22 nt, Human
cacuuaaagucuuagcuuacag

SEQ ID NO: 12606 - RNA, 22 nt, Human
cacuuagucucaccaguucagu

SEQ ID NO: 12607 - RNA, 22 nt, Human
cacuuaucucauuuaaucacca

SEQ ID NO: 12608 - RNA, 22 nt, Human
cacuuauuaugggcuaggaacu

SEQ ID NO: 12609 - RNA, 22 nt, Human
cacuucaauuaacuucagcauu

SEQ ID NO: 12610 - RNA, 22 nt, Human
cacuucucugauaaucucaguu

SEQ ID NO: 12611 - RNA, 22 nt, Human
cacuugaaaaucagaggaaauu

SEQ ID NO: 12612 - RNA, 22 nt, Human
cacuugaaaguaaugguugugc

SEQ ID NO: 12613 - RNA, 22 nt, Human
cacuugaaugaaagagacuccu

SEQ ID NO: 12614 - RNA, 22 nt, Human
cacuugaaugagaauuuccugg

SEQ ID NO: 12615 - RNA, 22 nt, Human
cacuugaguucuuaauagucag

SEQ ID NO: 12616 - RNA, 22 nt, Human
cacuugauguugucacuauugc

SEQ ID NO: 12617 - RNA, 22 nt, Human
cacuugcuggaugguggcucag

SEQ ID NO: 12618 - RNA, 22 nt, Human
cacuuggaggaaggccuauuca

SEQ ID NO: 12619 - RNA, 22 nt, Human
cacuugggacaaagcuucugcu

SEQ ID NO: 12620 - RNA, 22 nt, Human
cacuugguuugggaguacauaa

SEQ ID NO: 12621 - RNA, 22 nt, Human
cacuuuacuaucuauaaaauaa

SEQ ID NO: 12622 - RNA, 22 nt, Human
cacuuuauaugcauuaccucau

SEQ ID NO: 12623 - RNA, 22 nt, Human
cacuuucuguguugugcaaaaa

SEQ ID NO: 12624 - RNA, 22 nt, Human
cacuuuuaacaggagaauuccc

SEQ ID NO: 12625 - RNA, 22 nt, Human
cagaaaacaaaccuauccugag

SEQ ID NO: 12626 - RNA, 23 nt, Human
cagaaaacccagagcucaguccc

SEQ ID NO: 12627 - RNA, 22 nt, Human
cagaaaaggaagagcuauguaa

SEQ ID NO: 12628 - RNA, 22 nt, Human
cagaaaauagaguuucucugag

SEQ ID NO: 12629 - RNA, 22 nt, Human
cagaaacacuuguagagaaguu

SEQ ID NO: 12630 - RNA, 22 nt, Human
cagaaacagagaaauauuggcu

SEQ ID NO: 12631 - RNA, 22 nt, Human
cagaaacuauguaagaaaguga

SEQ ID NO: 12632 - RNA, 22 nt, Human
cagaaacugcuuguggucaucu

SEQ ID NO: 12633 - RNA, 22 nt, Human
cagaaacuguuuguuaauauuu

SEQ ID NO: 12634 - RNA, 22 nt, Human
cagaaacuucuggugucaaaua

SEQ ID NO: 12635 - RNA, 22 nt, Human
cagaaacuuucuuuacugagca

SEQ ID NO: 12636 - RNA, 22 nt, Human
cagaaacuuuugaugaguguau

SEQ ID NO: 12637 - RNA, 22 nt, Human
cagaaagaccugauuggcaguu

SEQ ID NO: 12638 - RNA, 22 nt, Human
cagaaagcaagccauucacugu

SEQ ID NO: 12639 - RNA, 22 nt, Human
cagaaagugauuugcuauucca

SEQ ID NO: 12640 - RNA, 22 nt, Human
cagaaauaaacuucucacaucg

SEQ ID NO: 12641 - RNA, 22 nt, Human
cagaaauaucaccuggacucua

SEQ ID NO: 12642 - RNA, 22 nt, Human
cagaaauauuccaaguacugca

SEQ ID NO: 12643 - RNA, 22 nt, Human
ccccacaacucauguugaaacu

SEQ ID NO: 12644 - RNA, 22 nt, Human
ccccacagccgccagcagggag

SEQ ID NO: 12645 - RNA, 22 nt, Human
ccccacccucgcuccauuucgg

SEQ ID NO: 12646 - RNA, 22 nt, Human
ccccaccuugcaauuguucccu

SEQ ID NO: 12647 - RNA, 22 nt, Human
ccccacuugcucagcaugucca

SEQ ID NO: 12648 - RNA, 22 nt, Human
ccccagagugagggauugagug

SEQ ID NO: 12649 - RNA, 22 nt, Human
ccccagcagcaccuggggcagu

SEQ ID NO: 12650 - RNA, 22 nt, Human
ccccagcaggaauacagggguc

SEQ ID NO: 12651 - RNA, 22 nt, Human
ccccagccuuccaugggaauug

SEQ ID NO: 12652 - RNA, 22 nt, Human
ccccaggacacauggaccaagu

SEQ ID NO: 12653 - RNA, 22 nt, Human
ccccaggacguggcccucauag

SEQ ID NO: 12654 - RNA, 16 nt, Human
ccccaggacuuggcac

SEQ ID NO: 12655 - RNA, 22 nt, Human
ccccaggagauuugggagcaca

SEQ ID NO: 12656 - RNA, 22 nt, Human
ccccaggcagggccuaacagag

SEQ ID NO: 12657 - RNA, 19 nt, Human
ccccaggguaggcuagggg

SEQ ID NO: 12658 - RNA, 22 nt, Human
ccccauccuauucauguuucug

SEQ ID NO: 12659 - RNA, 22 nt, Human
ccccaugcugggaucugacacc

SEQ ID NO: 12660 - RNA, 22 nt, Human
ccccauucuggccagcccagcu

SEQ ID NO: 12661 - RNA, 22 nt, Human
cccccaaggccaggcugagacc

SEQ ID NO: 12662 - RNA, 22 nt, Human
cccccacuaaguugagggcccu

SEQ ID NO: 12663 - RNA, 22 nt, Human
cccccagaugcgagccauagcc

SEQ ID NO: 12664 - RNA, 22 nt, Human
cccccugcgcccggcacgucau

SEQ ID NO: 12665 - RNA, 22 nt, Human
ccccucagguacccgugcagca

SEQ ID NO: 12666 - RNA, 21 nt, Human
ccccucauacacucuccuugc

SEQ ID NO: 12667 - RNA, 22 nt, Human
ccccucucccucacuuaucaau

SEQ ID NO: 12668 - RNA, 22 nt, Human
ccccucuggucaaccagucaca

SEQ ID NO: 12669 - RNA, 22 nt, Human
ccccucuuggcauugagugcca

SEQ ID NO: 12670 - RNA, 22 nt, Human
ccccugaagacaauggagaggu

SEQ ID NO: 12671 - RNA, 22 nt, Human
ccccugagauucuggcuuggga

SEQ ID NO: 12672 - RNA, 20 nt, Human
ccccuucaucuacagccuga

SEQ ID NO: 12673 - RNA, 22 nt, Human
ccccuuggcugcucucaagucc

SEQ ID NO: 12674 - RNA, 22 nt, Human
cccgaccucgcaaagcgcacuc

SEQ ID NO: 12675 - RNA, 22 nt, Human
cccgagugucuacucacuccca

SEQ ID NO: 12676 - RNA, 22 nt, Human
cccggaaacaggugacaaucuc

SEQ ID NO: 12677 - RNA, 22 nt, Human
cccggaaaggcgauuaucccuc

SEQ ID NO: 12678 - RNA, 18 nt, Human
cccggcuaauuuuuggua

SEQ ID NO: 12679 - RNA, 22 nt, Human
cccgggagguggagacugcagu

SEQ ID NO: 12680 - RNA, 22 nt, Human
cccgucccuuuugcccgcuggu

SEQ ID NO: 12681 - RNA, 21 nt, Human
cccguggagaaaaggaaugag

SEQ ID NO: 12682 - RNA, 22 nt, Human
cccuaagaaucucccuuguagc

SEQ ID NO: 12683 - RNA, 22 nt, Human
cccuaagcuuucgggcugagag

SEQ ID NO: 12684 - RNA, 22 nt, Human
cccuaggaauucuauggccaag

SEQ ID NO: 12685 - RNA, 22 nt, Human
cccuaggcugggcucuuggcuu

SEQ ID NO: 12686 - RNA, 22 nt, Human
cccucacuguccuugggcccuu

SEQ ID NO: 12687 - RNA, 22 nt, Human
cccucacuucacgcucugcaga

SEQ ID NO: 12688 - RNA, 22 nt, Human
cccucagcuucucccugcagcu

SEQ ID NO: 12689 - RNA, 21 nt, Human
cccucaggaaacagaaugcac

SEQ ID NO: 12690 - RNA, 22 nt, Human
cccucaggaugcaguggaagug

SEQ ID NO: 12691 - RNA, 19 nt, Human
cccucaggucugagcaguc

SEQ ID NO: 12692 - RNA, 22 nt, Human
cccucagucuggcugggaagac

SEQ ID NO: 12693 - RNA, 22 nt, Human
cccucauugccuccugcgugca

SEQ ID NO: 12694 - RNA, 22 nt, Human
cccuccacagacaggacuuguc

SEQ ID NO: 12695 - RNA, 22 nt, Human
cccuccagugucccagugggga

SEQ ID NO: 12696 - RNA, 22 nt, Human
cccucccaagcacucugacaua

SEQ ID NO: 12697 - RNA, 22 nt, Human
cccucccagaugggcuugaggu

SEQ ID NO: 12698 - RNA, 22 nt, Human
cccucccaggaguggccagaga

SEQ ID NO: 12699 - RNA, 22 nt, Human
cccucccuauguagaugauguu

SEQ ID NO: 12700 - RNA, 22 nt, Human
cccucccugugugccucauuug

SEQ ID NO: 12701 - RNA, 22 nt, Human
cccucccuuugcagcagugcau

SEQ ID NO: 12702 - RNA, 22 nt, Human
cccuccuggaggcggaugccca

SEQ ID NO: 12703 - RNA, 22 nt, Human
cccuccuuucuaggcuuccagc

SEQ ID NO: 12704 - RNA, 22 nt, Human
cccucuacagggaagcgcuuuc

SEQ ID NO: 12705 - RNA, 22 nt, Human
cccucucccugcagaauguggc

SEQ ID NO: 12706 - RNA, 18 nt, Human
cccucuccugcuaguggg

SEQ ID NO: 12707 - RNA, 22 nt, Human
cccucucucgguugcugugguu

SEQ ID NO: 12708 - RNA, 22 nt, Human
cccucucucuaucgggccccag

SEQ ID NO: 12709 - RNA, 22 nt, Human
cccucugagacagguagcucac

SEQ ID NO: 12710 - RNA, 22 nt, Human
cccucugccucugaguaggaca

SEQ ID NO: 12711 - RNA, 22 nt, Human
cccucugccugggaccaagucc

SEQ ID NO: 12712 - RNA, 20 nt, Human
cccucugcuacacugggagc

SEQ ID NO: 12713 - RNA, 22 nt, Human
cccucugcucaggugcauaggc

SEQ ID NO: 12714 - RNA, 20 nt, Human
cccugagacaaaggaggggc

SEQ ID NO: 12715 - RNA, 20 nt, Human
cccugagaccagagagcagc

SEQ ID NO: 12716 - RNA, 22 nt, Human
cccugagagguugagugucugc

SEQ ID NO: 12717 - RNA, 18 nt, Human
cccugagaugaugcugug

SEQ ID NO: 12718 - RNA, 22 nt, Human
cccugagcacaccuggcagaca

SEQ ID NO: 12719 - RNA, 22 nt, Human
cccugagcagucugcagagagc

SEQ ID NO: 12720 - RNA, 22 nt, Human
cccugagcauucaugugagcuu

SEQ ID NO: 12721 - RNA, 22 nt, Human
cccugaggagagcgcuucccga

SEQ ID NO: 12722 - RNA, 22 nt, Human
cagaaauggaauuuuccaucac

SEQ ID NO: 12723 - RNA, 22 nt, Human
cagaaauggagcccaggaaucu

SEQ ID NO: 12724 - RNA, 22 nt, Human
cagaaauguucuaaugauucag

SEQ ID NO: 12725 - RNA, 22 nt, Human
cagaaauguuuguuaauauugu

SEQ ID NO: 12726 - RNA, 22 nt, Human
cagaaauuggaauagagaaaua

SEQ ID NO: 12727 - RNA, 20 nt, Human
cagaaauuuguaaaagggau

SEQ ID NO: 12728 - RNA, 22 nt, Human
cagaacacauuuucagagucaa

SEQ ID NO: 12729 - RNA, 22 nt, Human
cagaacagagucaaaaguaugu

SEQ ID NO: 12730 - RNA, 19 nt, Human
cagaacagcugggaagaga

SEQ ID NO: 12731 - RNA, 22 nt, Human
cagaacaggucaugcuugcugu

SEQ ID NO: 12732 - RNA, 23 nt, Human
cagaacaguaaaagaugccaugg

SEQ ID NO: 12733 - RNA, 20 nt, Human
cagaacagucugagaggcca

SEQ ID NO: 12734 - RNA, 22 nt, Human
cagaaccugaacgugaggugga

SEQ ID NO: 12735 - RNA, 22 nt, Human
cagaaccugugaauguguuauc

SEQ ID NO: 12736 - RNA, 22 nt, Human
cagaaccuuggugguagggaca

SEQ ID NO: 12737 - RNA, 22 nt, Human
cagaacugggcucgcucugguu

SEQ ID NO: 12738 - RNA, 22 nt, Human
cagaagaauggugucugagcuc

SEQ ID NO: 12739 - RNA, 22 nt, Human
cagaagacagagcacuucucuu

SEQ ID NO: 12740 - RNA, 23 nt, Human
cagaagacagucucaagacaagg

SEQ ID NO: 12741 - RNA, 22 nt, Human
cagaagacugcagggaagggac

SEQ ID NO: 12742 - RNA, 22 nt, Human
cagaagaugcagugucugagaa

SEQ ID NO: 12743 - RNA, 22 nt, Human
cagaagcaaaugccuugcugag

SEQ ID NO: 12744 - RNA, 22 nt, Human
cagaagcaagagccggagcuag

SEQ ID NO: 12745 - RNA, 22 nt, Human
cagaagcaaguagugauucuuu

SEQ ID NO: 12746 - RNA, 23 nt, Human
cagaagcaccuguugacugcugc

SEQ ID NO: 12747 - RNA, 22 nt, Human
cagaagcuuugcucauaaccau

SEQ ID NO: 12748 - RNA, 22 nt, Human
cagaagcuuugucuagucuuga

SEQ ID NO: 12749 - RNA, 17 nt, Human
cagaaggaagcauggca

SEQ ID NO: 12750 - RNA, 20 nt, Human
cagaaggucuaagcuuuaga

SEQ ID NO: 12751 - RNA, 22 nt, Human
cagaagguuugaaagaugucuu

SEQ ID NO: 12752 - RNA, 22 nt, Human
cgggaacaugcuuucauuucag

SEQ ID NO: 12753 - RNA, 22 nt, Human
cgggagcacgggaggcggagcu

SEQ ID NO: 12754 - RNA, 22 nt, Human
cgggaggaaaggcgaggcucug

SEQ ID NO: 12755 - RNA, 22 nt, Human
cgggcacucagggucgaggugg

SEQ ID NO: 12756 - RNA, 22 nt, Human
cgggcagcggcguggccauggu

SEQ ID NO: 12757 - RNA, 22 nt, Human
cgggcagugcccagcggggcag

SEQ ID NO: 12758 - RNA, 22 nt, Human
cgggcuccgggucuuugcaguc

SEQ ID NO: 12759 - RNA, 22 nt, Human
cggggcaccgaccuccugccgc

SEQ ID NO: 12760 - RNA, 22 nt, Human
cggggcagaaaguugucuuuug

SEQ ID NO: 12761 - RNA, 22 nt, Human
cagcuacacaccagaacuauua

SEQ ID NO: 12762 - RNA, 22 nt, Human
cagcuacaggacgggcaucugc

SEQ ID NO: 12763 - RNA, 22 nt, Human
cagcuacagucugauugguuca

SEQ ID NO: 12764 - RNA, 22 nt, Human
cagcuacaguuccacugagcau

SEQ ID NO: 12765 - RNA, 22 nt, Human
cagcuagagggaugcuguguga

SEQ ID NO: 12766 - RNA, 22 nt, Human
cagcuagcuaagaaggccagag

SEQ ID NO: 12767 - RNA, 22 nt, Human
cagcuaguacaaugggagagca

SEQ ID NO: 12768 - RNA, 22 nt, Human
cagcuagucagaggcagggcca

SEQ ID NO: 12769 - RNA, 22 nt, Human
cagcuauggugacaaggucagg

SEQ ID NO: 12770 - RNA, 22 nt, Human
cagcuauuaauguuuuugcuga

SEQ ID NO: 12771 - RNA, 22 nt, Human
cagcuauuauuuucucuaaauu

SEQ ID NO: 12772 - RNA, 22 nt, Human
cagcuauucucugaaaugaaua

SEQ ID NO: 12773 - RNA, 22 nt, Human
cagcuauuuaucuuucaugaua

SEQ ID NO: 12774 - RNA, 22 nt, Human
cagcuauuuugccuaucauggu

SEQ ID NO: 12775 - RNA, 22 nt, Human
cagcucaaguuucccaggucag

SEQ ID NO: 12776 - RNA, 22 nt, Human
cagcucaauagccuaccuuaau

SEQ ID NO: 12777 - RNA, 22 nt, Human
cagcucacccaucacgucugcu

SEQ ID NO: 12778 - RNA, 22 nt, Human
cagcucacuuguuucaucuucu

SEQ ID NO: 12779 - RNA, 23 nt, Human
cagcucagaguguguccuguuuc

SEQ ID NO: 12780 - RNA, 23 nt, Human
cagcucagcacauaggagguacu

SEQ ID NO: 12781 - RNA, 19 nt, Human
cagcucaggacucagcccc

SEQ ID NO: 12782 - RNA, 22 nt, Human
cagcucaggcacuggcgcggga

SEQ ID NO: 12783 - RNA, 22 nt, Human
cagcucaggcucuccaugcucc

SEQ ID NO: 12784 - RNA, 22 nt, Human
cagcucagucuggagagaugca

SEQ ID NO: 12785 - RNA, 22 nt, Human
cagcucaguuucaauaccaggu

SEQ ID NO: 12786 - RNA, 22 nt, Human
cagcucauuccucaaucuagga

SEQ ID NO: 12787 - RNA, 21 nt, Human
cagcuccacuaaagcagcugu

SEQ ID NO: 12788 - RNA, 22 nt, Human
cagcuccagcccaggcagcucc

SEQ ID NO: 12789 - RNA, 22 nt, Human
cagcuccagccugacaccaaga

SEQ ID NO: 12790 - RNA, 22 nt, Human
cagcuccagcucugggcgccuc

SEQ ID NO: 12791 - RNA, 22 nt, Human
cagcucccagagugaccagcag

SEQ ID NO: 12792 - RNA, 22 nt, Human
cagcuccugccugggcagcugu

SEQ ID NO: 12793 - RNA, 22 nt, Human
cagcuccugggccaucuccuag

SEQ ID NO: 12794 - RNA, 22 nt, Human
cagcuccuguuggucuugagga

SEQ ID NO: 12795 - RNA, 22 nt, Human
cagcucuccacccuccugguuc

SEQ ID NO: 12796 - RNA, 22 nt, Human
cagcucugagacugaggcuaug

SEQ ID NO: 12797 - RNA, 21 nt, Human
cagcucugagauuucuacuag

SEQ ID NO: 12798 - RNA, 22 nt, Human
cagcucugccucuggggcugag

SEQ ID NO: 12799 - RNA, 22 nt, Human
cagcucuggcagagcccaaccc

SEQ ID NO: 12800 - RNA, 22 nt, Human
cagcucuggcuauugaggacca

SEQ ID NO: 12801 - RNA, 22 nt, Human
cagcucugguccagggagggca

SEQ ID NO: 12802 - RNA, 22 nt, Human
cagcucugguuccugggcccag

SEQ ID NO: 12803 - RNA, 22 nt, Human
cagcucugucuguagaaacuuc

SEQ ID NO: 12804 - RNA, 22 nt, Human
cagcucugugggagcguaugug

SEQ ID NO: 12805 - RNA, 22 nt, Human
cagcucuguguauuuuccccac

SEQ ID NO: 12806 - RNA, 22 nt, Human
cagcucuuagagggagacagac

SEQ ID NO: 12807 - RNA, 22 nt, Human
cagcucuucagugccugagaua

SEQ ID NO: 12808 - RNA, 22 nt, Human
cagcucuuccuacccuaguugg

SEQ ID NO: 12809 - RNA, 22 nt, Human
cagcucuuccucccaccggaca

SEQ ID NO: 12810 - RNA, 22 nt, Human
cagcucuuggagccuccaguaa

SEQ ID NO: 12811 - RNA, 22 nt, Human
cagcucuuuauugaaacaaaaa

SEQ ID NO: 12812 - RNA, 22 nt, Human
cagcucuuugaguauuccauuu

SEQ ID NO: 12813 - RNA, 22 nt, Human
cagcugaagagaggugcugagu

SEQ ID NO: 12814 - RNA, 22 nt, Human
cagcugaagcucuugucaaagg

SEQ ID NO: 12815 - RNA, 22 nt, Human
cagcugaagguaggaaccagga

SEQ ID NO: 12816 - RNA, 22 nt, Human
cagcugaauggcucccugcuaa

SEQ ID NO: 12817 - RNA, 22 nt, Human
cagcugaauucuucagacucca

SEQ ID NO: 12818 - RNA, 22 nt, Human
cagcugacaagaguccuuggag

SEQ ID NO: 12819 - RNA, 22 nt, Human
cagcugacacuuugaccuagag

SEQ ID NO: 12820 - RNA, 22 nt, Human
cagcugacuucauaggaagaca

SEQ ID NO: 12821 - RNA, 22 nt, Human
cagcugagaaaggcaggcucac

SEQ ID NO: 12822 - RNA, 22 nt, Human
cagcugagaguagaaauggagg

SEQ ID NO: 12823 - RNA, 22 nt, Human
cagcugagcaucacuagucugg

SEQ ID NO: 12824 - RNA, 22 nt, Human
cagcugaggaauacuagaugua

SEQ ID NO: 12825 - RNA, 18 nt, Human
cagcugaggaccaaacug

SEQ ID NO: 12826 - RNA, 22 nt, Human
cagcugaggucaaagaagcagg

SEQ ID NO: 12827 - RNA, 22 nt, Human
cagcugaggucuuuuuuaugug

SEQ ID NO: 12828 - RNA, 22 nt, Human
cagcugaguguuggcauguuca

SEQ ID NO: 12829 - RNA, 22 nt, Human
cagcugauuugagaaagaauga

SEQ ID NO: 12830 - RNA, 22 nt, Human
cagcugcagaaagcaagcaggu

SEQ ID NO: 12831 - RNA, 22 nt, Human
cagcugccacuugcucucggcu

SEQ ID NO: 12832 - RNA, 18 nt, Human
cagcugccagcucaugga

SEQ ID NO: 12833 - RNA, 22 nt, Human
cagcugcccaggccaccuggag

SEQ ID NO: 12834 - RNA, 22 nt, Human
cagcugcccauccugggaaaug

SEQ ID NO: 12835 - RNA, 22 nt, Human
cagcugccccauaaaucacagu

SEQ ID NO: 12836 - RNA, 22 nt, Human
cagcugccuaugaccuagccuc

SEQ ID NO: 12837 - RNA, 20 nt, Human
cagcugccuggcucugggau

SEQ ID NO: 12838 - RNA, 22 nt, Human
cagcugcuuuaguuuuccaucc

SEQ ID NO: 12839 - RNA, 22 nt, Human
cagcuggaucccugcagaacuu

SEQ ID NO: 12840 - RNA, 22 nt, Human
cagcuggccaaucagggcgccc

SEQ ID NO: 12841 - RNA, 22 nt, Human
cagcuggccugaucccuguggc

SEQ ID NO: 12842 - RNA, 22 nt, Human
cagcuggcgggcagagccgcca

SEQ ID NO: 12843 - RNA, 22 nt, Human
cagcuggcguggagugauugca

SEQ ID NO: 12844 - RNA, 22 nt, Human
cagcuggcuggucagugcacaa

SEQ ID NO: 12845 - RNA, 22 nt, Human
cagcugggagcuccauuagaua

SEQ ID NO: 12846 - RNA, 22 nt, Human
cagcugggccuccugagcccug

SEQ ID NO: 12847 - RNA, 22 nt, Human
cagcuggguggcucuucugcuc

SEQ ID NO: 12848 - RNA, 22 nt, Human
cagcugguucagugucugguga

SEQ ID NO: 12849 - RNA, 22 nt, Human
cagcugguugaagaggagcugg

SEQ ID NO: 12850 - RNA, 22 nt, Human
cagcuguccaaacacauuaacu

SEQ ID NO: 12851 - RNA, 22 nt, Human
cagcugucucagggaggugauc

SEQ ID NO: 12852 - RNA, 22 nt, Human
cagcugucugaagcaggagucc

SEQ ID NO: 12853 - RNA, 22 nt, Human
cagcugucugcugaaggaagcu

SEQ ID NO: 12854 - RNA, 17 nt, Human
cagcugugagagccuua

SEQ ID NO: 12855 - RNA, 18 nt, Human
cagcugugcccuguuugg

SEQ ID NO: 12856 - RNA, 22 nt, Human
cagcugugcuagaagccacgaa

SEQ ID NO: 12857 - RNA, 22 nt, Human
cagcugugggccugacguggca

SEQ ID NO: 12858 - RNA, 22 nt, Human
cagcuguguagaugcaggguca

SEQ ID NO: 12859 - RNA, 22 nt, Human
cagcuguguaugagagcaugcu

SEQ ID NO: 12860 - RNA, 22 nt, Human
cagcuguucacauuuccaaaac

SEQ ID NO: 12861 - RNA, 22 nt, Human
caggaugagaagggcucuuacg

SEQ ID NO: 12862 - RNA, 18 nt, Human
caggaugagugaugggga

SEQ ID NO: 12863 - RNA, 19 nt, Human
caggaugaucccaugacac

SEQ ID NO: 12864 - RNA, 22 nt, Human
caggaugcuucuggggccaggc

SEQ ID NO: 12865 - RNA, 22 nt, Human
caggauggagggagggcuguua

SEQ ID NO: 12866 - RNA, 22 nt, Human
caggaugggugucggccagcac

SEQ ID NO: 12867 - RNA, 22 nt, Human
caggauggucucgaucuccuga

SEQ ID NO: 12868 - RNA, 22 nt, Human
caggauuaaggugaggggagua

SEQ ID NO: 12869 - RNA, 22 nt, Human
caggauugaaugcuucucccug

SEQ ID NO: 12870 - RNA, 22 nt, Human
caggauuucauacaucuuuacu

SEQ ID NO: 12871 - RNA, 22 nt, Human
caggcaagcacggugaaccugg

SEQ ID NO: 12872 - RNA, 22 nt, Human
caggcacaaauuucuagauaag

SEQ ID NO: 12873 - RNA, 22 nt, Human
caggcacaaugagcgccaucuu

SEQ ID NO: 12874 - RNA, 22 nt, Human
caggcacacugucuacacugag

SEQ ID NO: 12875 - RNA, 22 nt, Human
caggcacagaguuauucauuua

SEQ ID NO: 12876 - RNA, 22 nt, Human
caggcacagugggguccucucu

SEQ ID NO: 12877 - RNA, 22 nt, Human
caggcacaugggagcucaucau

SEQ ID NO: 12878 - RNA, 22 nt, Human
cuacauuuguucaaauaagcug

SEQ ID NO: 12879 - RNA, 22 nt, Human
cuacauuuguucuauagcuuuu

SEQ ID NO: 12880 - RNA, 22 nt, Human
cuacauuuuaauaagcugcuua

SEQ ID NO: 12881 - RNA, 22 nt, Human
cuacccagcaccuaggcugccu

SEQ ID NO: 12882 - RNA, 22 nt, Human
cuacccaggcuggagugcagua

SEQ ID NO: 12883 - RNA, 16 nt, Human
cuacccagugagaagg

SEQ ID NO: 12884 - RNA, 22 nt, Human
cuacccuguauuuagagaugca

SEQ ID NO: 12885 - RNA, 22 nt, Human
cuacccuuaaguuucugugggg

SEQ ID NO: 12886 - RNA, 22 nt, Human
cuaccuuaucagagugguaagg

SEQ ID NO: 12887 - RNA, 22 nt, Human
cuacuauaaaauacacaucugu

SEQ ID NO: 12888 - RNA, 22 nt, Human
cuacucugaauugaagugauau

SEQ ID NO: 12889 - RNA, 22 nt, Human
cuacucuuuugagucuucagau

SEQ ID NO: 12890 - RNA, 22 nt, Human
cuacugaauuagacugcauuuu

SEQ ID NO: 12891 - RNA, 22 nt, Human
cuacuguccauaaaguauaacu

SEQ ID NO: 12892 - RNA, 22 nt, Human
cuacuguuguguuuuaaaggua

SEQ ID NO: 12893 - RNA, 22 nt, Human
cuacuucuguggcucuaagaga

SEQ ID NO: 12894 - RNA, 22 nt, Human
cuacuuguucacuguaggucgc

SEQ ID NO: 12895 - RNA, 22 nt, Human
cuacuuuaacauggaggcacuu

SEQ ID NO: 12896 - RNA, 22 nt, Human
cuacuuuaauuuucugcagaga

SEQ ID NO: 12897 - RNA, 22 nt, Human
cuacuuuaccuccaucagacug

SEQ ID NO: 12898 - RNA, 22 nt, Human
cuacuuugcugcccagcagugc

SEQ ID NO: 12899 - RNA, 22 nt, Human
cuagaaacgccuuuagcacaac

SEQ ID NO: 12900 - RNA, 22 nt, Human
cuagaaauacaggcacgugcca

SEQ ID NO: 12901 - RNA, 22 nt, Human
cuagaaaugcucaagagaaagu

SEQ ID NO: 12902 - RNA, 22 nt, Human
cuagaaauucugauucaguagg

SEQ ID NO: 12903 - RNA, 22 nt, Human
cuagaacaaauuaggaggcaua

SEQ ID NO: 12904 - RNA, 22 nt, Human
cuagaaggaagcccagcacuuc

SEQ ID NO: 12905 - RNA, 22 nt, Human
cuagaauacucguauuauuccc

SEQ ID NO: 12906 - RNA, 22 nt, Human
cuagacagaggcaagcgcauua

SEQ ID NO: 12907 - RNA, 22 nt, Human
cuagagaaaaagcuuagguacg

SEQ ID NO: 12908 - RNA, 22 nt, Human
cuagagaaacgccgugggagga

SEQ ID NO: 12909 - RNA, 22 nt, Human
cuagagaauugucuugagaguu

SEQ ID NO: 12910 - RNA, 22 nt, Human
cuagaggaacaguuucagguuu

SEQ ID NO: 12911 - RNA, 22 nt, Human
cuagaggggaaaaaggucuugu

SEQ ID NO: 12912 - RNA, 22 nt, Human
cuagagguagaggcagugggaa

SEQ ID NO: 12913 - RNA, 22 nt, Human
cuagaucagcuaacuuuccagu

SEQ ID NO: 12914 - RNA, 22 nt, Human
cuagauccgcagguuuucagug

SEQ ID NO: 12915 - RNA, 22 nt, Human
cuagaugccaauuuuuauggau

SEQ ID NO: 12916 - RNA, 22 nt, Human
cuagauuugcaugccuacacca

SEQ ID NO: 12917 - RNA, 22 nt, Human
cuagcacagcccauucagucua

SEQ ID NO: 12918 - RNA, 22 nt, Human
cuagcaguguacucaacaaggg

SEQ ID NO: 12919 - RNA, 22 nt, Human
cuagcaucucacugauuuacug

SEQ ID NO: 12920 - RNA, 22 nt, Human
cuagccagaugauucccaaaua

SEQ ID NO: 12921 - RNA, 22 nt, Human
cuagcccuuggugagaacagcg

SEQ ID NO: 12922 - RNA, 22 nt, Human
cuagcuagcagcauuacaacaa

SEQ ID NO: 12923 - RNA, 22 nt, Human
cuaggaaauuuaaaauaugauu

SEQ ID NO: 12924 - RNA, 22 nt, Human
cuaggaacaguucaacaguuua

SEQ ID NO: 12925 - RNA, 22 nt, Human
cuaggaagagaaggaauucccc

SEQ ID NO: 12926 - RNA, 22 nt, Human
cuaggaagcugugcggacccug

SEQ ID NO: 12927 - RNA, 22 nt, Human
cuaggaauagcaaaguaggaca

SEQ ID NO: 12928 - RNA, 22 nt, Human
cuaggcagcuuugggugugaag

SEQ ID NO: 12929 - RNA, 22 nt, Human
cuaggcagggugcugugccaug

SEQ ID NO: 12930 - RNA, 22 nt, Human
cuaggccacuugcucucaugga

SEQ ID NO: 12931 - RNA, 22 nt, Human
cuaggccagagagaccucauga

SEQ ID NO: 12932 - RNA, 22 nt, Human
cuaggccaguuaggaagagaag

SEQ ID NO: 12933 - RNA, 22 nt, Human
cuaggccuucauaggcauggaa

SEQ ID NO: 12934 - RNA, 22 nt, Human
cuaggcuggagugcauuggcgu

SEQ ID NO: 12935 - RNA, 22 nt, Human
cuagggaacaagaugcccaggg

SEQ ID NO: 12936 - RNA, 22 nt, Human
cuagggaaggacaaccucuucc

SEQ ID NO: 12937 - RNA, 22 nt, Human
cuagggagcacuagcugccuug

SEQ ID NO: 12938 - RNA, 22 nt, Human
cuagggccaaaggcugugaugc

SEQ ID NO: 12939 - RNA, 22 nt, Human
cuagggcucgcaagggcuggag

SEQ ID NO: 12940 - RNA, 22 nt, Human
cuagggcuuccaagaugccuuc

SEQ ID NO: 12941 - RNA, 19 nt, Human
cuagggcuuggcagcaggc

SEQ ID NO: 12942 - RNA, 22 nt, Human
cuagggucaggggccugcgucg

SEQ ID NO: 12943 - RNA, 22 nt, Human
cuaggguggauuugugcagagu

SEQ ID NO: 12944 - RNA, 22 nt, Human
cuagggugugcagauuuugccu

SEQ ID NO: 12945 - RNA, 22 nt, Human
cuagguggugguggguugacau

SEQ ID NO: 12946 - RNA, 22 nt, Human
cuaguaaaguacucaaauagcc

SEQ ID NO: 12947 - RNA, 22 nt, Human
cuaguacaauuuuagcaagaug

SEQ ID NO: 12948 - RNA, 22 nt, Human
cuagucacuguaauaaucugcu

SEQ ID NO: 12949 - RNA, 22 nt, Human
cuaguccagucucaaaaugcua

SEQ ID NO: 12950 - RNA, 22 nt, Human
cuagucugugugggaccagggc

SEQ ID NO: 12951 - RNA, 22 nt, Human
cuaguucuagaucccugaggaa

SEQ ID NO: 12952 - RNA, 22 nt, Human
cuaguugaagaggcugucauca

SEQ ID NO: 12953 - RNA, 22 nt, Human
cuaguuguuuaauauugauuga

SEQ ID NO: 12954 - RNA, 22 nt, Human
cuauacacuuuuugaaaauaga

SEQ ID NO: 12955 - RNA, 22 nt, Human
cuauacaguaaccacagugauu

SEQ ID NO: 12956 - RNA, 22 nt, Human
cuauagaaacaaccucucuuuc

SEQ ID NO: 12957 - RNA, 22 nt, Human
cuauauacuuuucacagauguu

SEQ ID NO: 12958 - RNA, 22 nt, Human
cuauaucauaaaucugaagagg

SEQ ID NO: 12959 - RNA, 22 nt, Human
cuauauucuggaauguccauuu

SEQ ID NO: 12960 - RNA, 22 nt, Human
cuauauuucuuggcuuuaaaca

SEQ ID NO: 12961 - RNA, 22 nt, Human
cuaucaaacagccauuaauaua

SEQ ID NO: 12962 - RNA, 18 nt, Human
cuaucccuggagcuuggg

SEQ ID NO: 12963 - RNA, 20 nt, Human
cuaucuccuggcgugccuuc

SEQ ID NO: 12964 - RNA, 22 nt, Human
cuaucucuccacaaugccagug

SEQ ID NO: 12965 - RNA, 22 nt, Human
cuaucucuuguuuuccugaagc

SEQ ID NO: 12966 - RNA, 22 nt, Human
cuaugaaaggauuuggaguugu

SEQ ID NO: 12967 - RNA, 22 nt, Human
cuaugagaagaaaacaagauua

SEQ ID NO: 12968 - RNA, 22 nt, Human
cuauggaaacucaacauuuguu

SEQ ID NO: 12969 - RNA, 23 nt, Human
cuauggaauaccaaugauucuca

SEQ ID NO: 12970 - RNA, 22 nt, Human
acauggugugcugagaaugaca

SEQ ID NO: 12971 - RNA, 22 nt, Human
acauguaaaaauuaagguaaga

SEQ ID NO: 12972 - RNA, 22 nt, Human
acauguaggagagucacaaugc

SEQ ID NO: 12973 - RNA, 22 nt, Human
acaugucuacacauucugcaau

SEQ ID NO: 12974 - RNA, 21 nt, Human
acaugucucuaaucucaguga

SEQ ID NO: 12975 - RNA, 22 nt, Human
acaugucucuucugaaagacaa

SEQ ID NO: 12976 - RNA, 21 nt, Human
acaugucuggucauuuuuagc

SEQ ID NO: 12977 - RNA, 22 nt, Human
acaugugaaaucucauaguuag

SEQ ID NO: 12978 - RNA, 22 nt, Human
acaugugaguaaauuuaauguu

SEQ ID NO: 12979 - RNA, 22 nt, Human
acauguguaaaaguggauaaaa

SEQ ID NO: 12980 - RNA, 22 nt, Human
acauguguacuuuuaaggaugu

SEQ ID NO: 12981 - RNA, 22 nt, Human
acauguuuacauuaggugauau

SEQ ID NO: 12982 - RNA, 22 nt, Human
acauguuugauaaauauuuggg

SEQ ID NO: 12983 - RNA, 19 nt, Human
acauguuuugcagaacagc

SEQ ID NO: 12984 - RNA, 22 nt, Human
acauuaaaaaauguugcaugaa

SEQ ID NO: 12985 - RNA, 22 nt, Human
acauuaacaccauaaguguguu

SEQ ID NO: 12986 - RNA, 22 nt, Human
acauuaagaaacgagagagcaa

SEQ ID NO: 12987 - RNA, 22 nt, Human
acauuaagaugugcuguaggau

SEQ ID NO: 12988 - RNA, 22 nt, Human
acauuacacugugguccuguuc

SEQ ID NO: 12989 - RNA, 22 nt, Human
acauuagagaagcuuggagaug

SEQ ID NO: 12990 - RNA, 22 nt, Human
acauuagauaacucagaaagga

SEQ ID NO: 12991 - RNA, 22 nt, Human
acauuagaugacucuuucuuuc

SEQ ID NO: 12992 - RNA, 22 nt, Human
acauuaguuucucagaucauuu

SEQ ID NO: 12993 - RNA, 21 nt, Human
acauuauaauucauauuccac

SEQ ID NO: 12994 - RNA, 22 nt, Human
acauuauagcuuugaguuugga

SEQ ID NO: 12995 - RNA, 22 nt, Human
acauuaugagcccacuggugaa

SEQ ID NO: 12996 - RNA, 22 nt, Human
acauucaaaauuagguuaguug

SEQ ID NO: 12997 - RNA, 22 nt, Human
acauucaaaauugugguuuaga

SEQ ID NO: 12998 - RNA, 22 nt, Human
acauucaaccaauguuugcuau

SEQ ID NO: 12999 - RNA, 22 nt, Human
acauucaaggccuucugacaca

SEQ ID NO: 13000 - RNA, 22 nt, Human
acauucuacaguuaaccauuag

SEQ ID NO: 13001 - RNA, 22 nt, Human
acauucuagaagagcuucacuu

SEQ ID NO: 13002 - RNA, 22 nt, Human
acauucuagaagucuuugcaau

SEQ ID NO: 13003 - RNA, 22 nt, Human
acauucuagauauguuauauuu

SEQ ID NO: 13004 - RNA, 22 nt, Human
acauucuaugguugaugaguug

SEQ ID NO: 13005 - RNA, 22 nt, Human
acauucugaaaaacaguguuuu

SEQ ID NO: 13006 - RNA, 22 nt, Human
acauucugggugauguucuuca

SEQ ID NO: 13007 - RNA, 22 nt, Human
acauucuuaacaguuaaaaacu

SEQ ID NO: 13008 - RNA, 22 nt, Human
acauucuuucgaugucugauuu

SEQ ID NO: 13009 - RNA, 22 nt, Human
acauugaagggaaugcaaagau

SEQ ID NO: 13010 - RNA, 22 nt, Human
acauugaagggcuauccaauag

SEQ ID NO: 13011 - RNA, 22 nt, Human
acauugaucagccucccaugca

SEQ ID NO: 13012 - RNA, 22 nt, Human
acauugaugaaaagguaucauu

SEQ ID NO: 13013 - RNA, 18 nt, Human
acauugauggcuuuaagc

SEQ ID NO: 13014 - RNA, 20 nt, Human
acauugauuauguuuguaga

SEQ ID NO: 13015 - RNA, 22 nt, Human
acauuggucacugaagaaugag

SEQ ID NO: 13016 - RNA, 22 nt, Human
acauuguuaguagaccaguggc

SEQ ID NO: 13017 - RNA, 22 nt, Human
acauuguuccagcgauagagaa

SEQ ID NO: 13018 - RNA, 22 nt, Human
acauuguuccugagaacuuggg

SEQ ID NO: 13019 - RNA, 22 nt, Human
acauuguugugcaauuauaguu

SEQ ID NO: 13020 - RNA, 19 nt, Human
acauuuaaauucagaucuc

SEQ ID NO: 13021 - RNA, 22 nt, Human
acauuuacagugcuagacaauc

SEQ ID NO: 13022 - RNA, 22 nt, Human
acauuuacccuggaacauugga

SEQ ID NO: 13023 - RNA, 22 nt, Human
acauuuagaguucuuuacucca

SEQ ID NO: 13024 - RNA, 22 nt, Human
acauuuagaugguguuauagua

SEQ ID NO: 13025 - RNA, 22 nt, Human
acauuucacuguucacagcagg

SEQ ID NO: 13026 - RNA, 22 nt, Human
acauuucagauguaaugugaug

SEQ ID NO: 13027 - RNA, 22 nt, Human
acauuucagcgugcaugacaug

SEQ ID NO: 13028 - RNA, 17 nt, Human
acauuuccuaacugaag

SEQ ID NO: 13029 - RNA, 22 nt, Human
acauuucgugcucuguuuuguu

SEQ ID NO: 13030 - RNA, 18 nt, Human
acauuucuaggugaaagc

SEQ ID NO: 13031 - RNA, 22 nt, Human
acauuucuaguuguucaucucc

SEQ ID NO: 13032 - RNA, 22 nt, Human
acauuucuauagugcaucuguu

SEQ ID NO: 13033 - RNA, 22 nt, Human
acauuucucagggaguuuugcu

SEQ ID NO: 13034 - RNA, 22 nt, Human
acauuucucagguaagucauuu

SEQ ID NO: 13035 - RNA, 18 nt, Human
acauuucuccuucugacc

SEQ ID NO: 13036 - RNA, 18 nt, Human
acauuucucucugcguga

SEQ ID NO: 13037 - RNA, 22 nt, Human
acauuucucuuagaguuggacu

SEQ ID NO: 13038 - RNA, 22 nt, Human
acauuucugagcagggagcugu

SEQ ID NO: 13039 - RNA, 22 nt, Human
acauuucugcuagaauagguga

SEQ ID NO: 13040 - RNA, 22 nt, Human
acauuucuucccuuuagcagaa

SEQ ID NO: 13041 - RNA, 22 nt, Human
acauuucuuccuaauuaucccu

SEQ ID NO: 13042 - RNA, 22 nt, Human
acauuucuuugcuagacagcag

SEQ ID NO: 13043 - RNA, 22 nt, Human
acauuugaaauucugaacagau

SEQ ID NO: 13044 - RNA, 22 nt, Human
acauuugacucuguucauauua

SEQ ID NO: 13045 - RNA, 22 nt, Human
acauuugagcauauuucuuguc

SEQ ID NO: 13046 - RNA, 22 nt, Human
acauuugauauggaguugugua

SEQ ID NO: 13047 - RNA, 22 nt, Human
acauuugauugaugaaucaaau

SEQ ID NO: 13048 - RNA, 22 nt, Human
acauuugggacccucucuucac

SEQ ID NO: 13049 - RNA, 22 nt, Human
acauuugguugagcuguuguca

SEQ ID NO: 13050 - RNA, 19 nt, Human
acauuugucaagagaaggu

SEQ ID NO: 13051 - RNA, 22 nt, Human
acauuugucuggcuagaaaguu

SEQ ID NO: 13052 - RNA, 22 nt, Human
acauuugugcaacguauccaca

SEQ ID NO: 13053 - RNA, 22 nt, Human
acauuuguuucucuagaguagg

SEQ ID NO: 13054 - RNA, 22 nt, Human
acauuuugcccuuauuugcuga

SEQ ID NO: 13055 - RNA, 22 nt, Human
acauuuuucacauuuguagggu

SEQ ID NO: 13056 - RNA, 22 nt, Human
accaaaggcagagcugaacacu

SEQ ID NO: 13057 - RNA, 22 nt, Human
accaaagggcagaacaugagca

SEQ ID NO: 13058 - RNA, 22 nt, Human
accaaauauaucuuuugaccug

SEQ ID NO: 13059 - RNA, 22 nt, Human
accaaaugcugacagcaugacu

SEQ ID NO: 13060 - RNA, 22 nt, Human
accaaccagggacuuggcuccc

SEQ ID NO: 13061 - RNA, 22 nt, Human
accaagcuagaacauuacaggc

SEQ ID NO: 13062 - RNA, 22 nt, Human
accaaggaagagauucucaguu

SEQ ID NO: 13063 - RNA, 22 nt, Human
accaagugaguacuuggcagaa

SEQ ID NO: 13064 - RNA, 20 nt, Human
accaauguuagcuuaguacu

SEQ ID NO: 13065 - RNA, 18 nt, Human
accacagugcuuaauaug

SEQ ID NO: 13066 - RNA, 22 nt, Human
accacaguuucauucaugcagg

SEQ ID NO: 13067 - RNA, 22 nt, Human
accacaucgggcggacacuggg

SEQ ID NO: 13068 - RNA, 18 nt, Human
accacaugauaucuugcc

SEQ ID NO: 13069 - RNA, 22 nt, Human
accaccaggggauuuucagaac

SEQ ID NO: 13070 - RNA, 22 nt, Human
accacugcccauggugaaaacu

SEQ ID NO: 13071 - RNA, 22 nt, Human
accacuggccugguggggacca

SEQ ID NO: 13072 - RNA, 22 nt, Human
accacugguuuugcagaggcgc

SEQ ID NO: 13073 - RNA, 22 nt, Human
accacugucuacacauugacuc

SEQ ID NO: 13074 - RNA, 22 nt, Human
accacuuaucaucacuaucuca

SEQ ID NO: 13075 - RNA, 22 nt, Human
accacuuuacagaaauggaaag

SEQ ID NO: 13076 - RNA, 22 nt, Human
accagacacugugaagacaggc

SEQ ID NO: 13077 - RNA, 22 nt, Human
accagagaaaacacagcaggcu

SEQ ID NO: 13078 - RNA, 22 nt, Human
accagagacucuuucuaguccu

SEQ ID NO: 13079 - RNA, 18 nt, Human
acccucuggcuucugagc

SEQ ID NO: 13080 - RNA, 22 nt, Human
acccugagaaugagugucuccu

SEQ ID NO: 13081 - RNA, 19 nt, Human
acccugagaggugguccgg

SEQ ID NO: 13082 - RNA, 22 nt, Human
acccugagccaaaccaguuaga

SEQ ID NO: 13083 - RNA, 22 nt, Human
acccugcagggcagaggcuggu

SEQ ID NO: 13084 - RNA, 20 nt, Human
acccugcauacuggaaggcu

SEQ ID NO: 13085 - RNA, 22 nt, Human
acccugccaaggauggccccga

SEQ ID NO: 13086 - RNA, 20 nt, Human
acccugccaggcaugugaau

SEQ ID NO: 13087 - RNA, 22 nt, Human
acagaagaaguucaaggugaag

SEQ ID NO: 13088 - RNA, 22 nt, Human
acagaagacagaguguucaucu

SEQ ID NO: 13089 - RNA, 23 nt, Human
acagaagccaggagccgcugggc

SEQ ID NO: 13090 - RNA, 22 nt, Human
acagaagcucaagagagcagug

SEQ ID NO: 13091 - RNA, 22 nt, Human
acagaaggacuugagaaagaca

SEQ ID NO: 13092 - RNA, 22 nt, Human
acagaaggcggggacaaggcgg

SEQ ID NO: 13093 - RNA, 22 nt, Human
acagaaguggcuucaaagagca

SEQ ID NO: 13094 - RNA, 22 nt, Human
acagaaguguguguguaggaau

SEQ ID NO: 13095 - RNA, 23 nt, Human
acagaauaccauugacuaggugu

SEQ ID NO: 13096 - RNA, 22 nt, Human
acagaauagagacugccugcuc

SEQ ID NO: 13097 - RNA, 22 nt, Human
acagaauagguacagucaguca

SEQ ID NO: 13098 - RNA, 22 nt, Human
acagaauagucagcuguaggcc

SEQ ID NO: 13099 - RNA, 22 nt, Human
acagaauaguuggcccugcuau

SEQ ID NO: 13100 - RNA, 20 nt, Human
acagaauaugcugguugugg

SEQ ID NO: 13101 - RNA, 22 nt, Human
acagaauauuuggcaugcgucu

SEQ ID NO: 13102 - RNA, 22 nt, Human
acagaauucucucugcagaggc

SEQ ID NO: 13103 - RNA, 22 nt, Human
acagaauugaaaguauaaucug

SEQ ID NO: 13104 - RNA, 22 nt, Human
acagaauuuacacaucucuaaa

SEQ ID NO: 13105 - RNA, 22 nt, Human
acagaauuugcuugggcaaugg

SEQ ID NO: 13106 - RNA, 18 nt, Human
acagacacuuaguaugag

SEQ ID NO: 13107 - RNA, 22 nt, Human
acagacagggcaccugccuccu

SEQ ID NO: 13108 - RNA, 16 nt, Human
acagacaugagugagc

SEQ ID NO: 13109 - RNA, 22 nt, Human
acagacauuuuaauuauuaaau

SEQ ID NO: 13110 - RNA, 22 nt, Human
acagaccaaaaaaggauauugg

SEQ ID NO: 13111 - RNA, 22 nt, Human
acagaccugggcacagaaagga

SEQ ID NO: 13112 - RNA, 22 nt, Human
acagacugauucauugcucagg

SEQ ID NO: 13113 - RNA, 22 nt, Human
acagacuggaggagaauaguuu

SEQ ID NO: 13114 - RNA, 22 nt, Human
acagacugugagucucauuuuc

SEQ ID NO: 13115 - RNA, 22 nt, Human
acagacuguuugguucaugucu

SEQ ID NO: 13116 - RNA, 22 nt, Human
acagacuuguucccuagugagu

SEQ ID NO: 13117 - RNA, 22 nt, Human
acagagacaaauguuaguaguu

SEQ ID NO: 13118 - RNA, 22 nt, Human
acagagacucaugaaagaugac

SEQ ID NO: 13119 - RNA, 22 nt, Human
acagagacugggagcaagaggc

SEQ ID NO: 13120 - RNA, 22 nt, Human
acagagagaaacaaucagcagc

SEQ ID NO: 13121 - RNA, 22 nt, Human
acagagaucagaggcauaagca

SEQ ID NO: 13122 - RNA, 22 nt, Human
acagagaugcaaguguguauuu

SEQ ID NO: 13123 - RNA, 22 nt, Human
acagagauggcacagagaaggu

SEQ ID NO: 13124 - RNA, 22 nt, Human
acagagaugucagauuggcagc

SEQ ID NO: 13125 - RNA, 22 nt, Human
acagagcaacuugaguauccuc

SEQ ID NO: 13126 - RNA, 22 nt, Human
acagagcaaugcguguucucua

SEQ ID NO: 13127 - RNA, 22 nt, Human
acagagcaauucuuggguguuu

SEQ ID NO: 13128 - RNA, 22 nt, Human
acagagcaguaagaacacagcu

SEQ ID NO: 13129 - RNA, 22 nt, Human
acagagcauauaaagugcuuug

SEQ ID NO: 13130 - RNA, 21 nt, Human
acagagccgggcacaaagcug

SEQ ID NO: 13131 - RNA, 22 nt, Human
acagagcucccagccaucuccu

SEQ ID NO: 13132 - RNA, 22 nt, Human
acagagcuguacaugugccaug

SEQ ID NO: 13133 - RNA, 22 nt, Human
acagagcuguacuacuuacuga

SEQ ID NO: 13134 - RNA, 17 nt, Human
acagaggcaggagugga

SEQ ID NO: 13135 - RNA, 22 nt, Human
acagaggccccgugggagagcc

SEQ ID NO: 13136 - RNA, 22 nt, Human
acagaggccucggccugcccag

SEQ ID NO: 13137 - RNA, 19 nt, Human
acagagggcaacugagaaa

SEQ ID NO: 13138 - RNA, 22 nt, Human
acagaggucauggagaguucuc

SEQ ID NO: 13139 - RNA, 22 nt, Human
acagagguguuccagaccuagg

SEQ ID NO: 13140 - RNA, 22 nt, Human
acagagguuaggauggguugua

SEQ ID NO: 13141 - RNA, 22 nt, Human
acagaguaggugcugucgacug

SEQ ID NO: 13142 - RNA, 22 nt, Human
acagagucauaagcggagcucg

SEQ ID NO: 13143 - RNA, 22 nt, Human
acagaguccuagcugcaaagaa

SEQ ID NO: 13144 - RNA, 17 nt, Human
acagagugucccgcagu

SEQ ID NO: 13145 - RNA, 22 nt, Human
acagaguuagcagaaaguugga

SEQ ID NO: 13146 - RNA, 22 nt, Human
acagaguuguaaacauuuacca

SEQ ID NO: 13147 - RNA, 22 nt, Human
acagauaaaaguuguuuaaaau

SEQ ID NO: 13148 - RNA, 22 nt, Human
acagauaaagaaacaaucacag

SEQ ID NO: 13149 - RNA, 22 nt, Human
acagauaaggcaguuaagaguu

SEQ ID NO: 13150 - RNA, 22 nt, Human
acagauacagggacuugguauu

SEQ ID NO: 13151 - RNA, 20 nt, Human
acagauaccagggacauggg

SEQ ID NO: 13152 - RNA, 20 nt, Human
acagauacccugugcuggug

SEQ ID NO: 13153 - RNA, 22 nt, Human
acagauacucagcucuaugcuu

SEQ ID NO: 13154 - RNA, 21 nt, Human
acagauauuucauugaacauu

SEQ ID NO: 13155 - RNA, 22 nt, Human
acagaucaccuguuagccaaaa

SEQ ID NO: 13156 - RNA, 22 nt, Human
acagaugaauuuauggauggaa

SEQ ID NO: 13157 - RNA, 22 nt, Human
acagaugaggcccaucagucug

SEQ ID NO: 13158 - RNA, 22 nt, Human
acagaugauuuuuaugaaaaca

SEQ ID NO: 13159 - RNA, 22 nt, Human
acagaugcaaggaaaugauugc

SEQ ID NO: 13160 - RNA, 22 nt, Human
acagaugcgcuugguugccaga

SEQ ID NO: 13161 - RNA, 22 nt, Human
acagaugcuuacuggugguucc

SEQ ID NO: 13162 - RNA, 19 nt, Human
acagaugcuuuugcugccc

SEQ ID NO: 13163 - RNA, 22 nt, Human
acagauggggcacaaagccaca

SEQ ID NO: 13164 - RNA, 22 nt, Human
acagauggugagccgcugaugu

SEQ ID NO: 13165 - RNA, 22 nt, Human
acagauguacacucauauauaa

SEQ ID NO: 13166 - RNA, 21 nt, Human
acagaugugauaugcagucuu

SEQ ID NO: 13167 - RNA, 21 nt, Human
acagauuagcacaaugcaggc

SEQ ID NO: 13168 - RNA, 22 nt, Human
acagauuauggauauaugugga

SEQ ID NO: 13169 - RNA, 22 nt, Human
acagauuuggcccagccaaugc

SEQ ID NO: 13170 - RNA, 22 nt, Human
acagcaagccagcuugucacug

SEQ ID NO: 13171 - RNA, 22 nt, Human
acagcaauuuugugcacaagug

SEQ ID NO: 13172 - RNA, 22 nt, Human
acagcacaggaguugaaugggc

SEQ ID NO: 13173 - RNA, 21 nt, Human
acagcagacaggcuuaggacc

SEQ ID NO: 13174 - RNA, 22 nt, Human
acagcagaccccagugccaugg

SEQ ID NO: 13175 - RNA, 22 nt, Human
acagcagagacacucaggaggc

SEQ ID NO: 13176 - RNA, 22 nt, Human
acagcagagccuagcuuaaucu

SEQ ID NO: 13177 - RNA, 22 nt, Human
acagcagagccugguacuuacu

SEQ ID NO: 13178 - RNA, 22 nt, Human
acagcagaguaguuuuccaacu

SEQ ID NO: 13179 - RNA, 22 nt, Human
acagcagaguggagaugagcac

SEQ ID NO: 13180 - RNA, 22 nt, Human
acagcagaugacaacuauuuau

SEQ ID NO: 13181 - RNA, 22 nt, Human
acagcagccugcagcccugugu

SEQ ID NO: 13182 - RNA, 22 nt, Human
acagcagccuuguugguuucga

SEQ ID NO: 13183 - RNA, 22 nt, Human
acagcagcgugaaguguguuau

SEQ ID NO: 13184 - RNA, 22 nt, Human
acagcaggagccuucauaugcu

SEQ ID NO: 13185 - RNA, 22 nt, Human
acagcaggauuuggcgauguug

SEQ ID NO: 13186 - RNA, 22 nt, Human
acagcaggcacacaaggauaga

SEQ ID NO: 13187 - RNA, 22 nt, Human
acagcaggcaugaagaaauguu

SEQ ID NO: 13188 - RNA, 22 nt, Human
acugagccucucuucccaccuc

SEQ ID NO: 13189 - RNA, 22 nt, Human
acugagcucccugagggcaggc

SEQ ID NO: 13190 - RNA, 22 nt, Human
acugagcugugacaaugcuuaa

SEQ ID NO: 13191 - RNA, 22 nt, Human
acugagggacucccaccuggca

SEQ ID NO: 13192 - RNA, 22 nt, Human
acugaggucuaucaugagccag

SEQ ID NO: 13193 - RNA, 22 nt, Human
acugaggucucagguggggaag

SEQ ID NO: 13194 - RNA, 22 nt, Human
acugagguggggucugcuugga

SEQ ID NO: 13195 - RNA, 21 nt, Human
acugagguuagaugccuugcc

SEQ ID NO: 13196 - RNA, 22 nt, Human
acugaguguaggacuuugaguu

SEQ ID NO: 13197 - RNA, 22 nt, Human
acugaugucuggggcagagucu

SEQ ID NO: 13198 - RNA, 22 nt, Human
acugauguuaacccucucuucu

SEQ ID NO: 13199 - RNA, 22 nt, Human
acugauuaugcguacucucuac

SEQ ID NO: 13200 - RNA, 22 nt, Human
acugcaaacauaguacuugagc

SEQ ID NO: 13201 - RNA, 22 nt, Human
acugcaacaccuccuggguuca

SEQ ID NO: 13202 - RNA, 20 nt, Human
acugcaagucacuuuuaggg

SEQ ID NO: 13203 - RNA, 22 nt, Human
acugcacacacagaauuuaggg

SEQ ID NO: 13204 - RNA, 21 nt, Human
acugcacacuaugugaauuga

SEQ ID NO: 13205 - RNA, 22 nt, Human
acugcacagaugaagcuguaaa

SEQ ID NO: 13206 - RNA, 22 nt, Human
acugcaccuguguaccaagaug

SEQ ID NO: 13207 - RNA, 22 nt, Human
acugcagacucuacaguuauaa

SEQ ID NO: 13208 - RNA, 22 nt, Human
acugcagcaaagcccgugucuu

SEQ ID NO: 13209 - RNA, 22 nt, Human
acugcagccuugaacucugggc

SEQ ID NO: 13210 - RNA, 22 nt, Human
acugcaggaugugcuccuauug

SEQ ID NO: 13211 - RNA, 19 nt, Human
acugcagggaggaggugug

SEQ ID NO: 13212 - RNA, 22 nt, Human
acugcagggcauccuggccaag

SEQ ID NO: 13213 - RNA, 22 nt, Human
acugccagaaucauucaaggaa

SEQ ID NO: 13214 - RNA, 23 nt, Human
acugccagauugaagguuucuua

SEQ ID NO: 13215 - RNA, 22 nt, Human
acugccaguuguuuuguccagu

SEQ ID NO: 13216 - RNA, 22 nt, Human
acugccauugguucuggaaaau

SEQ ID NO: 13217 - RNA, 22 nt, Human
acugccauuuugaauaauuacu

SEQ ID NO: 13218 - RNA, 22 nt, Human
acugcccucccaucuauugcaa

SEQ ID NO: 13219 - RNA, 19 nt, Human
acugccugaggcucacagg

SEQ ID NO: 13220 - RNA, 22 nt, Human
acugccugccucugauucugca

SEQ ID NO: 13221 - RNA, 21 nt, Human
acugccugucuccauagucua

SEQ ID NO: 13222 - RNA, 22 nt, Human
acugccuucaaacagcgccacc

SEQ ID NO: 13223 - RNA, 22 nt, Human
acugccuuccaccuauggauga

SEQ ID NO: 13224 - RNA, 22 nt, Human
acugccuucuuggccuucaaaa

SEQ ID NO: 13225 - RNA, 22 nt, Human
acugccuucuuuaauccuaguu

SEQ ID NO: 13226 - RNA, 20 nt, Human
acugccuugguucaguaggu

SEQ ID NO: 13227 - RNA, 22 nt, Human
acugccuugucucuugccuguu

SEQ ID NO: 13228 - RNA, 22 nt, Human
acugcucacgcauuacuugagc

SEQ ID NO: 13229 - RNA, 22 nt, Human
acugcucucuuugcaggggcua

SEQ ID NO: 13230 - RNA, 22 nt, Human
acugcugcagguccagccccuu

SEQ ID NO: 13231 - RNA, 20 nt, Human
acugcuguagaccaucugca

SEQ ID NO: 13232 - RNA, 22 nt, Human
acugcuuuagaccuagagcucu

SEQ ID NO: 13233 - RNA, 22 nt, Human
acugcuuugcucugcccccagg

SEQ ID NO: 13234 - RNA, 22 nt, Human
acugcuuuuagaaaucuauaga

SEQ ID NO: 13235 - RNA, 22 nt, Human
acugcuuuucagagucugccug

SEQ ID NO: 13236 - RNA, 22 nt, Human
acuggaaaacacuacuacaugc

SEQ ID NO: 13237 - RNA, 22 nt, Human
acuggaaauugagaggucacug

SEQ ID NO: 13238 - RNA, 22 nt, Human
acuggacagaggaaauauggag

SEQ ID NO: 13239 - RNA, 22 nt, Human
acuggaguauuguuuaauacca

SEQ ID NO: 13240 - RNA, 16 nt, Human
acuggaguggggaugc

SEQ ID NO: 13241 - RNA, 20 nt, Human
acuggaguucaugcuaagag

SEQ ID NO: 13242 - RNA, 22 nt, Human
acuggaguucaugguaaaguca

SEQ ID NO: 13243 - RNA, 22 nt, Human
acuggaguuuuaaaggaacuug

SEQ ID NO: 13244 - RNA, 22 nt, Human
acuggaugaggggaaagagaca

SEQ ID NO: 13245 - RNA, 22 nt, Human
acuggauggugucaugagcagc

SEQ ID NO: 13246 - RNA, 22 nt, Human
acuggcagaacgugaugcgggu

SEQ ID NO: 13247 - RNA, 22 nt, Human
acuggcagagggaaaaccauuc

SEQ ID NO: 13248 - RNA, 22 nt, Human
acuggcagccacaacuggcagg

SEQ ID NO: 13249 - RNA, 22 nt, Human
acuggcagguccaucgcccuuu

SEQ ID NO: 13250 - RNA, 22 nt, Human
acuggcaguggcagcagaaaga

SEQ ID NO: 13251 - RNA, 22 nt, Human
acuggcccgggagcagaggccu

SEQ ID NO: 13252 - RNA, 22 nt, Human
acuggcccuggcugcuaggcug

SEQ ID NO: 13253 - RNA, 22 nt, Human
acuggccuaucagcaugagucu

SEQ ID NO: 13254 - RNA, 22 nt, Human
acuggcugaaguuuacuuuuug

SEQ ID NO: 13255 - RNA, 22 nt, Human
acuggcugaggaaguugccacu

SEQ ID NO: 13256 - RNA, 22 nt, Human
acuggcugaguugcuucagcaa

SEQ ID NO: 13257 - RNA, 21 nt, Human
acuggcugccaugauccaggg

SEQ ID NO: 13258 - RNA, 22 nt, Human
acuggcugcgaucuuggcgcuu

SEQ ID NO: 13259 - RNA, 22 nt, Human
acuggcuggacucugaccucuu

SEQ ID NO: 13260 - RNA, 22 nt, Human
acuggcuggccacacccuggua

SEQ ID NO: 13261 - RNA, 21 nt, Human
acuggcugucuuccuacuggu

SEQ ID NO: 13262 - RNA, 22 nt, Human
acuggcugugcagagggcagua

SEQ ID NO: 13263 - RNA, 22 nt, Human
acuggcuucagggggaaagucc

SEQ ID NO: 13264 - RNA, 22 nt, Human
acuggcuugugagacaaugccu

SEQ ID NO: 13265 - RNA, 22 nt, Human
acugggaaauugcccuaguucu

SEQ ID NO: 13266 - RNA, 22 nt, Human
acugggaagauggaggcaagca

SEQ ID NO: 13267 - RNA, 22 nt, Human
acugggaaucucaggaacaugg

SEQ ID NO: 13268 - RNA, 22 nt, Human
acugggaauggagccugggccu

SEQ ID NO: 13269 - RNA, 22 nt, Human
acugggagaaacugacaccuua

SEQ ID NO: 13270 - RNA, 22 nt, Human
acugggcaaggauaugaugggu

SEQ ID NO: 13271 - RNA, 22 nt, Human
acugggcaucccauggcagagc

SEQ ID NO: 13272 - RNA, 22 nt, Human
acugggccaacuauuuguucua

SEQ ID NO: 13273 - RNA, 22 nt, Human
acugggccacauagaccugcug

SEQ ID NO: 13274 - RNA, 18 nt, Human
acugggccagcaggcagg

SEQ ID NO: 13275 - RNA, 20 nt, Human
acugggccuaggggaggcau

SEQ ID NO: 13276 - RNA, 22 nt, Human
acugggccuguacagagaaaac

SEQ ID NO: 13277 - RNA, 22 nt, Human
acugggcuccaaggaccuggag

SEQ ID NO: 13278 - RNA, 19 nt, Human
acugggcuuguccucgugg

SEQ ID NO: 13279 - RNA, 22 nt, Human
acuggggagagucaugccagca

SEQ ID NO: 13280 - RNA, 22 nt, Human
acuggggagugguuuugggaag

SEQ ID NO: 13281 - RNA, 22 nt, Human
acuggggcaggaaaguaugcug

SEQ ID NO: 13282 - RNA, 22 nt, Human
acuggggcagugggcagugguu

SEQ ID NO: 13283 - RNA, 20 nt, Human
acugguggacuguucauuga

SEQ ID NO: 13284 - RNA, 22 nt, Human
acugguggcuuucagacagaaa

SEQ ID NO: 13285 - RNA, 22 nt, Human
acugguguugauuuggaagggg

SEQ ID NO: 13286 - RNA, 22 nt, Human
acuguaaagagguguaucuuua

SEQ ID NO: 13287 - RNA, 22 nt, Human
acuguaaagcuuuucucaugcg

SEQ ID NO: 13288 - RNA, 22 nt, Human
acuguaaauuuugguugcaggu

SEQ ID NO: 13289 - RNA, 22 nt, Human
acuguaaccaguguggugagag

SEQ ID NO: 13290 - RNA, 22 nt, Human
acuguaauuggauugucugacu

SEQ ID NO: 13291 - RNA, 22 nt, Human
acuguacacacuucucugucuu

SEQ ID NO: 13292 - RNA, 22 nt, Human
acuguaccucaaacucuggaac

SEQ ID NO: 13293 - RNA, 22 nt, Human
acuguacucuucuagccaucug

SEQ ID NO: 13294 - RNA, 22 nt, Human
acuguacuguguauuguagaau

SEQ ID NO: 13295 - RNA, 22 nt, Human
acuguacuuuucuuggcuagau

SEQ ID NO: 13296 - RNA, 22 nt, Human
acuguagagaaucugagaaaaa

SEQ ID NO: 13297 - RNA, 22 nt, Human
acauugcaauaauaauucucuu

SEQ ID NO: 13298 - RNA, 22 nt, Human
acauuguaagcauauuagcuga

SEQ ID NO: 13299 - RNA, 22 nt, Human
acauuguacucuuagcguuguu

SEQ ID NO: 13300 - RNA, 22 nt, Human
acauuguaguuguucugcagca

SEQ ID NO: 13301 - RNA, 22 nt, Human
acauuguauaaugauuaucaca

SEQ ID NO: 13302 - RNA, 22 nt, Human
acauuguauacagacuuaguca

SEQ ID NO: 13303 - RNA, 23 nt, Human
acauuguucaaugaaaguuagga

SEQ ID NO: 13304 - RNA, 22 nt, Human
acauuguucacaggggcuucuc

SEQ ID NO: 13305 - RNA, 22 nt, Human
acauuguugccuagccaugagu

SEQ ID NO: 13306 - RNA, 22 nt, Human
acauuguuguuugcagcacagg

SEQ ID NO: 13307 - RNA, 22 nt, Human
acauuguuucugaccaugauga

SEQ ID NO: 13308 - RNA, 22 nt, Human
acauuuaaccuuugaggaacug

SEQ ID NO: 13309 - RNA, 22 nt, Human
acauuuaccuaguuaagucaau

SEQ ID NO: 13310 - RNA, 18 nt, Human
acauuuaggagagucaau

SEQ ID NO: 13311 - RNA, 22 nt, Human
acauuuauauaacucacuagga

SEQ ID NO: 13312 - RNA, 22 nt, Human
acauuuauuacucagguuguug

SEQ ID NO: 13313 - RNA, 22 nt, Human
acauuuauuuucagcugggaaa

SEQ ID NO: 13314 - RNA, 22 nt, Human
acauuuauuuuggcacggcaca

SEQ ID NO: 13315 - RNA, 22 nt, Human
acauuucagugagcuauugaag

SEQ ID NO: 13316 - RNA, 23 nt, Human
acauuucauauaaaagggaucag

SEQ ID NO: 13317 - RNA, 22 nt, Human
acauuucauguuuuccagagca

SEQ ID NO: 13318 - RNA, 22 nt, Human
acauuucauuugcaguauggau

SEQ ID NO: 13319 - RNA, 22 nt, Human
acauuuccuaacguauacacug

SEQ ID NO: 13320 - RNA, 22 nt, Human
acauuucucaucuaguagagua

SEQ ID NO: 13321 - RNA, 22 nt, Human
acauuucucauucuccccuaac

SEQ ID NO: 13322 - RNA, 22 nt, Human
acauuucucuugaugucucuau

SEQ ID NO: 13323 - RNA, 22 nt, Human
acauuucugcaucucagagcua

SEQ ID NO: 13324 - RNA, 22 nt, Human
acauuucugucuuagggacugu

SEQ ID NO: 13325 - RNA, 22 nt, Human
acauuucuuccacaugcugcug

SEQ ID NO: 13326 - RNA, 22 nt, Human
acauuucuugaugccucuguga

SEQ ID NO: 13327 - RNA, 22 nt, Human
acauuucuuucuauucaguagc

SEQ ID NO: 13328 - RNA, 22 nt, Human
acauuugaaaugccaugugagg

SEQ ID NO: 13329 - RNA, 20 nt, Human
acauuugaagucgcauuucu

SEQ ID NO: 13330 - RNA, 22 nt, Human
acauuugacuacauuuauauau

SEQ ID NO: 13331 - RNA, 22 nt, Human
acauuugacuguagauacuugc

SEQ ID NO: 13332 - RNA, 22 nt, Human
acauuugagcaucuacuaagug

SEQ ID NO: 13333 - RNA, 22 nt, Human
acauuugauaauuauaaagaca

SEQ ID NO: 13334 - RNA, 22 nt, Human
acauuuggcaagaaagagaaac

SEQ ID NO: 13335 - RNA, 22 nt, Human
acauuuggcaucuuguaacacu

SEQ ID NO: 13336 - RNA, 22 nt, Human
acauuuguacauuggcaugucu

SEQ ID NO: 13337 - RNA, 22 nt, Human
acauuugucuuccuccucagug

SEQ ID NO: 13338 - RNA, 22 nt, Human
acauuugucuucuuucagauua

SEQ ID NO: 13339 - RNA, 22 nt, Human
acauuugugcacaugugcaugg

SEQ ID NO: 13340 - RNA, 22 nt, Human
acugcccauuaaaggugcuuug

SEQ ID NO: 13341 - RNA, 22 nt, Human
acugcccauuaugguagucacu

SEQ ID NO: 13342 - RNA, 22 nt, Human
acugcccuggcaccacacaugc

SEQ ID NO: 13343 - RNA, 22 nt, Human
acugcccuguaacugccaggua

SEQ ID NO: 13344 - RNA, 19 nt, Human
acugccugcagguguuggg

SEQ ID NO: 13345 - RNA, 22 nt, Human
acugccuggcagagguuugcaa

SEQ ID NO: 13346 - RNA, 22 nt, Human
acugccuggccuggccucacug

SEQ ID NO: 13347 - RNA, 22 nt, Human
acugccuguagcccugagaugu

SEQ ID NO: 13348 - RNA, 22 nt, Human
acugccugugcacuggucuuuu

SEQ ID NO: 13349 - RNA, 23 nt, Human
acugccugugccgaucucucuca

SEQ ID NO: 13350 - RNA, 22 nt, Human
acugccuguuuggcauggcccc

SEQ ID NO: 13351 - RNA, 22 nt, Human
acugccuuagaacaaagcagga

SEQ ID NO: 13352 - RNA, 22 nt, Human
acugccuuauaauaugucaaca

SEQ ID NO: 13353 - RNA, 22 nt, Human
acugccuuuuccauuacuuaau

SEQ ID NO: 13354 - RNA, 22 nt, Human
acugcuaaaucuccaucgauua

SEQ ID NO: 13355 - RNA, 22 nt, Human
acugcuauuuuauaacagaaga

SEQ ID NO: 13356 - RNA, 22 nt, Human
acugcugauauaagaaaagauu

SEQ ID NO: 13357 - RNA, 22 nt, Human
acugcugauuauugaaguagag

SEQ ID NO: 13358 - RNA, 22 nt, Human
acugcuggaaacccagaauggu

SEQ ID NO: 13359 - RNA, 22 nt, Human
acugcuggcaugcauauacaaa

SEQ ID NO: 13360 - RNA, 22 nt, Human
acugcuggggcucauucaucuc

SEQ ID NO: 13361 - RNA, 22 nt, Human
acugcugugaucugauguaauu

SEQ ID NO: 13362 - RNA, 22 nt, Human
acugcuuacaaaaggaaagaau

SEQ ID NO: 13363 - RNA, 22 nt, Human
acugcuuccugagaaaucaaca

SEQ ID NO: 13364 - RNA, 22 nt, Human
acugcuuccuggauggccagca

SEQ ID NO: 13365 - RNA, 20 nt, Human
acugcuucuuucucugaccu

SEQ ID NO: 13366 - RNA, 16 nt, Human
acugcuuuucauaaga

SEQ ID NO: 13367 - RNA, 22 nt, Human
acuggaaaaccacugaaaugag

SEQ ID NO: 13368 - RNA, 22 nt, Human
acuggaaauaaauuuugaaugu

SEQ ID NO: 13369 - RNA, 22 nt, Human
acuggaaaugagaugauaucag

SEQ ID NO: 13370 - RNA, 22 nt, Human
acuggaagccaguugacaauca

SEQ ID NO: 13371 - RNA, 22 nt, Human
acuggaaugaaguuaaucugau

SEQ ID NO: 13372 - RNA, 23 nt, Human
acuggacagaguggacgaggcug

SEQ ID NO: 13373 - RNA, 22 nt, Human
acuggacuccccaagggccagg

SEQ ID NO: 13374 - RNA, 22 nt, Human
acuggacucuggagguuucgua

SEQ ID NO: 13375 - RNA, 18 nt, Human
acuggagcauuagcagcu

SEQ ID NO: 13376 - RNA, 20 nt, Human
acuggagccaucucagccua

SEQ ID NO: 13377 - RNA, 22 nt, Human
acuggagcccguggaggcgcag

SEQ ID NO: 13378 - RNA, 22 nt, Human
acuggagcugagagcaugggua

SEQ ID NO: 13379 - RNA, 22 nt, Human
acuggaggggaaaaugguagua

SEQ ID NO: 13380 - RNA, 22 nt, Human
acuggaguagaucugacugagu

SEQ ID NO: 13381 - RNA, 22 nt, Human
acuggaguccagacccaagagg

SEQ ID NO: 13382 - RNA, 22 nt, Human
acuggagugaguaucgaugaac

SEQ ID NO: 13383 - RNA, 22 nt, Human
acuggaguugauuacauaaaac

SEQ ID NO: 13384 - RNA, 22 nt, Human
acuggaguugggucaagauucu

SEQ ID NO: 13385 - RNA, 22 nt, Human
acuggaucuaauugguuauagu

SEQ ID NO: 13386 - RNA, 22 nt, Human
acuggauuccauugugcaaaga

SEQ ID NO: 13387 - RNA, 22 nt, Human
acuggauucucuuacacagaug

SEQ ID NO: 13388 - RNA, 22 nt, Human
acuggauugggaaaguacuuca

SEQ ID NO: 13389 - RNA, 19 nt, Human
acuggcacacaggggcugc

SEQ ID NO: 13390 - RNA, 22 nt, Human
acuggcacuauguuggagaaau

SEQ ID NO: 13391 - RNA, 22 nt, Human
acuggcagagacccugauggcc

SEQ ID NO: 13392 - RNA, 22 nt, Human
acuggcagaggauagcacuaau

SEQ ID NO: 13393 - RNA, 22 nt, Human
acuggcaggcugcuggccggcg

SEQ ID NO: 13394 - RNA, 22 nt, Human
acuggcagggggagccccgaga

SEQ ID NO: 13395 - RNA, 19 nt, Human
acuggcaguuucugcaugg

SEQ ID NO: 13396 - RNA, 22 nt, Human
acuggcaucccacugguacagg

SEQ ID NO: 13397 - RNA, 22 nt, Human
acuggcaucuguggguagaggc

SEQ ID NO: 13398 - RNA, 22 nt, Human
acuggccaggcagcaguagcuu

SEQ ID NO: 13399 - RNA, 22 nt, Human
acuggccaugaacuugggaucu

SEQ ID NO: 13400 - RNA, 22 nt, Human
acuggcccuugauugcaucagc

SEQ ID NO: 13401 - RNA, 22 nt, Human
acuggcugaaaguaaagaacac

SEQ ID NO: 13402 - RNA, 22 nt, Human
acuggcugaucaccugccucag

SEQ ID NO: 13403 - RNA, 22 nt, Human
acuggcuugaaguagauucaaa

SEQ ID NO: 13404 - RNA, 22 nt, Human
acuggcuuggcaggaggaagau

SEQ ID NO: 13405 - RNA, 22 nt, Human
acuggcuuugagggaauagcua

SEQ ID NO: 13406 - RNA, 22 nt, Human
accucacaagucucugucagcu

SEQ ID NO: 13407 - RNA, 22 nt, Human
accucagaggaggcuccuggcu

SEQ ID NO: 13408 - RNA, 22 nt, Human
accucaguucaauucaguuaga

SEQ ID NO: 13409 - RNA, 22 nt, Human
accucccugccucuuggcguca

SEQ ID NO: 13410 - RNA, 20 nt, Human
accuccuggaagcaggugcc

SEQ ID NO: 13411 - RNA, 21 nt, Human
accuccuggcauccuguuccc

SEQ ID NO: 13412 - RNA, 22 nt, Human
accuccuggcugcucauggaac

SEQ ID NO: 13413 - RNA, 22 nt, Human
accuccuggcuuaucauggaca

SEQ ID NO: 13414 - RNA, 22 nt, Human
accucuaaaaaauuagaagccu

SEQ ID NO: 13415 - RNA, 22 nt, Human
accucucaggucuuccucauau

SEQ ID NO: 13416 - RNA, 22 nt, Human
accucucugggccugcuuccug

SEQ ID NO: 13417 - RNA, 22 nt, Human
accucucuuguagcugcuggug

SEQ ID NO: 13418 - RNA, 19 nt, Human
accucugagaaugccaguc

SEQ ID NO: 13419 - RNA, 22 nt, Human
accucugcaacccuggaauggg

SEQ ID NO: 13420 - RNA, 20 nt, Human
accucugcaucaauccuuug

SEQ ID NO: 13421 - RNA, 22 nt, Human
accucugccacuuucuaacucu

SEQ ID NO: 13422 - RNA, 22 nt, Human
accucugcucaagaccccuccg

SEQ ID NO: 13423 - RNA, 22 nt, Human
accucuguauaguugccugugg

SEQ ID NO: 13424 - RNA, 22 nt, Human
accucuuugaaccucaguguga

SEQ ID NO: 13425 - RNA, 22 nt, Human
accugaauuuuggaugagcugu

SEQ ID NO: 13426 - RNA, 17 nt, Human
accugacaguacagugu

SEQ ID NO: 13427 - RNA, 22 nt, Human
accugagaccuaaucugacugu

SEQ ID NO: 13428 - RNA, 22 nt, Human
accugagacuugggaugggaau

SEQ ID NO: 13429 - RNA, 22 nt, Human
accugagccuagggagguugag

SEQ ID NO: 13430 - RNA, 22 nt, Human
accugagggagauuaggccuga

SEQ ID NO: 13431 - RNA, 22 nt, Human
accugccaagcaucaguggcag

SEQ ID NO: 13432 - RNA, 21 nt, Human
accugccacauugcagacuug

SEQ ID NO: 13433 - RNA, 22 nt, Human
accugccagugaauacuaucuu

SEQ ID NO: 13434 - RNA, 22 nt, Human
accugcccaugaaaauggggag

SEQ ID NO: 13435 - RNA, 22 nt, Human
accugcugugauucuaauuggc

SEQ ID NO: 13436 - RNA, 22 nt, Human
accugcuuuauuccuccugccu

SEQ ID NO: 13437 - RNA, 22 nt, Human
accuggaagugggugcuauggc

SEQ ID NO: 13438 - RNA, 22 nt, Human
accuggaaugggguugagagcu

SEQ ID NO: 13439 - RNA, 22 nt, Human
accuggaccugccaccuaugag

SEQ ID NO: 13440 - RNA, 22 nt, Human
accuggagcuuccaacucaacu

SEQ ID NO: 13441 - RNA, 22 nt, Human
accuggcauaagggcuugaguc

SEQ ID NO: 13442 - RNA, 22 nt, Human
accuggccauccagcuggcauc

SEQ ID NO: 13443 - RNA, 22 nt, Human
accuggcugguugugauuccca

SEQ ID NO: 13444 - RNA, 18 nt, Human
accuggcugugugagcug

SEQ ID NO: 13445 - RNA, 22 nt, Human
accuggcuucagagucuggcca

SEQ ID NO: 13446 - RNA, 20 nt, Human
accugggaaaaccuuuuccu

SEQ ID NO: 13447 - RNA, 22 nt, Human
accugggaacgcuuuguggagg

SEQ ID NO: 13448 - RNA, 22 nt, Human
accugggagagaggagccggcg

SEQ ID NO: 13449 - RNA, 20 nt, Human
accugggauuagauacccaa

SEQ ID NO: 13450 - RNA, 22 nt, Human
accugguuccuccucacugcug

SEQ ID NO: 13451 - RNA, 22 nt, Human
accugucaaguccagcgcaaca

SEQ ID NO: 13452 - RNA, 22 nt, Human
accugucaugucaauguucagu

SEQ ID NO: 13453 - RNA, 22 nt, Human
accuguggaucagauucuugua

SEQ ID NO: 13454 - RNA, 22 nt, Human
accuguguuucuguagugguca

SEQ ID NO: 13455 - RNA, 22 nt, Human
accuguguuuucccucaguuuc

SEQ ID NO: 13456 - RNA, 22 nt, Human
accuguuuaccugcaccuguuu

SEQ ID NO: 13457 - RNA, 22 nt, Human
accuguuuguguuuggacugca

SEQ ID NO: 13458 - RNA, 22 nt, Human
accuguuuuccuaucuagauug

SEQ ID NO: 13459 - RNA, 22 nt, Human
accuuaaacuuuacagccaagu

SEQ ID NO: 13460 - RNA, 22 nt, Human
agaagagaaauagugccacugu

SEQ ID NO: 13461 - RNA, 22 nt, Human
agaagagccuggggaccauggc

SEQ ID NO: 13462 - RNA, 22 nt, Human
agaagaggggugucccuguggc

SEQ ID NO: 13463 - RNA, 22 nt, Human
agaagaugucacugcagacagc

SEQ ID NO: 13464 - RNA, 22 nt, Human
agaagauuauuagagacuuugu

SEQ ID NO: 13465 - RNA, 22 nt, Human
agaagcaaggucugucaguaua

SEQ ID NO: 13466 - RNA, 19 nt, Human
agaagcaccagucauuccu

SEQ ID NO: 13467 - RNA, 22 nt, Human
agaagcacuacgauaggugguc

SEQ ID NO: 13468 - RNA, 22 nt, Human
agaagcagaaggaagcagggcc

SEQ ID NO: 13469 - RNA, 22 nt, Human
agaagcagcaagcccuucaaag

SEQ ID NO: 13470 - RNA, 23 nt, Human
agaagcagcuucuggaguaucgg

SEQ ID NO: 13471 - RNA, 22 nt, Human
agaagcauuauuuaauuuuacu

SEQ ID NO: 13472 - RNA, 20 nt, Human
agaagcauucaaagaaaacu

SEQ ID NO: 13473 - RNA, 22 nt, Human
agaagcauuggaccaggggccc

SEQ ID NO: 13474 - RNA, 22 nt, Human
agaagccaacagggcaggagag

SEQ ID NO: 13475 - RNA, 22 nt, Human
agaagccaauucugugugaguc

SEQ ID NO: 13476 - RNA, 22 nt, Human
agaagccacaggccucgucugg

SEQ ID NO: 13477 - RNA, 22 nt, Human
agaagccagaggcaguggguac

SEQ ID NO: 13478 - RNA, 22 nt, Human
agaagccauguuuaguaggaug

SEQ ID NO: 13479 - RNA, 22 nt, Human
agaagcguuccauuugaugggu

SEQ ID NO: 13480 - RNA, 22 nt, Human
agaagcucggguaagcuccauu

SEQ ID NO: 13481 - RNA, 22 nt, Human
agaagcugacagaugcagcagg

SEQ ID NO: 13482 - RNA, 23 nt, Human
agaagcugggagccuggggaugg

SEQ ID NO: 13483 - RNA, 22 nt, Human
agaagcugugguaugaaaugug

SEQ ID NO: 13484 - RNA, 22 nt, Human
agaaggaaggaagcauucuguu

SEQ ID NO: 13485 - RNA, 18 nt, Human
agaaggagcuaugggcag

SEQ ID NO: 13486 - RNA, 21 nt, Human
agaaggcaaaagcagacaucu

SEQ ID NO: 13487 - RNA, 22 nt, Human
agaaggcacagugcugcuaaga

SEQ ID NO: 13488 - RNA, 20 nt, Human
agaaggcaggagacaaaagg

SEQ ID NO: 13489 - RNA, 22 nt, Human
agaaggccaagaagaagccuau

SEQ ID NO: 13490 - RNA, 22 nt, Human
agaaggcccuguguggucugag

SEQ ID NO: 13491 - RNA, 22 nt, Human
agaaggccuaacuugggggcaa

SEQ ID NO: 13492 - RNA, 22 nt, Human
agaaggcuaaagaaacagauug

SEQ ID NO: 13493 - RNA, 22 nt, Human
agaaggcuagagacuugcccaa

SEQ ID NO: 13494 - RNA, 22 nt, Human
agaaggcuuaaaacauggaaua

SEQ ID NO: 13495 - RNA, 22 nt, Human
agaagggagagaaaguugguua

SEQ ID NO: 13496 - RNA, 23 nt, Human
agaaggugggccugcugaguuau

SEQ ID NO: 13497 - RNA, 22 nt, Human
agaaguaucuugggaaggcacu

SEQ ID NO: 13498 - RNA, 21 nt, Human
agaagucaauugaacugaaau

SEQ ID NO: 13499 - RNA, 20 nt, Human
agaagucagcucagaaguga

SEQ ID NO: 13500 - RNA, 22 nt, Human
agaagucauuuauguuagauga

SEQ ID NO: 13501 - RNA, 22 nt, Human
agaagucuggaauuccugcagg

SEQ ID NO: 13502 - RNA, 22 nt, Human
agaagugcuccagugaguuggg

SEQ ID NO: 13503 - RNA, 23 nt, Human
agaaguggaauggccgugggguc

SEQ ID NO: 13504 - RNA, 22 nt, Human
agaagugucagugcaggcagcu

SEQ ID NO: 13505 - RNA, 22 nt, Human
agaaguuguucaagguggugag

SEQ ID NO: 13506 - RNA, 22 nt, Human
agaaguuuaaccaggugcuacu

SEQ ID NO: 13507 - RNA, 22 nt, Human
agaaguuucacaauggguuuua

SEQ ID NO: 13508 - RNA, 22 nt, Human
agaaguuucuuugaacguguag

SEQ ID NO: 13509 - RNA, 22 nt, Human
agaaguuuuguugaauguguga

SEQ ID NO: 13510 - RNA, 22 nt, Human
agaauaaccaguguuucacagu

SEQ ID NO: 13511 - RNA, 22 nt, Human
agaauaauacugaaaugcugaa

SEQ ID NO: 13512 - RNA, 22 nt, Human
agaauaaucacugaaguucaaa

SEQ ID NO: 13513 - RNA, 21 nt, Human
agaauaaugguaucauuugcu

SEQ ID NO: 13514 - RNA, 22 nt, Human
agaauacaguaugcaaaaagau

SEQ ID NO: 13515 - RNA, 22 nt, Human
accuccaggaagcucuugguac

SEQ ID NO: 13516 - RNA, 22 nt, Human
accucccagaaaguuuugcagg

SEQ ID NO: 13517 - RNA, 22 nt, Human
accuccccgggagcagccuccu

SEQ ID NO: 13518 - RNA, 22 nt, Human
accucccuaacccuuuuggcuc

SEQ ID NO: 13519 - RNA, 22 nt, Human
accucccuggccuucugauucc

SEQ ID NO: 13520 - RNA, 22 nt, Human
accuccugaugagaguaaagga

SEQ ID NO: 13521 - RNA, 22 nt, Human
accucugaagggccaagcaaug

SEQ ID NO: 13522 - RNA, 19 nt, Human
accucugcagagauguuua

SEQ ID NO: 13523 - RNA, 22 nt, Human
accucugggaaaaguauggaaa

SEQ ID NO: 13524 - RNA, 22 nt, Human
accugaaaauuauuauuuccgc

SEQ ID NO: 13525 - RNA, 22 nt, Human
accugaaacucaacuuuaucuc

SEQ ID NO: 13526 - RNA, 22 nt, Human
accugaauccccagggccuucc

SEQ ID NO: 13527 - RNA, 22 nt, Human
accugagcaugccaggagagug

SEQ ID NO: 13528 - RNA, 22 nt, Human
accugaggccuccccagcagac

SEQ ID NO: 13529 - RNA, 20 nt, Human
accugaggucccuauggucu

SEQ ID NO: 13530 - RNA, 18 nt, Human
accugauuggcgcagccc

SEQ ID NO: 13531 - RNA, 22 nt, Human
accugcagccacuucucuccuu

SEQ ID NO: 13532 - RNA, 19 nt, Human
accugcaguaauaauuccu

SEQ ID NO: 13533 - RNA, 22 nt, Human
accugcccuuaacacugugugc

SEQ ID NO: 13534 - RNA, 22 nt, Human
accugccuaguugguucugccc

SEQ ID NO: 13535 - RNA, 22 nt, Human
accugccucagugcagcuggau

SEQ ID NO: 13536 - RNA, 22 nt, Human
accugccucuaagcagcaggug

SEQ ID NO: 13537 - RNA, 18 nt, Human
accugccuguucuucucu

SEQ ID NO: 13538 - RNA, 22 nt, Human
accugccuucucaaggacauga

SEQ ID NO: 13539 - RNA, 22 nt, Human
accugcucaacuggcuucucgc

SEQ ID NO: 13540 - RNA, 22 nt, Human
accugcugucuugggggaaugc

SEQ ID NO: 13541 - RNA, 22 nt, Human
accugcuugagccaguaugaga

SEQ ID NO: 13542 - RNA, 17 nt, Human
accuggagaccaagucc

SEQ ID NO: 13543 - RNA, 22 nt, Human
accuggagauccauggugucga

SEQ ID NO: 13544 - RNA, 22 nt, Human
accuggagggaaguucugacuu

SEQ ID NO: 13545 - RNA, 22 nt, Human
accuggcacagaguaugcucuc

SEQ ID NO: 13546 - RNA, 22 nt, Human
accuggccaguggggccgcgcu

SEQ ID NO: 13547 - RNA, 19 nt, Human
accuggcuggcgcacuugu

SEQ ID NO: 13548 - RNA, 22 nt, Human
accuggcuucuaaucauggcuc

SEQ ID NO: 13549 - RNA, 20 nt, Human
accuggcuugggggaggagu

SEQ ID NO: 13550 - RNA, 22 nt, Human
accuggcuuguuucuaccuccu

SEQ ID NO: 13551 - RNA, 22 nt, Human
accugggaaaaggaguggccau

SEQ ID NO: 13552 - RNA, 22 nt, Human
accugggaggcagagguugcag

SEQ ID NO: 13553 - RNA, 22 nt, Human
accugggagucacaccugagaa

SEQ ID NO: 13554 - RNA, 22 nt, Human
accugggucugguguugggacg

SEQ ID NO: 13555 - RNA, 22 nt, Human
accuguuuagaaagcuuaugag

SEQ ID NO: 13556 - RNA, 22 nt, Human
accuguuuguguccauuaguga

SEQ ID NO: 13557 - RNA, 22 nt, Human
accuguuuguuaagaaagcuuc

SEQ ID NO: 13558 - RNA, 22 nt, Human
accuguuuuagucuuuaaucau

SEQ ID NO: 13559 - RNA, 22 nt, Human
accuuaaaacugacacauggag

SEQ ID NO: 13560 - RNA, 22 nt, Human
accuuaaaggccgaaguaaaga

SEQ ID NO: 13561 - RNA, 22 nt, Human
accuuagaaaaucaaaauuaga

SEQ ID NO: 13562 - RNA, 22 nt, Human
accuuagaaagugacaaacgaa

SEQ ID NO: 13563 - RNA, 22 nt, Human
accuuauuuugaaauagauugu

SEQ ID NO: 13564 - RNA, 22 nt, Human
accuucaagaaacauuuccuug

SEQ ID NO: 13565 - RNA, 22 nt, Human
accuucaauuauuuuuguucca

SEQ ID NO: 13566 - RNA, 20 nt, Human
accuucaggaacuuaucagc

SEQ ID NO: 13567 - RNA, 22 nt, Human
accuucaggugagcacacagau

SEQ ID NO: 13568 - RNA, 22 nt, Human
accuugaacacaagaauuauug

SEQ ID NO: 13569 - RNA, 22 nt, Human
accuugaacccagcuugcugca

SEQ ID NO: 13570 - RNA, 20 nt, Human
accuugaacccgccagccau

SEQ ID NO: 13571 - RNA, 22 nt, Human
accuugaaggcagaggacaccu

SEQ ID NO: 13572 - RNA, 23 nt, Human
accuuggacuucccagcuuccag

SEQ ID NO: 13573 - RNA, 22 nt, Human
accuugggcaaccugcuccugc

SEQ ID NO: 13574 - RNA, 19 nt, Human
accuugggcaagugccuuc

SEQ ID NO: 13575 - RNA, 20 nt, Human
accuugggugagugacgguc

SEQ ID NO: 13576 - RNA, 22 nt, Human
accuuuauagcugauuaugaca

SEQ ID NO: 13577 - RNA, 22 nt, Human
accuuuaugauucacaauguau

SEQ ID NO: 13578 - RNA, 22 nt, Human
acucagaggaaaguugagauug

SEQ ID NO: 13579 - RNA, 22 nt, Human
acucagaggaccaaaaggaaag

SEQ ID NO: 13580 - RNA, 22 nt, Human
acucagaggcagcugcucaccc

SEQ ID NO: 13581 - RNA, 22 nt, Human
acucagaggggacugguguggu

SEQ ID NO: 13582 - RNA, 22 nt, Human
acucagaguagaaaauagguuc

SEQ ID NO: 13583 - RNA, 22 nt, Human
acucagaguuccugugcauagu

SEQ ID NO: 13584 - RNA, 22 nt, Human
acucagaguuugcguuccauac

SEQ ID NO: 13585 - RNA, 22 nt, Human
acucagaguuuuacccagagac

SEQ ID NO: 13586 - RNA, 22 nt, Human
acucagcuaaacucagucuaug

SEQ ID NO: 13587 - RNA, 22 nt, Human
acucagcugaugaagcacaagu

SEQ ID NO: 13588 - RNA, 23 nt, Human
acucagcuuugggagaugacuca

SEQ ID NO: 13589 - RNA, 22 nt, Human
acucaggaaauugagauaaugg

SEQ ID NO: 13590 - RNA, 22 nt, Human
acucaggaagaaagcagcuggu

SEQ ID NO: 13591 - RNA, 17 nt, Human
acucaggaucugggagu

SEQ ID NO: 13592 - RNA, 19 nt, Human
acucagggaaaggagaauu

SEQ ID NO: 13593 - RNA, 22 nt, Human
acucagugggcuugaugucgaa

SEQ ID NO: 13594 - RNA, 22 nt, Human
acucaucagccucuaggaaaga

SEQ ID NO: 13595 - RNA, 20 nt, Human
acucaucuacuccagacccu

SEQ ID NO: 13596 - RNA, 22 nt, Human
acucaucugccauuccuguacc

SEQ ID NO: 13597 - RNA, 22 nt, Human
acucaugauaugccuauaagau

SEQ ID NO: 13598 - RNA, 22 nt, Human
acucaugguagcacaggcugug

SEQ ID NO: 13599 - RNA, 22 nt, Human
acucaugucauguguucuuuac

SEQ ID NO: 13600 - RNA, 22 nt, Human
acuccacauuugaacacaguuc

SEQ ID NO: 13601 - RNA, 22 nt, Human
acuccagaauccuagggucagc

SEQ ID NO: 13602 - RNA, 22 nt, Human
acuccagagcucacaugucuaa

SEQ ID NO: 13603 - RNA, 22 nt, Human
acuccaggaaacuuaggggaaa

SEQ ID NO: 13604 - RNA, 22 nt, Human
acuccagggcuccaucccuugu

SEQ ID NO: 13605 - RNA, 22 nt, Human
acuccagggugacucugucuga

SEQ ID NO: 13606 - RNA, 22 nt, Human
acuccagguaggcacauugaca

SEQ ID NO: 13607 - RNA, 22 nt, Human
acuccaguuaccuuggcugagg

SEQ ID NO: 13608 - RNA, 22 nt, Human
acuccauacaauggcaggcugu

SEQ ID NO: 13609 - RNA, 23 nt, Human
acuccccagucucuucuugccaa

SEQ ID NO: 13610 - RNA, 22 nt, Human
acucccuuuucccguaaucuau

SEQ ID NO: 13611 - RNA, 22 nt, Human
acucccuuuucuacuucuaccc

SEQ ID NO: 13612 - RNA, 22 nt, Human
acuccugccacacagaugcugu

SEQ ID NO: 13613 - RNA, 22 nt, Human
acuccuggguuccggagauucu

SEQ ID NO: 13614 - RNA, 22 nt, Human
acuccuggguugcaguccucaa

SEQ ID NO: 13615 - RNA, 20 nt, Human
acuccugguaacuuuuguga

SEQ ID NO: 13616 - RNA, 17 nt, Human
acuccuggucugaaggg

SEQ ID NO: 13617 - RNA, 22 nt, Human
acuccuggugcugaugaagaga

SEQ ID NO: 13618 - RNA, 22 nt, Human
acuccugguucccaguugagau

SEQ ID NO: 13619 - RNA, 22 nt, Human
acucuaaauagauaaccaugca

SEQ ID NO: 13620 - RNA, 22 nt, Human
acucuaacuaauuaauaaagcc

SEQ ID NO: 13621 - RNA, 22 nt, Human
acucuaccaugccacuccauag

SEQ ID NO: 13622 - RNA, 22 nt, Human
acucuauaaagauaccucaauu

SEQ ID NO: 13623 - RNA, 22 nt, Human
acucucacuagcucugugaccu

SEQ ID NO: 13624 - RNA, 22 nt, Human
acucucccugcuauccacuucc

SEQ ID NO: 13625 - RNA, 22 nt, Human
agauauacagagaauuauucac

SEQ ID NO: 13626 - RNA, 22 nt, Human
agauaucuggaaaaaauguaug

SEQ ID NO: 13627 - RNA, 22 nt, Human
agauaucuguauuguuuccaau

SEQ ID NO: 13628 - RNA, 22 nt, Human
agauaugguuugcauaaauaag

SEQ ID NO: 13629 - RNA, 22 nt, Human
agauaugugcgucuuagauuga

SEQ ID NO: 13630 - RNA, 22 nt, Human
agauauguuaggcuuguucccu

SEQ ID NO: 13631 - RNA, 22 nt, Human
agauauucaaccaaacacuaau

SEQ ID NO: 13632 - RNA, 22 nt, Human
agauauuuaaaucagacaaaga

SEQ ID NO: 13633 - RNA, 22 nt, Human
agaucaaaucugggauuucuaa

SEQ ID NO: 13634 - RNA, 22 nt, Human
agaucacagucaauugcaaguu

SEQ ID NO: 13635 - RNA, 22 nt, Human
agaucagaaagccaauaucaua

SEQ ID NO: 13636 - RNA, 22 nt, Human
agaucagagaugcuaaaagagc

SEQ ID NO: 13637 - RNA, 22 nt, Human
agaucagaguggauugugcugc

SEQ ID NO: 13638 - RNA, 22 nt, Human
agaucagaucuccuuuugcauu

SEQ ID NO: 13639 - RNA, 22 nt, Human
agaucagauucugccuuuguga

SEQ ID NO: 13640 - RNA, 22 nt, Human
agaucaguuagauagcuugaug

SEQ ID NO: 13641 - RNA, 21 nt, Human
agaucauucuucugagcacuu

SEQ ID NO: 13642 - RNA, 22 nt, Human
agauccaggaugucccaaaaua

SEQ ID NO: 13643 - RNA, 21 nt, Human
agauccagugccauaaggccc

SEQ ID NO: 13644 - RNA, 22 nt, Human
agauccaucaucauauuuucua

SEQ ID NO: 13645 - RNA, 22 nt, Human
agaucccaaaucaccugcuuau

SEQ ID NO: 13646 - RNA, 22 nt, Human
agaucccaggauacuggccuau

SEQ ID NO: 13647 - RNA, 21 nt, Human
agaucccugaggagagcaucc

SEQ ID NO: 13648 - RNA, 22 nt, Human
agauccguggauuauaauuuag

SEQ ID NO: 13649 - RNA, 22 nt, Human
agauccuuaauuuaaucacauc

SEQ ID NO: 13650 - RNA, 22 nt, Human
agaucugaguaugauuugccug

SEQ ID NO: 13651 - RNA, 23 nt, Human
agaucugauguuaccaagaauug

SEQ ID NO: 13652 - RNA, 22 nt, Human
agaucuggaacugagguuuauu

SEQ ID NO: 13653 - RNA, 22 nt, Human
agaucuuaugaugcacagggca

SEQ ID NO: 13654 - RNA, 22 nt, Human
agaucuuuaaaaguuauuauua

SEQ ID NO: 13655 - RNA, 22 nt, Human
agaucuuuugguuauuauaaga

SEQ ID NO: 13656 - RNA, 22 nt, Human
agaugaaaauacgugacuuuaa

SEQ ID NO: 13657 - RNA, 22 nt, Human
agaugaaauuuguguugaguug

SEQ ID NO: 13658 - RNA, 22 nt, Human
agaugaagauaucugcaggggc

SEQ ID NO: 13659 - RNA, 22 nt, Human
agaugacuaacauaguauugcu

SEQ ID NO: 13660 - RNA, 22 nt, Human
agaugagggguagaaaggacuu

SEQ ID NO: 13661 - RNA, 22 nt, Human
agaugaugauaauugaaaggca

SEQ ID NO: 13662 - RNA, 22 nt, Human
agaugcauguuuaugucuuucc

SEQ ID NO: 13663 - RNA, 22 nt, Human
agaugcuauacauuguaagaca

SEQ ID NO: 13664 - RNA, 22 nt, Human
agaugcugaauuauugugcuuu

SEQ ID NO: 13665 - RNA, 22 nt, Human
agaugcugccucuccucacaag

SEQ ID NO: 13666 - RNA, 22 nt, Human
agaugcugucacacacacuguu

SEQ ID NO: 13667 - RNA, 22 nt, Human
agaugcugugucuguucccuug

SEQ ID NO: 13668 - RNA, 22 nt, Human
agaugcuuaaguuuucagugua

SEQ ID NO: 13669 - RNA, 22 nt, Human
agauggaaaauauagacagaga

SEQ ID NO: 13670 - RNA, 22 nt, Human
agauggaguggagaugaguaaa

SEQ ID NO: 13671 - RNA, 22 nt, Human
agauggauuucuuccagugaga

SEQ ID NO: 13672 - RNA, 22 nt, Human
agauggcagggguaccuggaag

SEQ ID NO: 13673 - RNA, 22 nt, Human
agauggcugggagcucuguuug

SEQ ID NO: 13674 - RNA, 22 nt, Human
agaugggccuucgagcaugccc

SEQ ID NO: 13675 - RNA, 22 nt, Human
agaugggcgcccuggacugagg

SEQ ID NO: 13676 - RNA, 22 nt, Human
agauggggcucaguguggaggc

SEQ ID NO: 13677 - RNA, 22 nt, Human
agauggguaacuggagucugcu

SEQ ID NO: 13678 - RNA, 22 nt, Human
agaugggucucccuuagcaccu

SEQ ID NO: 13679 - RNA, 16 nt, Human
agaugggugggucacu

SEQ ID NO: 13680 - RNA, 20 nt, Human
agauggguuaaagcuauggg

SEQ ID NO: 13681 - RNA, 22 nt, Human
agaugguccaucuauuuucuau

SEQ ID NO: 13682 - RNA, 20 nt, Human
agauggugaaggccagggag

SEQ ID NO: 13683 - RNA, 22 nt, Human
agauggugauagagcugggauu

SEQ ID NO: 13684 - RNA, 22 nt, Human
agaugguuaucuaagugaaaaa

SEQ ID NO: 13685 - RNA, 22 nt, Human
agaugguucagaauuauaaaga

SEQ ID NO: 13686 - RNA, 22 nt, Human
agaugguugguccauaggccua

SEQ ID NO: 13687 - RNA, 22 nt, Human
agauguaacgguagguggcauu

SEQ ID NO: 13688 - RNA, 22 nt, Human
agauguaguagugggucuuuua

SEQ ID NO: 13689 - RNA, 22 nt, Human
agauguggccggcuagggagag

SEQ ID NO: 13690 - RNA, 22 nt, Human
agaugugggugucaggcaguga

SEQ ID NO: 13691 - RNA, 22 nt, Human
agauguuuaaaaagaugacucu

SEQ ID NO: 13692 - RNA, 22 nt, Human
agauguuucaguaauuuaucuu

SEQ ID NO: 13693 - RNA, 21 nt, Human
agauguuucccccuuggcuuc

SEQ ID NO: 13694 - RNA, 22 nt, Human
agauguuuuguguauuucauca

SEQ ID NO: 13695 - RNA, 22 nt, Human
agauguuuuuccaggucuaauu

SEQ ID NO: 13696 - RNA, 21 nt, Human
agauuaaaaucugugagaagg

SEQ ID NO: 13697 - RNA, 20 nt, Human
agauuaggggcuuucuucuu

SEQ ID NO: 13698 - RNA, 22 nt, Human
agauuagguaugguuuaaguag

SEQ ID NO: 13699 - RNA, 21 nt, Human
agauuauaaagaaccuucuua

SEQ ID NO: 13700 - RNA, 22 nt, Human
agauuauuuaagacaggaacca

SEQ ID NO: 13701 - RNA, 22 nt, Human
agauucagaaaugaggagggcc

SEQ ID NO: 13702 - RNA, 22 nt, Human
agauucaggacuggccacagcc

SEQ ID NO: 13703 - RNA, 22 nt, Human
agauucaguuaaggcugguaga

SEQ ID NO: 13704 - RNA, 22 nt, Human
agauucauuauuaaugugaucu

SEQ ID NO: 13705 - RNA, 22 nt, Human
agauucauugcuuuaggcauug

SEQ ID NO: 13706 - RNA, 22 nt, Human
agauugauagauguuucuaaaa

SEQ ID NO: 13707 - RNA, 22 nt, Human
agauugcuaaugaaguucuuga

SEQ ID NO: 13708 - RNA, 22 nt, Human
agauugcuuuccaaaagcguug

SEQ ID NO: 13709 - RNA, 22 nt, Human
agauuggagauggaagaaaagu

SEQ ID NO: 13710 - RNA, 22 nt, Human
acugcucuguuuucauauguuu

SEQ ID NO: 13711 - RNA, 22 nt, Human
acugcugaccucaggucauccu

SEQ ID NO: 13712 - RNA, 22 nt, Human
acugcugauuaugaaagugaca

SEQ ID NO: 13713 - RNA, 22 nt, Human
acugcugauuuagcuuuguggg

SEQ ID NO: 13714 - RNA, 22 nt, Human
acugcuucuccaaugaauuaga

SEQ ID NO: 13715 - RNA, 22 nt, Human
acugcuuuaaaaaagcaagcuu

SEQ ID NO: 13716 - RNA, 22 nt, Human
acugcuuuaucugagaaguccu

SEQ ID NO: 13717 - RNA, 22 nt, Human
acugcuuuucuaagauucugug

SEQ ID NO: 13718 - RNA, 22 nt, Human
acuggaaaguugauuaugucca

SEQ ID NO: 13719 - RNA, 20 nt, Human
acuggacacugaggugagcu

SEQ ID NO: 13720 - RNA, 22 nt, Human
acuggacucacguauuccugag

SEQ ID NO: 13721 - RNA, 22 nt, Human
acuggagacugugucuuuugau

SEQ ID NO: 13722 - RNA, 22 nt, Human
acuggaguaaaggucacuugug

SEQ ID NO: 13723 - RNA, 22 nt, Human
acuggaguacaguggcgugaac

SEQ ID NO: 13724 - RNA, 22 nt, Human
acuggagucagggaaaaagugu

SEQ ID NO: 13725 - RNA, 22 nt, Human
acuggaguguuuggaggaugca

SEQ ID NO: 13726 - RNA, 22 nt, Human
acuggaguuauuauuugcagcu

SEQ ID NO: 13727 - RNA, 20 nt, Human
acuggaucuggcuggagcug

SEQ ID NO: 13728 - RNA, 19 nt, Human
acuggcaaaaaagguuaau

SEQ ID NO: 13729 - RNA, 22 nt, Human
acuggcaauagcaaaugcuugg

SEQ ID NO: 13730 - RNA, 20 nt, Human
acuggcacugguaggugugg

SEQ ID NO: 13731 - RNA, 22 nt, Human
acuggcagaacuggugauuguc

SEQ ID NO: 13732 - RNA, 22 nt, Human
acuggcagaauugaauaguugu

SEQ ID NO: 13733 - RNA, 22 nt, Human
acuggcagcagcagcccuuggg

SEQ ID NO: 13734 - RNA, 17 nt, Human
caguuggagacaagucc

SEQ ID NO: 13735 - RNA, 22 nt, Human
caguuggugaugaggcuaguag

SEQ ID NO: 13736 - RNA, 22 nt, Human
caguuguccuuuguaccaaguu

SEQ ID NO: 13737 - RNA, 20 nt, Human
caguuuaacuuugagcaguu

SEQ ID NO: 13738 - RNA, 22 nt, Human
caguuuaagacaagggggugua

SEQ ID NO: 13739 - RNA, 22 nt, Human
caguuuaaguagaacugagaau

SEQ ID NO: 13740 - RNA, 22 nt, Human
caguuuaaguguguugaaggua

SEQ ID NO: 13741 - RNA, 22 nt, Human
caguuuaccuauauguaaauuu

SEQ ID NO: 13742 - RNA, 22 nt, Human
caguuuauagcucuagcagcuu

SEQ ID NO: 13743 - RNA, 22 nt, Human
caguuuauaugaggguaucaag

SEQ ID NO: 13744 - RNA, 22 nt, Human
caguuuaugcagcuggaauaga

SEQ ID NO: 13745 - RNA, 22 nt, Human
caguuuccugaagagaaagaau

SEQ ID NO: 13746 - RNA, 22 nt, Human
caguuucucaggccucucccag

SEQ ID NO: 13747 - RNA, 22 nt, Human
caguuucuccaaacgcaggcug

SEQ ID NO: 13748 - RNA, 22 nt, Human
caguuucucucauacauauuug

SEQ ID NO: 13749 - RNA, 22 nt, Human
caguuucugagcccugucauuu

SEQ ID NO: 13750 - RNA, 22 nt, Human
caguuucuguuuuaaauagcag

SEQ ID NO: 13751 - RNA, 22 nt, Human
caguuucuuaagacugagaucu

SEQ ID NO: 13752 - RNA, 22 nt, Human
caguuucuucuauuuugaacua

SEQ ID NO: 13753 - RNA, 22 nt, Human
caguuugcaaaugacuuacaga

SEQ ID NO: 13754 - RNA, 22 nt, Human
caguuugucuugauucagaaca

SEQ ID NO: 13755 - RNA, 22 nt, Human
caguuuuaaauuuugaaugucu

SEQ ID NO: 13756 - RNA, 22 nt, Human
caguuuuauacacugcagcucc

SEQ ID NO: 13757 - RNA, 22 nt, Human
caguuuuauugguugaaaucug

SEQ ID NO: 13758 - RNA, 22 nt, Human
caguuuucuuguuauauuuggg

SEQ ID NO: 13759 - RNA, 23 nt, Human
cauaaaauauuaguaugguagca

SEQ ID NO: 13760 - RNA, 22 nt, Human
cauaaaauggcuuguucuuuaa

SEQ ID NO: 13761 - RNA, 22 nt, Human
cauaaaguaggcaagcauucca

SEQ ID NO: 13762 - RNA, 22 nt, Human
cauaaaguuaagcuguaaguau

SEQ ID NO: 13763 - RNA, 22 nt, Human
cauaaaguuuuauaggcucaaa

SEQ ID NO: 13764 - RNA, 22 nt, Human
cauaacacauucaucagcagag

SEQ ID NO: 13765 - RNA, 22 nt, Human
cauaacaguggcuucagcaagu

SEQ ID NO: 13766 - RNA, 22 nt, Human
cauaacauguacauauaaaugc

SEQ ID NO: 13767 - RNA, 22 nt, Human
cauaacauuaagccucuauuuc

SEQ ID NO: 13768 - RNA, 22 nt, Human
cauaacauugagcagcauuccu

SEQ ID NO: 13769 - RNA, 22 nt, Human
cauaacuagagugaaauguuga

SEQ ID NO: 13770 - RNA, 22 nt, Human
cauaacuugcuuuggagcccgg

SEQ ID NO: 13771 - RNA, 22 nt, Human
cauaagaauauuuaguggcagc

SEQ ID NO: 13772 - RNA, 22 nt, Human
cauaaucccaggcuugcauuca

SEQ ID NO: 13773 - RNA, 22 nt, Human
cauaauccuguccuggauucuu

SEQ ID NO: 13774 - RNA, 22 nt, Human
cauaauguuguaacacauagag

SEQ ID NO: 13775 - RNA, 22 nt, Human
cauaauuaaauucugggcaaga

SEQ ID NO: 13776 - RNA, 22 nt, Human
cauaauuacugauaugcugauu

SEQ ID NO: 13777 - RNA, 22 nt, Human
cauaauuagagaauucauguua

SEQ ID NO: 13778 - RNA, 22 nt, Human
cauaauuagucauguuaugcau

SEQ ID NO: 13779 - RNA, 22 nt, Human
cauaauuucacugucguauggc

SEQ ID NO: 13780 - RNA, 22 nt, Human
cauaauuugauaugcuugaugg

SEQ ID NO: 13781 - RNA, 22 nt, Human
cauacaagcguucaauagaugu

SEQ ID NO: 13782 - RNA, 20 nt, Human
cauacacuauucuguauagu

SEQ ID NO: 13783 - RNA, 22 nt, Human
cauacagucacugugguaccac

SEQ ID NO: 13784 - RNA, 22 nt, Human
cauacaguuuucccuagaugug

SEQ ID NO: 13785 - RNA, 22 nt, Human
cauacauugaauuugcacgugu

SEQ ID NO: 13786 - RNA, 22 nt, Human
cauacauuuugcauauuuacca

SEQ ID NO: 13787 - RNA, 22 nt, Human
cauacugugaagcuuacuauuu

SEQ ID NO: 13788 - RNA, 22 nt, Human
cauagaaaagaguagguaaugu

SEQ ID NO: 13789 - RNA, 22 nt, Human
cauagaaacugagacaaggauu

SEQ ID NO: 13790 - RNA, 22 nt, Human
cauagaaaguauuauggaauuu

SEQ ID NO: 13791 - RNA, 22 nt, Human
cauagaacagcuccuagcacau

SEQ ID NO: 13792 - RNA, 22 nt, Human
cauagaaucauagcacauuuga

SEQ ID NO: 13793 - RNA, 22 nt, Human
cugagcugggacucaguagcaa

SEQ ID NO: 13794 - RNA, 22 nt, Human
cugagcugggagccuggcacca

SEQ ID NO: 13795 - RNA, 22 nt, Human
cugagcugggcaacucuuagau

SEQ ID NO: 13796 - RNA, 21 nt, Human
cugagcuggggugaagguugc

SEQ ID NO: 13797 - RNA, 22 nt, Human
cugagcuggucuauggacuugg

SEQ ID NO: 13798 - RNA, 22 nt, Human
cugagcugguguuucaggguca

SEQ ID NO: 13799 - RNA, 22 nt, Human
cugagcugguucucuugugaaa

SEQ ID NO: 13800 - RNA, 22 nt, Human
cugagcugucaggaauggaaag

SEQ ID NO: 13801 - RNA, 22 nt, Human
cugaggaagagguaccauuugu

SEQ ID NO: 13802 - RNA, 22 nt, Human
cugaggaaugagugaggagcca

SEQ ID NO: 13803 - RNA, 22 nt, Human
cugaggagaaaugggaugguuc

SEQ ID NO: 13804 - RNA, 22 nt, Human
cugaggagaacaaugagaucaa

SEQ ID NO: 13805 - RNA, 22 nt, Human
cugaggagagguggccuguguu

SEQ ID NO: 13806 - RNA, 22 nt, Human
cugaggagaugggcuuuuuagg

SEQ ID NO: 13807 - RNA, 22 nt, Human
cugaggagcaaccccgugcccu

SEQ ID NO: 13808 - RNA, 22 nt, Human
cugaggagcagcuggcccgcua

SEQ ID NO: 13809 - RNA, 22 nt, Human
cugaggaucuaauuauuggguc

SEQ ID NO: 13810 - RNA, 19 nt, Human
cugaggcaaguggugguca

SEQ ID NO: 13811 - RNA, 22 nt, Human
cugaggcacccaucuucuccug

SEQ ID NO: 13812 - RNA, 22 nt, Human
cugaggcacugguaaugggcau

SEQ ID NO: 13813 - RNA, 22 nt, Human
cugaggcacugucagcugaggc

SEQ ID NO: 13814 - RNA, 22 nt, Human
cugaggcagagggcagaccaga

SEQ ID NO: 13815 - RNA, 21 nt, Human
cugaggcagcacagcuaguca

SEQ ID NO: 13816 - RNA, 22 nt, Human
cugaggcaggagaauugcugga

SEQ ID NO: 13817 - RNA, 21 nt, Human
cugaggcaugcaggccugggc

SEQ ID NO: 13818 - RNA, 17 nt, Human
cugaggcccagggccca

SEQ ID NO: 13819 - RNA, 22 nt, Human
cugaggccggagcacugaagag

SEQ ID NO: 13820 - RNA, 22 nt, Human
cugaggccgucugggucugcag

SEQ ID NO: 13821 - RNA, 22 nt, Human
cugaggcuaaccucgagagaca

SEQ ID NO: 13822 - RNA, 22 nt, Human
cugaggcuaguauaaagagcau

SEQ ID NO: 13823 - RNA, 22 nt, Human
cugaggcucagcgugaggaaag

SEQ ID NO: 13824 - RNA, 22 nt, Human
cugaggcucccucgggucugcu

SEQ ID NO: 13825 - RNA, 22 nt, Human
cugaggcucugagaaagccaaa

SEQ ID NO: 13826 - RNA, 22 nt, Human
cugaggcugaagagggccuacg

SEQ ID NO: 13827 - RNA, 22 nt, Human
cugaggcugcccagggccaggu

SEQ ID NO: 13828 - RNA, 22 nt, Human
cugaggcuggcguuugaggaag

SEQ ID NO: 13829 - RNA, 22 nt, Human
cugaggcugggcuugccuucuu

SEQ ID NO: 13830 - RNA, 18 nt, Human
cugaggcuuagagagguu

SEQ ID NO: 13831 - RNA, 22 nt, Human
cugagggaaggcagucaguugg

SEQ ID NO: 13832 - RNA, 22 nt, Human
cugagggcccugaagcuuggca

SEQ ID NO: 13833 - RNA, 21 nt, Human
cugagggccgcagcugggcuc

SEQ ID NO: 13834 - RNA, 22 nt, Human
cugagggcuggagcugaggccu

SEQ ID NO: 13835 - RNA, 23 nt, Human
cugaggggaaaagggcuucaggc

SEQ ID NO: 13836 - RNA, 17 nt, Human
cugaggggagugcugug

SEQ ID NO: 13837 - RNA, 22 nt, Human
cugaggggauaaagguuugggu

SEQ ID NO: 13838 - RNA, 22 nt, Human
cugagggguauccaagggguaa

SEQ ID NO: 13839 - RNA, 20 nt, Human
cugagguagggcagaucacc

SEQ ID NO: 13840 - RNA, 22 nt, Human
cugagguauugggaaguggacu

SEQ ID NO: 13841 - RNA, 22 nt, Human
cugaggucaccccacuggcugu

SEQ ID NO: 13842 - RNA, 22 nt, Human
cugaggugagcuucccugggcu

SEQ ID NO: 13843 - RNA, 22 nt, Human
cugcauugaucaggcagaaucu

SEQ ID NO: 13844 - RNA, 22 nt, Human
cugcauuucacauuuaaacuuu

SEQ ID NO: 13845 - RNA, 22 nt, Human
cugccacaagcuggcccugugu

SEQ ID NO: 13846 - RNA, 22 nt, Human
cugccaccaaauagcugcauga

SEQ ID NO: 13847 - RNA, 22 nt, Human
cugccaccaugccccagcagag

SEQ ID NO: 13848 - RNA, 22 nt, Human
cugccagcucaaagcgcagcua

SEQ ID NO: 13849 - RNA, 22 nt, Human
cugccagcucucuggaggcucu

SEQ ID NO: 13850 - RNA, 22 nt, Human
cugccagcuggagaccaaggaa

SEQ ID NO: 13851 - RNA, 22 nt, Human
cugccaggauucugugaacccc

SEQ ID NO: 13852 - RNA, 22 nt, Human
cugccaggcacgugcagcauca

SEQ ID NO: 13853 - RNA, 22 nt, Human
cugccaggccuccgcugucccc

SEQ ID NO: 13854 - RNA, 22 nt, Human
cugccaggugagcuccaggccu

SEQ ID NO: 13855 - RNA, 22 nt, Human
cugccaucgggggccccacugc

SEQ ID NO: 13856 - RNA, 22 nt, Human
cugccaucugaggguccagccu

SEQ ID NO: 13857 - RNA, 20 nt, Human
cugccaugauugauagagug

SEQ ID NO: 13858 - RNA, 22 nt, Human
cugccaugcaguuagucccuca

SEQ ID NO: 13859 - RNA, 22 nt, Human
cugccauguagucuauggggcg

SEQ ID NO: 13860 - RNA, 22 nt, Human
cugccaugugugaaaggggagg

SEQ ID NO: 13861 - RNA, 20 nt, Human
cugcccacuagaacuaccug

SEQ ID NO: 13862 - RNA, 22 nt, Human
cugcccacuauguugucauggg

SEQ ID NO: 13863 - RNA, 22 nt, Human
cugcccaucuggccacacacag

SEQ ID NO: 13864 - RNA, 22 nt, Human
cugcccauucaaccagcuacag

SEQ ID NO: 13865 - RNA, 22 nt, Human
cugccccacaggcuugguaggg

SEQ ID NO: 13866 - RNA, 22 nt, Human
cugccccugcucauggcugucc

SEQ ID NO: 13867 - RNA, 22 nt, Human
cugccccuggcuggugaagcag

SEQ ID NO: 13868 - RNA, 22 nt, Human
cugccccuggugauggacgcca

SEQ ID NO: 13869 - RNA, 18 nt, Human
cugccccuucucugagau

SEQ ID NO: 13870 - RNA, 22 nt, Human
cugcccucccaguugguccgug

SEQ ID NO: 13871 - RNA, 22 nt, Human
cugcccucgggcccucccauag

SEQ ID NO: 13872 - RNA, 22 nt, Human
cugcccucuagggaugcacugg

SEQ ID NO: 13873 - RNA, 23 nt, Human
cugcccugaucuugaucuauugu

SEQ ID NO: 13874 - RNA, 22 nt, Human
cugcccugcuucugagggaagc

SEQ ID NO: 13875 - RNA, 22 nt, Human
cugcccuggccacugugcccag

SEQ ID NO: 13876 - RNA, 22 nt, Human
cugcccugggaguaccuguccu

SEQ ID NO: 13877 - RNA, 22 nt, Human
cugcccuguaucuucucccaau

SEQ ID NO: 13878 - RNA, 22 nt, Human
cugcccugugguuguggguucu

SEQ ID NO: 13879 - RNA, 22 nt, Human
cugccguccaucuacgucucag

SEQ ID NO: 13880 - RNA, 22 nt, Human
cugccguguuuuucauguuaaa

SEQ ID NO: 13881 - RNA, 22 nt, Human
cugccguugugaagcucuuaga

SEQ ID NO: 13882 - RNA, 22 nt, Human
cugccuagaaaaccaggcuccu

SEQ ID NO: 13883 - RNA, 22 nt, Human
cugccucacauuggcuguguga

SEQ ID NO: 13884 - RNA, 22 nt, Human
cugccucucaggucccugagau

SEQ ID NO: 13885 - RNA, 22 nt, Human
cugccucuguugggcauggucu

SEQ ID NO: 13886 - RNA, 22 nt, Human
cugccucuugacagaucguggc

SEQ ID NO: 13887 - RNA, 22 nt, Human
cugccugaagaauuguguugca

SEQ ID NO: 13888 - RNA, 22 nt, Human
cugccugaguggaggucgaggg

SEQ ID NO: 13889 - RNA, 22 nt, Human
cugccugccuuggccuccagga

SEQ ID NO: 13890 - RNA, 22 nt, Human
cugccugcguugccucgugccu

SEQ ID NO: 13891 - RNA, 22 nt, Human
cugccugcucaccagggcucug

SEQ ID NO: 13892 - RNA, 22 nt, Human
cugccugcugauuaguauuguc

SEQ ID NO: 13893 - RNA, 22 nt, Human
cugccugcugcccuccagagcc

SEQ ID NO: 13894 - RNA, 22 nt, Human
cugccugcuuaccaugcaucag

SEQ ID NO: 13895 - RNA, 22 nt, Human
cugccuggaaggagcaagggga

SEQ ID NO: 13896 - RNA, 22 nt, Human
cugccuggaaugccagcuucuc

SEQ ID NO: 13897 - RNA, 22 nt, Human
cugccuggaccggcagcccucc

SEQ ID NO: 13898 - RNA, 20 nt, Human
cugccuggaggccucuaccu

SEQ ID NO: 13899 - RNA, 17 nt, Human
cugccuggagucccauc

SEQ ID NO: 13900 - RNA, 22 nt, Human
cugccuggccacaacccagggu

SEQ ID NO: 13901 - RNA, 22 nt, Human
cugccuggccugaucuccacgc

SEQ ID NO: 13902 - RNA, 22 nt, Human
cugccuggggaaugugaggauu

SEQ ID NO: 13903 - RNA, 22 nt, Human
cugccuggucucaggcaugggg

SEQ ID NO: 13904 - RNA, 22 nt, Human
cugccugugugugccugcagaa

SEQ ID NO: 13905 - RNA, 19 nt, Human
cugccuguuauggagagaa

SEQ ID NO: 13906 - RNA, 22 nt, Human
cugccuguuuucugauagauuu

SEQ ID NO: 13907 - RNA, 22 nt, Human
cugccuuaaaaguacuuuuacu

SEQ ID NO: 13908 - RNA, 22 nt, Human
cugccuucuuucaaggguaagc

SEQ ID NO: 13909 - RNA, 22 nt, Human
cugccuugcaccggcucucugg

SEQ ID NO: 13910 - RNA, 22 nt, Human
cugccuuggcccuaguucaugg

SEQ ID NO: 13911 - RNA, 22 nt, Human
cugccuugguuucuagcagggc

SEQ ID NO: 13912 - RNA, 22 nt, Human
cugccuuugcccuugacacugu

SEQ ID NO: 13913 - RNA, 22 nt, Human
cauucugcauuuggaaggggca

SEQ ID NO: 13914 - RNA, 22 nt, Human
cauucuuacacaauauuuuaau

SEQ ID NO: 13915 - RNA, 22 nt, Human
cauucuucucccuuaccuucca

SEQ ID NO: 13916 - RNA, 22 nt, Human
cauucuugaaccaggcacugug

SEQ ID NO: 13917 - RNA, 18 nt, Human
cauucuuggcagcuuuug

SEQ ID NO: 13918 - RNA, 22 nt, Human
cauugaaaccuaacauaggcug

SEQ ID NO: 13919 - RNA, 22 nt, Human
cauugaaauauggaaacugaug

SEQ ID NO: 13920 - RNA, 22 nt, Human
cauugagagugacuuggacaau

SEQ ID NO: 13921 - RNA, 21 nt, Human
cauugagauaggagagauugu

SEQ ID NO: 13922 - RNA, 20 nt, Human
cauugcaaaguagcagacug

SEQ ID NO: 13923 - RNA, 22 nt, Human
cauugcacaucugagaagagau

SEQ ID NO: 13924 - RNA, 22 nt, Human
cauugcaccacauugcaucccu

SEQ ID NO: 13925 - RNA, 22 nt, Human
cauugcacuccacccuaggcaa

SEQ ID NO: 13926 - RNA, 22 nt, Human
cauugcacuccagcuugggcaa

SEQ ID NO: 13927 - RNA, 22 nt, Human
cauugcacucuggcuggaacgg

SEQ ID NO: 13928 - RNA, 22 nt, Human
cauugcacugcagcccgggcaa

SEQ ID NO: 13929 - RNA, 22 nt, Human
cauugcacuuuggguccaggac

SEQ ID NO: 13930 - RNA, 22 nt, Human
cauugcaggagaguaaauaaaa

SEQ ID NO: 13931 - RNA, 20 nt, Human
cauugcauauuucauugagg

SEQ ID NO: 13932 - RNA, 22 nt, Human
cauugcccaguaggaucaccag

SEQ ID NO: 13933 - RNA, 20 nt, Human
cauuggacuuggcuucaugg

SEQ ID NO: 13934 - RNA, 22 nt, Human
cauuggcuccugugggacauga

SEQ ID NO: 13935 - RNA, 22 nt, Human
cauugguagaguuuguuuuaua

SEQ ID NO: 13936 - RNA, 22 nt, Human
cauuggucuucuaacagagaga

SEQ ID NO: 13937 - RNA, 22 nt, Human
cauuguaagaggcuuugcagca

SEQ ID NO: 13938 - RNA, 22 nt, Human
cauuguccucugaugccuuccc

SEQ ID NO: 13939 - RNA, 22 nt, Human
cauugucugguaggaagugggc

SEQ ID NO: 13940 - RNA, 22 nt, Human
cauuguuaauugguaucuuaca

SEQ ID NO: 13941 - RNA, 22 nt, Human
cauuguuauagcauuacacacc

SEQ ID NO: 13942 - RNA, 22 nt, Human
cauuguuggcagagggacagag

SEQ ID NO: 13943 - RNA, 22 nt, Human
cauuguuugagcaucugggauc

SEQ ID NO: 13944 - RNA, 22 nt, Human
cauuuaaugcacggauguagcc

SEQ ID NO: 13945 - RNA, 22 nt, Human
cauuuacaauguacagguugug

SEQ ID NO: 13946 - RNA, 22 nt, Human
cauuuacacacagaggugugcu

SEQ ID NO: 13947 - RNA, 21 nt, Human
cauuuacaugacagauugguu

SEQ ID NO: 13948 - RNA, 22 nt, Human
cauuuagaaacuguuuuuaaca

SEQ ID NO: 13949 - RNA, 22 nt, Human
cauuuaguuuugcaguagcagg

SEQ ID NO: 13950 - RNA, 22 nt, Human
cauuuauucagcucagucgguu

SEQ ID NO: 13951 - RNA, 22 nt, Human
cauuuauucaugaucuguagcu

SEQ ID NO: 13952 - RNA, 19 nt, Human
cuguggacucuagaucaug

SEQ ID NO: 13953 - RNA, 23 nt, Human
cuguggagcccuuuguugggaga

SEQ ID NO: 13954 - RNA, 22 nt, Human
cuguggagguaggagcaggaca

SEQ ID NO: 13955 - RNA, 22 nt, Human
cuguggaguuuguggcgcugac

SEQ ID NO: 13956 - RNA, 22 nt, Human
cuguggcaaaugauaccuccca

SEQ ID NO: 13957 - RNA, 23 nt, Human
cuguggcaaguccugcaccugcc

SEQ ID NO: 13958 - RNA, 22 nt, Human
cuguggcaagucugccugucac

SEQ ID NO: 13959 - RNA, 22 nt, Human
cuguggcacauguggcaaggcc

SEQ ID NO: 13960 - RNA, 22 nt, Human
cuguggcaggaagggacuagca

SEQ ID NO: 13961 - RNA, 22 nt, Human
cuguggcagggaagaggccaug

SEQ ID NO: 13962 - RNA, 23 nt, Human
cuguggccaccccuagcuggagg

SEQ ID NO: 13963 - RNA, 22 nt, Human
cuguggccccacccucuuggcc

SEQ ID NO: 13964 - RNA, 22 nt, Human
cuguggccuggggacacuaucu

SEQ ID NO: 13965 - RNA, 22 nt, Human
cuguggcuaggauuauuccuga

SEQ ID NO: 13966 - RNA, 22 nt, Human
cuguggcuaugguguacauacu

SEQ ID NO: 13967 - RNA, 22 nt, Human
cuguggcucauucuugguggca

SEQ ID NO: 13968 - RNA, 22 nt, Human
cuguggcuccauagaaguugca

SEQ ID NO: 13969 - RNA, 22 nt, Human
cuguggcucucagaggcugcug

SEQ ID NO: 13970 - RNA, 22 nt, Human
cuguggcucuccaauggaggga

SEQ ID NO: 13971 - RNA, 22 nt, Human
cuguggcucugcagucccaaca

SEQ ID NO: 13972 - RNA, 22 nt, Human
cuguggcugcagccuugguccu

SEQ ID NO: 13973 - RNA, 22 nt, Human
cuguggcugccucaccuacagg

SEQ ID NO: 13974 - RNA, 22 nt, Human
cuguggcuggccuuauugcugc

SEQ ID NO: 13975 - RNA, 22 nt, Human
cuguggcuggcucaucauaggu

SEQ ID NO: 13976 - RNA, 22 nt, Human
cuguggcugucucuuucccaug

SEQ ID NO: 13977 - RNA, 22 nt, Human
cuguggcuuuggggcggaggac

SEQ ID NO: 13978 - RNA, 22 nt, Human
cugugggaaaggaugagauugc

SEQ ID NO: 13979 - RNA, 18 nt, Human
cugugggaagaguuuggg

SEQ ID NO: 13980 - RNA, 22 nt, Human
cugugggaauacugcgagugua

SEQ ID NO: 13981 - RNA, 22 nt, Human
cugugggagaaguugcuggagu

SEQ ID NO: 13982 - RNA, 22 nt, Human
cugugggagaggugccuggauu

SEQ ID NO: 13983 - RNA, 22 nt, Human
cugugggcauuugagugugggu

SEQ ID NO: 13984 - RNA, 22 nt, Human
cugugggccugauguucuucuc

SEQ ID NO: 13985 - RNA, 22 nt, Human
cugugggugaagacaagggaga

SEQ ID NO: 13986 - RNA, 19 nt, Human
cugugggugugcaagggug

SEQ ID NO: 13987 - RNA, 22 nt, Human
cuguggucaccaggcuggggcc

SEQ ID NO: 13988 - RNA, 22 nt, Human
cuguggucaucucagaguggcc

SEQ ID NO: 13989 - RNA, 22 nt, Human
cuguggugagcaacugacugaa

SEQ ID NO: 13990 - RNA, 22 nt, Human
cuguggugggcccugggcuuca

SEQ ID NO: 13991 - RNA, 22 nt, Human
cuguguagucagguggucccac

SEQ ID NO: 13992 - RNA, 22 nt, Human
cuguguaucucugugggacaga

SEQ ID NO: 13993 - RNA, 22 nt, Human
cuguguccauguucuaauuugg

SEQ ID NO: 13994 - RNA, 22 nt, Human
cuguguccauuuaucauuguca

SEQ ID NO: 13995 - RNA, 22 nt, Human
cugugucccaguaccuugggua

SEQ ID NO: 13996 - RNA, 22 nt, Human
cuguguccugcgucaagccaau

SEQ ID NO: 13997 - RNA, 22 nt, Human
cuguguccugucuccuaaggug

SEQ ID NO: 13998 - RNA, 21 nt, Human
cugugucgcucucgcugggag

SEQ ID NO: 13999 - RNA, 22 nt, Human
cugugucuaaucuuauacauca

SEQ ID NO: 14000 - RNA, 22 nt, Human
cugugucucauccgccucuggc

SEQ ID NO: 14001 - RNA, 22 nt, Human
cugugucuccuuggugggauau

SEQ ID NO: 14002 - RNA, 22 nt, Human
cugugucucguuaaagcauugg

SEQ ID NO: 14003 - RNA, 22 nt, Human
cugugucuguggaauagcgaau

SEQ ID NO: 14004 - RNA, 22 nt, Human
cugugucuucuguuuugaaguu

SEQ ID NO: 14005 - RNA, 22 nt, Human
cugugucuugaguaauucggug

SEQ ID NO: 14006 - RNA, 22 nt, Human
cugugugaugggaagaauguuu

SEQ ID NO: 14007 - RNA, 22 nt, Human
cugugugcaggugcuggguacc

SEQ ID NO: 14008 - RNA, 22 nt, Human
cugugugugagaagcagguuga

SEQ ID NO: 14009 - RNA, 22 nt, Human
cugugugugcuacaggcuucca

SEQ ID NO: 14010 - RNA, 22 nt, Human
cuguguuccccugcugcugagg

SEQ ID NO: 14011 - RNA, 22 nt, Human
cuguguuucuaaguaaaggagc

SEQ ID NO: 14012 - RNA, 22 nt, Human
cuguguuuugagauauuauuaa

SEQ ID NO: 14013 - RNA, 20 nt, Human
cuguuaaaagguaugaauuc

SEQ ID NO: 14014 - RNA, 22 nt, Human
cuguuaaguguagauaaugugg

SEQ ID NO: 14015 - RNA, 22 nt, Human
cuguuaauucuagauggugagu

SEQ ID NO: 14016 - RNA, 22 nt, Human
cuguuaauugugaauuuuacau

SEQ ID NO: 14017 - RNA, 22 nt, Human
cuguuacaagagagagacauga

SEQ ID NO: 14018 - RNA, 22 nt, Human
cuguuacauagcuuuucuuaac

SEQ ID NO: 14019 - RNA, 22 nt, Human
cuguuauuucugccaggugagu

SEQ ID NO: 14020 - RNA, 22 nt, Human
cuguuauuuuauaauucaagaa

SEQ ID NO: 14021 - RNA, 22 nt, Human
cuguucaauuuguuucaguuau

SEQ ID NO: 14022 - RNA, 21 nt, Human
cuguucacugugcugugcaaa

SEQ ID NO: 14023 - RNA, 17 nt, Human
cuguuccccacuacuca

SEQ ID NO: 14024 - RNA, 22 nt, Human
cuguucuguaagcugcuguugu

SEQ ID NO: 14025 - RNA, 22 nt, Human
cuguuggccuuucaucaguaau

SEQ ID NO: 14026 - RNA, 22 nt, Human
cuguuguauuauucaauauuau

SEQ ID NO: 14027 - RNA, 22 nt, Human
cuguugucccugggagcucagc

SEQ ID NO: 14028 - RNA, 22 nt, Human
cuguugucuccucucagauuau

SEQ ID NO: 14029 - RNA, 22 nt, Human
cuguugugaauuuaguuaccaa

SEQ ID NO: 14030 - RNA, 22 nt, Human
cuguuuaaccagaucucauauc

SEQ ID NO: 14031 - RNA, 22 nt, Human
cuguuuauaaaccaccaguuua

SEQ ID NO: 14032 - RNA, 22 nt, Human
cuguuuauaaauagaggggagu

SEQ ID NO: 14033 - RNA, 22 nt, Human
cuguuuauacgacagguggagg

SEQ ID NO: 14034 - RNA, 22 nt, Human
cuguuuaucauguacauuucca

SEQ ID NO: 14035 - RNA, 22 nt, Human
cuguuuauggagguaaggcauc

SEQ ID NO: 14036 - RNA, 22 nt, Human
cuguuucaugucuuccgcagcu

SEQ ID NO: 14037 - RNA, 22 nt, Human
cuguuuccccaugcccugacuc

SEQ ID NO: 14038 - RNA, 22 nt, Human
cuguuucucccauguccaagug

SEQ ID NO: 14039 - RNA, 21 nt, Human
cuguuucuugugaagugacac

SEQ ID NO: 14040 - RNA, 22 nt, Human
cuguuugugauuagcagugggu

SEQ ID NO: 14041 - RNA, 22 nt, Human
cuguuuuauaaaguccaaaagu

SEQ ID NO: 14042 - RNA, 22 nt, Human
cuguuuucccuggaguucagca

SEQ ID NO: 14043 - RNA, 22 nt, Human
cuuaaaaucuggcaguuagcua

SEQ ID NO: 14044 - RNA, 20 nt, Human
cuuaaacacagagauagauu

SEQ ID NO: 14045 - RNA, 22 nt, Human
cuuaaauccaucauuucuaauc

SEQ ID NO: 14046 - RNA, 22 nt, Human
cuuaacaagcccaacuuucauu

SEQ ID NO: 14047 - RNA, 22 nt, Human
cuuaacagagagaaguguugcu

SEQ ID NO: 14048 - RNA, 22 nt, Human
cuuaagaauauugaaguugugg

SEQ ID NO: 14049 - RNA, 22 nt, Human
cuuaauaauaggugaggcuaug

SEQ ID NO: 14050 - RNA, 22 nt, Human
cuuaauuacccaaugugguagg

SEQ ID NO: 14051 - RNA, 22 nt, Human
cuuaauuuuuguaguagaugga

SEQ ID NO: 14052 - RNA, 22 nt, Human
cuuacaagcaaaacaacuguag

SEQ ID NO: 14053 - RNA, 22 nt, Human
cuuacacacuagaugguaggug

SEQ ID NO: 14054 - RNA, 22 nt, Human
cuuacagugacccugcagauuu

SEQ ID NO: 14055 - RNA, 22 nt, Human
cuuacagugaucaacacaaaga

SEQ ID NO: 14056 - RNA, 22 nt, Human
cuuacauaugcaagacaaaggg

SEQ ID NO: 14057 - RNA, 22 nt, Human
cuuacauuaaguaagagauuga

SEQ ID NO: 14058 - RNA, 22 nt, Human
cuuagaaaucgaacucagguua

SEQ ID NO: 14059 - RNA, 22 nt, Human
cuuagaacauacuuagugugau

SEQ ID NO: 14060 - RNA, 22 nt, Human
cuuagaacauucugccugggaa

SEQ ID NO: 14061 - RNA, 22 nt, Human
ccccuuccuuccucagacagcc

SEQ ID NO: 14062 - RNA, 22 nt, Human
ccccuucuggucuucaauggug

SEQ ID NO: 14063 - RNA, 22 nt, Human
ccccuuucucccgcgucuggcc

SEQ ID NO: 14064 - RNA, 22 nt, Human
cccgacuagcugggauuacagg

SEQ ID NO: 14065 - RNA, 22 nt, Human
cccgagccucgguuucuuuucu

SEQ ID NO: 14066 - RNA, 22 nt, Human
cccgaggaaccagagguagcuc

SEQ ID NO: 14067 - RNA, 22 nt, Human
cccgggaggaggaaguugcagu

SEQ ID NO: 14068 - RNA, 21 nt, Human
cccgugccuucagcaguccug

SEQ ID NO: 14069 - RNA, 22 nt, Human
cccguuuaauuacucgagcugu

SEQ ID NO: 14070 - RNA, 23 nt, Human
cccuaacuaauucuagggccuaa

SEQ ID NO: 14071 - RNA, 22 nt, Human
cuuccugaaaguaguagguuga

SEQ ID NO: 14072 - RNA, 22 nt, Human
cuuccugaagagguuggucagg

SEQ ID NO: 14073 - RNA, 22 nt, Human
cuuccugagcaaggaacuauag

SEQ ID NO: 14074 - RNA, 22 nt, Human
cuuccuggaugaacaguagaaa

SEQ ID NO: 14075 - RNA, 22 nt, Human
cuuccuggaugaagcccagcau

SEQ ID NO: 14076 - RNA, 22 nt, Human
cuuccuggcaugggucucauga

SEQ ID NO: 14077 - RNA, 22 nt, Human
cuuccugggcccugcuuaagca

SEQ ID NO: 14078 - RNA, 22 nt, Human
cuuccugggucuggagacugga

SEQ ID NO: 14079 - RNA, 22 nt, Human
cuuccuguuguauuugugagcc

SEQ ID NO: 14080 - RNA, 22 nt, Human
cuuccuuccacaccuucagaau

SEQ ID NO: 14081 - RNA, 22 nt, Human
cuuccuucugaagcauagaagc

SEQ ID NO: 14082 - RNA, 22 nt, Human
cuuccuugugguccuucucauu

SEQ ID NO: 14083 - RNA, 20 nt, Human
cuuccuuuuccuucgucaaa

SEQ ID NO: 14084 - RNA, 23 nt, Human
cuucggaauaugauaagggaccu

SEQ ID NO: 14085 - RNA, 22 nt, Human
cuucguuuuuaguagcaauguu

SEQ ID NO: 14086 - RNA, 19 nt, Human
cuucuaagucauuuggaau

SEQ ID NO: 14087 - RNA, 22 nt, Human
cuucuaauucuuauguaagcuu

SEQ ID NO: 14088 - RNA, 22 nt, Human
cuucuacacaucccucuugcuu

SEQ ID NO: 14089 - RNA, 23 nt, Human
cuucuagagucagcuccaaguuu

SEQ ID NO: 14090 - RNA, 22 nt, Human
cuucuagaguuucugaugcaac

SEQ ID NO: 14091 - RNA, 22 nt, Human
cuucuagccuugaugacuggga

SEQ ID NO: 14092 - RNA, 22 nt, Human
cuucuaugaggagagacaugca

SEQ ID NO: 14093 - RNA, 22 nt, Human
cuucucaaaguugugaaucagg

SEQ ID NO: 14094 - RNA, 22 nt, Human
cuucucagcaugguuacuguga

SEQ ID NO: 14095 - RNA, 22 nt, Human
cuucucagucaccugugagucu

SEQ ID NO: 14096 - RNA, 22 nt, Human
cuucuccagccacgcccacucc

SEQ ID NO: 14097 - RNA, 22 nt, Human
cuucucccaaguaugcaguuug

SEQ ID NO: 14098 - RNA, 22 nt, Human
cuucuccgacaaccgacgccgg

SEQ ID NO: 14099 - RNA, 22 nt, Human
cuucucuaucuuuggcacauca

SEQ ID NO: 14100 - RNA, 22 nt, Human
cuucucugcaccccacuuuugc

SEQ ID NO: 14101 - RNA, 22 nt, Human
cuucucuggcagaugugugucc

SEQ ID NO: 14102 - RNA, 22 nt, Human
cuucucuggcauagcaagcagg

SEQ ID NO: 14103 - RNA, 22 nt, Human
cuucucuggcuccucagcgccc

SEQ ID NO: 14104 - RNA, 22 nt, Human
cuucucugucacaggguuacgu

SEQ ID NO: 14105 - RNA, 22 nt, Human
cuucugaaaugugagcaaaauc

SEQ ID NO: 14106 - RNA, 22 nt, Human
cuucugaagagguuaucauaga

SEQ ID NO: 14107 - RNA, 22 nt, Human
cuucugaaguguuugaugauug

SEQ ID NO: 14108 - RNA, 22 nt, Human
cuucugaauggcuguguaugcu

SEQ ID NO: 14109 - RNA, 22 nt, Human
cuucugagaggggcuaggagca

SEQ ID NO: 14110 - RNA, 22 nt, Human
cuucugagcagaccuccugggg

SEQ ID NO: 14111 - RNA, 22 nt, Human
cuucugcaagagcaucaguugu

SEQ ID NO: 14112 - RNA, 22 nt, Human
cuucugcuggcauacugcccca

SEQ ID NO: 14113 - RNA, 22 nt, Human
cuucuggaaacuuuuccaauuu

SEQ ID NO: 14114 - RNA, 19 nt, Human
cuucuggauccgcagggcc

SEQ ID NO: 14115 - RNA, 22 nt, Human
cuucuggcaaucccagggucuu

SEQ ID NO: 14116 - RNA, 22 nt, Human
cuucuggcguuggaggucugag

SEQ ID NO: 14117 - RNA, 22 nt, Human
cuucugggcauucagcugcaca

SEQ ID NO: 14118 - RNA, 22 nt, Human
cuucuggguaauucuucuucau

SEQ ID NO: 14119 - RNA, 22 nt, Human
cuucuggguguggagugaggac

SEQ ID NO: 14120 - RNA, 22 nt, Human
cuucugugacguaugugaggac

SEQ ID NO: 14121 - RNA, 22 nt, Human
cuucugugagucaguguuucug

SEQ ID NO: 14122 - RNA, 22 nt, Human
cuucugugauuugguuaggaua

SEQ ID NO: 14123 - RNA, 22 nt, Human
cuucugugcaauuguggaggag

SEQ ID NO: 14124 - RNA, 22 nt, Human
cuucuguggauguuggaugcau

SEQ ID NO: 14125 - RNA, 22 nt, Human
cuucuguguuaaaugagucuuu

SEQ ID NO: 14126 - RNA, 22 nt, Human
cuucuguuacuguuagcugaag

SEQ ID NO: 14127 - RNA, 22 nt, Human
cuucuuaaucccuuauauauuu

SEQ ID NO: 14128 - RNA, 22 nt, Human
cuucuuaaugcauaaacugugu

SEQ ID NO: 14129 - RNA, 22 nt, Human
cuucuucaagagaaugggagac

SEQ ID NO: 14130 - RNA, 22 nt, Human
cuucuucaauagcaagcgcaua

SEQ ID NO: 14131 - RNA, 22 nt, Human
cuucuucacacuggucugaagc

SEQ ID NO: 14132 - RNA, 22 nt, Human
cuucuucagcacaauauugaug

SEQ ID NO: 14133 - RNA, 20 nt, Human
cuucuucaguaguuuguucu

SEQ ID NO: 14134 - RNA, 22 nt, Human
cuucuuccaagcuuaugcucaa

SEQ ID NO: 14135 - RNA, 22 nt, Human
cuucuucccagcuucccucacc

SEQ ID NO: 14136 - RNA, 22 nt, Human
cuucuucuuuuaauaaaugucu

SEQ ID NO: 14137 - RNA, 22 nt, Human
cuucuugaaaguggugacccuc

SEQ ID NO: 14138 - RNA, 19 nt, Human
cuucuugauaagguucuuu

SEQ ID NO: 14139 - RNA, 22 nt, Human
cuucuugauugcuuucaaacca

SEQ ID NO: 14140 - RNA, 22 nt, Human
cuucuuggacuacucacuagag

SEQ ID NO: 14141 - RNA, 22 nt, Human
cuucuugugcugggccagcuuc

SEQ ID NO: 14142 - RNA, 22 nt, Human
cuucuuuaccaagagauagagu

SEQ ID NO: 14143 - RNA, 22 nt, Human
cuucuuuagggaucucuugcug

SEQ ID NO: 14144 - RNA, 22 nt, Human
cuucuuuccuuccuccaguggc

SEQ ID NO: 14145 - RNA, 22 nt, Human
cuucuuuguucuguugucucac

SEQ ID NO: 14146 - RNA, 22 nt, Human
cuucuuuucauggcuugggaag

SEQ ID NO: 14147 - RNA, 22 nt, Human
cuucuuuugaagggcguugugu

SEQ ID NO: 14148 - RNA, 22 nt, Human
cuugaaaauaagaaagacuuuc

SEQ ID NO: 14149 - RNA, 22 nt, Human
cuugaaagaagggucuuuuaau

SEQ ID NO: 14150 - RNA, 22 nt, Human
cuugaaagcacuuaguaaauua

SEQ ID NO: 14151 - RNA, 22 nt, Human
cuugaacucaaugugaggaaga

SEQ ID NO: 14152 - RNA, 20 nt, Human
cuugaacugauucuauuucc

SEQ ID NO: 14153 - RNA, 22 nt, Human
cuugaaguugcaaaacauuaau

SEQ ID NO: 14154 - RNA, 23 nt, Human
cuugaaugggauggaauucacug

SEQ ID NO: 14155 - RNA, 22 nt, Human
cuugaaugguaugagaguaauu

SEQ ID NO: 14156 - RNA, 22 nt, Human
cuugaauguccuguggcaaagu

SEQ ID NO: 14157 - RNA, 22 nt, Human
cuugacagaagguuuuauccua

SEQ ID NO: 14158 - RNA, 22 nt, Human
cuugacagucccaggaaaauag

SEQ ID NO: 14159 - RNA, 21 nt, Human
cuugacauagccugucagcuu

SEQ ID NO: 14160 - RNA, 22 nt, Human
cuugagaagagauuuauauuug

SEQ ID NO: 14161 - RNA, 18 nt, Human
cuugagcuaagggacccc

SEQ ID NO: 14162 - RNA, 23 nt, Human
cuugagcucaggaagagcugagu

SEQ ID NO: 14163 - RNA, 22 nt, Human
cuugagcuuagguucaggauug

SEQ ID NO: 14164 - RNA, 22 nt, Human
cuugagggacucuaugacuuag

SEQ ID NO: 14165 - RNA, 20 nt, Human
cuugaugagauaaacagcag

SEQ ID NO: 14166 - RNA, 22 nt, Human
cuugaugagucagaacugaagg

SEQ ID NO: 14167 - RNA, 22 nt, Human
cuugaugaugacgucggugaug

SEQ ID NO: 14168 - RNA, 22 nt, Human
cuugauguauaaguugauaugu

SEQ ID NO: 14169 - RNA, 20 nt, Human
cuugauucuuugaugaggua

SEQ ID NO: 14170 - RNA, 22 nt, Human
gagaaggagcucaaauauggcu

SEQ ID NO: 14171 - RNA, 22 nt, Human
gagaaggauguggcucauagcu

SEQ ID NO: 14172 - RNA, 22 nt, Human
gagaaggccaggaacccagugu

SEQ ID NO: 14173 - RNA, 22 nt, Human
gagaagggauaugccacucucg

SEQ ID NO: 14174 - RNA, 22 nt, Human
gagaaggggugauguggguaau

SEQ ID NO: 14175 - RNA, 22 nt, Human
gagaaguucuaauuggcucuuu

SEQ ID NO: 14176 - RNA, 22 nt, Human
gagaaguuguguggauuuaaag

SEQ ID NO: 14177 - RNA, 22 nt, Human
gagaaguuucuuccuagguuug

SEQ ID NO: 14178 - RNA, 22 nt, Human
gagaauaaaucuaaaguuucuu

SEQ ID NO: 14179 - RNA, 22 nt, Human
gagaauacaaccagaagcugag

SEQ ID NO: 14180 - RNA, 22 nt, Human
gagaaucuacaggaaaccgaag

SEQ ID NO: 14181 - RNA, 22 nt, Human
gagaaucucuuugacaagcaga

SEQ ID NO: 14182 - RNA, 19 nt, Human
gagaaucucuuugauguuu

SEQ ID NO: 14183 - RNA, 22 nt, Human
gagaaucuggguuuuggcuauc

SEQ ID NO: 14184 - RNA, 22 nt, Human
gagaauuagggcguaauucaga

SEQ ID NO: 14185 - RNA, 22 nt, Human
gagaauuuucuaguaguuucau

SEQ ID NO: 14186 - RNA, 22 nt, Human
gagacacaagacgcaacucugu

SEQ ID NO: 14187 - RNA, 22 nt, Human
gagacacaggugguuccuguca

SEQ ID NO: 14188 - RNA, 22 nt, Human
gagacacaguuaucaggcauac

SEQ ID NO: 14189 - RNA, 22 nt, Human
gagacagcuuaauuggugguca

SEQ ID NO: 14190 - RNA, 22 nt, Human
gagacaggcagcuaguggguca

SEQ ID NO: 14191 - RNA, 22 nt, Human
gagacagugguugcagaagcuc

SEQ ID NO: 14192 - RNA, 22 nt, Human
gagacauggcaaaagcacuggu

SEQ ID NO: 14193 - RNA, 19 nt, Human
gagacauguagauagaaga

SEQ ID NO: 14194 - RNA, 22 nt, Human
gagacauucuuaggaacaaugu

SEQ ID NO: 14195 - RNA, 17 nt, Human
gagacccccacuacacc

SEQ ID NO: 14196 - RNA, 22 nt, Human
gagaccuggaggauguggaugg

SEQ ID NO: 14197 - RNA, 22 nt, Human
gagaccuuaagagaugucagcu

SEQ ID NO: 14198 - RNA, 22 nt, Human
gagacguggccuuugccugagc

SEQ ID NO: 14199 - RNA, 22 nt, Human
gagacugcauuguccaaggguu

SEQ ID NO: 14200 - RNA, 22 nt, Human
gagacugguguuugcugggcug

SEQ ID NO: 14201 - RNA, 22 nt, Human
gagacuuuuuaaucacuaggaa

SEQ ID NO: 14202 - RNA, 22 nt, Human
gagagaaaaaugagcuucauug

SEQ ID NO: 14203 - RNA, 22 nt, Human
gagagaaaacaaguucuccauu

SEQ ID NO: 14204 - RNA, 22 nt, Human
gagagaaagccccugcaucccu

SEQ ID NO: 14205 - RNA, 22 nt, Human
gagagaaauuaguugguuugcu

SEQ ID NO: 14206 - RNA, 22 nt, Human
gagagaacccuaaaugagauau

SEQ ID NO: 14207 - RNA, 22 nt, Human
gagagaagaacaaugucauuca

SEQ ID NO: 14208 - RNA, 22 nt, Human
gagagaagaauguuccgaggcc

SEQ ID NO: 14209 - RNA, 22 nt, Human
gagagaagggggauaugagccu

SEQ ID NO: 14210 - RNA, 22 nt, Human
gagagaauguacaugcuagggg

SEQ ID NO: 14211 - RNA, 22 nt, Human
gagagaccuugcuaagugccuu

SEQ ID NO: 14212 - RNA, 22 nt, Human
gagagagaaaaugacuccggac

SEQ ID NO: 14213 - RNA, 22 nt, Human
gagagagaaccccgugcccuuc

SEQ ID NO: 14214 - RNA, 22 nt, Human
gagagagaaggccugugggugu

SEQ ID NO: 14215 - RNA, 22 nt, Human
gagagagacauguaaacgcggu

SEQ ID NO: 14216 - RNA, 23 nt, Human
gagagcaaugagauguaaacacu

SEQ ID NO: 14217 - RNA, 22 nt, Human
gagagcacaugaacauggagga

SEQ ID NO: 14218 - RNA, 22 nt, Human
gagagcagacucucaaagcugg

SEQ ID NO: 14219 - RNA, 22 nt, Human
gagagcauguggucuaguuuua

SEQ ID NO: 14220 - RNA, 22 nt, Human
gagagccagcucacuccagggc

SEQ ID NO: 14221 - RNA, 23 nt, Human
gagagcccauuggcagggguacc

SEQ ID NO: 14222 - RNA, 22 nt, Human
gagagccugccagugaguguau

SEQ ID NO: 14223 - RNA, 22 nt, Human
gagagcugcaagguagggcggg

SEQ ID NO: 14224 - RNA, 22 nt, Human
ccugcuggcggggacccaguga

SEQ ID NO: 14225 - RNA, 22 nt, Human
ccugcuggcugguagaguuccg

SEQ ID NO: 14226 - RNA, 20 nt, Human
ccugcugggaacccucugaa

SEQ ID NO: 14227 - RNA, 22 nt, Human
ccugcugggacgugugguugcc

SEQ ID NO: 14228 - RNA, 22 nt, Human
ccugcugucugcuguguuaagc

SEQ ID NO: 14229 - RNA, 22 nt, Human
ccugcugugaccggggagcagg

SEQ ID NO: 14230 - RNA, 21 nt, Human
ccugcugugaucuuagugagu

SEQ ID NO: 14231 - RNA, 22 nt, Human
ccugcugugugacgggauguua

SEQ ID NO: 14232 - RNA, 22 nt, Human
ccugcuguuuucuucacuucag

SEQ ID NO: 14233 - RNA, 22 nt, Human
ccuggaaagaggaaggaagccu

SEQ ID NO: 14234 - RNA, 22 nt, Human
ccuggaagauucaccacuacca

SEQ ID NO: 14235 - RNA, 22 nt, Human
ccuggaaggcaggcauggauug

SEQ ID NO: 14236 - RNA, 22 nt, Human
ccuggacagagggcagcggcca

SEQ ID NO: 14237 - RNA, 22 nt, Human
ccuggacucagaggugcuggug

SEQ ID NO: 14238 - RNA, 21 nt, Human
ccuggacugggagcagcacug

SEQ ID NO: 14239 - RNA, 22 nt, Human
ccuggacuguguccugugguca

SEQ ID NO: 14240 - RNA, 22 nt, Human
ccuggacuuucaggacuacugu

SEQ ID NO: 14241 - RNA, 22 nt, Human
ccuggacuuucauuuccccuug

SEQ ID NO: 14242 - RNA, 21 nt, Human
ccuggagacaaagacagggug

SEQ ID NO: 14243 - RNA, 22 nt, Human
ccuggagauuucuucaagcuuu

SEQ ID NO: 14244 - RNA, 22 nt, Human
ccuggagcaggagcugcagagg

SEQ ID NO: 14245 - RNA, 22 nt, Human
ccuggagggcagcccauucugg

SEQ ID NO: 14246 - RNA, 22 nt, Human
ccuggagucugugacuuuccuc

SEQ ID NO: 14247 - RNA, 22 nt, Human
ccuggaucgaugccgagggaaa

SEQ ID NO: 14248 - RNA, 22 nt, Human
ccuggaucuuucugacugacaa

SEQ ID NO: 14249 - RNA, 22 nt, Human
ccuggaugauccaugucaugga

SEQ ID NO: 14250 - RNA, 22 nt, Human
ccuggcacaagagcagcauugg

SEQ ID NO: 14251 - RNA, 18 nt, Human
ccuggcacacuggcucau

SEQ ID NO: 14252 - RNA, 22 nt, Human
ccuggcacagauccuucauaca

SEQ ID NO: 14253 - RNA, 22 nt, Human
ccuggcacugaccaggcacuga

SEQ ID NO: 14254 - RNA, 22 nt, Human
ccuggcagcagcacaugccuuc

SEQ ID NO: 14255 - RNA, 18 nt, Human
ccuggcagccaugcgcgc

SEQ ID NO: 14256 - RNA, 22 nt, Human
ccuggcagccucagccaauucu

SEQ ID NO: 14257 - RNA, 22 nt, Human
ccuggcagcgugccgagcugcg

SEQ ID NO: 14258 - RNA, 22 nt, Human
ccuggcagcuccuccccggcgg

SEQ ID NO: 14259 - RNA, 22 nt, Human
ccuggcaggacuguuguaagaa

SEQ ID NO: 14260 - RNA, 22 nt, Human
ccuggcaggcaagaggaaggga

SEQ ID NO: 14261 - RNA, 22 nt, Human
ccuggcagguggcgcccucggc

SEQ ID NO: 14262 - RNA, 22 nt, Human
ccuggcagguuacaaccaguua

SEQ ID NO: 14263 - RNA, 22 nt, Human
ccuggcagucaggggaguccuu

SEQ ID NO: 14264 - RNA, 22 nt, Human
ccuggcaguggugaagaagagg

SEQ ID NO: 14265 - RNA, 22 nt, Human
ccuggcauguccuccuggcaug

SEQ ID NO: 14266 - RNA, 21 nt, Human
ccuggccaaucugauaggguu

SEQ ID NO: 14267 - RNA, 22 nt, Human
ccuggccagaggcgugccugug

SEQ ID NO: 14268 - RNA, 22 nt, Human
ccuggccagcagccccuuccuc

SEQ ID NO: 14269 - RNA, 22 nt, Human
ccuggccucagacagagggugg

SEQ ID NO: 14270 - RNA, 22 nt, Human
ccuggccucgugcucacggcuc

SEQ ID NO: 14271 - RNA, 22 nt, Human
ccuggccucuccgaguaaccug

SEQ ID NO: 14272 - RNA, 22 nt, Human
ccuggccugugaaucugagagc

SEQ ID NO: 14273 - RNA, 23 nt, Human
ccuggcucaccccuuauguccag

SEQ ID NO: 14274 - RNA, 22 nt, Human
ccuggcucagaguaugucaucg

SEQ ID NO: 14275 - RNA, 22 nt, Human
ccuggcucauuaugugccccca

SEQ ID NO: 14276 - RNA, 22 nt, Human
ccuggcucccccaucauagcug

SEQ ID NO: 14277 - RNA, 22 nt, Human
ccuggcucccggaacagggucu

SEQ ID NO: 14278 - RNA, 22 nt, Human
ccuggcuccgguucaagggaaa

SEQ ID NO: 14279 - RNA, 18 nt, Human
cgaggcaggcggaucacg

SEQ ID NO: 14280 - RNA, 20 nt, Human
cgaggccaaggggcugggcc

SEQ ID NO: 14281 - RNA, 22 nt, Human
cgaggccaauguguuuuaugaa

SEQ ID NO: 14282 - RNA, 22 nt, Human
cgaggccaugcaugcugaggac

SEQ ID NO: 14283 - RNA, 17 nt, Human
cgagggcuugcuggcuc

SEQ ID NO: 14284 - RNA, 22 nt, Human
cgaguccaggguuaggaguccg

SEQ ID NO: 14285 - RNA, 22 nt, Human
cgauggaauuggaaagaggaau

SEQ ID NO: 14286 - RNA, 22 nt, Human
cgcaacagagcagguuugauga

SEQ ID NO: 14287 - RNA, 22 nt, Human
cgcagacacugaggguccgggg

SEQ ID NO: 14288 - RNA, 21 nt, Human
cgcagcugagaaauauacaga

SEQ ID NO: 14289 - RNA, 19 nt, Human
cgcaggagccgaggugacc

SEQ ID NO: 14290 - RNA, 22 nt, Human
cgcaggcaaugcuccgcggggg

SEQ ID NO: 14291 - RNA, 19 nt, Human
cgcaggcuucgggucgcuc

SEQ ID NO: 14292 - RNA, 22 nt, Human
cgcaggggaggaagguacaccu

SEQ ID NO: 14293 - RNA, 22 nt, Human
cgcagugagucuguaaaaggcu

SEQ ID NO: 14294 - RNA, 22 nt, Human
cgcauacauagaaacacacaga

SEQ ID NO: 14295 - RNA, 18 nt, Human
cgcauguacacgucaugc

SEQ ID NO: 14296 - RNA, 20 nt, Human
cgcccagugcgguucugacc

SEQ ID NO: 14297 - RNA, 18 nt, Human
cgcccugcuauaaaugac

SEQ ID NO: 14298 - RNA, 22 nt, Human
cgccgccugcugcagcagcugu

SEQ ID NO: 14299 - RNA, 22 nt, Human
cgccggcuugaggcaggcggca

SEQ ID NO: 14300 - RNA, 22 nt, Human
cgccguccccuaggaaagagcu

SEQ ID NO: 14301 - RNA, 22 nt, Human
cgccucagccguggucaucuuc

SEQ ID NO: 14302 - RNA, 16 nt, Human
cgccucccucccucgc

SEQ ID NO: 14303 - RNA, 22 nt, Human
cgccugcucuguuuccaugugg

SEQ ID NO: 14304 - RNA, 22 nt, Human
cgccuggaaccucuaggaccag

SEQ ID NO: 14305 - RNA, 22 nt, Human
cgccuggagaggaggcgacgcg

SEQ ID NO: 14306 - RNA, 22 nt, Human
cgcgcucauuuccgccuccuuc

SEQ ID NO: 14307 - RNA, 22 nt, Human
cgcggucucuuuaaggcggguc

SEQ ID NO: 14308 - RNA, 22 nt, Human
cgcgguggcggccuccagcgcc

SEQ ID NO: 14309 - RNA, 20 nt, Human
cgcuccagucgcuggugugu

SEQ ID NO: 14310 - RNA, 22 nt, Human
cgcuccuugagcgugucggccu

SEQ ID NO: 14311 - RNA, 19 nt, Human
cgcucuggguuucguguca

SEQ ID NO: 14312 - RNA, 22 nt, Human
cgcuggaaauugccguuggcuu

SEQ ID NO: 14313 - RNA, 22 nt, Human
cgcuggcuuccuccuggggcca

SEQ ID NO: 14314 - RNA, 22 nt, Human
cgcugggcgccgaccugcuggc

SEQ ID NO: 14315 - RNA, 22 nt, Human
cgcugggggaacuucagccaau

SEQ ID NO: 14316 - RNA, 22 nt, Human
cgcugugccuggcacccagugu

SEQ ID NO: 14317 - RNA, 22 nt, Human
cgcuguguuuacaucauugcug

SEQ ID NO: 14318 - RNA, 21 nt, Human
cggaaacucggcucugguucc

SEQ ID NO: 14319 - RNA, 23 nt, Human
cggacaaccauuguuuuaguauc

SEQ ID NO: 14320 - RNA, 22 nt, Human
cggagcagagccacucgggccg

SEQ ID NO: 14321 - RNA, 22 nt, Human
cggagcuggcgucuguguggac

SEQ ID NO: 14322 - RNA, 22 nt, Human
cggaggggauacauuuucugaa

SEQ ID NO: 14323 - RNA, 22 nt, Human
cggagggguuugaacagaggag

SEQ ID NO: 14324 - RNA, 18 nt, Human
cggaucaugcgcugaggc

SEQ ID NO: 14325 - RNA, 22 nt, Human
cggauccucagucgugcgggag

SEQ ID NO: 14326 - RNA, 22 nt, Human
cggcagagcccugagucagccu

SEQ ID NO: 14327 - RNA, 22 nt, Human
cggcagcugauugcagagcacc

SEQ ID NO: 14328 - RNA, 22 nt, Human
cggcaggaccucauuuccuucu

SEQ ID NO: 14329 - RNA, 22 nt, Human
cggcagggcuccaugcauuucu

SEQ ID NO: 14330 - RNA, 22 nt, Human
cggcaggguugguuuucucuga

SEQ ID NO: 14331 - RNA, 21 nt, Human
cggccaaauuccuccuaggga

SEQ ID NO: 14332 - RNA, 22 nt, Human
cggcccugcugagcuugucugg

SEQ ID NO: 14333 - RNA, 22 nt, Human
cggccuugacaagcuuagcagc

SEQ ID NO: 14334 - RNA, 22 nt, Human
cggcuggaagcuggacaggccg

SEQ ID NO: 14335 - RNA, 22 nt, Human
cggcuggguagaggugccgggu

SEQ ID NO: 14336 - RNA, 22 nt, Human
cggcuggugucgggcacagcaa

SEQ ID NO: 14337 - RNA, 22 nt, Human
cggcugugucuucacaggagcc

SEQ ID NO: 14338 - RNA, 22 nt, Human
cggcuucaaagggagcgagauc

SEQ ID NO: 14339 - RNA, 22 nt, Human
cggcuucaucuuuacuucaaga

SEQ ID NO: 14340 - RNA, 21 nt, Human
cggcuucugcauuccagagcu

SEQ ID NO: 14341 - RNA, 22 nt, Human
cggcuucuuuuaagguugcuga

SEQ ID NO: 14342 - RNA, 22 nt, Human
cgggcagaucacacagggcuug

SEQ ID NO: 14343 - RNA, 17 nt, Human
cgggcauggagggcagg

SEQ ID NO: 14344 - RNA, 18 nt, Human
cgggcgggcgccuggccc

SEQ ID NO: 14345 - RNA, 22 nt, Human
cggggagaacacuguguccuuc

SEQ ID NO: 14346 - RNA, 22 nt, Human
cggggccuaccgcugcguggcc

SEQ ID NO: 14347 - RNA, 22 nt, Human
cgggggaguugaggcacauggg

SEQ ID NO: 14348 - RNA, 22 nt, Human
cgguccuggcacuugcggcucc

SEQ ID NO: 14349 - RNA, 22 nt, Human
cgguccuguacuugaugagaua

SEQ ID NO: 14350 - RNA, 22 nt, Human
cggucugagauuuuuaauaggc

SEQ ID NO: 14351 - RNA, 21 nt, Human
cgguggcucccgggauggcuc

SEQ ID NO: 14352 - RNA, 22 nt, Human
cgguggucauaaguggcuggcg

SEQ ID NO: 14353 - RNA, 22 nt, Human
cguauacaugaagacauugcug

SEQ ID NO: 14354 - RNA, 22 nt, Human
cgucacuucuuagucuauuuuc

SEQ ID NO: 14355 - RNA, 22 nt, Human
cgucccuaccuggcagcugcgc

SEQ ID NO: 14356 - RNA, 22 nt, Human
cguccugggucugggaaggcau

SEQ ID NO: 14357 - RNA, 22 nt, Human
cgucuccuguguucgagccauu

SEQ ID NO: 14358 - RNA, 22 nt, Human
cgucugccuaaggacugccuuc

SEQ ID NO: 14359 - RNA, 22 nt, Human
cgucuuccucuuacgaugcgcu

SEQ ID NO: 14360 - RNA, 22 nt, Human
cgucuuuauugauuccuucaag

SEQ ID NO: 14361 - RNA, 22 nt, Human
cgugacagggucuggcugguca

SEQ ID NO: 14362 - RNA, 22 nt, Human
cgugagggcauggcagugagga

SEQ ID NO: 14363 - RNA, 22 nt, Human
cgugaguggguagcuuauucuu

SEQ ID NO: 14364 - RNA, 22 nt, Human
cgugauuucuggcuuucuauau

SEQ ID NO: 14365 - RNA, 22 nt, Human
cgugccuuggucccaaccccca

SEQ ID NO: 14366 - RNA, 22 nt, Human
cgugcuaacguuuaagguuaug

SEQ ID NO: 14367 - RNA, 22 nt, Human
cguggccagccauuuccuggaa

SEQ ID NO: 14368 - RNA, 22 nt, Human
cguggggacccacgugcagcac

SEQ ID NO: 14369 - RNA, 23 nt, Human
cguguccuucagggagagugugg

SEQ ID NO: 14370 - RNA, 22 nt, Human
cgugucugggauagcagaagua

SEQ ID NO: 14371 - RNA, 22 nt, Human
cgugucugggcucccauggcag

SEQ ID NO: 14372 - RNA, 22 nt, Human
cgugucuguaugucaaucagcu

SEQ ID NO: 14373 - RNA, 23 nt, Human
cgugucugugggcgauccggccu

SEQ ID NO: 14374 - RNA, 20 nt, Human
cguguguggcuauuuugggu

SEQ ID NO: 14375 - RNA, 22 nt, Human
cguuaauaggugcaagguaagg

SEQ ID NO: 14376 - RNA, 22 nt, Human
cguuaguggaguuugaagcugu

SEQ ID NO: 14377 - RNA, 22 nt, Human
cguucacaucguauuauuggga

SEQ ID NO: 14378 - RNA, 22 nt, Human
cguuccucuacuccagcuaccc

SEQ ID NO: 14379 - RNA, 22 nt, Human
cguuuaaccagcacgcuuggcc

SEQ ID NO: 14380 - RNA, 22 nt, Human
gaugucuuugcuguuauccacu

SEQ ID NO: 14381 - RNA, 22 nt, Human
gaugugaggugguaaacaggga

SEQ ID NO: 14382 - RNA, 22 nt, Human
gaugugagugguagcugggauu

SEQ ID NO: 14383 - RNA, 22 nt, Human
gauguggaugaucuuagauggu

SEQ ID NO: 14384 - RNA, 22 nt, Human
gauguguaacaugcugugacau

SEQ ID NO: 14385 - RNA, 20 nt, Human
gauguguccucagcaguggu

SEQ ID NO: 14386 - RNA, 22 nt, Human
gauguguccuuuucuccaucca

SEQ ID NO: 14387 - RNA, 22 nt, Human
gaugugucuccguuucaaggca

SEQ ID NO: 14388 - RNA, 22 nt, Human
gauguguguuuauacauauauu

SEQ ID NO: 14389 - RNA, 22 nt, Human
gcaagcaguuacccaggauucg

SEQ ID NO: 14390 - RNA, 22 nt, Human
gcaagcugugccuucucaggau

SEQ ID NO: 14391 - RNA, 22 nt, Human
gcaaggaccuuugagcgugcca

SEQ ID NO: 14392 - RNA, 22 nt, Human
gcaaggagcaccuuucuggaac

SEQ ID NO: 14393 - RNA, 22 nt, Human
gcaaggaggcugguggaggaag

SEQ ID NO: 14394 - RNA, 21 nt, Human
gcaaguacuaucaucauuauc

SEQ ID NO: 14395 - RNA, 22 nt, Human
gcaaguagugggaaagaagaug

SEQ ID NO: 14396 - RNA, 22 nt, Human
gcaagugauugucacgucccuu

SEQ ID NO: 14397 - RNA, 22 nt, Human
gcaaguuauuuccauuuaaagc

SEQ ID NO: 14398 - RNA, 22 nt, Human
gcaaguuggagacucaugagaa

SEQ ID NO: 14399 - RNA, 22 nt, Human
gcaauaaagauuuuacugucag

SEQ ID NO: 14400 - RNA, 22 nt, Human
gcaauacaguaagaguacugua

SEQ ID NO: 14401 - RNA, 22 nt, Human
gcaauagagcagcuaauggaaa

SEQ ID NO: 14402 - RNA, 22 nt, Human
gcaauauaaccaguugucaugc

SEQ ID NO: 14403 - RNA, 22 nt, Human
gcaaugaauaaauaauguuuag

SEQ ID NO: 14404 - RNA, 22 nt, Human
gcaaugaggagugguagggaua

SEQ ID NO: 14405 - RNA, 22 nt, Human
gcaaugcaaucuuuauuauauu

SEQ ID NO: 14406 - RNA, 22 nt, Human
gcaaugcagggcaacauggggu

SEQ ID NO: 14407 - RNA, 20 nt, Human
gcaauggcgugcuaguucug

SEQ ID NO: 14408 - RNA, 22 nt, Human
gcaaugucugcaaugggugugg

SEQ ID NO: 14409 - RNA, 22 nt, Human
gcaauuauaucaccagagaucu

SEQ ID NO: 14410 - RNA, 22 nt, Human
gcacaaaacacauuuugacaau

SEQ ID NO: 14411 - RNA, 22 nt, Human
gcacaaacugcaauuacuuuug

SEQ ID NO: 14412 - RNA, 22 nt, Human
gcacaaagaugaauacagaaug

SEQ ID NO: 14413 - RNA, 22 nt, Human
gcacaaauacaaaguugagaaa

SEQ ID NO: 14414 - RNA, 17 nt, Human
gcacaaaucaauuacua

SEQ ID NO: 14415 - RNA, 23 nt, Human
gcacaagaccuggcagcuuccau

SEQ ID NO: 14416 - RNA, 22 nt, Human
gcacaaggguggucucuggagc

SEQ ID NO: 14417 - RNA, 22 nt, Human
gcacaaguuucuucauuguuca

SEQ ID NO: 14418 - RNA, 22 nt, Human
gcacaauaauucuuguuuugcu

SEQ ID NO: 14419 - RNA, 22 nt, Human
gcacaauuauuuaugcaguaug

SEQ ID NO: 14420 - RNA, 22 nt, Human
gcacacacuguuuuccucacau

SEQ ID NO: 14421 - RNA, 22 nt, Human
gcacacagacuaaccauauuuc

SEQ ID NO: 14422 - RNA, 19 nt, Human
gcacacaguagggcuggca

SEQ ID NO: 14423 - RNA, 19 nt, Human
gcacacauacacccuuugg

SEQ ID NO: 14424 - RNA, 22 nt, Human
gcacacaucuuguaauccugag

SEQ ID NO: 14425 - RNA, 22 nt, Human
gcacacauucggauucuuaacc

SEQ ID NO: 14426 - RNA, 22 nt, Human
gcacacccucucaccagcacug

SEQ ID NO: 14427 - RNA, 22 nt, Human
gcacacguagaagaacuugacu

SEQ ID NO: 14428 - RNA, 22 nt, Human
gcacagaaaugucuacacaugu

SEQ ID NO: 14429 - RNA, 22 nt, Human
gcacagaaccagacaugaggca

SEQ ID NO: 14430 - RNA, 22 nt, Human
gcacagaacuucucuuaguagg

SEQ ID NO: 14431 - RNA, 22 nt, Human
gcacagaagagcuuuggaauga

SEQ ID NO: 14432 - RNA, 22 nt, Human
gcacagacucaccuuaauuuga

SEQ ID NO: 14433 - RNA, 22 nt, Human
gcacagagaggcugugagcgcc

SEQ ID NO: 14434 - RNA, 22 nt, Human
gcacagagagggaagguaacuu

SEQ ID NO: 14435 - RNA, 20 nt, Human
gcacagagaugagcaaagua

SEQ ID NO: 14436 - RNA, 22 nt, Human
gcacagagugggugagaugugg

SEQ ID NO: 14437 - RNA, 22 nt, Human
gcacagcagacuugguggggcu

SEQ ID NO: 14438 - RNA, 22 nt, Human
gcacagcagcugcucaguugcu

SEQ ID NO: 14439 - RNA, 21 nt, Human
gcacagcaugaguguuggcau

SEQ ID NO: 14440 - RNA, 22 nt, Human
gcacagccacguaaugugguca

SEQ ID NO: 14441 - RNA, 22 nt, Human
gcacagccggaccgaggaaaag

SEQ ID NO: 14442 - RNA, 18 nt, Human
gcacagcuaggagggucc

SEQ ID NO: 14443 - RNA, 22 nt, Human
gcacagcucgagcucaggaggg

SEQ ID NO: 14444 - RNA, 19 nt, Human
gcacaggacaucugaugga

SEQ ID NO: 14445 - RNA, 22 nt, Human
gcacagggagacagccguggcc

SEQ ID NO: 14446 - RNA, 22 nt, Human
gcacagggccuggcacauaaga

SEQ ID NO: 14447 - RNA, 22 nt, Human
gcacagucaacacuuauucacc

SEQ ID NO: 14448 - RNA, 22 nt, Human
gcacagugauaggcaguugugc

SEQ ID NO: 14449 - RNA, 22 nt, Human
gcacaguggaguguguccaggg

SEQ ID NO: 14450 - RNA, 22 nt, Human
gcacauaacugaccacaucuaa

SEQ ID NO: 14451 - RNA, 22 nt, Human
gcacauauguaaauagcugccu

SEQ ID NO: 14452 - RNA, 22 nt, Human
gcacaugaggcugucuuugucu

SEQ ID NO: 14453 - RNA, 21 nt, Human
gcacaugagggagggcaugcc

SEQ ID NO: 14454 - RNA, 20 nt, Human
gcacaugcaacuuuuauuua

SEQ ID NO: 14455 - RNA, 22 nt, Human
gcacauuguuacucuuacugug

SEQ ID NO: 14456 - RNA, 22 nt, Human
gcacauuucucaaagaauuguc

SEQ ID NO: 14457 - RNA, 22 nt, Human
gcacauuugccacugagcuccu

SEQ ID NO: 14458 - RNA, 22 nt, Human
gcaccacaucaaugaggggagc

SEQ ID NO: 14459 - RNA, 22 nt, Human
gcaccagcugcuggguucuaga

SEQ ID NO: 14460 - RNA, 22 nt, Human
gcaccagggugcuguguucugg

SEQ ID NO: 14461 - RNA, 22 nt, Human
gcacccacuuaggccagucaau

SEQ ID NO: 14462 - RNA, 22 nt, Human
gcacccagaauaaggacaggac

SEQ ID NO: 14463 - RNA, 22 nt, Human
gcacccagaggucagcagugcu

SEQ ID NO: 14464 - RNA, 21 nt, Human
gcacccagccgguucucccag

SEQ ID NO: 14465 - RNA, 19 nt, Human
gcaccccaucuuccuccug

SEQ ID NO: 14466 - RNA, 22 nt, Human
gcaccccuggacgguagggcca

SEQ ID NO: 14467 - RNA, 22 nt, Human
gcacccugcucuauccuugcua

SEQ ID NO: 14468 - RNA, 17 nt, Human
gcaccgugggcacacuc

SEQ ID NO: 14469 - RNA, 22 nt, Human
gcaccugaacgaccugcuccag

SEQ ID NO: 14470 - RNA, 22 nt, Human
gcaccugaggaggcaucuggag

SEQ ID NO: 14471 - RNA, 22 nt, Human
gcaccugauugauuucacugcu

SEQ ID NO: 14472 - RNA, 22 nt, Human
gcaccugguuuauauaaucaua

SEQ ID NO: 14473 - RNA, 22 nt, Human
gcaccuuaauuaagaaauugcc

SEQ ID NO: 14474 - RNA, 22 nt, Human
gcacguguucuguggcaugggu

SEQ ID NO: 14475 - RNA, 22 nt, Human
gcacuagauacuguucaggaaa

SEQ ID NO: 14476 - RNA, 22 nt, Human
gcacuaguucuacugccagcaa

SEQ ID NO: 14477 - RNA, 22 nt, Human
gcacuauagcugcagcacagag

SEQ ID NO: 14478 - RNA, 22 nt, Human
gcacucaguaccaggucacugc

SEQ ID NO: 14479 - RNA, 22 nt, Human
gcacucugugaucugcagagcc

SEQ ID NO: 14480 - RNA, 22 nt, Human
gcacugaaauuauaugcauuug

SEQ ID NO: 14481 - RNA, 19 nt, Human
gcacugaagaguuggucac

SEQ ID NO: 14482 - RNA, 22 nt, Human
gcacugaaugccaaaguguagg

SEQ ID NO: 14483 - RNA, 22 nt, Human
gcacugccaucaaugcaugaca

SEQ ID NO: 14484 - RNA, 22 nt, Human
gcacugccuaugcaaauguacu

SEQ ID NO: 14485 - RNA, 22 nt, Human
gcacugccugugagcccugguu

SEQ ID NO: 14486 - RNA, 22 nt, Human
gcacugcuuucugagucauugu

SEQ ID NO: 14487 - RNA, 22 nt, Human
gcacugggcuccaggaaggagg

SEQ ID NO: 14488 - RNA, 22 nt, Human
gcacuggggucauagccuccag

SEQ ID NO: 14489 - RNA, 22 nt, Human
gcacugggugggagaucugaau

SEQ ID NO: 14490 - RNA, 22 nt, Human
gcacugguuuauuuaagaacaa

SEQ ID NO: 14491 - RNA, 22 nt, Human
gcacugugacagcaagagugag

SEQ ID NO: 14492 - RNA, 22 nt, Human
gcacugugcuaaacauguauca

SEQ ID NO: 14493 - RNA, 22 nt, Human
gcacugugcuuaguucacuauu

SEQ ID NO: 14494 - RNA, 22 nt, Human
gcacuucacaugccuuuuccug

SEQ ID NO: 14495 - RNA, 21 nt, Human
gcacuucugcagggcugcugg

SEQ ID NO: 14496 - RNA, 22 nt, Human
gcacuugacccccagagcuggu

SEQ ID NO: 14497 - RNA, 20 nt, Human
gcacuuggcugcugcuucuc

SEQ ID NO: 14498 - RNA, 22 nt, Human
agaacagcaggaaggccaggua

SEQ ID NO: 14499 - RNA, 22 nt, Human
agaacagcaguuaugguucauu

SEQ ID NO: 14500 - RNA, 22 nt, Human
agaacagccaacuguguaggag

SEQ ID NO: 14501 - RNA, 22 nt, Human
agaacaggaggaagccagcucc

SEQ ID NO: 14502 - RNA, 22 nt, Human
agaacagugcugauaaaucaua

SEQ ID NO: 14503 - RNA, 22 nt, Human
agaacauaucuguuuucuaacu

SEQ ID NO: 14504 - RNA, 22 nt, Human
agaacauuugucaaaaagccaa

SEQ ID NO: 14505 - RNA, 22 nt, Human
agaaccucuggauacaguuuaa

SEQ ID NO: 14506 - RNA, 22 nt, Human
agaaccuugaucuuggacuucu

SEQ ID NO: 14507 - RNA, 22 nt, Human
agaacgucuuuacucuuacgaa

SEQ ID NO: 14508 - RNA, 22 nt, Human
agaacuauugcaauaacaagaa

SEQ ID NO: 14509 - RNA, 22 nt, Human
agaacucugaacacugucugga

SEQ ID NO: 14510 - RNA, 22 nt, Human
agaacucuuuaucuguggaaug

SEQ ID NO: 14511 - RNA, 20 nt, Human
agaacugaaucauuuugggu

SEQ ID NO: 14512 - RNA, 21 nt, Human
agaacugauuaaauaagcagu

SEQ ID NO: 14513 - RNA, 22 nt, Human
agaacugguggugaucaguuau

SEQ ID NO: 14514 - RNA, 22 nt, Human
agaacuguccuuggaggagagu

SEQ ID NO: 14515 - RNA, 22 nt, Human
agaacugugaaguaugugaaau

SEQ ID NO: 14516 - RNA, 22 nt, Human
agaagaaagauugaagguuccu

SEQ ID NO: 14517 - RNA, 22 nt, Human
agaagagaacugccaaacacuu

SEQ ID NO: 14518 - RNA, 22 nt, Human
agaagaguaguaacagaaauua

SEQ ID NO: 14519 - RNA, 22 nt, Human
agaagauguugcaguugaugcg

SEQ ID NO: 14520 - RNA, 23 nt, Human
agaagcaaugcuuuuuuuccucu

SEQ ID NO: 14521 - RNA, 18 nt, Human
agaagcacaagaugucuu

SEQ ID NO: 14522 - RNA, 22 nt, Human
agaagcacaccugaccucuagc

SEQ ID NO: 14523 - RNA, 22 nt, Human
agaagcagacucugaggcaagg

SEQ ID NO: 14524 - RNA, 22 nt, Human
agaagcagcuuucaaggugauu

SEQ ID NO: 14525 - RNA, 22 nt, Human
agaagcaggcagauuucagcuc

SEQ ID NO: 14526 - RNA, 18 nt, Human
agaagcagguucucccag

SEQ ID NO: 14527 - RNA, 20 nt, Human
agaagcaucauucugauguc

SEQ ID NO: 14528 - RNA, 22 nt, Human
agaagccaagaacagacagugc

SEQ ID NO: 14529 - RNA, 20 nt, Human
agaagccaagugacauguuu

SEQ ID NO: 14530 - RNA, 22 nt, Human
agaagccaauccuugucucucu

SEQ ID NO: 14531 - RNA, 22 nt, Human
agaagccagaauauucauggau

SEQ ID NO: 14532 - RNA, 22 nt, Human
agaagccagauuguagugggac

SEQ ID NO: 14533 - RNA, 22 nt, Human
agaagccagucgcucucccgca

SEQ ID NO: 14534 - RNA, 22 nt, Human
agaagccauaguaucucagggu

SEQ ID NO: 14535 - RNA, 22 nt, Human
agaagccauauuuagggaggag

SEQ ID NO: 14536 - RNA, 21 nt, Human
agaagccaugccaguaaaauu

SEQ ID NO: 14537 - RNA, 22 nt, Human
agaagccauggggucaccagag

SEQ ID NO: 14538 - RNA, 22 nt, Human
agaagccauucucaguuccuga

SEQ ID NO: 14539 - RNA, 22 nt, Human
agaagccauugaagcagaccuc

SEQ ID NO: 14540 - RNA, 21 nt, Human
agaagcuagucacuaaaucca

SEQ ID NO: 14541 - RNA, 22 nt, Human
agaagcugagaaugaauuaaga

SEQ ID NO: 14542 - RNA, 20 nt, Human
agaagcugagacuggguuuu

SEQ ID NO: 14543 - RNA, 22 nt, Human
agaagcuguugcauuccuggcg

SEQ ID NO: 14544 - RNA, 22 nt, Human
agaaggaaacagcugugcuuug

SEQ ID NO: 14545 - RNA, 22 nt, Human
agaaggaagccaggagggugca

SEQ ID NO: 14546 - RNA, 22 nt, Human
agaaggaaggauaacugcauua

SEQ ID NO: 14547 - RNA, 22 nt, Human
agaaggcagaugggacggagca

SEQ ID NO: 14548 - RNA, 22 nt, Human
agaaggcaucagaaguguguag

SEQ ID NO: 14549 - RNA, 22 nt, Human
agaaggcugagacugggaugaa

SEQ ID NO: 14550 - RNA, 22 nt, Human
agaaggguagggacuuauccaa

SEQ ID NO: 14551 - RNA, 22 nt, Human
agaaguauaacuauuugcuuuc

SEQ ID NO: 14552 - RNA, 22 nt, Human
agaaguaugugagaaauuaucc

SEQ ID NO: 14553 - RNA, 22 nt, Human
agaagucaaugaugagagugcu

SEQ ID NO: 14554 - RNA, 21 nt, Human
agaaguccccacucugucgca

SEQ ID NO: 14555 - RNA, 22 nt, Human
agaagugagugugacucagcag

SEQ ID NO: 14556 - RNA, 22 nt, Human
agaagugaguugugacuauggg

SEQ ID NO: 14557 - RNA, 22 nt, Human
agaagugccauacuguggucca

SEQ ID NO: 14558 - RNA, 22 nt, Human
agaagugucucaucaggcaaua

SEQ ID NO: 14559 - RNA, 22 nt, Human
agaaguuaauuccugaaauucu

SEQ ID NO: 14560 - RNA, 22 nt, Human
agaaguuaccacauacuucucu

SEQ ID NO: 14561 - RNA, 19 nt, Human
agaaguuagacauugcaau

SEQ ID NO: 14562 - RNA, 22 nt, Human
agaaguuugaaauuaggagaaa

SEQ ID NO: 14563 - RNA, 22 nt, Human
agaaguuuucauuaccuauaca

SEQ ID NO: 14564 - RNA, 22 nt, Human
agaauaaaauagucugaagaug

SEQ ID NO: 14565 - RNA, 22 nt, Human
agaauaaacugcuuuagggcag

SEQ ID NO: 14566 - RNA, 22 nt, Human
agaauaaauguuggacuuagga

SEQ ID NO: 14567 - RNA, 22 nt, Human
agaauagaauucucauagaauu

SEQ ID NO: 14568 - RNA, 22 nt, Human
agaauagagaaaaagguuauuu

SEQ ID NO: 14569 - RNA, 22 nt, Human
agaauaguuuuacuuuucuaug

SEQ ID NO: 14570 - RNA, 22 nt, Human
agaauauaguuaccaaauucug

SEQ ID NO: 14571 - RNA, 22 nt, Human
agaauaucguagcauauuaucu

SEQ ID NO: 14572 - RNA, 22 nt, Human
agaauaugccuuagcaagccca

SEQ ID NO: 14573 - RNA, 22 nt, Human
agaauauugaaaguucuugaca

SEQ ID NO: 14574 - RNA, 22 nt, Human
agaaucaauuagauucuaugag

SEQ ID NO: 14575 - RNA, 22 nt, Human
agaaucagaugaagacuccugc

SEQ ID NO: 14576 - RNA, 22 nt, Human
agaaucagugcuggcuauuagc

SEQ ID NO: 14577 - RNA, 22 nt, Human
agaaucauuauauuuauuaagc

SEQ ID NO: 14578 - RNA, 22 nt, Human
agaauccuauugucagauucuu

SEQ ID NO: 14579 - RNA, 22 nt, Human
agaauccuguuuuacuucauca

SEQ ID NO: 14580 - RNA, 22 nt, Human
agaaucugcauuuuuaauaaca

SEQ ID NO: 14581 - RNA, 22 nt, Human
agaaucuuggaacucagaucac

SEQ ID NO: 14582 - RNA, 22 nt, Human
agaaucuuguuucuuguguguu

SEQ ID NO: 14583 - RNA, 22 nt, Human
agaaugauuuuggacaauaugg

SEQ ID NO: 14584 - RNA, 17 nt, Human
agaaugcaaagcaggcu

SEQ ID NO: 14585 - RNA, 22 nt, Human
agaaugcaagauaaacuuuauu

SEQ ID NO: 14586 - RNA, 22 nt, Human
agaaugcauuuuguguagcuau

SEQ ID NO: 14587 - RNA, 22 nt, Human
agaaugcuccagagcugaaaga

SEQ ID NO: 14588 - RNA, 20 nt, Human
agaaugcuuuuugcauugca

SEQ ID NO: 14589 - RNA, 22 nt, Human
agaaugucuaaguguucagccc

SEQ ID NO: 14590 - RNA, 22 nt, Human
agaaugugaagacccgguuugu

SEQ ID NO: 14591 - RNA, 22 nt, Human
agaaugugauauagugauaugu

SEQ ID NO: 14592 - RNA, 22 nt, Human
agaaugugugcaagcaagugug

SEQ ID NO: 14593 - RNA, 22 nt, Human
agaauguguuuuaacaugggaa

SEQ ID NO: 14594 - RNA, 22 nt, Human
agaauuacagcuuuuagaauag

SEQ ID NO: 14595 - RNA, 22 nt, Human
agaauuagucacaauuauagga

SEQ ID NO: 14596 - RNA, 22 nt, Human
agaauucauaggaaguuuccua

SEQ ID NO: 14597 - RNA, 22 nt, Human
agcaggugagcacagccaggcu

SEQ ID NO: 14598 - RNA, 22 nt, Human
agcaggugaucgcgugugcucc

SEQ ID NO: 14599 - RNA, 22 nt, Human
agcaggugcguuacuucacucu

SEQ ID NO: 14600 - RNA, 22 nt, Human
agcagguggacagaggaagaaa

SEQ ID NO: 14601 - RNA, 18 nt, Human
agcagguggauuuauugg

SEQ ID NO: 14602 - RNA, 22 nt, Human
agcaggugggaucaagcuggca

SEQ ID NO: 14603 - RNA, 22 nt, Human
agcaggugggcaugaaagcuga

SEQ ID NO: 14604 - RNA, 21 nt, Human
agcagguguaaaggaggaaau

SEQ ID NO: 14605 - RNA, 18 nt, Human
agcaggugugcagaaugu

SEQ ID NO: 14606 - RNA, 18 nt, Human
agcagguucucacagcca

SEQ ID NO: 14607 - RNA, 22 nt, Human
agccaggcuacuccuugcugac

SEQ ID NO: 14608 - RNA, 22 nt, Human
agccagggacgcugcaggcuac

SEQ ID NO: 14609 - RNA, 22 nt, Human
agccagggauggcagugcccag

SEQ ID NO: 14610 - RNA, 22 nt, Human
agccagggcucuccuucgcgug

SEQ ID NO: 14611 - RNA, 22 nt, Human
agccagggcugcagguuccuug

SEQ ID NO: 14612 - RNA, 22 nt, Human
agccaggguaagguacuuagua

SEQ ID NO: 14613 - RNA, 22 nt, Human
agccagggucucucgcucuguu

SEQ ID NO: 14614 - RNA, 21 nt, Human
agccaggguggacacuguaug

SEQ ID NO: 14615 - RNA, 17 nt, Human
agccagguacaagucca

SEQ ID NO: 14616 - RNA, 22 nt, Human
agccaggucaggaaagguccca

SEQ ID NO: 14617 - RNA, 22 nt, Human
agccaggugcaguggcacacac

SEQ ID NO: 14618 - RNA, 21 nt, Human
agccagucauuaugagcggga

SEQ ID NO: 14619 - RNA, 22 nt, Human
agccagugaugaagacucugga

SEQ ID NO: 14620 - RNA, 22 nt, Human
agccagugcagcuggaaauuca

SEQ ID NO: 14621 - RNA, 22 nt, Human
agccaguggaauucccaggggu

SEQ ID NO: 14622 - RNA, 22 nt, Human
agccagugucgugugacaugag

SEQ ID NO: 14623 - RNA, 23 nt, Human
agccaguuguagccacagaacuc

SEQ ID NO: 14624 - RNA, 22 nt, Human
agccauaucaagcauucuucac

SEQ ID NO: 14625 - RNA, 23 nt, Human
agccaucauccugcugcuggggc

SEQ ID NO: 14626 - RNA, 22 nt, Human
agccauccucccaccucagccu

SEQ ID NO: 14627 - RNA, 22 nt, Human
agccaucuaagaaauacaaaau

SEQ ID NO: 14628 - RNA, 22 nt, Human
agccaucucugaaaucaaagcu

SEQ ID NO: 14629 - RNA, 22 nt, Human
agccauuagucauuuuagaaua

SEQ ID NO: 14630 - RNA, 22 nt, Human
agccauugaauuuagugccuuu

SEQ ID NO: 14631 - RNA, 22 nt, Human
agccauuguugucuucaucuuc

SEQ ID NO: 14632 - RNA, 22 nt, Human
agccauuuuccugaaauauaac

SEQ ID NO: 14633 - RNA, 22 nt, Human
agccauuuugguaaugauaaca

SEQ ID NO: 14634 - RNA, 22 nt, Human
agcccaagccuggcuggcgaug

SEQ ID NO: 14635 - RNA, 22 nt, Human
agcccaagcuaugaggugaccu

SEQ ID NO: 14636 - RNA, 22 nt, Human
agcccagauaaaguacaaccau

SEQ ID NO: 14637 - RNA, 22 nt, Human
agcccagaugguagcccuagaa

SEQ ID NO: 14638 - RNA, 22 nt, Human
agcccagcaaagggguuugaga

SEQ ID NO: 14639 - RNA, 22 nt, Human
agcccagcacugggggcccagc

SEQ ID NO: 14640 - RNA, 23 nt, Human
agcccagcagagaaccuaggucc

SEQ ID NO: 14641 - RNA, 22 nt, Human
agcccagccugauucuacaccc

SEQ ID NO: 14642 - RNA, 22 nt, Human
agcccagcggagcgggcccggg

SEQ ID NO: 14643 - RNA, 18 nt, Human
agcccagcggagugaauc

SEQ ID NO: 14644 - RNA, 22 nt, Human
agcccaggagccuuuggagggu

SEQ ID NO: 14645 - RNA, 22 nt, Human
agcccaggaguccuuaaggacc

SEQ ID NO: 14646 - RNA, 18 nt, Human
agcccaggcaucgucugc

SEQ ID NO: 14647 - RNA, 20 nt, Human
agcccaggccugugugaguc

SEQ ID NO: 14648 - RNA, 22 nt, Human
agcccagggaaccaggaagugg

SEQ ID NO: 14649 - RNA, 22 nt, Human
agcccaggucuggcccagccug

SEQ ID NO: 14650 - RNA, 22 nt, Human
agcccauguggcugaggcuucu

SEQ ID NO: 14651 - RNA, 22 nt, Human
agccccagccccucucucacaa

SEQ ID NO: 14652 - RNA, 22 nt, Human
agccccaguaagggagggccug

SEQ ID NO: 14653 - RNA, 22 nt, Human
agccccaguccgcugcgggcgg

SEQ ID NO: 14654 - RNA, 23 nt, Human
agccccucauaucugcuuucucu

SEQ ID NO: 14655 - RNA, 22 nt, Human
agccccucuccgcccugagucg

SEQ ID NO: 14656 - RNA, 22 nt, Human
agccccucuguggcucugccuc

SEQ ID NO: 14657 - RNA, 22 nt, Human
agccccugggaguagcugcugc

SEQ ID NO: 14658 - RNA, 22 nt, Human
agccccuguacccugagugcuu

SEQ ID NO: 14659 - RNA, 22 nt, Human
agccccuguccucucugaugac

SEQ ID NO: 14660 - RNA, 22 nt, Human
agccccuguuuuuccagucaga

SEQ ID NO: 14661 - RNA, 22 nt, Human
agcccgagcgcaccuguggaaa

SEQ ID NO: 14662 - RNA, 22 nt, Human
agcccgcaucucgcuaaagaua

SEQ ID NO: 14663 - RNA, 22 nt, Human
agcccuccaucugugcucaggc

SEQ ID NO: 14664 - RNA, 22 nt, Human
agcccuccucacaucagcgucc

SEQ ID NO: 14665 - RNA, 22 nt, Human
agcccugaccuguccuguucug

SEQ ID NO: 14666 - RNA, 22 nt, Human
agcccugauuaaccuuggcuuu

SEQ ID NO: 14667 - RNA, 22 nt, Human
agcccugcccugccauguggca

SEQ ID NO: 14668 - RNA, 22 nt, Human
agcccugcgaucgugauuucuu

SEQ ID NO: 14669 - RNA, 22 nt, Human
agcccugcgcucacguucugca

SEQ ID NO: 14670 - RNA, 22 nt, Human
agcccugcucaucuggaucccg

SEQ ID NO: 14671 - RNA, 22 nt, Human
agcccugcugcuucuuguauuu

SEQ ID NO: 14672 - RNA, 22 nt, Human
agcccuggagcaaaggugucuu

SEQ ID NO: 14673 - RNA, 22 nt, Human
agcccugggcguuacugggaug

SEQ ID NO: 14674 - RNA, 22 nt, Human
agcccugggcuguagauaagca

SEQ ID NO: 14675 - RNA, 22 nt, Human
agcccugggucccaguccuggc

SEQ ID NO: 14676 - RNA, 22 nt, Human
agcccugguuugcagcauuugc

SEQ ID NO: 14677 - RNA, 20 nt, Human
agcccuguaaauccccugga

SEQ ID NO: 14678 - RNA, 22 nt, Human
agcccuguuaacuguuuugaag

SEQ ID NO: 14679 - RNA, 22 nt, Human
agcccuguugucugaugauggg

SEQ ID NO: 14680 - RNA, 20 nt, Human
agcccuguuuccuggagaga

SEQ ID NO: 14681 - RNA, 22 nt, Human
agcccuugaguguaucucaaau

SEQ ID NO: 14682 - RNA, 22 nt, Human
agcccuuuccaauuugauuuau

SEQ ID NO: 14683 - RNA, 22 nt, Human
agccuccaucucccaucuguga

SEQ ID NO: 14684 - RNA, 22 nt, Human
agccuccuggaguuucugggau

SEQ ID NO: 14685 - RNA, 22 nt, Human
agccucuagacccuggccugca

SEQ ID NO: 14686 - RNA, 22 nt, Human
agccucucaaagaaacccugua

SEQ ID NO: 14687 - RNA, 22 nt, Human
agccucucauguucucccccag

SEQ ID NO: 14688 - RNA, 22 nt, Human
agccucugaugaucacaggggg

SEQ ID NO: 14689 - RNA, 18 nt, Human
agccucuggcagagagaa

SEQ ID NO: 14690 - RNA, 22 nt, Human
agccucuggcccuagacugcuu

SEQ ID NO: 14691 - RNA, 22 nt, Human
agccucugguccucccucagcu

SEQ ID NO: 14692 - RNA, 22 nt, Human
agccugccaggcgcugccugga

SEQ ID NO: 14693 - RNA, 17 nt, Human
agccugccccaugcugc

SEQ ID NO: 14694 - RNA, 21 nt, Human
agccugccugaacucuguggc

SEQ ID NO: 14695 - RNA, 22 nt, Human
agccugccugugaggcuuugag

SEQ ID NO: 14696 - RNA, 22 nt, Human
agccugccuugggcugcuugag

SEQ ID NO: 14697 - RNA, 17 nt, Human
agccugcugaucucaca

SEQ ID NO: 14698 - RNA, 22 nt, Human
agccugcugggaagggaggcuu

SEQ ID NO: 14699 - RNA, 20 nt, Human
agccugcuguagaaguuugg

SEQ ID NO: 14700 - RNA, 22 nt, Human
agccuggagaagauguguauug

SEQ ID NO: 14701 - RNA, 19 nt, Human
agccuggagggcuggucac

SEQ ID NO: 14702 - RNA, 20 nt, Human
agccuggcaaacacccccag

SEQ ID NO: 14703 - RNA, 22 nt, Human
agccuggcacugccccauccau

SEQ ID NO: 14704 - RNA, 22 nt, Human
agccuggccaggccugcccagg

SEQ ID NO: 14705 - RNA, 22 nt, Human
agccuggcccugcugaacucug

SEQ ID NO: 14706 - RNA, 22 nt, Human
agccuggccugggcaggcacau

SEQ ID NO: 14707 - RNA, 22 nt, Human
agccuggcuuaauccuccuuuu

SEQ ID NO: 14708 - RNA, 19 nt, Human
agccuggcuuugcucugcu

SEQ ID NO: 14709 - RNA, 22 nt, Human
agccugggagacacuaaguugu

SEQ ID NO: 14710 - RNA, 22 nt, Human
agccugggcaugggacgggagg

SEQ ID NO: 14711 - RNA, 22 nt, Human
agccuggguggggguucggaga

SEQ ID NO: 14712 - RNA, 22 nt, Human
agccuggguuuuuauuaaggag

SEQ ID NO: 14713 - RNA, 22 nt, Human
agccuggugauaucagugguuu

SEQ ID NO: 14714 - RNA, 22 nt, Human
agccugguuuaagcauuuuaua

SEQ ID NO: 14715 - RNA, 22 nt, Human
agccugugacucugugaaacca

SEQ ID NO: 14716 - RNA, 22 nt, Human
agaggacacaucuuuccucaaa

SEQ ID NO: 14717 - RNA, 22 nt, Human
agaggacagagugcuggauuua

SEQ ID NO: 14718 - RNA, 22 nt, Human
agaggacagguuuuccaugggc

SEQ ID NO: 14719 - RNA, 22 nt, Human
agaggaguauuuucuaagggaa

SEQ ID NO: 14720 - RNA, 22 nt, Human
agaggaucuaagugaguccuca

SEQ ID NO: 14721 - RNA, 20 nt, Human
agaggauuuauguggaugug

SEQ ID NO: 14722 - RNA, 22 nt, Human
agaggcaagauuaucagggcau

SEQ ID NO: 14723 - RNA, 19 nt, Human
agaggcaagggcucaugac

SEQ ID NO: 14724 - RNA, 22 nt, Human
agaggcaaguucagagcuagga

SEQ ID NO: 14725 - RNA, 23 nt, Human
agaggcacuaauuauucagagau

SEQ ID NO: 14726 - RNA, 22 nt, Human
agaggcagaaguguucaaaccc

SEQ ID NO: 14727 - RNA, 22 nt, Human
agaggcagcagucauacuacag

SEQ ID NO: 14728 - RNA, 22 nt, Human
agaggcaugaucuuauaauuua

SEQ ID NO: 14729 - RNA, 22 nt, Human
agaggcaugcacagaugugcug

SEQ ID NO: 14730 - RNA, 21 nt, Human
agaggccaagucaucauuucc

SEQ ID NO: 14731 - RNA, 22 nt, Human
agaggccaccagagguggugcc

SEQ ID NO: 14732 - RNA, 22 nt, Human
agaggccagaucaucauagaug

SEQ ID NO: 14733 - RNA, 22 nt, Human
agaggccagcacugcagggaag

SEQ ID NO: 14734 - RNA, 22 nt, Human
agaggccagcuagcgggccauc

SEQ ID NO: 14735 - RNA, 22 nt, Human
agaggccaggcugcagagggau

SEQ ID NO: 14736 - RNA, 22 nt, Human
agaggccagguccagaguuugu

SEQ ID NO: 14737 - RNA, 22 nt, Human
agaggccaucugcucugugggg

SEQ ID NO: 14738 - RNA, 22 nt, Human
agaggccauggggcauuuuuca

SEQ ID NO: 14739 - RNA, 22 nt, Human
agaggcccugggcuggugugcu

SEQ ID NO: 14740 - RNA, 22 nt, Human
agaggccuaauugcuacccuuu

SEQ ID NO: 14741 - RNA, 22 nt, Human
agaggccugugugcuccagugg

SEQ ID NO: 14742 - RNA, 21 nt, Human
agaggccuuacaggauagacc

SEQ ID NO: 14743 - RNA, 22 nt, Human
agaggcgcagacucuugagugu

SEQ ID NO: 14744 - RNA, 22 nt, Human
agaggcggagguugcagugagc

SEQ ID NO: 14745 - RNA, 22 nt, Human
aggaagcuccaugaaggcagag

SEQ ID NO: 14746 - RNA, 22 nt, Human
aggaagcuccuggagagccagu

SEQ ID NO: 14747 - RNA, 22 nt, Human
aggaagcugcuaagaaacaaug

SEQ ID NO: 14748 - RNA, 22 nt, Human
aggaagcuggugugaggaugaa

SEQ ID NO: 14749 - RNA, 22 nt, Human
aggaagcugguuacgaagggau

SEQ ID NO: 14750 - RNA, 22 nt, Human
aggaagcuuagauuuccagauc

SEQ ID NO: 14751 - RNA, 22 nt, Human
aggaagcuuuaugaccagcuaa

SEQ ID NO: 14752 - RNA, 22 nt, Human
aggaaggaagagacaccauuug

SEQ ID NO: 14753 - RNA, 22 nt, Human
aggaaggacuccaugguccguc

SEQ ID NO: 14754 - RNA, 22 nt, Human
aggaaggacugcagcauuuggu

SEQ ID NO: 14755 - RNA, 22 nt, Human
aggaagggcuguuucuccaaga

SEQ ID NO: 14756 - RNA, 22 nt, Human
aggaaggguucuuugugaaaga

SEQ ID NO: 14757 - RNA, 20 nt, Human
aggaagugauguuuuaucug

SEQ ID NO: 14758 - RNA, 21 nt, Human
aggaaguggccagauugggaa

SEQ ID NO: 14759 - RNA, 22 nt, Human
aggaagugggaagggucugcca

SEQ ID NO: 14760 - RNA, 22 nt, Human
aggaagugggguucucucacug

SEQ ID NO: 14761 - RNA, 22 nt, Human
aggaagugucagggauaacgau

SEQ ID NO: 14762 - RNA, 23 nt, Human
aggaaguuaugaagggagaauag

SEQ ID NO: 14763 - RNA, 22 nt, Human
aggaaguuggcauuuuguuuca

SEQ ID NO: 14764 - RNA, 17 nt, Human
aggaauacagaucuuca

SEQ ID NO: 14765 - RNA, 22 nt, Human
aggaaucccgcaccagcugcug

SEQ ID NO: 14766 - RNA, 22 nt, Human
aggaaugauaguaaaagagaau

SEQ ID NO: 14767 - RNA, 22 nt, Human
aggaaugauucaagacuuggcu

SEQ ID NO: 14768 - RNA, 22 nt, Human
aggaaugguuauggggauagua

SEQ ID NO: 14769 - RNA, 22 nt, Human
aggaauguaaaucuagauuuua

SEQ ID NO: 14770 - RNA, 22 nt, Human
aggaauguaacaggaguaaaaa

SEQ ID NO: 14771 - RNA, 14 nt, Human
aggaauguccuagg

SEQ ID NO: 14772 - RNA, 22 nt, Human
aggaaugucgucauaaacauga

SEQ ID NO: 14773 - RNA, 22 nt, Human
aggaaugugacuauuuuuucag

SEQ ID NO: 14774 - RNA, 23 nt, Human
aggaaugugcccacccaucuccu

SEQ ID NO: 14775 - RNA, 22 nt, Human
aggaaugugccuagccucccug

SEQ ID NO: 14776 - RNA, 22 nt, Human
aggaauguggaagguggcggcg

SEQ ID NO: 14777 - RNA, 21 nt, Human
aggaauguguauauauacaau

SEQ ID NO: 14778 - RNA, 22 nt, Human
aggaauguuaaagauuaagagc

SEQ ID NO: 14779 - RNA, 22 nt, Human
aggaauguuuacacgacagaaa

SEQ ID NO: 14780 - RNA, 22 nt, Human
aggacaagacaaggaccagaga

SEQ ID NO: 14781 - RNA, 22 nt, Human
aggacaauugagaguuuguuga

SEQ ID NO: 14782 - RNA, 22 nt, Human
aggacacacagaauacaaaucc

SEQ ID NO: 14783 - RNA, 22 nt, Human
aggacacaccagguccagcugu

SEQ ID NO: 14784 - RNA, 22 nt, Human
aggacacagcugcucugcagag

SEQ ID NO: 14785 - RNA, 22 nt, Human
aggacacaggcaggaggagauc

SEQ ID NO: 14786 - RNA, 22 nt, Human
aggacacaugcacacccugcgu

SEQ ID NO: 14787 - RNA, 22 nt, Human
aggacacuuggcuauuguucca

SEQ ID NO: 14788 - RNA, 22 nt, Human
aggacagaaucuauauucaguu

SEQ ID NO: 14789 - RNA, 22 nt, Human
aggacagagggaccagagccca

SEQ ID NO: 14790 - RNA, 22 nt, Human
aggacagauuuuuggccaccag

SEQ ID NO: 14791 - RNA, 22 nt, Human
aggacagcagccauuggcaguc

SEQ ID NO: 14792 - RNA, 20 nt, Human
aggacagcagcugccacuug

SEQ ID NO: 14793 - RNA, 22 nt, Human
aggacaguccgggguccuccac

SEQ ID NO: 14794 - RNA, 22 nt, Human
aggacaguggacacuagucccu

SEQ ID NO: 14795 - RNA, 22 nt, Human
aggaccagugagucuggcaagu

SEQ ID NO: 14796 - RNA, 22 nt, Human
aggaccauccuaagguaggcaa

SEQ ID NO: 14797 - RNA, 22 nt, Human
aggacccagaggcagaggacgu

SEQ ID NO: 14798 - RNA, 22 nt, Human
aggacccugaggucuccuguga

SEQ ID NO: 14799 - RNA, 22 nt, Human
aggaccugacauuguguuuucu

SEQ ID NO: 14800 - RNA, 22 nt, Human
aggaccuuggaauaacaaauuc

SEQ ID NO: 14801 - RNA, 22 nt, Human
aggaccuuuggcaaggcugcuc

SEQ ID NO: 14802 - RNA, 22 nt, Human
aggacuaaaaagaugcucuccc

SEQ ID NO: 14803 - RNA, 22 nt, Human
aggacuccauguguccuggaga

SEQ ID NO: 14804 - RNA, 18 nt, Human
aggacuccugggaguugg

SEQ ID NO: 14805 - RNA, 23 nt, Human
aggacugcucacuugaggcuucc

SEQ ID NO: 14806 - RNA, 22 nt, Human
aggacuggcggucgguggggau

SEQ ID NO: 14807 - RNA, 22 nt, Human
aggacuggugugugaucagcau

SEQ ID NO: 14808 - RNA, 22 nt, Human
aggacuucaaauggaaacaaaa

SEQ ID NO: 14809 - RNA, 22 nt, Human
aggacuuccauggauggauugg

SEQ ID NO: 14810 - RNA, 22 nt, Human
aggacuucuccgauaagucaga

SEQ ID NO: 14811 - RNA, 22 nt, Human
aggacuucugagcugcuuuaaa

SEQ ID NO: 14812 - RNA, 22 nt, Human
aggagaaggaagugcaucacua

SEQ ID NO: 14813 - RNA, 22 nt, Human
aggagacaucuaacuguagguu

SEQ ID NO: 14814 - RNA, 21 nt, Human
aggagaccggcuuguuugugc

SEQ ID NO: 14815 - RNA, 22 nt, Human
aggagagaauguuccaggcuug

SEQ ID NO: 14816 - RNA, 22 nt, Human
aggagagcaggccagccguccc

SEQ ID NO: 14817 - RNA, 22 nt, Human
aggagauagucaaagcuucuug

SEQ ID NO: 14818 - RNA, 20 nt, Human
aggagaugauccagagucag

SEQ ID NO: 14819 - RNA, 22 nt, Human
aggagauggagcucagugggca

SEQ ID NO: 14820 - RNA, 22 nt, Human
aggagcaaggaagcuacaguuu

SEQ ID NO: 14821 - RNA, 19 nt, Human
aggagcacugccagcacca

SEQ ID NO: 14822 - RNA, 22 nt, Human
aggagcagaacugauucugacu

SEQ ID NO: 14823 - RNA, 22 nt, Human
aggagcagaacuguuguggagg

SEQ ID NO: 14824 - RNA, 22 nt, Human
aggagcagaauuuaaugugcag

SEQ ID NO: 14825 - RNA, 21 nt, Human
agcaggugaaccuccaguaca

SEQ ID NO: 14826 - RNA, 22 nt, Human
agcaggugacccaagcaggcug

SEQ ID NO: 14827 - RNA, 20 nt, Human
agcaggugacggggccugcu

SEQ ID NO: 14828 - RNA, 22 nt, Human
agcagguggauuuagacgggag

SEQ ID NO: 14829 - RNA, 18 nt, Human
agcagguggcgucugcag

SEQ ID NO: 14830 - RNA, 22 nt, Human
agcaggugguaggcagucagca

SEQ ID NO: 14831 - RNA, 22 nt, Human
agcagguggugggccagauuug

SEQ ID NO: 14832 - RNA, 22 nt, Human
agcagguguauauaaggcugag

SEQ ID NO: 14833 - RNA, 22 nt, Human
agcaggugucacuuucacucca

SEQ ID NO: 14834 - RNA, 22 nt, Human
agcagguguuagggauccaaug

SEQ ID NO: 14835 - RNA, 22 nt, Human
agcagguguuuguaucauaagg

SEQ ID NO: 14836 - RNA, 22 nt, Human
agcaguaagcaacugagcuugc

SEQ ID NO: 14837 - RNA, 22 nt, Human
agcaguaagugaagacuaguuu

SEQ ID NO: 14838 - RNA, 18 nt, Human
agcaguagcgccaggugc

SEQ ID NO: 14839 - RNA, 22 nt, Human
agcagucauuuuaggucaugca

SEQ ID NO: 14840 - RNA, 22 nt, Human
agcagugaaacagcugcauaug

SEQ ID NO: 14841 - RNA, 22 nt, Human
agcagugacuugcuuuguuucc

SEQ ID NO: 14842 - RNA, 23 nt, Human
agcagugaguaaacagauaggau

SEQ ID NO: 14843 - RNA, 22 nt, Human
agcagugaguaacacagaccag

SEQ ID NO: 14844 - RNA, 22 nt, Human
agcaguggcugacagacuuacc

SEQ ID NO: 14845 - RNA, 22 nt, Human
agcaguguucaaugauacacug

SEQ ID NO: 14846 - RNA, 22 nt, Human
agcaguuacuaguuaaaugcau

SEQ ID NO: 14847 - RNA, 23 nt, Human
agcaguuagggauacaaguuauc

SEQ ID NO: 14848 - RNA, 22 nt, Human
agcaguugagugggaaucaggc

SEQ ID NO: 14849 - RNA, 22 nt, Human
agcaguuuagcuauacugcuug

SEQ ID NO: 14850 - RNA, 22 nt, Human
agcaguuuggaaaauacuagaa

SEQ ID NO: 14851 - RNA, 22 nt, Human
agcaguuuuagggagacacauu

SEQ ID NO: 14852 - RNA, 22 nt, Human
agcaguuuuuauaacacuggaa

SEQ ID NO: 14853 - RNA, 22 nt, Human
agcauaaaggcacuagaaagag

SEQ ID NO: 14854 - RNA, 22 nt, Human
agcauaaguugguacagccacu

SEQ ID NO: 14855 - RNA, 22 nt, Human
agcauacaggucugaaacagcu

SEQ ID NO: 14856 - RNA, 22 nt, Human
agcauacaguugaaaguggcuu

SEQ ID NO: 14857 - RNA, 22 nt, Human
agcauagaaaagauucccagag

SEQ ID NO: 14858 - RNA, 22 nt, Human
agcauagaauaagcugaaguca

SEQ ID NO: 14859 - RNA, 22 nt, Human
agcauagagcaggaaguuaaga

SEQ ID NO: 14860 - RNA, 22 nt, Human
agcauauaaauggacauauuug

SEQ ID NO: 14861 - RNA, 22 nt, Human
agcauauaggaaauguugaauc

SEQ ID NO: 14862 - RNA, 22 nt, Human
agauauuguuuguuucaccaau

SEQ ID NO: 14863 - RNA, 22 nt, Human
agauauuuguaucuugcuauug

SEQ ID NO: 14864 - RNA, 22 nt, Human
agaucaaaaacuuaauggcuuu

SEQ ID NO: 14865 - RNA, 22 nt, Human
agaucaagcacugugcaaaaau

SEQ ID NO: 14866 - RNA, 22 nt, Human
agaucacagagccaagauucca

SEQ ID NO: 14867 - RNA, 22 nt, Human
agaucacaguggcaacucccuu

SEQ ID NO: 14868 - RNA, 22 nt, Human
agaucacaguucucuauucgua

SEQ ID NO: 14869 - RNA, 23 nt, Human
agaucacauaguuaucagaugac

SEQ ID NO: 14870 - RNA, 23 nt, Human
agaucacaugcugauggaaaaug

SEQ ID NO: 14871 - RNA, 22 nt, Human
agaucacuuugaugcuaccugg

SEQ ID NO: 14872 - RNA, 22 nt, Human
agaucauagcacaaaagugaca

SEQ ID NO: 14873 - RNA, 22 nt, Human
agauccacuauggugcugauga

SEQ ID NO: 14874 - RNA, 22 nt, Human
agauccaggguuggauuugcau

SEQ ID NO: 14875 - RNA, 22 nt, Human
agauccauccagcacucuugcc

SEQ ID NO: 14876 - RNA, 23 nt, Human
agauccaugugggcuggaaacug

SEQ ID NO: 14877 - RNA, 22 nt, Human
agaucugaaucucauccgagga

SEQ ID NO: 14878 - RNA, 22 nt, Human
agaucuggaaaaucacaggugc

SEQ ID NO: 14879 - RNA, 22 nt, Human
agaugaagaugccacuaagacc

SEQ ID NO: 14880 - RNA, 22 nt, Human
agaugaauccacacauggcaaa

SEQ ID NO: 14881 - RNA, 22 nt, Human
agaugaauugauguuggacaga

SEQ ID NO: 14882 - RNA, 22 nt, Human
agaugacaaaucaggggacggg

SEQ ID NO: 14883 - RNA, 22 nt, Human
agaugacaaugaaggaaaaugu

SEQ ID NO: 14884 - RNA, 22 nt, Human
agaugacaugggagcaagcacu

SEQ ID NO: 14885 - RNA, 22 nt, Human
agaugagaauuuuuagagugcu

SEQ ID NO: 14886 - RNA, 23 nt, Human
agaugaggcuucuccauguuggu

SEQ ID NO: 14887 - RNA, 22 nt, Human
agaugaguacagagcuguacuc

SEQ ID NO: 14888 - RNA, 22 nt, Human
agaugaguagguagcauuagua

SEQ ID NO: 14889 - RNA, 22 nt, Human
agaugauauacuacauggcuuc

SEQ ID NO: 14890 - RNA, 21 nt, Human
agaugcaguuugcaggugggu

SEQ ID NO: 14891 - RNA, 22 nt, Human
agaugccugccaguuauuuagc

SEQ ID NO: 14892 - RNA, 22 nt, Human
agaugcugccaggccccucagu

SEQ ID NO: 14893 - RNA, 22 nt, Human
agaugcuucaguguuuaauuua

SEQ ID NO: 14894 - RNA, 22 nt, Human
agauggagaaugacaauuaagg

SEQ ID NO: 14895 - RNA, 22 nt, Human
agauggagaccuuggaugaacu

SEQ ID NO: 14896 - RNA, 22 nt, Human
agauggaguuguagcagugacu

SEQ ID NO: 14897 - RNA, 22 nt, Human
agauggcagcagaacaaacagg

SEQ ID NO: 14898 - RNA, 22 nt, Human
agauggcaggcccugugggggu

SEQ ID NO: 14899 - RNA, 22 nt, Human
agauggcuagauugcaagaacu

SEQ ID NO: 14900 - RNA, 22 nt, Human
agauggcuuagccuggcuccca

SEQ ID NO: 14901 - RNA, 19 nt, Human
agauggcuuggacugaaaa

SEQ ID NO: 14902 - RNA, 22 nt, Human
agauggcuuugcuuuuagaagc

SEQ ID NO: 14903 - RNA, 19 nt, Human
agauggggaagagugugag

SEQ ID NO: 14904 - RNA, 22 nt, Human
agauggguaauugauggcagua

SEQ ID NO: 14905 - RNA, 22 nt, Human
agaugguaaucacauuuaucug

SEQ ID NO: 14906 - RNA, 22 nt, Human
agaugguucucagaaacucaac

SEQ ID NO: 14907 - RNA, 22 nt, Human
agauguaaacucucaugucauu

SEQ ID NO: 14908 - RNA, 22 nt, Human
agaugucuguaauucuaagcau

SEQ ID NO: 14909 - RNA, 23 nt, Human
agaugucuuagaaacugaagcug

SEQ ID NO: 14910 - RNA, 22 nt, Human
agaugugccuccaaggggugca

SEQ ID NO: 14911 - RNA, 22 nt, Human
agaugugggagaugcuucugca

SEQ ID NO: 14912 - RNA, 22 nt, Human
agaugugggcaauggaauggag

SEQ ID NO: 14913 - RNA, 22 nt, Human
agaugugguaguugaagggaag

SEQ ID NO: 14914 - RNA, 22 nt, Human
agaugugguuauucucuuccuu

SEQ ID NO: 14915 - RNA, 22 nt, Human
agauguuuguaaacacacugcu

SEQ ID NO: 14916 - RNA, 22 nt, Human
agauguuuguguuaucuccauu

SEQ ID NO: 14917 - RNA, 22 nt, Human
agauguuuuggagacacuaacc

SEQ ID NO: 14918 - RNA, 22 nt, Human
agauuacaacaugggacgcaua

SEQ ID NO: 14919 - RNA, 22 nt, Human
agauuacagcaugggaauggga

SEQ ID NO: 14920 - RNA, 21 nt, Human
agauuacaggugugauccacc

SEQ ID NO: 14921 - RNA, 22 nt, Human
agauuaucuccugauuuuaagg

SEQ ID NO: 14922 - RNA, 22 nt, Human
agauuaugcuggcugcuacaag

SEQ ID NO: 14923 - RNA, 19 nt, Human
agauuauugcacauucaug

SEQ ID NO: 14924 - RNA, 21 nt, Human
agauucauaaucuguaaaaug

SEQ ID NO: 14925 - RNA, 22 nt, Human
agauucaugggucuaaccagug

SEQ ID NO: 14926 - RNA, 22 nt, Human
agauucauuaucuucuuuguac

SEQ ID NO: 14927 - RNA, 22 nt, Human
agauuccaggccuggggccaag

SEQ ID NO: 14928 - RNA, 22 nt, Human
agauucgaaaccuuuaggucuu

SEQ ID NO: 14929 - RNA, 22 nt, Human
agauucucaacaaagaguagca

SEQ ID NO: 14930 - RNA, 23 nt, Human
agauugaaguauugaccagagcu

SEQ ID NO: 14931 - RNA, 22 nt, Human
agauugaauauagagauucuug

SEQ ID NO: 14932 - RNA, 22 nt, Human
agauuggaucaagcagcaguug

SEQ ID NO: 14933 - RNA, 22 nt, Human
agauugggauuagagaucugua

SEQ ID NO: 14934 - RNA, 22 nt, Human
aggcaacugagaggcccguguu

SEQ ID NO: 14935 - RNA, 22 nt, Human
aggcaacuugcaucucggcaag

SEQ ID NO: 14936 - RNA, 22 nt, Human
aggcaagaaacuuucugggaga

SEQ ID NO: 14937 - RNA, 23 nt, Human
aggcaagaacggguuguucaccc

SEQ ID NO: 14938 - RNA, 22 nt, Human
aggcaagaccagaaagggcuga

SEQ ID NO: 14939 - RNA, 22 nt, Human
aggcaagauuaggaccagaaga

SEQ ID NO: 14940 - RNA, 23 nt, Human
aggcaaggguguaaaggaaauga

SEQ ID NO: 14941 - RNA, 21 nt, Human
aggcaauaaaguuuugucuac

SEQ ID NO: 14942 - RNA, 22 nt, Human
aggcaauaagccucaacugucu

SEQ ID NO: 14943 - RNA, 22 nt, Human
aggcaauagaauaugccugagg

SEQ ID NO: 14944 - RNA, 21 nt, Human
aggcaauucgaaguugcagac

SEQ ID NO: 14945 - RNA, 22 nt, Human
aggcacaaagacagaaaagcac

SEQ ID NO: 14946 - RNA, 22 nt, Human
aggcacacagaccccagcaagu

SEQ ID NO: 14947 - RNA, 22 nt, Human
aggcacaggaacaggaaaagag

SEQ ID NO: 14948 - RNA, 22 nt, Human
aggcacaggaaugucauccagu

SEQ ID NO: 14949 - RNA, 22 nt, Human
aggcacagugccuggaaucaaa

SEQ ID NO: 14950 - RNA, 22 nt, Human
aggcacaguggcccuguuuggg

SEQ ID NO: 14951 - RNA, 22 nt, Human
aggcacaguggcucacaccugu

SEQ ID NO: 14952 - RNA, 20 nt, Human
aggcacaguuccuaguuggg

SEQ ID NO: 14953 - RNA, 22 nt, Human
aggcaccaggaucaguuagaga

SEQ ID NO: 14954 - RNA, 22 nt, Human
aggcaccagguugugguuuguc

SEQ ID NO: 14955 - RNA, 20 nt, Human
aggcaccugucacaggugag

SEQ ID NO: 14956 - RNA, 22 nt, Human
aggcacugaauauccaguaaaa

SEQ ID NO: 14957 - RNA, 22 nt, Human
aggcacugauucucagaguuac

SEQ ID NO: 14958 - RNA, 22 nt, Human
aggcacuggucuaccccuuagu

SEQ ID NO: 14959 - RNA, 22 nt, Human
aggcacuguacuagguacaggg

SEQ ID NO: 14960 - RNA, 22 nt, Human
aggcacuguggaagacaugguu

SEQ ID NO: 14961 - RNA, 22 nt, Human
aggcacuguggguguggccgga

SEQ ID NO: 14962 - RNA, 20 nt, Human
aggcacuguugucuguaucc

SEQ ID NO: 14963 - RNA, 22 nt, Human
aggcacuugaauugaugauguu

SEQ ID NO: 14964 - RNA, 22 nt, Human
aggcacuugauuaaugugaauu

SEQ ID NO: 14965 - RNA, 22 nt, Human
aggcacuuguaauugcagucau

SEQ ID NO: 14966 - RNA, 22 nt, Human
aggcacuuuacaaugugugaca

SEQ ID NO: 14967 - RNA, 22 nt, Human
aggcacuuuccuugaggaguuu

SEQ ID NO: 14968 - RNA, 22 nt, Human
aggcagacaaguccagaacugg

SEQ ID NO: 14969 - RNA, 22 nt, Human
aggcagacuuccugcuuggauc

SEQ ID NO: 14970 - RNA, 22 nt, Human
aggcagagaaaaaccagauaug

SEQ ID NO: 14971 - RNA, 22 nt, Human
aggcagauauuggggugaugug

SEQ ID NO: 14972 - RNA, 22 nt, Human
aggcagauauuucaguucacau

SEQ ID NO: 14973 - RNA, 22 nt, Human
aggcagaugggagcuggaaguu

SEQ ID NO: 14974 - RNA, 22 nt, Human
aggcagaugugauuaauuuccu

SEQ ID NO: 14975 - RNA, 22 nt, Human
agcacagggacaaugccaggug

SEQ ID NO: 14976 - RNA, 22 nt, Human
agcacagggcccagccuaggcc

SEQ ID NO: 14977 - RNA, 22 nt, Human
agcacagguacggagaugcuac

SEQ ID NO: 14978 - RNA, 22 nt, Human
agcacaggugaaacagucaggu

SEQ ID NO: 14979 - RNA, 22 nt, Human
agcacagugccugacauauaug

SEQ ID NO: 14980 - RNA, 22 nt, Human
agcacaguuucuuuuccuuguc

SEQ ID NO: 14981 - RNA, 23 nt, Human
agcacaucaaagcagggaggaga

SEQ ID NO: 14982 - RNA, 22 nt, Human
agcacauuaagugaguucaugu

SEQ ID NO: 14983 - RNA, 22 nt, Human
agcacauucugccuugcuuugc

SEQ ID NO: 14984 - RNA, 22 nt, Human
agcaccaagccuagagugaugu

SEQ ID NO: 14985 - RNA, 22 nt, Human
agcaccagagcuaugggccugc

SEQ ID NO: 14986 - RNA, 22 nt, Human
agcaccaggaaagaaggggcca

SEQ ID NO: 14987 - RNA, 22 nt, Human
agcaccaggauauuguuggaga

SEQ ID NO: 14988 - RNA, 22 nt, Human
agcaccaggcaguauaucaaag

SEQ ID NO: 14989 - RNA, 22 nt, Human
agcaccaggccauggggucccu

SEQ ID NO: 14990 - RNA, 22 nt, Human
agcaccaggcuguuggaagccc

SEQ ID NO: 14991 - RNA, 22 nt, Human
agcaccaggucgcuggcacgcu

SEQ ID NO: 14992 - RNA, 18 nt, Human
agcaccagucacuaacag

SEQ ID NO: 14993 - RNA, 22 nt, Human
agcaccaucacagcuguauguc

SEQ ID NO: 14994 - RNA, 22 nt, Human
agcaccaucagaugcaauaucu

SEQ ID NO: 14995 - RNA, 23 nt, Human
agcaccauuacaguuugauuggg

SEQ ID NO: 14996 - RNA, 22 nt, Human
agcaccauuuaucaucuaggua

SEQ ID NO: 14997 - RNA, 22 nt, Human
agcaccauuucucuaaagcacu

SEQ ID NO: 14998 - RNA, 22 nt, Human
agcacccucagccuuauccaga

SEQ ID NO: 14999 - RNA, 22 nt, Human
agcaccuccuuagcuaugacca

SEQ ID NO: 15000 - RNA, 22 nt, Human
agcaccugcuuaaugugcagug

SEQ ID NO: 15001 - RNA, 22 nt, Human
agcaccuggagggcugggaccu

SEQ ID NO: 15002 - RNA, 22 nt, Human
agcaccuggauuugauagucag

SEQ ID NO: 15003 - RNA, 22 nt, Human
agcaccugucaaguccaggcug

SEQ ID NO: 15004 - RNA, 22 nt, Human
agcaccugugugagcuagaugu

SEQ ID NO: 15005 - RNA, 22 nt, Human
agcaccugugugguagggaggu

SEQ ID NO: 15006 - RNA, 22 nt, Human
agcacgagaucgaugugccuuu

SEQ ID NO: 15007 - RNA, 22 nt, Human
agcacuagcuuuaagcauucug

SEQ ID NO: 15008 - RNA, 20 nt, Human
agcacuagguguggcaggug

SEQ ID NO: 15009 - RNA, 22 nt, Human
agcacucuaagugcaagacacu

SEQ ID NO: 15010 - RNA, 22 nt, Human
agcacuggaaaguuaagaguuu

SEQ ID NO: 15011 - RNA, 22 nt, Human
agcacugugagcaccagcacgc

SEQ ID NO: 15012 - RNA, 22 nt, Human
agcacugugguggaagcaucaa

SEQ ID NO: 15013 - RNA, 22 nt, Human
agcacuuuauucaggaacucca

SEQ ID NO: 15014 - RNA, 22 nt, Human
agcagaaaauuggaaaugacaa

SEQ ID NO: 15015 - RNA, 22 nt, Human
agcagaacugaugagacuugag

SEQ ID NO: 15016 - RNA, 22 nt, Human
agcagaagaaagccacaugacu

SEQ ID NO: 15017 - RNA, 22 nt, Human
agcagaagugccuuagcaauca

SEQ ID NO: 15018 - RNA, 18 nt, Human
agcagaauucuaggguuc

SEQ ID NO: 15019 - RNA, 22 nt, Human
agcagacaauugccuggaugga

SEQ ID NO: 15020 - RNA, 21 nt, Human
agcagacagcccaagaaaauc

SEQ ID NO: 15021 - RNA, 22 nt, Human
agcagacauaucucaugucaca

SEQ ID NO: 15022 - RNA, 21 nt, Human
agcagacugaauacauucuua

SEQ ID NO: 15023 - RNA, 22 nt, Human
agcagagaccugguuuuguuga

SEQ ID NO: 15024 - RNA, 18 nt, Human
agcagagagugaauggga

SEQ ID NO: 15025 - RNA, 19 nt, Human
agcagagcagggccguggg

SEQ ID NO: 15026 - RNA, 22 nt, Human
agcagagcaugcuaagugacuc

SEQ ID NO: 15027 - RNA, 22 nt, Human
agcagagcccuuccauggccuu

SEQ ID NO: 15028 - RNA, 22 nt, Human
agcagagcugcaguggccugcu

SEQ ID NO: 15029 - RNA, 22 nt, Human
agcagaggacaguucuuaggaa

SEQ ID NO: 15030 - RNA, 21 nt, Human
agcagaggggacauguuugau

SEQ ID NO: 15031 - RNA, 22 nt, Human
agcagagguguuuauuauggga

SEQ ID NO: 15032 - RNA, 21 nt, Human
agcagagugcuuugacuuugu

SEQ ID NO: 15033 - RNA, 20 nt, Human
agcagauagcgggagaguuu

SEQ ID NO: 15034 - RNA, 22 nt, Human
agcagaugcauuaugauugaaa

SEQ ID NO: 15035 - RNA, 22 nt, Human
agcagaugggagauggagcugc

SEQ ID NO: 15036 - RNA, 23 nt, Human
agcagcaaaaauuuaucuuucug

SEQ ID NO: 15037 - RNA, 22 nt, Human
agcagcaaagaauaggcccucu

SEQ ID NO: 15038 - RNA, 22 nt, Human
agcagcaaagccaggggauggg

SEQ ID NO: 15039 - RNA, 22 nt, Human
agcagcaaaguauugggcaaga

SEQ ID NO: 15040 - RNA, 21 nt, Human
agcagcaaccacauaguuuuu

SEQ ID NO: 15041 - RNA, 22 nt, Human
agcagcaacuuauuuuucuuau

SEQ ID NO: 15042 - RNA, 22 nt, Human
agcagcaaguguaacugaauau

SEQ ID NO: 15043 - RNA, 22 nt, Human
agccaggaaugcaugcucugcu

SEQ ID NO: 15044 - RNA, 22 nt, Human
agccaggcagggcucucgcucu

SEQ ID NO: 15045 - RNA, 22 nt, Human
agccaggccagcugucuugagu

SEQ ID NO: 15046 - RNA, 22 nt, Human
agccaggcgcaguggcuuaugc

SEQ ID NO: 15047 - RNA, 22 nt, Human
agccaggcgggucuuugcuccu

SEQ ID NO: 15048 - RNA, 22 nt, Human
agccaggcugcaguuggcuggc

SEQ ID NO: 15049 - RNA, 16 nt, Human
agccaggcugccucgg

SEQ ID NO: 15050 - RNA, 22 nt, Human
agccaggggagucagcugcugg

SEQ ID NO: 15051 - RNA, 19 nt, Human
agccaggguccagacaugu

SEQ ID NO: 15052 - RNA, 19 nt, Human
agccagggugagaaggagc

SEQ ID NO: 15053 - RNA, 22 nt, Human
agccagggugagagggcuuugu

SEQ ID NO: 15054 - RNA, 22 nt, Human
agccagggugggugaaugcuau

SEQ ID NO: 15055 - RNA, 20 nt, Human
agccaggguucuggaugcac

SEQ ID NO: 15056 - RNA, 19 nt, Human
agccaguccaaguucuguc

SEQ ID NO: 15057 - RNA, 22 nt, Human
agccagucucucucccuggaga

SEQ ID NO: 15058 - RNA, 19 nt, Human
agccagugagccucugggu

SEQ ID NO: 15059 - RNA, 22 nt, Human
agccauccuacuaccucagcau

SEQ ID NO: 15060 - RNA, 22 nt, Human
agccaugauuuucucauuuuca

SEQ ID NO: 15061 - RNA, 22 nt, Human
agccaugcuccuuccccucugg

SEQ ID NO: 15062 - RNA, 22 nt, Human
agccauggcgccacuagaggga

SEQ ID NO: 15063 - RNA, 22 nt, Human
agccaugggagacugugggaga

SEQ ID NO: 15064 - RNA, 22 nt, Human
agccauguuggggaaggugggc

SEQ ID NO: 15065 - RNA, 22 nt, Human
agccauugaguuuuaugugcua

SEQ ID NO: 15066 - RNA, 22 nt, Human
agccauuggcugccuggugcgu

SEQ ID NO: 15067 - RNA, 22 nt, Human
agccauuuggacuucugguagg

SEQ ID NO: 15068 - RNA, 22 nt, Human
agcccacuguuuucauuucucu

SEQ ID NO: 15069 - RNA, 22 nt, Human
agcccagaaaugaaaggaugau

SEQ ID NO: 15070 - RNA, 22 nt, Human
agcccagaggcugggcgugcau

SEQ ID NO: 15071 - RNA, 22 nt, Human
agcccagaggguagcagaagaa

SEQ ID NO: 15072 - RNA, 22 nt, Human
agcccagccacuauuaaauguu

SEQ ID NO: 15073 - RNA, 22 nt, Human
agcccagccggauucccaguuc

SEQ ID NO: 15074 - RNA, 22 nt, Human
agcccagcugccugccugcugu

SEQ ID NO: 15075 - RNA, 19 nt, Human
agcccagcuuauuugucag

SEQ ID NO: 15076 - RNA, 22 nt, Human
agcccaggaaguugaggcuugc

SEQ ID NO: 15077 - RNA, 22 nt, Human
agcccaggaaucugcaucuuga

SEQ ID NO: 15078 - RNA, 22 nt, Human
agcccagguugaggcugcagug

SEQ ID NO: 15079 - RNA, 20 nt, Human
agcccaucucccacagcuac

SEQ ID NO: 15080 - RNA, 22 nt, Human
agcccccaaaagugcuuaugau

SEQ ID NO: 15081 - RNA, 19 nt, Human
agcccccagacagcaggcc

SEQ ID NO: 15082 - RNA, 15 nt, Human
agcccccucagagga

SEQ ID NO: 15083 - RNA, 22 nt, Human
agccccucuguagcuaauagua

SEQ ID NO: 15084 - RNA, 22 nt, Human
agccccuugcugcccucuagag

SEQ ID NO: 15085 - RNA, 22 nt, Human
agccccuuggaacacagggcug

SEQ ID NO: 15086 - RNA, 22 nt, Human
agcccggcuuccccgguugcua

SEQ ID NO: 15087 - RNA, 22 nt, Human
agcccuagagcuggaggucagu

SEQ ID NO: 15088 - RNA, 22 nt, Human
agcccucucccuuucuucuuag

SEQ ID NO: 15089 - RNA, 22 nt, Human
agcccucugcaaacaccugaua

SEQ ID NO: 15090 - RNA, 22 nt, Human
agcccugaagcuggccaugucc

SEQ ID NO: 15091 - RNA, 22 nt, Human
agcccugagccagccuggucag

SEQ ID NO: 15092 - RNA, 22 nt, Human
aggcagauuuaggagaaaagaa

SEQ ID NO: 15093 - RNA, 22 nt, Human
aggcagcaaagaaaugaugcug

SEQ ID NO: 15094 - RNA, 22 nt, Human
aggcagcaauugaaaucauugu

SEQ ID NO: 15095 - RNA, 22 nt, Human
aggcagcagucaugaggaaaga

SEQ ID NO: 15096 - RNA, 21 nt, Human
aggcagcaucugauuuauaug

SEQ ID NO: 15097 - RNA, 22 nt, Human
aggcagcaugcucugcuucuac

SEQ ID NO: 15098 - RNA, 22 nt, Human
aggcagcauuucugcuuaucca

SEQ ID NO: 15099 - RNA, 22 nt, Human
aggcagccacaugagcuccuga

SEQ ID NO: 15100 - RNA, 22 nt, Human
aggcagccauccaggaggcuca

SEQ ID NO: 15101 - RNA, 22 nt, Human
aggcagcccugugcuggaugcu

SEQ ID NO: 15102 - RNA, 21 nt, Human
aggcagcgauuuucauauugc

SEQ ID NO: 15103 - RNA, 22 nt, Human
aggcagcguagcaaggcuagua

SEQ ID NO: 15104 - RNA, 21 nt, Human
aggcagcgugagggccacuca

SEQ ID NO: 15105 - RNA, 17 nt, Human
aggcagcucagaacauc

SEQ ID NO: 15106 - RNA, 21 nt, Human
aggcagcucaggcccagagag

SEQ ID NO: 15107 - RNA, 22 nt, Human
aggcagcucuguggccucccag

SEQ ID NO: 15108 - RNA, 22 nt, Human
aggcagcugaggucuggcgccc

SEQ ID NO: 15109 - RNA, 22 nt, Human
aggcagcuggacauaacuaacc

SEQ ID NO: 15110 - RNA, 22 nt, Human
aggcagcuggcagcacccaggg

SEQ ID NO: 15111 - RNA, 20 nt, Human
aggcagcugggaaaugaggg

SEQ ID NO: 15112 - RNA, 22 nt, Human
aggcagcuuucuguaggggugu

SEQ ID NO: 15113 - RNA, 22 nt, Human
aggcaggaacccugugugcgcc

SEQ ID NO: 15114 - RNA, 17 nt, Human
aggcaggagauuggaga

SEQ ID NO: 15115 - RNA, 18 nt, Human
aggcaggauccuggccuc

SEQ ID NO: 15116 - RNA, 22 nt, Human
aggcaggcacuccggaaguguc

SEQ ID NO: 15117 - RNA, 22 nt, Human
aggcaggccccugagaauagac

SEQ ID NO: 15118 - RNA, 22 nt, Human
aggcaggcccugggccaucccg

SEQ ID NO: 15119 - RNA, 18 nt, Human
aggcaggcuggagugacu

SEQ ID NO: 15120 - RNA, 22 nt, Human
aggcagggcucauuucuuaggc

SEQ ID NO: 15121 - RNA, 22 nt, Human
aggcagggucuugcuauguugc

SEQ ID NO: 15122 - RNA, 22 nt, Human
aggcaggucacaugcuuggcga

SEQ ID NO: 15123 - RNA, 22 nt, Human
aggcagguguuaacccucugag

SEQ ID NO: 15124 - RNA, 22 nt, Human
aggcagguguuaccucugguuu

SEQ ID NO: 15125 - RNA, 22 nt, Human
aggcagugcucaagacagcagc

SEQ ID NO: 15126 - RNA, 22 nt, Human
aggcagugcugugcccugaacc

SEQ ID NO: 15127 - RNA, 22 nt, Human
aggcaguguauugcuagcggcu

SEQ ID NO: 15128 - RNA, 22 nt, Human
aggcaguucucguguguguccc

SEQ ID NO: 15129 - RNA, 22 nt, Human
aggcaguuguugcugagcagcu

SEQ ID NO: 15130 - RNA, 22 nt, Human
aggcauccaugguggucgcuga

SEQ ID NO: 15131 - RNA, 22 nt, Human
aggcaucuaacagagaucuuua

SEQ ID NO: 15132 - RNA, 22 nt, Human
aggcaucugaguuugcaagcuu

SEQ ID NO: 15133 - RNA, 21 nt, Human
aggcaugagcccugcauggac

SEQ ID NO: 15134 - RNA, 22 nt, Human
aggcaugaugugcaguggcaaa

SEQ ID NO: 15135 - RNA, 22 nt, Human
aggcauucaacaaauguuugug

SEQ ID NO: 15136 - RNA, 22 nt, Human
aggcauugcugguauuggaagu

SEQ ID NO: 15137 - RNA, 22 nt, Human
aggcauuuggcugucauuugua

SEQ ID NO: 15138 - RNA, 22 nt, Human
aggcauuuuuguuaaucuuugg

SEQ ID NO: 15139 - RNA, 22 nt, Human
aggccaaagcaagacccuguaa

SEQ ID NO: 15140 - RNA, 22 nt, Human
aggccaaagcucaccugcagcu

SEQ ID NO: 15141 - RNA, 22 nt, Human
aggccaaguagcuagcauugaa

SEQ ID NO: 15142 - RNA, 21 nt, Human
aggccaaguuggauuucuuca

SEQ ID NO: 15143 - RNA, 22 nt, Human
aggccacaaccacccugugccc

SEQ ID NO: 15144 - RNA, 22 nt, Human
aggccacaggcacccuguguuc

SEQ ID NO: 15145 - RNA, 22 nt, Human
aggccacggcggguggauuacu

SEQ ID NO: 15146 - RNA, 22 nt, Human
aggccagaaaaagacagcucca

SEQ ID NO: 15147 - RNA, 22 nt, Human
aggccagacagcuagaaacagg

SEQ ID NO: 15148 - RNA, 22 nt, Human
aggccagauauugugcuaccca

SEQ ID NO: 15149 - RNA, 22 nt, Human
aggccagcaagaaagagagucu

SEQ ID NO: 15150 - RNA, 22 nt, Human
aggccagcacgacagccgcagg

SEQ ID NO: 15151 - RNA, 18 nt, Human
aggccagcccugcuacug

SEQ ID NO: 15152 - RNA, 22 nt, Human
aggccagccucaggcagggacc

SEQ ID NO: 15153 - RNA, 22 nt, Human
agcugguguggauuuuugaaug

SEQ ID NO: 15154 - RNA, 22 nt, Human
agcugguucacuaagcauaaua

SEQ ID NO: 15155 - RNA, 22 nt, Human
agcugguucaguuucugggccu

SEQ ID NO: 15156 - RNA, 22 nt, Human
agcuguaugcccaagaugcuau

SEQ ID NO: 15157 - RNA, 22 nt, Human
agcuguauuugugaauauuuaa

SEQ ID NO: 15158 - RNA, 22 nt, Human
agcugucaggcagaacugagcu

SEQ ID NO: 15159 - RNA, 22 nt, Human
agcugucuaccugcagaguccu

SEQ ID NO: 15160 - RNA, 19 nt, Human
agcugucugcugcuuuugu

SEQ ID NO: 15161 - RNA, 22 nt, Human
agcugucugucuccugaggaga

SEQ ID NO: 15162 - RNA, 22 nt, Human
agcugucugugaacacagcauu

SEQ ID NO: 15163 - RNA, 22 nt, Human
agcugucuuucauuaccucauu

SEQ ID NO: 15164 - RNA, 22 nt, Human
agcugugaauuuuaugcuagug

SEQ ID NO: 15165 - RNA, 22 nt, Human
agcugugccuugcugcacggug

SEQ ID NO: 15166 - RNA, 22 nt, Human
agcugugcuguggucaucuggg

SEQ ID NO: 15167 - RNA, 22 nt, Human
agcuguggaaaucaggcaauga

SEQ ID NO: 15168 - RNA, 22 nt, Human
agcuguggaagacugucagggu

SEQ ID NO: 15169 - RNA, 22 nt, Human
agcuguggauuggguacuuucu

SEQ ID NO: 15170 - RNA, 21 nt, Human
agcuguggcgaggggaacaug

SEQ ID NO: 15171 - RNA, 22 nt, Human
agcugugguacuugauucacaa

SEQ ID NO: 15172 - RNA, 21 nt, Human
agcugugguuuuacaucuuuu

SEQ ID NO: 15173 - RNA, 22 nt, Human
agcuguguaagucauguaggug

SEQ ID NO: 15174 - RNA, 22 nt, Human
agcuguguagggaaucagagaa

SEQ ID NO: 15175 - RNA, 22 nt, Human
agcugugucauccuggaaaaug

SEQ ID NO: 15176 - RNA, 22 nt, Human
agcugugugcauuugggucuca

SEQ ID NO: 15177 - RNA, 22 nt, Human
agcugugugguuugggcaaauu

SEQ ID NO: 15178 - RNA, 22 nt, Human
agcuguguuaggauguuaauaa

SEQ ID NO: 15179 - RNA, 22 nt, Human
agcuguguuauuagaaaccugc

SEQ ID NO: 15180 - RNA, 22 nt, Human
agcuguuggaguaaagcacuua

SEQ ID NO: 15181 - RNA, 22 nt, Human
agcuguugucugcaggagaagc

SEQ ID NO: 15182 - RNA, 23 nt, Human
agcuguuucauuauuacaacacc

SEQ ID NO: 15183 - RNA, 22 nt, Human
agcuguuuguacuuagauagua

SEQ ID NO: 15184 - RNA, 22 nt, Human
agcuguuuuacugguuguauaa

SEQ ID NO: 15185 - RNA, 22 nt, Human
agcuguuuuugucugcugaucc

SEQ ID NO: 15186 - RNA, 22 nt, Human
agcuguuuuuuccucaccacuu

SEQ ID NO: 15187 - RNA, 22 nt, Human
agcuuacaguucaaugacaaag

SEQ ID NO: 15188 - RNA, 21 nt, Human
agcuuacauuaccauuguugc

SEQ ID NO: 15189 - RNA, 22 nt, Human
agcuuagaagugugcugagagg

SEQ ID NO: 15190 - RNA, 22 nt, Human
agcuuagaauguguuaggaaag

SEQ ID NO: 15191 - RNA, 22 nt, Human
agcuuagucacucuuaaauuua

SEQ ID NO: 15192 - RNA, 22 nt, Human
agcuuaucuuguuaguuucauu

SEQ ID NO: 15193 - RNA, 22 nt, Human
agcuuauuaucuuaucaagcuu

SEQ ID NO: 15194 - RNA, 22 nt, Human
agcuucacuuuguacuuuguca

SEQ ID NO: 15195 - RNA, 20 nt, Human
agcuucagcccuaggauugc

SEQ ID NO: 15196 - RNA, 22 nt, Human
agcuucaugccuaaagacagcg

SEQ ID NO: 15197 - RNA, 22 nt, Human
agcuucauggaaccugaggcua

SEQ ID NO: 15198 - RNA, 22 nt, Human
agcuucauuccagccacuguga

SEQ ID NO: 15199 - RNA, 22 nt, Human
agcuuccaauuucuccaagaga

SEQ ID NO: 15200 - RNA, 21 nt, Human
agcuuccagagcacauuccau

SEQ ID NO: 15201 - RNA, 22 nt, Human
agcuucccaggagaaucaggga

SEQ ID NO: 15202 - RNA, 22 nt, Human
agcuuccugaugcaagagggcu

SEQ ID NO: 15203 - RNA, 23 nt, Human
agcuucgccuuccuuucucugca

SEQ ID NO: 15204 - RNA, 22 nt, Human
agcuucucaggagucugaggca

SEQ ID NO: 15205 - RNA, 22 nt, Human
agcuucuccaucugcccagaga

SEQ ID NO: 15206 - RNA, 22 nt, Human
agcuucucucaggguaucuuuc

SEQ ID NO: 15207 - RNA, 22 nt, Human
agcuucuggaagccuggcagca

SEQ ID NO: 15208 - RNA, 22 nt, Human
agcuucuuccaggcagugacuc

SEQ ID NO: 15209 - RNA, 22 nt, Human
agcuucuucuauuuuggggcca

SEQ ID NO: 15210 - RNA, 22 nt, Human
agcuucuucugauuugucaguc

SEQ ID NO: 15211 - RNA, 22 nt, Human
agcuucuucuuggucuuuccca

SEQ ID NO: 15212 - RNA, 22 nt, Human
agcuucuuguagaacucaaaag

SEQ ID NO: 15213 - RNA, 22 nt, Human
agcuucuuuaauucagcaugau

SEQ ID NO: 15214 - RNA, 19 nt, Human
agcuucuuuggaaacauuu

SEQ ID NO: 15215 - RNA, 22 nt, Human
agcuucuuuuaccaggaaguug

SEQ ID NO: 15216 - RNA, 22 nt, Human
agcuugaaacguaccaacauug

SEQ ID NO: 15217 - RNA, 22 nt, Human
agcuugaaccacaugaaauugc

SEQ ID NO: 15218 - RNA, 22 nt, Human
agcuugaagccuuggcgagauu

SEQ ID NO: 15219 - RNA, 22 nt, Human
agcuugauaguggcuaucaagc

SEQ ID NO: 15220 - RNA, 22 nt, Human
agcuugcacagagaauacagua

SEQ ID NO: 15221 - RNA, 22 nt, Human
agcuugcaguuucugcuguuuu

SEQ ID NO: 15222 - RNA, 22 nt, Human
agcuugccaguugaagaucuuc

SEQ ID NO: 15223 - RNA, 22 nt, Human
agcuugccucccccucuuagga

SEQ ID NO: 15224 - RNA, 22 nt, Human
agcuugggugugccugcgagcu

SEQ ID NO: 15225 - RNA, 22 nt, Human
agguauaugaagaugaaauaac

SEQ ID NO: 15226 - RNA, 22 nt, Human
agguauauugaaugcuuacuua

SEQ ID NO: 15227 - RNA, 22 nt, Human
agguaugagagccacucuguag

SEQ ID NO: 15228 - RNA, 22 nt, Human
agguaugccaauuaggucaagu

SEQ ID NO: 15229 - RNA, 22 nt, Human
agguauggcauaaaucacaggg

SEQ ID NO: 15230 - RNA, 22 nt, Human
agguauguacacacagcucuaa

SEQ ID NO: 15231 - RNA, 22 nt, Human
agguauguauguguguauauuu

SEQ ID NO: 15232 - RNA, 22 nt, Human
agguaugugcuauuguuauauu

SEQ ID NO: 15233 - RNA, 22 nt, Human
agguauuccaguggucaccaag

SEQ ID NO: 15234 - RNA, 17 nt, Human
agguauuuaaggagcug

SEQ ID NO: 15235 - RNA, 22 nt, Human
agguauuuacccacuuuuguuu

SEQ ID NO: 15236 - RNA, 22 nt, Human
agguauuuaugagagcacauau

SEQ ID NO: 15237 - RNA, 22 nt, Human
agguauuucccaaaguggcaug

SEQ ID NO: 15238 - RNA, 22 nt, Human
agguauuuguuauuugagagug

SEQ ID NO: 15239 - RNA, 22 nt, Human
aggucaaaccacagcucuaggc

SEQ ID NO: 15240 - RNA, 23 nt, Human
aggucaaccacaagcugacaaac

SEQ ID NO: 15241 - RNA, 22 nt, Human
aggucaagguucacaggggauc

SEQ ID NO: 15242 - RNA, 22 nt, Human
aggucaaguuuagauagaguua

SEQ ID NO: 15243 - RNA, 22 nt, Human
aggucacacaacugucagaggc

SEQ ID NO: 15244 - RNA, 22 nt, Human
aggucacacuuggaucauagaa

SEQ ID NO: 15245 - RNA, 20 nt, Human
aggucaguagaaugauuuug

SEQ ID NO: 15246 - RNA, 22 nt, Human
aggucauuaaaguuaaaugagg

SEQ ID NO: 15247 - RNA, 22 nt, Human
aggucauuacaauuaucauuuu

SEQ ID NO: 15248 - RNA, 22 nt, Human
aggucauuggggacuaucuccg

SEQ ID NO: 15249 - RNA, 22 nt, Human
aggucauuuuugccuucuauuu

SEQ ID NO: 15250 - RNA, 22 nt, Human
agguccacaguucagcugccca

SEQ ID NO: 15251 - RNA, 22 nt, Human
agguccagccugcccucucucc

SEQ ID NO: 15252 - RNA, 22 nt, Human
agguccagcucuauugaaaaga

SEQ ID NO: 15253 - RNA, 22 nt, Human
agguccagugaaacuuuauuug

SEQ ID NO: 15254 - RNA, 22 nt, Human
agguccaguuuucaguucucau

SEQ ID NO: 15255 - RNA, 22 nt, Human
aggucccaggcauagcuggucu

SEQ ID NO: 15256 - RNA, 22 nt, Human
aggucccucagaggccucaccg

SEQ ID NO: 15257 - RNA, 19 nt, Human
aggucccugucaccucuca

SEQ ID NO: 15258 - RNA, 19 nt, Human
agguccucaggaugacccu

SEQ ID NO: 15259 - RNA, 22 nt, Human
agguccucugugccugcuggcg

SEQ ID NO: 15260 - RNA, 19 nt, Human
agguccugaucagcaagga

SEQ ID NO: 15261 - RNA, 20 nt, Human
agguccugggacuggcagag

SEQ ID NO: 15262 - RNA, 22 nt, Human
aguaacaaauagcugccuuuaa

SEQ ID NO: 15263 - RNA, 22 nt, Human
aguaacagaaggccugacuuaa

SEQ ID NO: 15264 - RNA, 22 nt, Human
aguaacagguguacagacuauc

SEQ ID NO: 15265 - RNA, 22 nt, Human
aguaacaucuuugacauuuguu

SEQ ID NO: 15266 - RNA, 22 nt, Human
aguaagauucuucugaaaaauu

SEQ ID NO: 15267 - RNA, 22 nt, Human
aguaagcaauagagugagaauu

SEQ ID NO: 15268 - RNA, 22 nt, Human
aguaauaauaguagccggcauu

SEQ ID NO: 15269 - RNA, 22 nt, Human
aguaauaauuuauauuagggag

SEQ ID NO: 15270 - RNA, 22 nt, Human
aguaaugaggauguuugcaaaa

SEQ ID NO: 15271 - RNA, 22 nt, Human
aguaaugcuucuagaacuauuu

SEQ ID NO: 15272 - RNA, 22 nt, Human
aguaaugucccuuaaauguggu

SEQ ID NO: 15273 - RNA, 22 nt, Human
aguacaaaggcccuugauuacu

SEQ ID NO: 15274 - RNA, 22 nt, Human
aguacaaaugcagccagaguag

SEQ ID NO: 15275 - RNA, 22 nt, Human
aguacaaguauuagaguuauuc

SEQ ID NO: 15276 - RNA, 23 nt, Human
aguacaauaaguauaauucuuuc

SEQ ID NO: 15277 - RNA, 22 nt, Human
aguacaaugucugacacaguag

SEQ ID NO: 15278 - RNA, 22 nt, Human
aguacacaagacacauuuaaaa

SEQ ID NO: 15279 - RNA, 22 nt, Human
aguacacagaauucuacuuguu

SEQ ID NO: 15280 - RNA, 22 nt, Human
aguacacucaagaaaccgguaa

SEQ ID NO: 15281 - RNA, 19 nt, Human
aguacagaaaagagcccug

SEQ ID NO: 15282 - RNA, 22 nt, Human
aguacagaccugucucuuccug

SEQ ID NO: 15283 - RNA, 22 nt, Human
aguacagauuuagacacgauag

SEQ ID NO: 15284 - RNA, 22 nt, Human
aguacagcaccaugagcacagg

SEQ ID NO: 15285 - RNA, 22 nt, Human
aguacaguagggugcuguuagu

SEQ ID NO: 15286 - RNA, 22 nt, Human
aguacagucaggaagcugcugu

SEQ ID NO: 15287 - RNA, 22 nt, Human
aguacaguggucauaauauaaa

SEQ ID NO: 15288 - RNA, 22 nt, Human
aguacauauaguaauuuagcca

SEQ ID NO: 15289 - RNA, 23 nt, Human
aguacauucgaaaaauucuguga

SEQ ID NO: 15290 - RNA, 22 nt, Human
aguacauuuaguuuaugaacau

SEQ ID NO: 15291 - RNA, 22 nt, Human
aguaccauuacucacuuauuuu

SEQ ID NO: 15292 - RNA, 22 nt, Human
aguacuucagaggcugcccagg

SEQ ID NO: 15293 - RNA, 22 nt, Human
aguacuuuacuucuuacaguuu

SEQ ID NO: 15294 - RNA, 22 nt, Human
aguagaaauguaguguagagaa

SEQ ID NO: 15295 - RNA, 22 nt, Human
aguagaauagauggauacuauu

SEQ ID NO: 15296 - RNA, 22 nt, Human
aguagaaucagccucuugaugg

SEQ ID NO: 15297 - RNA, 22 nt, Human
aguagauuuuagauuacauagu

SEQ ID NO: 15298 - RNA, 23 nt, Human
aguagcacauacaguacuuguuc

SEQ ID NO: 15299 - RNA, 20 nt, Human
aguagcagugugacauugac

SEQ ID NO: 15300 - RNA, 22 nt, Human
aguagcauaaauagugguagua

SEQ ID NO: 15301 - RNA, 22 nt, Human
aguaggacuagggguugaggca

SEQ ID NO: 15302 - RNA, 22 nt, Human
aguaggcauagaaagaagcacc

SEQ ID NO: 15303 - RNA, 22 nt, Human
aguagggaauacauugggguaa

SEQ ID NO: 15304 - RNA, 22 nt, Human
aguagugugacaauuaauauuu

SEQ ID NO: 15305 - RNA, 21 nt, Human
aguaguuuagcacaggguuug

SEQ ID NO: 15306 - RNA, 22 nt, Human
aguauaaugaaaugugucagua

SEQ ID NO: 15307 - RNA, 22 nt, Human
aguauauaugaggaaccacaaa

SEQ ID NO: 15308 - RNA, 22 nt, Human
aguauaucacauguaguaaugg

SEQ ID NO: 15309 - RNA, 22 nt, Human
aguauauuuguuaagauuauuc

SEQ ID NO: 15310 - RNA, 22 nt, Human
aguauauuuugauuguaugugu

SEQ ID NO: 15311 - RNA, 22 nt, Human
aguaucaauaauagaggagcua

SEQ ID NO: 15312 - RNA, 22 nt, Human
aguaucaucuccauuucacuga

SEQ ID NO: 15313 - RNA, 22 nt, Human
aguaugaaccuggguucuggau

SEQ ID NO: 15314 - RNA, 22 nt, Human
aguaugaagcugaaugauuuua

SEQ ID NO: 15315 - RNA, 22 nt, Human
aguaugaaucuuucagaccgua

SEQ ID NO: 15316 - RNA, 23 nt, Human
aguaugaauucauuguuuuaguu

SEQ ID NO: 15317 - RNA, 20 nt, Human
aguaugauccacucugcucu

SEQ ID NO: 15318 - RNA, 22 nt, Human
aguauguauuuuauacuuacag

SEQ ID NO: 15319 - RNA, 22 nt, Human
aguauguugacuuauucuugga

SEQ ID NO: 15320 - RNA, 22 nt, Human
aguauugugacucaaguauucu

SEQ ID NO: 15321 - RNA, 22 nt, Human
aguauuuagagacacaagacgg

SEQ ID NO: 15322 - RNA, 22 nt, Human
aguauuugaucagaugauagua

SEQ ID NO: 15323 - RNA, 22 nt, Human
agucaaagaugaccgaguuccu

SEQ ID NO: 15324 - RNA, 22 nt, Human
agucaaauaucuuaaaaggcua

SEQ ID NO: 15325 - RNA, 22 nt, Human
agucaacaguuuuugauguaaa

SEQ ID NO: 15326 - RNA, 22 nt, Human
agucaagagacuuaaaauauuu

SEQ ID NO: 15327 - RNA, 23 nt, Human
agucaagaugcaucugugaggaa

SEQ ID NO: 15328 - RNA, 22 nt, Human
agucaaggcuauuaugugggaa

SEQ ID NO: 15329 - RNA, 22 nt, Human
agucaauucuuuucaacucaag

SEQ ID NO: 15330 - RNA, 20 nt, Human
agucacaguaucagucuuag

SEQ ID NO: 15331 - RNA, 22 nt, Human
agucacaugaggaaggggaagg

SEQ ID NO: 15332 - RNA, 22 nt, Human
agucacaugaguuucucuuuau

SEQ ID NO: 15333 - RNA, 20 nt, Human
agucacaugcauacacaagu

SEQ ID NO: 15334 - RNA, 22 nt, Human
agucacauucugggguacuggg

SEQ ID NO: 15335 - RNA, 21 nt, Human
agucacauuggggguuuaggg

SEQ ID NO: 15336 - RNA, 22 nt, Human
agucacauuugggggugucaaa

SEQ ID NO: 15337 - RNA, 22 nt, Human
agucaccaacaugguucccagg

SEQ ID NO: 15338 - RNA, 22 nt, Human
agucaccauuuucaccugccuc

SEQ ID NO: 15339 - RNA, 22 nt, Human
agucacugggcugcuuccuaua

SEQ ID NO: 15340 - RNA, 22 nt, Human
agucacugucaaagccacacac

SEQ ID NO: 15341 - RNA, 22 nt, Human
agucacuucuauucuauuaagu

SEQ ID NO: 15342 - RNA, 22 nt, Human
agucacuuucuacuugguuucu

SEQ ID NO: 15343 - RNA, 22 nt, Human
agcccaguugcuccacgcugca

SEQ ID NO: 15344 - RNA, 22 nt, Human
agcccaugcaacaggccuagcg

SEQ ID NO: 15345 - RNA, 20 nt, Human
agccccacccuuguccuggc

SEQ ID NO: 15346 - RNA, 22 nt, Human
agccccacguugucuagcaccu

SEQ ID NO: 15347 - RNA, 22 nt, Human
agccccaggcccggacgccucu

SEQ ID NO: 15348 - RNA, 22 nt, Human
agccccaguucccuggaagucu

SEQ ID NO: 15349 - RNA, 22 nt, Human
agcccccacguuuccugggucc

SEQ ID NO: 15350 - RNA, 22 nt, Human
agccccccaagggccuucucuu

SEQ ID NO: 15351 - RNA, 22 nt, Human
agccccuccaguggcauaaaau

SEQ ID NO: 15352 - RNA, 22 nt, Human
agccccuugugggcgcacagca

SEQ ID NO: 15353 - RNA, 22 nt, Human
agcccuagagaaccagccugug

SEQ ID NO: 15354 - RNA, 22 nt, Human
agcccucauggaacagcuccua

SEQ ID NO: 15355 - RNA, 22 nt, Human
agcccucucuauggcccucuug

SEQ ID NO: 15356 - RNA, 22 nt, Human
agcccucugcuguucuagucuc

SEQ ID NO: 15357 - RNA, 22 nt, Human
agcccugcacaggucuguggcu

SEQ ID NO: 15358 - RNA, 22 nt, Human
agcccugcacaguucgggagga

SEQ ID NO: 15359 - RNA, 22 nt, Human
agcccugcaggaggugggagag

SEQ ID NO: 15360 - RNA, 22 nt, Human
agcccugccucuccaaugccca

SEQ ID NO: 15361 - RNA, 22 nt, Human
agcccugcuucaccauuuacuu

SEQ ID NO: 15362 - RNA, 22 nt, Human
agcccuggauucugagguccaa

SEQ ID NO: 15363 - RNA, 22 nt, Human
agcccuggcagagccagguagu

SEQ ID NO: 15364 - RNA, 22 nt, Human
agcccuggcucccagcagcgcu

SEQ ID NO: 15365 - RNA, 22 nt, Human
agcccugggauacaguaaaagc

SEQ ID NO: 15366 - RNA, 22 nt, Human
agcccugggcagccaaggaagc

SEQ ID NO: 15367 - RNA, 22 nt, Human
agcccuggguuagggugggagc

SEQ ID NO: 15368 - RNA, 17 nt, Human
agcccugugcucuuuuu

SEQ ID NO: 15369 - RNA, 22 nt, Human
agcccugugggccuuguggcac

SEQ ID NO: 15370 - RNA, 22 nt, Human
agcccugugugcuuguguuccu

SEQ ID NO: 15371 - RNA, 22 nt, Human
agcugggaugauaaccucaguc

SEQ ID NO: 15372 - RNA, 22 nt, Human
agcugggcagugcuuggauuca

SEQ ID NO: 15373 - RNA, 22 nt, Human
agcugggccugagcuggaagcu

SEQ ID NO: 15374 - RNA, 22 nt, Human
agcugggccugauuugcagggg

SEQ ID NO: 15375 - RNA, 22 nt, Human
agcugggcuccaagagggaucu

SEQ ID NO: 15376 - RNA, 22 nt, Human
agcugggcuggagcuccaagcg

SEQ ID NO: 15377 - RNA, 22 nt, Human
agcuggguguagggcuggacaa

SEQ ID NO: 15378 - RNA, 22 nt, Human
agcuggguugacaagauggaaa

SEQ ID NO: 15379 - RNA, 22 nt, Human
agcuggguuucuggcaggcuua

SEQ ID NO: 15380 - RNA, 22 nt, Human
agcugguaugaacaggauagga

SEQ ID NO: 15381 - RNA, 22 nt, Human
agcugguauuuguuagggaguu

SEQ ID NO: 15382 - RNA, 22 nt, Human
agcuggucagaguggggauaga

SEQ ID NO: 15383 - RNA, 20 nt, Human
agcuggugaauuaaagacug

SEQ ID NO: 15384 - RNA, 22 nt, Human
agcuggugauggccuaagaagg

SEQ ID NO: 15385 - RNA, 22 nt, Human
agcuggugccugcuuuugugug

SEQ ID NO: 15386 - RNA, 22 nt, Human
agcuggugcucaggggcaugga

SEQ ID NO: 15387 - RNA, 22 nt, Human
agcugguggauuaugcuguaca

SEQ ID NO: 15388 - RNA, 18 nt, Human
agcugguggggagacagc

SEQ ID NO: 15389 - RNA, 22 nt, Human
agcuggugugcucuggaauccu

SEQ ID NO: 15390 - RNA, 22 nt, Human
agcugguuagcaaucuaaguga

SEQ ID NO: 15391 - RNA, 22 nt, Human
agcugguucauggacugccugg

SEQ ID NO: 15392 - RNA, 22 nt, Human
agcugguuuaggaaaagguagg

SEQ ID NO: 15393 - RNA, 22 nt, Human
agcuguccuggcucaggcugug

SEQ ID NO: 15394 - RNA, 22 nt, Human
agcuguccugugggagggagug

SEQ ID NO: 15395 - RNA, 22 nt, Human
agcugucuccagauacaggauu

SEQ ID NO: 15396 - RNA, 22 nt, Human
agcugucucucugguguccaua

SEQ ID NO: 15397 - RNA, 22 nt, Human
agcugucucugguauuauguga

SEQ ID NO: 15398 - RNA, 22 nt, Human
agcugucuuucugccuccugau

SEQ ID NO: 15399 - RNA, 22 nt, Human
agcugucuuuggagagggagag

SEQ ID NO: 15400 - RNA, 19 nt, Human
agcugugcagacacuucgc

SEQ ID NO: 15401 - RNA, 22 nt, Human
agcuguggccagaugugagcgg

SEQ ID NO: 15402 - RNA, 22 nt, Human
agcugugggagaaucucugggu

SEQ ID NO: 15403 - RNA, 22 nt, Human
agcugugggauuugggugugcc

SEQ ID NO: 15404 - RNA, 22 nt, Human
agcugugggccugggagagcug

SEQ ID NO: 15405 - RNA, 19 nt, Human
agcuguggggccuagcacc

SEQ ID NO: 15406 - RNA, 22 nt, Human
agcuguguaggaucauaacacg

SEQ ID NO: 15407 - RNA, 22 nt, Human
agcuguguccugaagacacugc

SEQ ID NO: 15408 - RNA, 22 nt, Human
agcugugugacucuaagcaagu

SEQ ID NO: 15409 - RNA, 22 nt, Human
agcugugugccaggggagaugu

SEQ ID NO: 15410 - RNA, 22 nt, Human
agcugugugcccaugguggagg

SEQ ID NO: 15411 - RNA, 22 nt, Human
agcugugugugaauuuggccua

SEQ ID NO: 15412 - RNA, 22 nt, Human
agcuguguguuuccacugagcu

SEQ ID NO: 15413 - RNA, 22 nt, Human
agcuguguguuugucaugggcg

SEQ ID NO: 15414 - RNA, 22 nt, Human
agcuguguuuccagaugguagc

SEQ ID NO: 15415 - RNA, 22 nt, Human
agcuguucccucacugcaguca

SEQ ID NO: 15416 - RNA, 22 nt, Human
agcuguugcugggaggagagaa

SEQ ID NO: 15417 - RNA, 22 nt, Human
agcuguuggcuggcugagcucu

SEQ ID NO: 15418 - RNA, 22 nt, Human
agcuguuguuaauuaacucauu

SEQ ID NO: 15419 - RNA, 22 nt, Human
agcuguuuaauaaaugucuguu

SEQ ID NO: 15420 - RNA, 21 nt, Human
agcuguuugaagcuauauugg

SEQ ID NO: 15421 - RNA, 22 nt, Human
agcuguuuuacucagaaacaua

SEQ ID NO: 15422 - RNA, 22 nt, Human
agcuguuuucuaaugcauuuga

SEQ ID NO: 15423 - RNA, 22 nt, Human
agcuuaaacucuuugaaguuau

SEQ ID NO: 15424 - RNA, 22 nt, Human
agcuuaaagccgccaucuagua

SEQ ID NO: 15425 - RNA, 22 nt, Human
agcuuaauggaacuugcucaaa

SEQ ID NO: 15426 - RNA, 22 nt, Human
agcuuacaccccccaagauucu

SEQ ID NO: 15427 - RNA, 22 nt, Human
agcuuaggaggaugaugaacau

SEQ ID NO: 15428 - RNA, 22 nt, Human
agcuuauuaauuuuucugcaug

SEQ ID NO: 15429 - RNA, 22 nt, Human
agcuucaagguucaaggaugcu

SEQ ID NO: 15430 - RNA, 22 nt, Human
agcuucagauuuaucuuucugu

SEQ ID NO: 15431 - RNA, 22 nt, Human
agcuucaggaacaggcagccug

SEQ ID NO: 15432 - RNA, 20 nt, Human
agcuucaggcucaagagaac

SEQ ID NO: 15433 - RNA, 22 nt, Human
agcuucagugucaggcccgugg

SEQ ID NO: 15434 - RNA, 17 nt, Human
agcuucaguugcaaaac

SEQ ID NO: 15435 - RNA, 22 nt, Human
agcuucauaauuccuugacuca

SEQ ID NO: 15436 - RNA, 22 nt, Human
agcuuccacaucugucuucagu

SEQ ID NO: 15437 - RNA, 22 nt, Human
agcuuccauacuaagacaaaag

SEQ ID NO: 15438 - RNA, 19 nt, Human
agcuuccauauucucuagu

SEQ ID NO: 15439 - RNA, 22 nt, Human
agcuuccucaccucagaggucu

SEQ ID NO: 15440 - RNA, 22 nt, Human
agcuuccugucuucugcacaaa

SEQ ID NO: 15441 - RNA, 22 nt, Human
agcuucuagcccauccagcagg

SEQ ID NO: 15442 - RNA, 22 nt, Human
agcuucucaaguguuugcgggg

SEQ ID NO: 15443 - RNA, 22 nt, Human
agcuucucaucuuccaaaauug

SEQ ID NO: 15444 - RNA, 22 nt, Human
agcuucucucuuugcacucaca

SEQ ID NO: 15445 - RNA, 22 nt, Human
agcuucugcaucuuuucuuccc

SEQ ID NO: 15446 - RNA, 22 nt, Human
agcuucugcccguguuugcucu

SEQ ID NO: 15447 - RNA, 22 nt, Human
agcuucuuaaguuccugcagca

SEQ ID NO: 15448 - RNA, 20 nt, Human
agcuucuucugucuaauuuu

SEQ ID NO: 15449 - RNA, 22 nt, Human
agcuucuugacggauguucugg

SEQ ID NO: 15450 - RNA, 22 nt, Human
agcuucuugggcuuuacacaaa

SEQ ID NO: 15451 - RNA, 22 nt, Human
agcuucuuugugggcuccagaa

SEQ ID NO: 15452 - RNA, 22 nt, Human
agcuucuuuuacagcucaugcu

SEQ ID NO: 15453 - RNA, 22 nt, Human
agcuugauuucucugcagugug

SEQ ID NO: 15454 - RNA, 23 nt, Human
agcuugcuuuucccaguacugca

SEQ ID NO: 15455 - RNA, 23 nt, Human
agcuuggaacaaugcaaauacag

SEQ ID NO: 15456 - RNA, 22 nt, Human
agcuuguaacagacauaaaaau

SEQ ID NO: 15457 - RNA, 22 nt, Human
agcuuguagaaggccacgagca

SEQ ID NO: 15458 - RNA, 22 nt, Human
aggaccugagaguuggaaaucc

SEQ ID NO: 15459 - RNA, 22 nt, Human
aggaccugccaggugcaaagca

SEQ ID NO: 15460 - RNA, 22 nt, Human
aggaccuguguuuuccuugaau

SEQ ID NO: 15461 - RNA, 22 nt, Human
aggacucaucccugcuugucag

SEQ ID NO: 15462 - RNA, 22 nt, Human
aggacugacuuuugccaugaaa

SEQ ID NO: 15463 - RNA, 22 nt, Human
aggacugaugauggugcugaca

SEQ ID NO: 15464 - RNA, 22 nt, Human
aggacugggugcagagggcauc

SEQ ID NO: 15465 - RNA, 22 nt, Human
aggacuguuuuuucuucuaggg

SEQ ID NO: 15466 - RNA, 22 nt, Human
aggacuucaucaccuguauaaa

SEQ ID NO: 15467 - RNA, 22 nt, Human
aggacuucuagugguacuguga

SEQ ID NO: 15468 - RNA, 22 nt, Human
aggacuucuuagaugccuuccg

SEQ ID NO: 15469 - RNA, 22 nt, Human
aggacuuuagagccagaaagac

SEQ ID NO: 15470 - RNA, 22 nt, Human
aggacuuuaucuucuagaccuc

SEQ ID NO: 15471 - RNA, 22 nt, Human
aggacuuuucaucagcuauccu

SEQ ID NO: 15472 - RNA, 18 nt, Human
aggagaaagggaccaggg

SEQ ID NO: 15473 - RNA, 22 nt, Human
aggagaaauccaucgagaaugg

SEQ ID NO: 15474 - RNA, 19 nt, Human
aggagaagacucucucccc

SEQ ID NO: 15475 - RNA, 19 nt, Human
aggagaaguagcagaaauu

SEQ ID NO: 15476 - RNA, 22 nt, Human
aggagaauuaggaacucaagau

SEQ ID NO: 15477 - RNA, 23 nt, Human
aggagacagggaagugccuggcu

SEQ ID NO: 15478 - RNA, 22 nt, Human
aggagacaguuuggacguguag

SEQ ID NO: 15479 - RNA, 20 nt, Human
aggagaccaagccaagugga

SEQ ID NO: 15480 - RNA, 22 nt, Human
cugauucuguugaacaccuucc

SEQ ID NO: 15481 - RNA, 22 nt, Human
cugauucuuugaagaugcaccc

SEQ ID NO: 15482 - RNA, 22 nt, Human
cugauugagaaggaaggggauc

SEQ ID NO: 15483 - RNA, 22 nt, Human
cugauuguguuccugggagcug

SEQ ID NO: 15484 - RNA, 22 nt, Human
cugauuucucaguucuaggaag

SEQ ID NO: 15485 - RNA, 22 nt, Human
cugcaaaaguaauuggggcuuu

SEQ ID NO: 15486 - RNA, 22 nt, Human
cugcaaaauuguucuuugcucc

SEQ ID NO: 15487 - RNA, 21 nt, Human
cugcaaauaccuaguuaucug

SEQ ID NO: 15488 - RNA, 22 nt, Human
cugcaaaucaaguucuuauaau

SEQ ID NO: 15489 - RNA, 21 nt, Human
cugcaaaugcaaggugaccag

SEQ ID NO: 15490 - RNA, 22 nt, Human
cugcaaaugccgugagagcagg

SEQ ID NO: 15491 - RNA, 22 nt, Human
cugcaagauguugucauaugcu

SEQ ID NO: 15492 - RNA, 22 nt, Human
cugcaaggcuggggugagcugg

SEQ ID NO: 15493 - RNA, 22 nt, Human
cugcacaaugcaccaucaaguu

SEQ ID NO: 15494 - RNA, 22 nt, Human
cugcacagagcagggcagacac

SEQ ID NO: 15495 - RNA, 22 nt, Human
cugcacagcccucaagagccug

SEQ ID NO: 15496 - RNA, 22 nt, Human
cugcacagccugucugggggcc

SEQ ID NO: 15497 - RNA, 22 nt, Human
cugcacagcuggccagggagag

SEQ ID NO: 15498 - RNA, 22 nt, Human
cugcacaggggaugagggcagu

SEQ ID NO: 15499 - RNA, 22 nt, Human
cugcacaguaagcuucagagau

SEQ ID NO: 15500 - RNA, 22 nt, Human
cugcaccgugucucgggcugcc

SEQ ID NO: 15501 - RNA, 22 nt, Human
cugcacguauaaucagucuguu

SEQ ID NO: 15502 - RNA, 22 nt, Human
cugcacugagacccucuuugcu

SEQ ID NO: 15503 - RNA, 22 nt, Human
cugcacugagcaucuaaccuua

SEQ ID NO: 15504 - RNA, 22 nt, Human
cugcagaaagcugagaugauua

SEQ ID NO: 15505 - RNA, 22 nt, Human
cugcagagcaaguaacauccuc

SEQ ID NO: 15506 - RNA, 21 nt, Human
cugcagagcaugcaaaauguu

SEQ ID NO: 15507 - RNA, 22 nt, Human
cugcagagcuaggcugagugaa

SEQ ID NO: 15508 - RNA, 22 nt, Human
cugcagauggcucaguggggca

SEQ ID NO: 15509 - RNA, 22 nt, Human
cugcagcaaauguuaagugacu

SEQ ID NO: 15510 - RNA, 22 nt, Human
cugcagccucaaccuccugagc

SEQ ID NO: 15511 - RNA, 22 nt, Human
cugcagcuccccugagaucaag

SEQ ID NO: 15512 - RNA, 22 nt, Human
cugcagcucuagcuuuugaccu

SEQ ID NO: 15513 - RNA, 22 nt, Human
cugcagcugcgggaccggagcg

SEQ ID NO: 15514 - RNA, 22 nt, Human
cugcagcugcucauguuacuug

SEQ ID NO: 15515 - RNA, 22 nt, Human
cugcagcugggccagggccacc

SEQ ID NO: 15516 - RNA, 22 nt, Human
cugcagcuuuuugugcuuguaa

SEQ ID NO: 15517 - RNA, 22 nt, Human
cugcaggaauucaaagugagcu

SEQ ID NO: 15518 - RNA, 22 nt, Human
cugcaggacugaaagaugaggu

SEQ ID NO: 15519 - RNA, 22 nt, Human
cugcaggaggauccugagagug

SEQ ID NO: 15520 - RNA, 22 nt, Human
cugcaggagggcuggggaagcc

SEQ ID NO: 15521 - RNA, 22 nt, Human
cugcaggagugaaagcaggccu

SEQ ID NO: 15522 - RNA, 22 nt, Human
cugcaggauuucaugggcugac

SEQ ID NO: 15523 - RNA, 22 nt, Human
cugcaggcaucuaacugugggc

SEQ ID NO: 15524 - RNA, 22 nt, Human
cugcaggcugagcgccugccgg

SEQ ID NO: 15525 - RNA, 22 nt, Human
gccaggacuagagggaggugag

SEQ ID NO: 15526 - RNA, 22 nt, Human
gccaggacucuuccuagaaggu

SEQ ID NO: 15527 - RNA, 22 nt, Human
gccaggagaaaaggcgaaugau

SEQ ID NO: 15528 - RNA, 22 nt, Human
gccaggagcccugggcaaguuc

SEQ ID NO: 15529 - RNA, 20 nt, Human
gccaggagggugugaugagc

SEQ ID NO: 15530 - RNA, 22 nt, Human
gccaggaggucagccccucaac

SEQ ID NO: 15531 - RNA, 23 nt, Human
gccaggaguggguagacuaaugc

SEQ ID NO: 15532 - RNA, 22 nt, Human
gccaggaugacuauacaacagc

SEQ ID NO: 15533 - RNA, 22 nt, Human
gccaggcacaguucuaggugcu

SEQ ID NO: 15534 - RNA, 20 nt, Human
gccaggcacuguucucaaua

SEQ ID NO: 15535 - RNA, 22 nt, Human
gccaggcagauaugugagcuua

SEQ ID NO: 15536 - RNA, 22 nt, Human
gccaggcagcagcgaggauggu

SEQ ID NO: 15537 - RNA, 22 nt, Human
gccaggcagcuagcaaccccug

SEQ ID NO: 15538 - RNA, 22 nt, Human
gccaggcauuuguuaggugcug

SEQ ID NO: 15539 - RNA, 22 nt, Human
gccaggcccugggcacuucgug

SEQ ID NO: 15540 - RNA, 22 nt, Human
gccaggcgggucucaaacuccu

SEQ ID NO: 15541 - RNA, 22 nt, Human
gccaggcucaguagcgauuccu

SEQ ID NO: 15542 - RNA, 19 nt, Human
gccaggcucuuauucugug

SEQ ID NO: 15543 - RNA, 22 nt, Human
gccaggcucuuccauuuggguc

SEQ ID NO: 15544 - RNA, 22 nt, Human
gccaggcugacucccccggccu

SEQ ID NO: 15545 - RNA, 22 nt, Human
gccaggcugcuggcugcugucc

SEQ ID NO: 15546 - RNA, 22 nt, Human
gccaggcuggaaagaacagaca

SEQ ID NO: 15547 - RNA, 22 nt, Human
gccaggcugguuauuuaaugag

SEQ ID NO: 15548 - RNA, 22 nt, Human
gccaggcuguuuuuauuacugu

SEQ ID NO: 15549 - RNA, 22 nt, Human
gccagggaacccaagggccuca

SEQ ID NO: 15550 - RNA, 21 nt, Human
gccagggaagagaguuggcug

SEQ ID NO: 15551 - RNA, 21 nt, Human
gccagggaguuaaagagucuu

SEQ ID NO: 15552 - RNA, 22 nt, Human
gccagguacauuuaagaagccu

SEQ ID NO: 15553 - RNA, 22 nt, Human
gccagguaugaauuacgcacga

SEQ ID NO: 15554 - RNA, 22 nt, Human
gccaggucacagggauaaaugg

SEQ ID NO: 15555 - RNA, 22 nt, Human
gccaggucaccucacucaucca

SEQ ID NO: 15556 - RNA, 22 nt, Human
gccaggucugcaggcauccuga

SEQ ID NO: 15557 - RNA, 22 nt, Human
gccagguggcugagugacugag

SEQ ID NO: 15558 - RNA, 22 nt, Human
gccagguucuggggagguacaa

SEQ ID NO: 15559 - RNA, 22 nt, Human
gccagucugauaggggagaagu

SEQ ID NO: 15560 - RNA, 22 nt, Human
gccagugccugcugcucagggc

SEQ ID NO: 15561 - RNA, 21 nt, Human
gccagugcugucugugugauc

SEQ ID NO: 15562 - RNA, 22 nt, Human
gccaguggagcacauggugaag

SEQ ID NO: 15563 - RNA, 22 nt, Human
gccaguggaggacccauggaga

SEQ ID NO: 15564 - RNA, 22 nt, Human
gccagugggacccgcugugggc

SEQ ID NO: 15565 - RNA, 22 nt, Human
gccaguggucacugaggaagaa

SEQ ID NO: 15566 - RNA, 22 nt, Human
gccaguggucagugggagggug

SEQ ID NO: 15567 - RNA, 17 nt, Human
gccaguugucuuggcau

SEQ ID NO: 15568 - RNA, 22 nt, Human
gccaguuuaaaccuugugaaua

SEQ ID NO: 15569 - RNA, 22 nt, Human
gccaucugcugcucuccagugu

SEQ ID NO: 15570 - RNA, 22 nt, Human
gccaugaggcuccgagaaguca

SEQ ID NO: 15571 - RNA, 22 nt, Human
gccaugcaauggaauaaaauca

SEQ ID NO: 15572 - RNA, 22 nt, Human
gccauggcccauaccaggugca

SEQ ID NO: 15573 - RNA, 22 nt, Human
gccaugggcaaaugcagagcug

SEQ ID NO: 15574 - RNA, 22 nt, Human
gccauggggagggcagcgccug

SEQ ID NO: 15575 - RNA, 22 nt, Human
gccaugugggcagaggaggcug

SEQ ID NO: 15576 - RNA, 22 nt, Human
gccauuaaagugcauguuuugc

SEQ ID NO: 15577 - RNA, 22 nt, Human
gccauuaacaagaauauaguag

SEQ ID NO: 15578 - RNA, 22 nt, Human
gccauuaaugagaucaagaauc

SEQ ID NO: 15579 - RNA, 22 nt, Human
gccauucaauucuacaaguaua

SEQ ID NO: 15580 - RNA, 22 nt, Human
gccauucauauuuuagcauuaa

SEQ ID NO: 15581 - RNA, 22 nt, Human
gccauugagauugaaguaagca

SEQ ID NO: 15582 - RNA, 22 nt, Human
gccauuuagggaggcaagguga

SEQ ID NO: 15583 - RNA, 22 nt, Human
gcccaagacuguacaguuaaag

SEQ ID NO: 15584 - RNA, 22 nt, Human
gcccacagcucguuccucuccu

SEQ ID NO: 15585 - RNA, 22 nt, Human
gcccacauccacuagacaugca

SEQ ID NO: 15586 - RNA, 23 nt, Human
gcccacccucagcguccucacgg

SEQ ID NO: 15587 - RNA, 20 nt, Human
gcccacucuaauccacuguc

SEQ ID NO: 15588 - RNA, 22 nt, Human
gcccacuuucugccagcucacc

SEQ ID NO: 15589 - RNA, 22 nt, Human
gccuccugaaaggaagagcucc

SEQ ID NO: 15590 - RNA, 22 nt, Human
gccuccugaagugcugggauua

SEQ ID NO: 15591 - RNA, 22 nt, Human
gccuccugagaagccacaggcu

SEQ ID NO: 15592 - RNA, 22 nt, Human
gccuccugcccagaugagugau

SEQ ID NO: 15593 - RNA, 22 nt, Human
gccuccuggaagucacauguuu

SEQ ID NO: 15594 - RNA, 22 nt, Human
gccucuccuggagaaggcaggg

SEQ ID NO: 15595 - RNA, 22 nt, Human
gccucucuccuuggcuugcagu

SEQ ID NO: 15596 - RNA, 22 nt, Human
gccucucucuacccaguaugau

SEQ ID NO: 15597 - RNA, 22 nt, Human
gccucugauggaggccagcgcu

SEQ ID NO: 15598 - RNA, 22 nt, Human
gccucugcacuguggcacacca

SEQ ID NO: 15599 - RNA, 22 nt, Human
gccucugcaucuucgccgcacu

SEQ ID NO: 15600 - RNA, 22 nt, Human
gccucugcaugcucagcaccca

SEQ ID NO: 15601 - RNA, 22 nt, Human
gccucugcgccucagccgaccu

SEQ ID NO: 15602 - RNA, 22 nt, Human
gccucugcucggacuuugccuc

SEQ ID NO: 15603 - RNA, 22 nt, Human
gccucugcucucagguagccuc

SEQ ID NO: 15604 - RNA, 23 nt, Human
gccucuggagccccagugcucag

SEQ ID NO: 15605 - RNA, 22 nt, Human
gccucuggaguugcuuguaaau

SEQ ID NO: 15606 - RNA, 22 nt, Human
gccucugggguggagcccagca

SEQ ID NO: 15607 - RNA, 22 nt, Human
gccucuggguuggugacaggcu

SEQ ID NO: 15608 - RNA, 22 nt, Human
gccugaagaacagcugugagga

SEQ ID NO: 15609 - RNA, 22 nt, Human
gccugaccucuucugcccuggg

SEQ ID NO: 15610 - RNA, 22 nt, Human
gccugagaaggacacagcaggu

SEQ ID NO: 15611 - RNA, 22 nt, Human
gccugagagucugcauuucuaa

SEQ ID NO: 15612 - RNA, 22 nt, Human
gccugagauucccggagccgug

SEQ ID NO: 15613 - RNA, 22 nt, Human
gccugagcccaggugugcagag

SEQ ID NO: 15614 - RNA, 22 nt, Human
gccugagccgccugagcggcgg

SEQ ID NO: 15615 - RNA, 20 nt, Human
gccugagcuauugccaggau

SEQ ID NO: 15616 - RNA, 22 nt, Human
gccugagcuuuaauuuucuugu

SEQ ID NO: 15617 - RNA, 22 nt, Human
gccugagggcuccuagcaggcu

SEQ ID NO: 15618 - RNA, 21 nt, Human
gccugcagaccccaccaggcu

SEQ ID NO: 15619 - RNA, 22 nt, Human
gccugcagccucagagaauuuu

SEQ ID NO: 15620 - RNA, 22 nt, Human
gccugcagcugcuuccacacac

SEQ ID NO: 15621 - RNA, 17 nt, Human
gccugcaggcccgcaga

SEQ ID NO: 15622 - RNA, 22 nt, Human
gccugcagggccugggccuacc

SEQ ID NO: 15623 - RNA, 18 nt, Human
gccugccaacuccugauc

SEQ ID NO: 15624 - RNA, 18 nt, Human
gccugccagccgagggac

SEQ ID NO: 15625 - RNA, 19 nt, Human
gccugccagccugaaucug

SEQ ID NO: 15626 - RNA, 23 nt, Human
gccugccauauaccuggaaacag

SEQ ID NO: 15627 - RNA, 22 nt, Human
gccugcccugaaagaggugaag

SEQ ID NO: 15628 - RNA, 22 nt, Human
gccugccuagaauugcagcuuu

SEQ ID NO: 15629 - RNA, 22 nt, Human
gccugccugaaggcuguaccag

SEQ ID NO: 15630 - RNA, 19 nt, Human
gccugccuggguuucugag

SEQ ID NO: 15631 - RNA, 22 nt, Human
gccugccuuuuggaggcacauu

SEQ ID NO: 15632 - RNA, 22 nt, Human
gccugcucagaccuagcaggcc

SEQ ID NO: 15633 - RNA, 22 nt, Human
gccugcugccacccuggcuccg

SEQ ID NO: 15634 - RNA, 22 nt, Human
gccugcugggagacacccccag

SEQ ID NO: 15635 - RNA, 22 nt, Human
gccugcuuccuagccuuccaag

SEQ ID NO: 15636 - RNA, 22 nt, Human
gccugcuuccuuuucauagaug

SEQ ID NO: 15637 - RNA, 22 nt, Human
gccugcuuugccuacaagcaga

SEQ ID NO: 15638 - RNA, 22 nt, Human
gccuggaaugcaaugugacgaa

SEQ ID NO: 15639 - RNA, 22 nt, Human
gccuggagacaaggacaaaggg

SEQ ID NO: 15640 - RNA, 22 nt, Human
gccuggagaggaagccggugga

SEQ ID NO: 15641 - RNA, 22 nt, Human
gccuggagcucaugugggcauu

SEQ ID NO: 15642 - RNA, 22 nt, Human
cugcagggaacugaggcccaga

SEQ ID NO: 15643 - RNA, 22 nt, Human
cugcagggaugugaggcccguu

SEQ ID NO: 15644 - RNA, 19 nt, Human
cugcagggaugugcagagu

SEQ ID NO: 15645 - RNA, 22 nt, Human
cugcagggcagaagggcauaga

SEQ ID NO: 15646 - RNA, 22 nt, Human
cugcagggcuguggucuggagu

SEQ ID NO: 15647 - RNA, 20 nt, Human
cugcaggguuagaggcucca

SEQ ID NO: 15648 - RNA, 22 nt, Human
cugcaggguuuuaacaauggac

SEQ ID NO: 15649 - RNA, 22 nt, Human
cugcagguuaggagcacuccuu

SEQ ID NO: 15650 - RNA, 22 nt, Human
cugcagguugagcagccagguu

SEQ ID NO: 15651 - RNA, 22 nt, Human
cugcaguagcagagcugaguag

SEQ ID NO: 15652 - RNA, 22 nt, Human
cugcaguaguuuuugacucuag

SEQ ID NO: 15653 - RNA, 22 nt, Human
cugcaguaucugcuuuggguag

SEQ ID NO: 15654 - RNA, 23 nt, Human
cugcagucgccggccugggugcc

SEQ ID NO: 15655 - RNA, 22 nt, Human
cugcaguguucuggaaugcauu

SEQ ID NO: 15656 - RNA, 22 nt, Human
cugcaguuggcugagacccccc

SEQ ID NO: 15657 - RNA, 20 nt, Human
cugcaucagcggccgcgucu

SEQ ID NO: 15658 - RNA, 22 nt, Human
cugcaucaggccaauuaagaau

SEQ ID NO: 15659 - RNA, 20 nt, Human
cugcaucugugacuugcaaa

SEQ ID NO: 15660 - RNA, 22 nt, Human
cugcaugagcugucaguggagg

SEQ ID NO: 15661 - RNA, 22 nt, Human
cugcauuacagccuccuuagga

SEQ ID NO: 15662 - RNA, 22 nt, Human
cugcauuauuggaacggcugaa

SEQ ID NO: 15663 - RNA, 22 nt, Human
cugcauucauaucagauagaag

SEQ ID NO: 15664 - RNA, 23 nt, Human
cugcauugucuccugggagcaug

SEQ ID NO: 15665 - RNA, 22 nt, Human
cugccaaaaggugcaccugcug

SEQ ID NO: 15666 - RNA, 22 nt, Human
cugccaaggcuggggaggacaa

SEQ ID NO: 15667 - RNA, 22 nt, Human
cugccaaguaaugccugggcuc

SEQ ID NO: 15668 - RNA, 22 nt, Human
cugccagaagagaacaccaguu

SEQ ID NO: 15669 - RNA, 22 nt, Human
cugccagaagguuccugcugca

SEQ ID NO: 15670 - RNA, 22 nt, Human
cugccagcaaugugaccaugcu

SEQ ID NO: 15671 - RNA, 22 nt, Human
cugccagcacugccuccugagg

SEQ ID NO: 15672 - RNA, 22 nt, Human
cugccagcagaggccagcgcug

SEQ ID NO: 15673 - RNA, 22 nt, Human
cugccagccaggccagguaggc

SEQ ID NO: 15674 - RNA, 22 nt, Human
cugccaggacugacgucuucag

SEQ ID NO: 15675 - RNA, 21 nt, Human
cugccaggauagcaugcaggc

SEQ ID NO: 15676 - RNA, 22 nt, Human
cugccaggccuggggugcuguc

SEQ ID NO: 15677 - RNA, 22 nt, Human
cugccaggcugucccagguccg

SEQ ID NO: 15678 - RNA, 22 nt, Human
cugccagguaaacugcaggaau

SEQ ID NO: 15679 - RNA, 22 nt, Human
cugccagugaaauugugucagu

SEQ ID NO: 15680 - RNA, 22 nt, Human
cugccauccucaccagagcagc

SEQ ID NO: 15681 - RNA, 18 nt, Human
cugccauguccuacuguc

SEQ ID NO: 15682 - RNA, 22 nt, Human
cugcccaaauccuucuuccucu

SEQ ID NO: 15683 - RNA, 22 nt, Human
cugcccacaccugagcugggcc

SEQ ID NO: 15684 - RNA, 22 nt, Human
cugcccacaguucucugccaug

SEQ ID NO: 15685 - RNA, 22 nt, Human
cugcccagaaucacucacucga

SEQ ID NO: 15686 - RNA, 18 nt, Human
cugcccagagcauuucau

SEQ ID NO: 15687 - RNA, 22 nt, Human
cugcccaggaaccagaggggca

SEQ ID NO: 15688 - RNA, 22 nt, Human
cugcccaguuugggagccuuuc

SEQ ID NO: 15689 - RNA, 22 nt, Human
cugccccaggccuccuuuucuu

SEQ ID NO: 15690 - RNA, 22 nt, Human
cugccccaggccucgggaggag

SEQ ID NO: 15691 - RNA, 22 nt, Human
cugccccagugccaggcaggug

SEQ ID NO: 15692 - RNA, 22 nt, Human
cugccccauggucccugguggg

SEQ ID NO: 15693 - RNA, 22 nt, Human
cugcccugagggccuguguguu

SEQ ID NO: 15694 - RNA, 22 nt, Human
cugcccugcuugaugacagcga

SEQ ID NO: 15695 - RNA, 22 nt, Human
cugcccugggccaggaagcggc

SEQ ID NO: 15696 - RNA, 22 nt, Human
cugcccugggugcuggggaucc

SEQ ID NO: 15697 - RNA, 22 nt, Human
cugcccuguuuggacagcccgg

SEQ ID NO: 15698 - RNA, 22 nt, Human
cuucagaggggacucaaaguca

SEQ ID NO: 15699 - RNA, 22 nt, Human
cuucagagugcagaagauuggg

SEQ ID NO: 15700 - RNA, 22 nt, Human
cuucagcaccucagcuggagag

SEQ ID NO: 15701 - RNA, 22 nt, Human
cuucagcagaugugcuagagau

SEQ ID NO: 15702 - RNA, 22 nt, Human
cuucagcccugagugccagcag

SEQ ID NO: 15703 - RNA, 22 nt, Human
cuucagccucaacuacuauggu

SEQ ID NO: 15704 - RNA, 22 nt, Human
cuucagcucuugguaaauguuu

SEQ ID NO: 15705 - RNA, 22 nt, Human
cuucaggaaaaucucuaaggau

SEQ ID NO: 15706 - RNA, 20 nt, Human
cuucaggacccauccucccc

SEQ ID NO: 15707 - RNA, 22 nt, Human
cuucaggauuuaggaagaugaa

SEQ ID NO: 15708 - RNA, 22 nt, Human
cuucagucgccuuggcaggggc

SEQ ID NO: 15709 - RNA, 18 nt, Human
cuucagugacagucuggc

SEQ ID NO: 15710 - RNA, 23 nt, Human
cuucagugugggacugcagcgug

SEQ ID NO: 15711 - RNA, 22 nt, Human
cuucaguuagaguuuacaaagu

SEQ ID NO: 15712 - RNA, 22 nt, Human
cuucaguuaugugccaaggaca

SEQ ID NO: 15713 - RNA, 22 nt, Human
cuucauaaacucagaaggcagc

SEQ ID NO: 15714 - RNA, 22 nt, Human
cuucauagaacagaaauuuaau

SEQ ID NO: 15715 - RNA, 22 nt, Human
cuucaucuuucugagccucagu

SEQ ID NO: 15716 - RNA, 22 nt, Human
cuucaugacccauaaaaauuua

SEQ ID NO: 15717 - RNA, 22 nt, Human
cuucaugaggccggcuuuaucc

SEQ ID NO: 15718 - RNA, 22 nt, Human
cuucaugguaaaucugccuuua

SEQ ID NO: 15719 - RNA, 22 nt, Human
cuucauguacaguuauuggaga

SEQ ID NO: 15720 - RNA, 22 nt, Human
cuucauguucuuggugaaaggc

SEQ ID NO: 15721 - RNA, 22 nt, Human
cuucauuaaugucuauaaguuu

SEQ ID NO: 15722 - RNA, 22 nt, Human
cuucauuacuugcucguagcac

SEQ ID NO: 15723 - RNA, 19 nt, Human
cuucauucuucagcuuuug

SEQ ID NO: 15724 - RNA, 22 nt, Human
cuucauuucaggcugaagaaua

SEQ ID NO: 15725 - RNA, 22 nt, Human
cuuccaaaauuuauauguugaa

SEQ ID NO: 15726 - RNA, 22 nt, Human
cuuccaaguugcucugcugacc

SEQ ID NO: 15727 - RNA, 22 nt, Human
cuuccaauagcaacaaagauua

SEQ ID NO: 15728 - RNA, 22 nt, Human
cuuccagaguugcguucucggu

SEQ ID NO: 15729 - RNA, 22 nt, Human
cuuccagcugauuggcauccag

SEQ ID NO: 15730 - RNA, 22 nt, Human
cuuccaggacaccaggguagua

SEQ ID NO: 15731 - RNA, 22 nt, Human
cuuccaggugcuggccuggccu

SEQ ID NO: 15732 - RNA, 22 nt, Human
cuuccaguaguaucauucucau

SEQ ID NO: 15733 - RNA, 22 nt, Human
cuuccagucuagagcuaucugu

SEQ ID NO: 15734 - RNA, 22 nt, Human
cuuccauacagacaaugcaaug

SEQ ID NO: 15735 - RNA, 22 nt, Human
cuucccaaguaaauuuguauuu

SEQ ID NO: 15736 - RNA, 22 nt, Human
cuucccaggugcucuuagcaug

SEQ ID NO: 15737 - RNA, 22 nt, Human
cuucccauauaacuaauuucug

SEQ ID NO: 15738 - RNA, 22 nt, Human
cuuccccaggaccucugcuaaa

SEQ ID NO: 15739 - RNA, 22 nt, Human
cuucccccaaaucaagagaccu

SEQ ID NO: 15740 - RNA, 22 nt, Human
cuucccuucugugcagggcaga

SEQ ID NO: 15741 - RNA, 22 nt, Human
cuucccuuggugaacagagcau

SEQ ID NO: 15742 - RNA, 22 nt, Human
cuuccgugucaguuccaggugg

SEQ ID NO: 15743 - RNA, 22 nt, Human
cuuccuaaaagcuucaagagaa

SEQ ID NO: 15744 - RNA, 22 nt, Human
cuuccucugccucccgugcuca

SEQ ID NO: 15745 - RNA, 16 nt, Human
cuuccucuucacuggc

SEQ ID NO: 15746 - RNA, 22 nt, Human
cuuccugcaggacagccaucug

SEQ ID NO: 15747 - RNA, 22 nt, Human
cuuccugcauggagucugaaug

SEQ ID NO: 15748 - RNA, 22 nt, Human
cuuccugcuccccugccaauuc

SEQ ID NO: 15749 - RNA, 22 nt, Human
cuuccuggaugagcaggcugau

SEQ ID NO: 15750 - RNA, 22 nt, Human
cuuccuggcucggugccucacc

SEQ ID NO: 15751 - RNA, 22 nt, Human
cuuccugggucagccuggaggu

SEQ ID NO: 15752 - RNA, 22 nt, Human
cuuccugguuugaagcucgccg

SEQ ID NO: 15753 - RNA, 22 nt, Human
cuuccuguugucacagucugcg

SEQ ID NO: 15754 - RNA, 22 nt, Human
cuuccuucaauauaauuuuuac

SEQ ID NO: 15755 - RNA, 22 nt, Human
cuuccuuccuuccccgaaaugc

SEQ ID NO: 15756 - RNA, 22 nt, Human
cuuccuucuguaagaccaguug

SEQ ID NO: 15757 - RNA, 22 nt, Human
cuuccuugcggccccugccuag

SEQ ID NO: 15758 - RNA, 19 nt, Human
cuuccuugcuccccaugug

SEQ ID NO: 15759 - RNA, 22 nt, Human
cuuccuugcugucugcuccagg

SEQ ID NO: 15760 - RNA, 22 nt, Human
cuucgauuuaauucuuaaccuu

SEQ ID NO: 15761 - RNA, 22 nt, Human
cuucuaacauccuacaaugcaa

SEQ ID NO: 15762 - RNA, 19 nt, Human
cuucuagaccuuauaccac

SEQ ID NO: 15763 - RNA, 22 nt, Human
cuucuagaguaaggaacaaaug

SEQ ID NO: 15764 - RNA, 22 nt, Human
cuucuagcuauaguguuuucuu

SEQ ID NO: 15765 - RNA, 22 nt, Human
cuucuagggcaucaugacaaau

SEQ ID NO: 15766 - RNA, 22 nt, Human
cuucuauuuucaugccuggguc

SEQ ID NO: 15767 - RNA, 22 nt, Human
cuucucaaacugagacugucua

SEQ ID NO: 15768 - RNA, 22 nt, Human
cuucucagaggccagaagcuau

SEQ ID NO: 15769 - RNA, 22 nt, Human
cuucucagcuuagguaugguuu

SEQ ID NO: 15770 - RNA, 22 nt, Human
cuucucagucuugguuagagag

SEQ ID NO: 15771 - RNA, 22 nt, Human
cuucucaguugcaagugucaga

SEQ ID NO: 15772 - RNA, 18 nt, Human
cuucucccaucuuggcca

SEQ ID NO: 15773 - RNA, 22 nt, Human
cuucuccuaaggucagaauugc

SEQ ID NO: 15774 - RNA, 22 nt, Human
cuucucuaugauguucuaaggu

SEQ ID NO: 15775 - RNA, 22 nt, Human
cuucucuucccagggacacagg

SEQ ID NO: 15776 - RNA, 22 nt, Human
cuucucuuccuuugucaacuga

SEQ ID NO: 15777 - RNA, 22 nt, Human
cuucucuugguaguucuuguug

SEQ ID NO: 15778 - RNA, 22 nt, Human
cuucugagauguuguuuuacag

SEQ ID NO: 15779 - RNA, 22 nt, Human
cuucugaucuggauuccuaacu

SEQ ID NO: 15780 - RNA, 22 nt, Human
cuucugcacugaccuuuugucc

SEQ ID NO: 15781 - RNA, 22 nt, Human
cuucuggaggacacuggcccca

SEQ ID NO: 15782 - RNA, 23 nt, Human
cuucuggcucuauaucagaauuc

SEQ ID NO: 15783 - RNA, 22 nt, Human
cuucugggagagcuuuugcuuc

SEQ ID NO: 15784 - RNA, 22 nt, Human
cuucugggcauggcagagccug

SEQ ID NO: 15785 - RNA, 22 nt, Human
cuucugggccauggccuuccuc

SEQ ID NO: 15786 - RNA, 22 nt, Human
cuucugggugccugugaguguu

SEQ ID NO: 15787 - RNA, 22 nt, Human
cuucugugaaugaaguguggga

SEQ ID NO: 15788 - RNA, 19 nt, Human
cuucugugauacaucaguc

SEQ ID NO: 15789 - RNA, 22 nt, Human
cuucuguggauauguucucucu

SEQ ID NO: 15790 - RNA, 22 nt, Human
cuucuguguagaaagguagccc

SEQ ID NO: 15791 - RNA, 22 nt, Human
cuucuuaaagauuacacaauga

SEQ ID NO: 15792 - RNA, 22 nt, Human
cuggccaguuacugcuauuggc

SEQ ID NO: 15793 - RNA, 22 nt, Human
cuggccaguuguccuggcuugg

SEQ ID NO: 15794 - RNA, 22 nt, Human
cuggcccagguggucguugagg

SEQ ID NO: 15795 - RNA, 20 nt, Human
cuggcccaucuaccgcucug

SEQ ID NO: 15796 - RNA, 22 nt, Human
cuggcccggcugccuggucauu

SEQ ID NO: 15797 - RNA, 22 nt, Human
cuggcccucgucaguuucacug

SEQ ID NO: 15798 - RNA, 22 nt, Human
cuggcccugcuccgcgccgcgg

SEQ ID NO: 15799 - RNA, 22 nt, Human
cuggcccuggagggcugugcga

SEQ ID NO: 15800 - RNA, 23 nt, Human
cuggcccuggcucugugaucaug

SEQ ID NO: 15801 - RNA, 22 nt, Human
cuggcccuguaggaugugaguu

SEQ ID NO: 15802 - RNA, 22 nt, Human
cuggcccuguggaggcaggaac

SEQ ID NO: 15803 - RNA, 22 nt, Human
cuggcccuguggccuaaggacu

SEQ ID NO: 15804 - RNA, 22 nt, Human
cuggccuaaaauugcuucugca

SEQ ID NO: 15805 - RNA, 22 nt, Human
cuggccuaggaaugguuuuccg

SEQ ID NO: 15806 - RNA, 22 nt, Human
cuggccucagagggucauggug

SEQ ID NO: 15807 - RNA, 22 nt, Human
cuucuugcaauuuucaucuuau

SEQ ID NO: 15808 - RNA, 22 nt, Human
cuucuugcugggggccucagug

SEQ ID NO: 15809 - RNA, 22 nt, Human
cuucuuggaagucguccuucca

SEQ ID NO: 15810 - RNA, 22 nt, Human
cuucuuguaaacgguuccccga

SEQ ID NO: 15811 - RNA, 22 nt, Human
cuucuuguaucugccgccgagc

SEQ ID NO: 15812 - RNA, 22 nt, Human
cuucuuguuuuagcccucauac

SEQ ID NO: 15813 - RNA, 22 nt, Human
cuucuuuacuuucuagaaauaa

SEQ ID NO: 15814 - RNA, 22 nt, Human
cuucuuugugccuauuggugac

SEQ ID NO: 15815 - RNA, 22 nt, Human
cuucuuuuacaggucuuggguu

SEQ ID NO: 15816 - RNA, 22 nt, Human
cuugaaaaauaugccuugcuuc

SEQ ID NO: 15817 - RNA, 19 nt, Human
cuugaaacuacuguugaga

SEQ ID NO: 15818 - RNA, 22 nt, Human
cuugaaagucacaugcagcccu

SEQ ID NO: 15819 - RNA, 22 nt, Human
cuugaaagucagcagaguggau

SEQ ID NO: 15820 - RNA, 22 nt, Human
cuugaaauccagauuucagagg

SEQ ID NO: 15821 - RNA, 22 nt, Human
cuugaagacaauggcagauucc

SEQ ID NO: 15822 - RNA, 22 nt, Human
cuugaaugaaaccaacugauga

SEQ ID NO: 15823 - RNA, 22 nt, Human
cuugacacugucacucaggcca

SEQ ID NO: 15824 - RNA, 22 nt, Human
cuugagaacaggguuagguaac

SEQ ID NO: 15825 - RNA, 22 nt, Human
cuugagaaucuucucugaagag

SEQ ID NO: 15826 - RNA, 22 nt, Human
cuugagcuaggaaggcugaggc

SEQ ID NO: 15827 - RNA, 22 nt, Human
cuugaggcugcacuccagggcc

SEQ ID NO: 15828 - RNA, 22 nt, Human
cuugagucauauaaagacagag

SEQ ID NO: 15829 - RNA, 22 nt, Human
cuugaugaaugaccuggguggu

SEQ ID NO: 15830 - RNA, 22 nt, Human
cuugaugagguaugaaccucuc

SEQ ID NO: 15831 - RNA, 22 nt, Human
cuugauggaggggccaggcuuu

SEQ ID NO: 15832 - RNA, 22 nt, Human
cuugauugcuucuacgugacug

SEQ ID NO: 15833 - RNA, 22 nt, Human
cuugcagaggcuguuccagaug

SEQ ID NO: 15834 - RNA, 22 nt, Human
cuugcagggcugaugggaagug

SEQ ID NO: 15835 - RNA, 22 nt, Human
cuugcaguuuagguccucugug

SEQ ID NO: 15836 - RNA, 22 nt, Human
cuugccuguggcuaguuggcuc

SEQ ID NO: 15837 - RNA, 22 nt, Human
cuugcucacaguaccuggcuug

SEQ ID NO: 15838 - RNA, 22 nt, Human
cuugcuggagcggagcgggugu

SEQ ID NO: 15839 - RNA, 22 nt, Human
cuugcuggcagucacuguugcg

SEQ ID NO: 15840 - RNA, 22 nt, Human
cuugcugucccuugguaugaac

SEQ ID NO: 15841 - RNA, 22 nt, Human
cuugcuuaccuaguuagcucca

SEQ ID NO: 15842 - RNA, 22 nt, Human
cuugcuucugcugcacuauccu

SEQ ID NO: 15843 - RNA, 22 nt, Human
cuugcuugauuaugaucauaaa

SEQ ID NO: 15844 - RNA, 22 nt, Human
cuugcuuguuuaguucacagau

SEQ ID NO: 15845 - RNA, 22 nt, Human
cuugcuuguuuugaagaaagau

SEQ ID NO: 15846 - RNA, 22 nt, Human
cuuggaaagguuuuacaaagcg

SEQ ID NO: 15847 - RNA, 22 nt, Human
cuuggaaaguuaucauuuuccu

SEQ ID NO: 15848 - RNA, 21 nt, Human
cuuggaacggguagaacucac

SEQ ID NO: 15849 - RNA, 22 nt, Human
cuuggaacuuaguaauaugaca

SEQ ID NO: 15850 - RNA, 22 nt, Human
cuuggaauugaugauuuucaua

SEQ ID NO: 15851 - RNA, 18 nt, Human
cuuggagaacuaaugaua

SEQ ID NO: 15852 - RNA, 22 nt, Human
cuuggagaauccugguuauuca

SEQ ID NO: 15853 - RNA, 22 nt, Human
cuuggagagagccucagcuguu

SEQ ID NO: 15854 - RNA, 22 nt, Human
cuuggagagggagaaaaauaac

SEQ ID NO: 15855 - RNA, 22 nt, Human
cuuggagauacaagugguaccu

SEQ ID NO: 15856 - RNA, 21 nt, Human
cuuggaguugguugaggaugc

SEQ ID NO: 15857 - RNA, 22 nt, Human
cuuggcagauccaaaaaugaca

SEQ ID NO: 15858 - RNA, 22 nt, Human
cuuggcagcuacacagguaaga

SEQ ID NO: 15859 - RNA, 22 nt, Human
cuuggcaggguggaggaugcag

SEQ ID NO: 15860 - RNA, 22 nt, Human
cuuggccagacagggagcucca

SEQ ID NO: 15861 - RNA, 22 nt, Human
cuuggcccggagccccaugaag

SEQ ID NO: 15862 - RNA, 20 nt, Human
cuuggccuacuuagcuuugu

SEQ ID NO: 15863 - RNA, 22 nt, Human
cuuggccugggccgcagccacu

SEQ ID NO: 15864 - RNA, 22 nt, Human
cuuggcugaacuccaggaugca

SEQ ID NO: 15865 - RNA, 22 nt, Human
cuuggcugggaacugugauuca

SEQ ID NO: 15866 - RNA, 22 nt, Human
cuuggcuguaaaaucagaggcu

SEQ ID NO: 15867 - RNA, 22 nt, Human
cuuggcuuuagaacaugggagc

SEQ ID NO: 15868 - RNA, 22 nt, Human
cuugggaacugccuugccuuug

SEQ ID NO: 15869 - RNA, 22 nt, Human
cuugggaaguguuuaaagcuga

SEQ ID NO: 15870 - RNA, 22 nt, Human
cuugggaggggagcauuggccu

SEQ ID NO: 15871 - RNA, 22 nt, Human
cuugggcaagcagcauucagaa

SEQ ID NO: 15872 - RNA, 22 nt, Human
cuugggcaggguauuguagaag

SEQ ID NO: 15873 - RNA, 22 nt, Human
cuugggcccuccccuugugaau

SEQ ID NO: 15874 - RNA, 23 nt, Human
cuugggcuagagacuuagcagug

SEQ ID NO: 15875 - RNA, 22 nt, Human
cuugggcucuaaaugccaguga

SEQ ID NO: 15876 - RNA, 22 nt, Human
cuuggggaagccacugaucccu

SEQ ID NO: 15877 - RNA, 22 nt, Human
cuugggggccauuaaggggccu

SEQ ID NO: 15878 - RNA, 22 nt, Human
cuuggguguuuuaaaacuagau

SEQ ID NO: 15879 - RNA, 22 nt, Human
cuuggucuaaugguaauaagca

SEQ ID NO: 15880 - RNA, 22 nt, Human
cuuggucuagugagugagcaua

SEQ ID NO: 15881 - RNA, 22 nt, Human
cuuggugcauuacucaaucugu

SEQ ID NO: 15882 - RNA, 19 nt, Human
cuuggugcuugcccuuggc

SEQ ID NO: 15883 - RNA, 22 nt, Human
cuuguacaggaauccaugguau

SEQ ID NO: 15884 - RNA, 22 nt, Human
cuuguacauagagaagaagccu

SEQ ID NO: 15885 - RNA, 22 nt, Human
cuuguauacagagaaggcucau

SEQ ID NO: 15886 - RNA, 22 nt, Human
cuuguauacaguguacacauug

SEQ ID NO: 15887 - RNA, 22 nt, Human
cuuguauuaugguucgcuuagu

SEQ ID NO: 15888 - RNA, 22 nt, Human
cuuguauucagaguggacauga

SEQ ID NO: 15889 - RNA, 22 nt, Human
cuuguauucagcaucuuaacua

SEQ ID NO: 15890 - RNA, 22 nt, Human
cuuguauucuuccacuuaagau

SEQ ID NO: 15891 - RNA, 22 nt, Human
cuuguauugcuguuuugcaucu

SEQ ID NO: 15892 - RNA, 22 nt, Human
cuugucagcacuuugccgaaaa

SEQ ID NO: 15893 - RNA, 22 nt, Human
cuuguccccagcagguugguuu

SEQ ID NO: 15894 - RNA, 22 nt, Human
cuuguccuuuacuugagacuca

SEQ ID NO: 15895 - RNA, 22 nt, Human
cuugucuuuauuucauauucca

SEQ ID NO: 15896 - RNA, 22 nt, Human
cuugugaaaugccagauaaucu

SEQ ID NO: 15897 - RNA, 22 nt, Human
cuugugcaucauaguuugccaa

SEQ ID NO: 15898 - RNA, 22 nt, Human
cuugugcaucucuucaugacca

SEQ ID NO: 15899 - RNA, 22 nt, Human
cuugugcauuucauuccucagg

SEQ ID NO: 15900 - RNA, 22 nt, Human
cuuguggagugccugcugcagu

SEQ ID NO: 15901 - RNA, 21 nt, Human
cuuguuccaagcaugucugag

SEQ ID NO: 15902 - RNA, 22 nt, Human
cuuguucugugcuucuuacauu

SEQ ID NO: 15903 - RNA, 22 nt, Human
cuuguugcugaauucaggauuc

SEQ ID NO: 15904 - RNA, 22 nt, Human
cuuguuuaagccgcuguuaagc

SEQ ID NO: 15905 - RNA, 22 nt, Human
cuuguuuaauaauaccuuagca

SEQ ID NO: 15906 - RNA, 22 nt, Human
cuuguuuugaaagcaguggcca

SEQ ID NO: 15907 - RNA, 22 nt, Human
cugggccagaagacauuuagga

SEQ ID NO: 15908 - RNA, 22 nt, Human
cugggccagaccuuguggucuu

SEQ ID NO: 15909 - RNA, 19 nt, Human
cugggccagagcuguccuc

SEQ ID NO: 15910 - RNA, 22 nt, Human
cugggccaguuaugucucaucu

SEQ ID NO: 15911 - RNA, 22 nt, Human
cugggcccacaaguggaaucgu

SEQ ID NO: 15912 - RNA, 22 nt, Human
cugggcccugaagacagucagg

SEQ ID NO: 15913 - RNA, 17 nt, Human
cugggccucugcccuuu

SEQ ID NO: 15914 - RNA, 22 nt, Human
cugggccugccaccaucuuagg

SEQ ID NO: 15915 - RNA, 22 nt, Human
cugggccuuaugaguaccugga

SEQ ID NO: 15916 - RNA, 22 nt, Human
gacagagcagcacccagccccu

SEQ ID NO: 15917 - RNA, 22 nt, Human
gacagaggcaagaccagaagcc

SEQ ID NO: 15918 - RNA, 22 nt, Human
gacagaguuguugauguaugcu

SEQ ID NO: 15919 - RNA, 22 nt, Human
gacagcaacacaugcuuagugc

SEQ ID NO: 15920 - RNA, 22 nt, Human
gacagcagagcagacuaaugga

SEQ ID NO: 15921 - RNA, 22 nt, Human
gacagcagggaaaguccagacc

SEQ ID NO: 15922 - RNA, 22 nt, Human
gacagcagguaauuaguuaaca

SEQ ID NO: 15923 - RNA, 22 nt, Human
gacagcaggugcuugggaaagg

SEQ ID NO: 15924 - RNA, 22 nt, Human
gacagcaguccuggaguuccca

SEQ ID NO: 15925 - RNA, 22 nt, Human
gacagcauccaagagggaggga

SEQ ID NO: 15926 - RNA, 22 nt, Human
gacagcaucuguguggcaggag

SEQ ID NO: 15927 - RNA, 22 nt, Human
gacagccaggcauagggaguau

SEQ ID NO: 15928 - RNA, 22 nt, Human
gacagccagugcgauggauuca

SEQ ID NO: 15929 - RNA, 22 nt, Human
gacagccaugcacuucugcugu

SEQ ID NO: 15930 - RNA, 22 nt, Human
gacagccucaugaggagcaaaa

SEQ ID NO: 15931 - RNA, 22 nt, Human
gacagccucaugugcaugaacu

SEQ ID NO: 15932 - RNA, 22 nt, Human
gacagccuggcuuaaucugucu

SEQ ID NO: 15933 - RNA, 22 nt, Human
gacagcuggacagacacugaug

SEQ ID NO: 15934 - RNA, 17 nt, Human
gacagcugggcgcacgc

SEQ ID NO: 15935 - RNA, 17 nt, Human
gacagcugguuccuggc

SEQ ID NO: 15936 - RNA, 22 nt, Human
gacagcuguggagaggcaugug

SEQ ID NO: 15937 - RNA, 22 nt, Human
gacagcuucgaggaggugagcu

SEQ ID NO: 15938 - RNA, 22 nt, Human
gacagcuucuugggccgggccu

SEQ ID NO: 15939 - RNA, 22 nt, Human
gacaggaaaggggucuguuuuc

SEQ ID NO: 15940 - RNA, 21 nt, Human
gacaggacuagaccagagcuc

SEQ ID NO: 15941 - RNA, 22 nt, Human
gacaggauguauuggcaagagg

SEQ ID NO: 15942 - RNA, 22 nt, Human
gacaggcacgaaauugggcugg

SEQ ID NO: 15943 - RNA, 22 nt, Human
gacaggcaguuuuccagaucag

SEQ ID NO: 15944 - RNA, 22 nt, Human
gacaggcuuccuaagugccaga

SEQ ID NO: 15945 - RNA, 22 nt, Human
gacagggaaacauugaaguguc

SEQ ID NO: 15946 - RNA, 17 nt, Human
cuuggcaccucugccau

SEQ ID NO: 15947 - RNA, 22 nt, Human
cuuggcagcuuuuggaggagcc

SEQ ID NO: 15948 - RNA, 22 nt, Human
cuuggcauuguguugauagaag

SEQ ID NO: 15949 - RNA, 22 nt, Human
cuuggcccaguugccaaggaaa

SEQ ID NO: 15950 - RNA, 21 nt, Human
cuuggccucuagcuagagcug

SEQ ID NO: 15951 - RNA, 22 nt, Human
cuuggccucuucucaggguggg

SEQ ID NO: 15952 - RNA, 21 nt, Human
cuuggcugcagugacaggcau

SEQ ID NO: 15953 - RNA, 22 nt, Human
cuuggcuguugggcauugagaa

SEQ ID NO: 15954 - RNA, 22 nt, Human
cuugggaaugcuaacagaugac

SEQ ID NO: 15955 - RNA, 22 nt, Human
cuugggagacacaagaagacau

SEQ ID NO: 15956 - RNA, 22 nt, Human
cuugggcacaucccugguauuu

SEQ ID NO: 15957 - RNA, 22 nt, Human
cuugggccaccuggagggacug

SEQ ID NO: 15958 - RNA, 21 nt, Human
cuugggcuuguagauggugga

SEQ ID NO: 15959 - RNA, 22 nt, Human
cuuggggacacagagcccaggg

SEQ ID NO: 15960 - RNA, 22 nt, Human
cuuggggauuuuaaagaccucu

SEQ ID NO: 15961 - RNA, 22 nt, Human
cuugggugcuggaggcugccgc

SEQ ID NO: 15962 - RNA, 22 nt, Human
cuugguaaaacugucuuaaauu

SEQ ID NO: 15963 - RNA, 22 nt, Human
cuuggucuacuagagaaaaaga

SEQ ID NO: 15964 - RNA, 22 nt, Human
cuuggugagacucccacccacc

SEQ ID NO: 15965 - RNA, 22 nt, Human
cuuggugcccagcagguggcug

SEQ ID NO: 15966 - RNA, 20 nt, Human
cuugguggcucugggaagug

SEQ ID NO: 15967 - RNA, 22 nt, Human
cuuguaaaugcagauucugauu

SEQ ID NO: 15968 - RNA, 22 nt, Human
cuuguaauagauaggaucaaau

SEQ ID NO: 15969 - RNA, 20 nt, Human
cuuguacaugauaaagauuu

SEQ ID NO: 15970 - RNA, 22 nt, Human
cuuguacaugauaaucucacuc

SEQ ID NO: 15971 - RNA, 22 nt, Human
cuuguagaccccuggacucacg

SEQ ID NO: 15972 - RNA, 22 nt, Human
cuuguauucugccuaaccuuca

SEQ ID NO: 15973 - RNA, 22 nt, Human
cuugucagccaauuguggauuu

SEQ ID NO: 15974 - RNA, 22 nt, Human
cuugucaguguacuuucuuuug

SEQ ID NO: 15975 - RNA, 22 nt, Human
cuuguccagauguuuguuaggu

SEQ ID NO: 15976 - RNA, 16 nt, Human
cuugucuguugcucau

SEQ ID NO: 15977 - RNA, 22 nt, Human
cuugucuugcacacgguugcca

SEQ ID NO: 15978 - RNA, 21 nt, Human
cuugucuugcuuagaauagac

SEQ ID NO: 15979 - RNA, 22 nt, Human
cuugugcaagaaaccuggaaug

SEQ ID NO: 15980 - RNA, 17 nt, Human
cuuguggccaguuuuua

SEQ ID NO: 15981 - RNA, 22 nt, Human
cuuguguuguacauucuauggg

SEQ ID NO: 15982 - RNA, 22 nt, Human
cuuguuaaaaugcagauuccaa

SEQ ID NO: 15983 - RNA, 22 nt, Human
cuuguucaguccugacuuccug

SEQ ID NO: 15984 - RNA, 22 nt, Human
cuuguucaucucauugggacug

SEQ ID NO: 15985 - RNA, 17 nt, Human
cuuguugagcucguucc

SEQ ID NO: 15986 - RNA, 22 nt, Human
cuuguugggucgugaauucugu

SEQ ID NO: 15987 - RNA, 22 nt, Human
cuuguuuuggcuaguaugaugu

SEQ ID NO: 15988 - RNA, 22 nt, Human
cuuuaacaaaugacucuugucu

SEQ ID NO: 15989 - RNA, 22 nt, Human
cuuuaagacucugcucuuggug

SEQ ID NO: 15990 - RNA, 22 nt, Human
cuuuaauucagauuugaaggga

SEQ ID NO: 15991 - RNA, 22 nt, Human
cuuuacaccaagcagaucuuuc

SEQ ID NO: 15992 - RNA, 22 nt, Human
cuuuacagcuuagugguaugga

SEQ ID NO: 15993 - RNA, 22 nt, Human
cuuuacaggaaaagguggcugu

SEQ ID NO: 15994 - RNA, 22 nt, Human
cuuuaccacaaggacagaacuu

SEQ ID NO: 15995 - RNA, 22 nt, Human
cuuuacuaucaggaauaaacaa

SEQ ID NO: 15996 - RNA, 22 nt, Human
cuuuacugaagugaagaccugg

SEQ ID NO: 15997 - RNA, 22 nt, Human
cuuuacuguuuggugcucuauu

SEQ ID NO: 15998 - RNA, 22 nt, Human
cuuuagaaggguaacggaauua

SEQ ID NO: 15999 - RNA, 19 nt, Human
cuuuagacacaccuggaca

SEQ ID NO: 16000 - RNA, 22 nt, Human
cuuuagacaucucauuguguaa

SEQ ID NO: 16001 - RNA, 18 nt, Human
cuuuagcugucaucuuug

SEQ ID NO: 16002 - RNA, 22 nt, Human
cuuuaguguucaacccagauaa

SEQ ID NO: 16003 - RNA, 22 nt, Human
cuuuaguguuguugugaggauu

SEQ ID NO: 16004 - RNA, 20 nt, Human
cuuuaguuacacguuuccuc

SEQ ID NO: 16005 - RNA, 22 nt, Human
cuuuauauauucccaggcugcc

SEQ ID NO: 16006 - RNA, 22 nt, Human
cuuuaucagaaaacacauuagg

SEQ ID NO: 16007 - RNA, 22 nt, Human
cuuuaucuaggguaagaaaacc

SEQ ID NO: 16008 - RNA, 22 nt, Human
cuuuaugaaccuguucagcuug

SEQ ID NO: 16009 - RNA, 22 nt, Human
cuuuauguguacuuuccauuuu

SEQ ID NO: 16010 - RNA, 22 nt, Human
cuuuauuguccuucuuaggugg

SEQ ID NO: 16011 - RNA, 22 nt, Human
cuuucaaagaguaggagguuuu

SEQ ID NO: 16012 - RNA, 22 nt, Human
cuuucaacuacauacaggcgau

SEQ ID NO: 16013 - RNA, 22 nt, Human
cuuucaaucaaaguuucuagug

SEQ ID NO: 16014 - RNA, 22 nt, Human
cuuucaaugugccugccuuggg

SEQ ID NO: 16015 - RNA, 22 nt, Human
cuuucacaagauuugagaugcu

SEQ ID NO: 16016 - RNA, 22 nt, Human
cuuucacacacauacauuugga

SEQ ID NO: 16017 - RNA, 22 nt, Human
cuuucacagccuucguucugaa

SEQ ID NO: 16018 - RNA, 22 nt, Human
cuuucacagucauaugaugaau

SEQ ID NO: 16019 - RNA, 22 nt, Human
cuuucacaguccugacugagcg

SEQ ID NO: 16020 - RNA, 18 nt, Human
cuuucagauggauaugcu

SEQ ID NO: 16021 - RNA, 22 nt, Human
cuuucagcaucccugggauuac

SEQ ID NO: 16022 - RNA, 22 nt, Human
cuuucaugcaguugacaaggug

SEQ ID NO: 16023 - RNA, 23 nt, Human
cuuucauugugguuucacagagc

SEQ ID NO: 16024 - RNA, 22 nt, Human
cuuuccaacugggugggcagcu

SEQ ID NO: 16025 - RNA, 22 nt, Human
cuuuccaccaacucacuucccu

SEQ ID NO: 16026 - RNA, 19 nt, Human
gaaagauuucaguugagga

SEQ ID NO: 16027 - RNA, 22 nt, Human
gaaagcaauuuguguaaucugu

SEQ ID NO: 16028 - RNA, 22 nt, Human
gaaagcacaggcucaggaacag

SEQ ID NO: 16029 - RNA, 22 nt, Human
gaaagcacaguucaugagacaa

SEQ ID NO: 16030 - RNA, 22 nt, Human
gaaagcagaugaaauugcaaca

SEQ ID NO: 16031 - RNA, 22 nt, Human
gaaagccagagagaaagggcuc

SEQ ID NO: 16032 - RNA, 22 nt, Human
gaaagcugggaaauaaauauua

SEQ ID NO: 16033 - RNA, 22 nt, Human
gaaaggaaauauucuaagcacu

SEQ ID NO: 16034 - RNA, 22 nt, Human
gaaaggagggaaacagagcggu

SEQ ID NO: 16035 - RNA, 22 nt, Human
gaaaggagucagucuuacugaa

SEQ ID NO: 16036 - RNA, 22 nt, Human
gaaaggcuaugaguuugguaua

SEQ ID NO: 16037 - RNA, 22 nt, Human
gaaaggcucagauucccccagg

SEQ ID NO: 16038 - RNA, 19 nt, Human
gaaaggcugcugcuaccug

SEQ ID NO: 16039 - RNA, 22 nt, Human
gaaaggcuugcuuuugcucggu

SEQ ID NO: 16040 - RNA, 22 nt, Human
gaaagggagugaagaugguaua

SEQ ID NO: 16041 - RNA, 17 nt, Human
gaaagguccuagaaauc

SEQ ID NO: 16042 - RNA, 22 nt, Human
gaaaguacagauuccuggccag

SEQ ID NO: 16043 - RNA, 22 nt, Human
gaaaguaugccaucuaccucuu

SEQ ID NO: 16044 - RNA, 22 nt, Human
gaaaguauuagccuagaaguca

SEQ ID NO: 16045 - RNA, 22 nt, Human
gaaaguauucacaaaguucuug

SEQ ID NO: 16046 - RNA, 22 nt, Human
gaaaguauuuacauuaacaucu

SEQ ID NO: 16047 - RNA, 22 nt, Human
gaaaguuauaucaugauuuuag

SEQ ID NO: 16048 - RNA, 22 nt, Human
gaaaguucguccuguggcuucu

SEQ ID NO: 16049 - RNA, 22 nt, Human
gaaaguucugcucugauuggcu

SEQ ID NO: 16050 - RNA, 22 nt, Human
gaaaguuuucauauauaccaaa

SEQ ID NO: 16051 - RNA, 22 nt, Human
gaaauaauacagugcucuucuc

SEQ ID NO: 16052 - RNA, 22 nt, Human
gaaaucacuuuuuucauaguug

SEQ ID NO: 16053 - RNA, 20 nt, Human
gaaaucaguuaaugaugguu

SEQ ID NO: 16054 - RNA, 22 nt, Human
gaaaucauuauaugguauugcu

SEQ ID NO: 16055 - RNA, 22 nt, Human
gaaauccaguucccuacucuua

SEQ ID NO: 16056 - RNA, 23 nt, Human
gaaaucuagucauuuuuagucug

SEQ ID NO: 16057 - RNA, 22 nt, Human
gaaaucuccaaucuuuucuuua

SEQ ID NO: 16058 - RNA, 22 nt, Human
gaaaucugaacaacagcuguca

SEQ ID NO: 16059 - RNA, 22 nt, Human
gaaaucugcccagugcacuggu

SEQ ID NO: 16060 - RNA, 22 nt, Human
gaaaucugucuuuguuugaaua

SEQ ID NO: 16061 - RNA, 22 nt, Human
gaaaucuuccaauggucacauc

SEQ ID NO: 16062 - RNA, 22 nt, Human
gaaaucuuccuucagugaagaa

SEQ ID NO: 16063 - RNA, 22 nt, Human
gaaaucuuugccuuagcugugu

SEQ ID NO: 16064 - RNA, 22 nt, Human
gacagggcauggugcagaguuc

SEQ ID NO: 16065 - RNA, 22 nt, Human
gacagggccgcagauggagacu

SEQ ID NO: 16066 - RNA, 22 nt, Human
gacagggcgagacucagucuca

SEQ ID NO: 16067 - RNA, 22 nt, Human
gacagggcugugggaggagcag

SEQ ID NO: 16068 - RNA, 21 nt, Human
gacaggggaagaagcaaggag

SEQ ID NO: 16069 - RNA, 21 nt, Human
gacaggggccauggguuucua

SEQ ID NO: 16070 - RNA, 22 nt, Human
gacaggggcuuugcaugcuuua

SEQ ID NO: 16071 - RNA, 22 nt, Human
gacaggguacgggcuaggcaca

SEQ ID NO: 16072 - RNA, 22 nt, Human
gacagguaaagaugguggcagg

SEQ ID NO: 16073 - RNA, 22 nt, Human
gacaggugcuaagggaccuggc

SEQ ID NO: 16074 - RNA, 22 nt, Human
gacagguggggaaacuaaggua

SEQ ID NO: 16075 - RNA, 22 nt, Human
gacaggugugaugauuuaggcu

SEQ ID NO: 16076 - RNA, 18 nt, Human
gacaguaaacuuccccau

SEQ ID NO: 16077 - RNA, 22 nt, Human
gacaguaacuacaguucugugg

SEQ ID NO: 16078 - RNA, 22 nt, Human
gacagugacagcuuggaaagca

SEQ ID NO: 16079 - RNA, 22 nt, Human
gacagugauuaguuacuauaaa

SEQ ID NO: 16080 - RNA, 22 nt, Human
gacagugcuaugguaggacauu

SEQ ID NO: 16081 - RNA, 22 nt, Human
gacaguggagggcugauguuaa

SEQ ID NO: 16082 - RNA, 22 nt, Human
gacaguggauucaucuagucaa

SEQ ID NO: 16083 - RNA, 22 nt, Human
gacagugguuccaaggcagcuu

SEQ ID NO: 16084 - RNA, 22 nt, Human
gacagugucccucuggggugga

SEQ ID NO: 16085 - RNA, 22 nt, Human
gacaguuuaagcaccuaauauu

SEQ ID NO: 16086 - RNA, 22 nt, Human
gacauaaaguucuugcuugaau

SEQ ID NO: 16087 - RNA, 22 nt, Human
gacauacaagcugguaccuccu

SEQ ID NO: 16088 - RNA, 22 nt, Human
gacaucaggaagacaugagagg

SEQ ID NO: 16089 - RNA, 22 nt, Human
gacaucaggccugcagucuggg

SEQ ID NO: 16090 - RNA, 22 nt, Human
gacaucauagggugggaggaaa

SEQ ID NO: 16091 - RNA, 22 nt, Human
gacaucauggagaggacaaaca

SEQ ID NO: 16092 - RNA, 22 nt, Human
gacaucuccaaggcaaccuguu

SEQ ID NO: 16093 - RNA, 22 nt, Human
gacaucugaauauuagagagaa

SEQ ID NO: 16094 - RNA, 22 nt, Human
gacaucugaggcccucagagcc

SEQ ID NO: 16095 - RNA, 22 nt, Human
gacaugcaugaaugcaggucuc

SEQ ID NO: 16096 - RNA, 22 nt, Human
gacaugcauuaagacacacuga

SEQ ID NO: 16097 - RNA, 22 nt, Human
gacauguacuucaauuucucuu

SEQ ID NO: 16098 - RNA, 22 nt, Human
gacauguauuagucaugcacag

SEQ ID NO: 16099 - RNA, 22 nt, Human
gacaugucggauagaaugaguu

SEQ ID NO: 16100 - RNA, 20 nt, Human
gacaugucuuucucacacaa

SEQ ID NO: 16101 - RNA, 22 nt, Human
gacaugugagcaagcgugcggc

SEQ ID NO: 16102 - RNA, 22 nt, Human
gacauguuaucucuggcuucaa

SEQ ID NO: 16103 - RNA, 22 nt, Human
gacauuaauggcaaauuaauua

SEQ ID NO: 16104 - RNA, 22 nt, Human
gacauucagccaauuacuuucu

SEQ ID NO: 16105 - RNA, 22 nt, Human
gacauucauuaagccuuucugu

SEQ ID NO: 16106 - RNA, 22 nt, Human
gacauucuaaaaaauauggaag

SEQ ID NO: 16107 - RNA, 22 nt, Human
gacauugaauuugaauguaugu

SEQ ID NO: 16108 - RNA, 21 nt, Human
gacauugagcgugucgcagug

SEQ ID NO: 16109 - RNA, 22 nt, Human
gacauugaguauuucuuuucuc

SEQ ID NO: 16110 - RNA, 22 nt, Human
gacauuggguguacaauuggca

SEQ ID NO: 16111 - RNA, 22 nt, Human
gacauuucuagcccauaaaacu

SEQ ID NO: 16112 - RNA, 22 nt, Human
gacauuuguaucuuaggggaaa

SEQ ID NO: 16113 - RNA, 22 nt, Human
gaccaacagaauuuccuguuuu

SEQ ID NO: 16114 - RNA, 22 nt, Human
gaccacagguaugggcuuggca

SEQ ID NO: 16115 - RNA, 22 nt, Human
gaccacaguccagucaucaugg

SEQ ID NO: 16116 - RNA, 22 nt, Human
gaccagagaaaggcacuggaag

SEQ ID NO: 16117 - RNA, 22 nt, Human
gaccaggaaagagugugacuaa

SEQ ID NO: 16118 - RNA, 22 nt, Human
gaccagggucacucacagggcu

SEQ ID NO: 16119 - RNA, 22 nt, Human
gaccagguccaaagcuacuguc

SEQ ID NO: 16120 - RNA, 22 nt, Human
gacccagaaggagugcccuaga

SEQ ID NO: 16121 - RNA, 22 nt, Human
gacccagcuuaagucacauguu

SEQ ID NO: 16122 - RNA, 22 nt, Human
gacccaggagagaggguugcau

SEQ ID NO: 16123 - RNA, 22 nt, Human
gacccaggguauccagagcugc

SEQ ID NO: 16124 - RNA, 22 nt, Human
gacccagugacucgucucugug

SEQ ID NO: 16125 - RNA, 22 nt, Human
gacccauaggaaucuguugucc

SEQ ID NO: 16126 - RNA, 22 nt, Human
gacccauauauacguaauuugu

SEQ ID NO: 16127 - RNA, 22 nt, Human
gaccccaagggaugcgugugcu

SEQ ID NO: 16128 - RNA, 21 nt, Human
gaccccagaccagcagacaca

SEQ ID NO: 16129 - RNA, 22 nt, Human
gacccucauugucaccgugagc

SEQ ID NO: 16130 - RNA, 22 nt, Human
gacccugaggauucccugcuga

SEQ ID NO: 16131 - RNA, 22 nt, Human
gacccuggggaccaucuagccc

SEQ ID NO: 16132 - RNA, 22 nt, Human
gacccuguggcucuguggcaga

SEQ ID NO: 16133 - RNA, 22 nt, Human
gacccuguuucuacaaauaauu

SEQ ID NO: 16134 - RNA, 22 nt, Human
gacccuuggcugcagcaucaca

SEQ ID NO: 16135 - RNA, 22 nt, Human
gagguggcuggcucagagccag

SEQ ID NO: 16136 - RNA, 22 nt, Human
gagguggugguggaggcauagc

SEQ ID NO: 16137 - RNA, 22 nt, Human
gaggugguucagguagagccca

SEQ ID NO: 16138 - RNA, 22 nt, Human
gaggugucaugagggccugcuc

SEQ ID NO: 16139 - RNA, 22 nt, Human
gaggugucccgcaguccccaag

SEQ ID NO: 16140 - RNA, 22 nt, Human
gaggugucccugacccuuugca

SEQ ID NO: 16141 - RNA, 22 nt, Human
gaggugucugcuguguucaaag

SEQ ID NO: 16142 - RNA, 22 nt, Human
gagguucacaggcuaucacagu

SEQ ID NO: 16143 - RNA, 22 nt, Human
gagguuggagggcuggccugca

SEQ ID NO: 16144 - RNA, 19 nt, Human
gagguuucugaagugggcu

SEQ ID NO: 16145 - RNA, 22 nt, Human
gagguuuuaggcugccauuauu

SEQ ID NO: 16146 - RNA, 22 nt, Human
gaguaaaagaugaggcaguaga

SEQ ID NO: 16147 - RNA, 22 nt, Human
gaguaaaaguuggauuacaaag

SEQ ID NO: 16148 - RNA, 22 nt, Human
gaguaacauguauuggaaggcc

SEQ ID NO: 16149 - RNA, 22 nt, Human
gaguagaacugguuaucuaaua

SEQ ID NO: 16150 - RNA, 22 nt, Human
gaguagaaggaaguuaucuacc

SEQ ID NO: 16151 - RNA, 22 nt, Human
gaguaggaauguucugccaucu

SEQ ID NO: 16152 - RNA, 17 nt, Human
gaguaguuacaacagac

SEQ ID NO: 16153 - RNA, 22 nt, Human
gagucacaaaagaugcccaggg

SEQ ID NO: 16154 - RNA, 22 nt, Human
gagucacauuaauuuaauuuua

SEQ ID NO: 16155 - RNA, 22 nt, Human
gagucaccacugugauagucga

SEQ ID NO: 16156 - RNA, 22 nt, Human
gagucacuucccgaauaaaccc

SEQ ID NO: 16157 - RNA, 22 nt, Human
gagucagaagaaacuauuuaca

SEQ ID NO: 16158 - RNA, 22 nt, Human
gagucagaauuguauuuuaaac

SEQ ID NO: 16159 - RNA, 22 nt, Human
gagucagaugaagauaaaaggg

SEQ ID NO: 16160 - RNA, 22 nt, Human
gagucagauugcagacagggcu

SEQ ID NO: 16161 - RNA, 22 nt, Human
gagucaggaugcaaggggaugg

SEQ ID NO: 16162 - RNA, 22 nt, Human
gagucaggcacugcugcugcuc

SEQ ID NO: 16163 - RNA, 22 nt, Human
gagucaggcaugaagguaauua

SEQ ID NO: 16164 - RNA, 22 nt, Human
gagucaggcuagaggugagucu

SEQ ID NO: 16165 - RNA, 22 nt, Human
gagucaggcuagggugacaggc

SEQ ID NO: 16166 - RNA, 22 nt, Human
gagucaguaauggauaugucau

SEQ ID NO: 16167 - RNA, 22 nt, Human
gagucauuugggggcuucuuga

SEQ ID NO: 16168 - RNA, 22 nt, Human
gaguccaagcuagagccacuca

SEQ ID NO: 16169 - RNA, 22 nt, Human
gaguccagacaccauaccugau

SEQ ID NO: 16170 - RNA, 22 nt, Human
gaguccagcagaaugagccaag

SEQ ID NO: 16171 - RNA, 22 nt, Human
gaguccaggcucagaaacccgu

SEQ ID NO: 16172 - RNA, 18 nt, Human
gaguccaggcucuucacc

SEQ ID NO: 16173 - RNA, 22 nt, Human
gaguccaguuagugaggcuggg

SEQ ID NO: 16174 - RNA, 22 nt, Human
gagucccaugaugauagccaca

SEQ ID NO: 16175 - RNA, 22 nt, Human
gaguccucagauagaaagugcg

SEQ ID NO: 16176 - RNA, 22 nt, Human
gaguccugaauccuguggcaac

SEQ ID NO: 16177 - RNA, 22 nt, Human
gaguccugauccuuagcucucc

SEQ ID NO: 16178 - RNA, 22 nt, Human
gaguccuggcguccaauuuccu

SEQ ID NO: 16179 - RNA, 22 nt, Human
gaguccuguaacuuucuuccua

SEQ ID NO: 16180 - RNA, 22 nt, Human
gaguccuguugucccagauggg

SEQ ID NO: 16181 - RNA, 20 nt, Human
gaguccuuaugggcugaggu

SEQ ID NO: 16182 - RNA, 21 nt, Human
gaguccuuccaauguccucag

SEQ ID NO: 16183 - RNA, 22 nt, Human
gaguccuuuguuccuugccaca

SEQ ID NO: 16184 - RNA, 22 nt, Human
gaguccuuuucucuguccacug

SEQ ID NO: 16185 - RNA, 22 nt, Human
gagucuaucucacucccccagg

SEQ ID NO: 16186 - RNA, 22 nt, Human
gagucuccaauccaugccuguc

SEQ ID NO: 16187 - RNA, 22 nt, Human
gagucucugaccagggugccaa

SEQ ID NO: 16188 - RNA, 22 nt, Human
gagucugagucuaauggcccca

SEQ ID NO: 16189 - RNA, 22 nt, Human
gagucugaugucccccaggcca

SEQ ID NO: 16190 - RNA, 22 nt, Human
gagucuggaaacuuugacaaaa

SEQ ID NO: 16191 - RNA, 22 nt, Human
gagucuggcccugaugcaucau

SEQ ID NO: 16192 - RNA, 22 nt, Human
gagucuggugauggucauuguc

SEQ ID NO: 16193 - RNA, 22 nt, Human
gagucuguaugucuuccaugca

SEQ ID NO: 16194 - RNA, 22 nt, Human
gagucuuaggcaaaaauaaugg

SEQ ID NO: 16195 - RNA, 18 nt, Human
gagucuuuguuacugcug

SEQ ID NO: 16196 - RNA, 22 nt, Human
gagugagggccaacauccagcu

SEQ ID NO: 16197 - RNA, 22 nt, Human
gagugagugcugggcugaggcu

SEQ ID NO: 16198 - RNA, 22 nt, Human
gagugcaauggcaugaucuggg

SEQ ID NO: 16199 - RNA, 21 nt, Human
gagugcaggucugaugccauc

SEQ ID NO: 16200 - RNA, 22 nt, Human
gagugcaucguggccauuuuaa

SEQ ID NO: 16201 - RNA, 21 nt, Human
gagugcucaguuaaguggaga

SEQ ID NO: 16202 - RNA, 22 nt, Human
gagugcugaaugcgagaacaga

SEQ ID NO: 16203 - RNA, 22 nt, Human
gagugcuggaggugugaguggg

SEQ ID NO: 16204 - RNA, 17 nt, Human
gagugcugguggagcuc

SEQ ID NO: 16205 - RNA, 21 nt, Human
gaguggaacgcucuucacacc

SEQ ID NO: 16206 - RNA, 22 nt, Human
gaguggcuccaauuugguccua

SEQ ID NO: 16207 - RNA, 22 nt, Human
gaguggcuguguacaugcccag

SEQ ID NO: 16208 - RNA, 15 nt, Human
gaguggcuuucagaa

SEQ ID NO: 16209 - RNA, 22 nt, Human
gaguggcuuuggagaaguaggg

SEQ ID NO: 16210 - RNA, 22 nt, Human
gaguggcuuuuuuaugguaaug

SEQ ID NO: 16211 - RNA, 22 nt, Human
gaguggggaaagccaggacaga

SEQ ID NO: 16212 - RNA, 22 nt, Human
gaguggggcuuuaaaggcucag

SEQ ID NO: 16213 - RNA, 22 nt, Human
gaguggguaaaggugcuuggcu

SEQ ID NO: 16214 - RNA, 22 nt, Human
gaguggguaccggagcaggugc

SEQ ID NO: 16215 - RNA, 22 nt, Human
gaguguaaaaacuuagugagau

SEQ ID NO: 16216 - RNA, 22 nt, Human
gaguguauggaaggaagagauu

SEQ ID NO: 16217 - RNA, 22 nt, Human
gagugucuaaucacguuucaca

SEQ ID NO: 16218 - RNA, 21 nt, Human
gagugucuaauccaggcuguc

SEQ ID NO: 16219 - RNA, 22 nt, Human
gagugucuauguuuagucuuuc

SEQ ID NO: 16220 - RNA, 22 nt, Human
gagugucugaauuagagcacaa

SEQ ID NO: 16221 - RNA, 22 nt, Human
gagacugcugguaaagauggga

SEQ ID NO: 16222 - RNA, 22 nt, Human
gagacuguaagcuccuugagga

SEQ ID NO: 16223 - RNA, 22 nt, Human
gagacugucacuugggaccugu

SEQ ID NO: 16224 - RNA, 22 nt, Human
gagagaaaggauaacagcucaa

SEQ ID NO: 16225 - RNA, 22 nt, Human
gagagaacacaaagggccagcu

SEQ ID NO: 16226 - RNA, 22 nt, Human
gagagaagggacuucuacacuu

SEQ ID NO: 16227 - RNA, 22 nt, Human
gagagacagcacacaguguggg

SEQ ID NO: 16228 - RNA, 22 nt, Human
gagagacuggaaugggcugugg

SEQ ID NO: 16229 - RNA, 22 nt, Human
gagagagaagugggugucaccu

SEQ ID NO: 16230 - RNA, 22 nt, Human
gagagagagcuaauauuaagcu

SEQ ID NO: 16231 - RNA, 23 nt, Human
gagagagauugcuaaaccacucc

SEQ ID NO: 16232 - RNA, 18 nt, Human
gagagcccagcagguggu

SEQ ID NO: 16233 - RNA, 22 nt, Human
gagagcccucacuccuucccug

SEQ ID NO: 16234 - RNA, 22 nt, Human
gagagcccugcuccuaucccag

SEQ ID NO: 16235 - RNA, 22 nt, Human
gagagcuaacuaccuggaaaug

SEQ ID NO: 16236 - RNA, 23 nt, Human
gagagcugacugucaagacuguu

SEQ ID NO: 16237 - RNA, 22 nt, Human
gagagcugcauucucagacaca

SEQ ID NO: 16238 - RNA, 22 nt, Human
gagagcuguaauagucaugucu

SEQ ID NO: 16239 - RNA, 22 nt, Human
gagagcuguccggcugagcagc

SEQ ID NO: 16240 - RNA, 22 nt, Human
gagagcugugguuugaccaggc

SEQ ID NO: 16241 - RNA, 22 nt, Human
gagaggaagccuucuguacuug

SEQ ID NO: 16242 - RNA, 22 nt, Human
gagaggagguggcuaugacagc

SEQ ID NO: 16243 - RNA, 22 nt, Human
gagaggauccacaaaccaggaa

SEQ ID NO: 16244 - RNA, 22 nt, Human
gagccaagcaccacauuaaguu

SEQ ID NO: 16245 - RNA, 22 nt, Human
gagccaagggcgugcuggagag

SEQ ID NO: 16246 - RNA, 22 nt, Human
gagccacagugguggcccacgu

SEQ ID NO: 16247 - RNA, 22 nt, Human
gagccaccuucaacucaggaau

SEQ ID NO: 16248 - RNA, 22 nt, Human
gagccagacugccugaagcuca

SEQ ID NO: 16249 - RNA, 22 nt, Human
gagccagagauccaggauggcu

SEQ ID NO: 16250 - RNA, 22 nt, Human
gagccagccgcaagagcuguga

SEQ ID NO: 16251 - RNA, 22 nt, Human
gagccagcgccuugccucuggg

SEQ ID NO: 16252 - RNA, 22 nt, Human
gagccaggaagaaggccuuacu

SEQ ID NO: 16253 - RNA, 22 nt, Human
gagccaggagauaccuaagggg

SEQ ID NO: 16254 - RNA, 22 nt, Human
gagccagguuggaggcugcagu

SEQ ID NO: 16255 - RNA, 22 nt, Human
gagccagugaucagacagggag

SEQ ID NO: 16256 - RNA, 22 nt, Human
gagcccagauuggaauuuccca

SEQ ID NO: 16257 - RNA, 22 nt, Human
gagcccagcucuaccucagacu

SEQ ID NO: 16258 - RNA, 22 nt, Human
gagcccagcugcggcccucagc

SEQ ID NO: 16259 - RNA, 22 nt, Human
gagcccaggcugggguucagag

SEQ ID NO: 16260 - RNA, 22 nt, Human
gagcccagguucugcuuccagc

SEQ ID NO: 16261 - RNA, 22 nt, Human
gagccccagcccugcuucuaua

SEQ ID NO: 16262 - RNA, 17 nt, Human
gagccccuuuccaaguu

SEQ ID NO: 16263 - RNA, 22 nt, Human
gagcccgagcgcguacccggcg

SEQ ID NO: 16264 - RNA, 22 nt, Human
gagcccucaaugaaucugcauu

SEQ ID NO: 16265 - RNA, 18 nt, Human
gagcccugggagaucucu

SEQ ID NO: 16266 - RNA, 22 nt, Human
gagcccuguagcaagucauguc

SEQ ID NO: 16267 - RNA, 22 nt, Human
gagcccugugaggaaagagggu

SEQ ID NO: 16268 - RNA, 22 nt, Human
gagccgugccagcccugucucg

SEQ ID NO: 16269 - RNA, 22 nt, Human
gagccucguggcggccacugcg

SEQ ID NO: 16270 - RNA, 22 nt, Human
gagccugcccagcccuguccac

SEQ ID NO: 16271 - RNA, 22 nt, Human
gagccugccccuccaccaggau

SEQ ID NO: 16272 - RNA, 22 nt, Human
gagccugccucuagucucuaga

SEQ ID NO: 16273 - RNA, 22 nt, Human
gagccuggagcuggaacgaagc

SEQ ID NO: 16274 - RNA, 22 nt, Human
gagccuggauugaagugggugg

SEQ ID NO: 16275 - RNA, 22 nt, Human
gagccuggccuccugccucagc

SEQ ID NO: 16276 - RNA, 22 nt, Human
gagcgauugcgggggucagagg

SEQ ID NO: 16277 - RNA, 22 nt, Human
gagcgcgccacaaggagcggcg

SEQ ID NO: 16278 - RNA, 22 nt, Human
gagcuaaaugaaucauaaauca

SEQ ID NO: 16279 - RNA, 22 nt, Human
gagcuaagagucuagaaaggcu

SEQ ID NO: 16280 - RNA, 22 nt, Human
gagcuaaggcacaggcaggcuu

SEQ ID NO: 16281 - RNA, 22 nt, Human
gagcuacaagggagacuuuuuu

SEQ ID NO: 16282 - RNA, 20 nt, Human
gagcuacacaaaugcugcuu

SEQ ID NO: 16283 - RNA, 22 nt, Human
gagcuagaauuaggccaauuuc

SEQ ID NO: 16284 - RNA, 22 nt, Human
gagcuagcuucuuccagguuuc

SEQ ID NO: 16285 - RNA, 22 nt, Human
gagcuaguagaacaagugagga

SEQ ID NO: 16286 - RNA, 22 nt, Human
gagcucagaggauucuggggag

SEQ ID NO: 16287 - RNA, 22 nt, Human
gagcucagcaaaggucugugug

SEQ ID NO: 16288 - RNA, 22 nt, Human
gagcucauccccaugguccguc

SEQ ID NO: 16289 - RNA, 22 nt, Human
gagcuccaccaccuucaggcag

SEQ ID NO: 16290 - RNA, 22 nt, Human
gagcuccagaguuagacacccg

SEQ ID NO: 16291 - RNA, 21 nt, Human
gagcucucaggcaagaagcag

SEQ ID NO: 16292 - RNA, 18 nt, Human
gagcucugccucccaguc

SEQ ID NO: 16293 - RNA, 22 nt, Human
gagcucugggaaacaaagugua

SEQ ID NO: 16294 - RNA, 22 nt, Human
gagcucuucuaaagauggcaau

SEQ ID NO: 16295 - RNA, 22 nt, Human
gagcucuuugaaccugggcagu

SEQ ID NO: 16296 - RNA, 22 nt, Human
gagcugaagcgcuacagcaucc

SEQ ID NO: 16297 - RNA, 22 nt, Human
gagcugaaggagaaagcagggg

SEQ ID NO: 16298 - RNA, 22 nt, Human
gagcugagccuggguggaccgc

SEQ ID NO: 16299 - RNA, 22 nt, Human
gagcugaggccagagucuucug

SEQ ID NO: 16300 - RNA, 23 nt, Human
gagcugaguguagggagacuagg

SEQ ID NO: 16301 - RNA, 20 nt, Human
gagcugaguguggucauggg

SEQ ID NO: 16302 - RNA, 22 nt, Human
gagcugcauagcugggauccuc

SEQ ID NO: 16303 - RNA, 22 nt, Human
gagcugcaugcaacucgaaaau

SEQ ID NO: 16304 - RNA, 22 nt, Human
gagcugcaugcaacuguuuaaa

SEQ ID NO: 16305 - RNA, 22 nt, Human
gagcugccaagauuacaaucag

SEQ ID NO: 16306 - RNA, 18 nt, Human
gagcugccauauuuaguu

SEQ ID NO: 16307 - RNA, 22 nt, Human
gagcugccggcccacaguacua

SEQ ID NO: 16308 - RNA, 22 nt, Human
gagcugccugaacaagcagcag

SEQ ID NO: 16309 - RNA, 22 nt, Human
gagcugccuguugcauagcaac

SEQ ID NO: 16310 - RNA, 22 nt, Human
gagcugcuggauauguggccug

SEQ ID NO: 16311 - RNA, 22 nt, Human
gagcugcuucugugugccgggu

SEQ ID NO: 16312 - RNA, 22 nt, Human
gagcuggaagucuguggucaga

SEQ ID NO: 16313 - RNA, 22 nt, Human
gagcuggcugugguugagugca

SEQ ID NO: 16314 - RNA, 22 nt, Human
gagcugggaagauagcuugagc

SEQ ID NO: 16315 - RNA, 22 nt, Human
gagcugggacauggguccucuc

SEQ ID NO: 16316 - RNA, 18 nt, Human
gagcugggagaaggaagg

SEQ ID NO: 16317 - RNA, 22 nt, Human
gagcugggagcugggauuugga

SEQ ID NO: 16318 - RNA, 22 nt, Human
gagcuggguauauggcuuuaug

SEQ ID NO: 16319 - RNA, 22 nt, Human
gagcuggguguuuauuugccaa

SEQ ID NO: 16320 - RNA, 22 nt, Human
gagcugguccacaaucugcagg

SEQ ID NO: 16321 - RNA, 22 nt, Human
gagcugguucuguccagggaau

SEQ ID NO: 16322 - RNA, 22 nt, Human
gagcuguccgccccugggccga

SEQ ID NO: 16323 - RNA, 22 nt, Human
gagcugucucuauaugaaugcu

SEQ ID NO: 16324 - RNA, 22 nt, Human
gagcugucucuuugggccuuuu

SEQ ID NO: 16325 - RNA, 22 nt, Human
gagcugugaaaagugccugggg

SEQ ID NO: 16326 - RNA, 22 nt, Human
gagcugugacacgcagcccagg

SEQ ID NO: 16327 - RNA, 22 nt, Human
gagcugugagggacacauugcu

SEQ ID NO: 16328 - RNA, 22 nt, Human
gagcugugauuggugucucacu

SEQ ID NO: 16329 - RNA, 22 nt, Human
gagcuguuugugacaggcugug

SEQ ID NO: 16330 - RNA, 22 nt, Human
gagcuguuuuuuaaaguuagga

SEQ ID NO: 16331 - RNA, 22 nt, Human
gagcuucaaauggacgaccuuu

SEQ ID NO: 16332 - RNA, 22 nt, Human
gagcuuccauggacgccaucug

SEQ ID NO: 16333 - RNA, 22 nt, Human
gagcuucccucugcagucccug

SEQ ID NO: 16334 - RNA, 22 nt, Human
gagcuuccucagccuuucucac

SEQ ID NO: 16335 - RNA, 22 nt, Human
gagcuucucaacaguuaucucu

SEQ ID NO: 16336 - RNA, 22 nt, Human
gagcuucuuguuucuucaucug

SEQ ID NO: 16337 - RNA, 22 nt, Human
gagcuuggacaagcucugaagg

SEQ ID NO: 16338 - RNA, 22 nt, Human
gaugaggaaaccaaggcucagg

SEQ ID NO: 16339 - RNA, 22 nt, Human
gaugaggaaugcucagcucaau

SEQ ID NO: 16340 - RNA, 22 nt, Human
gaugaggcagcucagggggaaa

SEQ ID NO: 16341 - RNA, 22 nt, Human
gaugaggcauaaacacagucac

SEQ ID NO: 16342 - RNA, 22 nt, Human
gaugaggcucaugcacccugcg

SEQ ID NO: 16343 - RNA, 22 nt, Human
gaugagugauguugaagaaggu

SEQ ID NO: 16344 - RNA, 22 nt, Human
gaugaugacagugauuagacug

SEQ ID NO: 16345 - RNA, 22 nt, Human
gaugaugaggccaugaggcagg

SEQ ID NO: 16346 - RNA, 22 nt, Human
gaugauggguugaugugaaggg

SEQ ID NO: 16347 - RNA, 22 nt, Human
gaugcaaacugugacauagagu

SEQ ID NO: 16348 - RNA, 22 nt, Human
gaugcaaagaggaccuucagua

SEQ ID NO: 16349 - RNA, 22 nt, Human
gaugcacaaagcagagggaauc

SEQ ID NO: 16350 - RNA, 22 nt, Human
gaugcacggucaugucuuuuca

SEQ ID NO: 16351 - RNA, 22 nt, Human
gaugcagcagccagcuucugaa

SEQ ID NO: 16352 - RNA, 22 nt, Human
gaugcagggaacuuagugggcu

SEQ ID NO: 16353 - RNA, 22 nt, Human
agugacagcugggaaggugaaa

SEQ ID NO: 16354 - RNA, 22 nt, Human
agugacaggggaggcaggugug

SEQ ID NO: 16355 - RNA, 22 nt, Human
agugacagucucagagaucagg

SEQ ID NO: 16356 - RNA, 22 nt, Human
agugacaguuucaggcauuuuu

SEQ ID NO: 16357 - RNA, 22 nt, Human
agugacauuugcaccagcugcu

SEQ ID NO: 16358 - RNA, 22 nt, Human
agugaccaacaaugcugagaag

SEQ ID NO: 16359 - RNA, 22 nt, Human
agugaccauuuucagcuagagg

SEQ ID NO: 16360 - RNA, 22 nt, Human
agugacguuuauugggugugaa

SEQ ID NO: 16361 - RNA, 22 nt, Human
agugacuugacacuugugaggg

SEQ ID NO: 16362 - RNA, 17 nt, Human
agugacuuggaaagagc

SEQ ID NO: 16363 - RNA, 22 nt, Human
agugacuuggcaugaugagaag

SEQ ID NO: 16364 - RNA, 19 nt, Human
agugagcauccagagaggu

SEQ ID NO: 16365 - RNA, 22 nt, Human
agugagcauccagagagguggg

SEQ ID NO: 16366 - RNA, 19 nt, Human
agugagcauggcuugacug

SEQ ID NO: 16367 - RNA, 22 nt, Human
agugagcauucguuuggaaccc

SEQ ID NO: 16368 - RNA, 22 nt, Human
agugaggaaauccauuaucaag

SEQ ID NO: 16369 - RNA, 17 nt, Human
agugaggagauuggaag

SEQ ID NO: 16370 - RNA, 22 nt, Human
agugaggggauucaggcaaggu

SEQ ID NO: 16371 - RNA, 22 nt, Human
agugaggucaggaucucaggga

SEQ ID NO: 16372 - RNA, 22 nt, Human
agugagucaaaaaacuuagaua

SEQ ID NO: 16373 - RNA, 18 nt, Human
agugaguuguugaaagaa

SEQ ID NO: 16374 - RNA, 22 nt, Human
agugaguuuagggugcaggugu

SEQ ID NO: 16375 - RNA, 22 nt, Human
agugaucagcuagaucuacuug

SEQ ID NO: 16376 - RNA, 22 nt, Human
agugaucugacucccaguuaga

SEQ ID NO: 16377 - RNA, 22 nt, Human
agugaucuuuuaaaaagaagug

SEQ ID NO: 16378 - RNA, 22 nt, Human
agugauggcagugaauaaggcu

SEQ ID NO: 16379 - RNA, 22 nt, Human
agugauggcauauauagaugug

SEQ ID NO: 16380 - RNA, 22 nt, Human
agugaugguuuccagucacuga

SEQ ID NO: 16381 - RNA, 22 nt, Human
agugauguagguggauucuggc

SEQ ID NO: 16382 - RNA, 22 nt, Human
agugaugugaggugugagaggg

SEQ ID NO: 16383 - RNA, 22 nt, Human
agugauguugauuuuaccacuu

SEQ ID NO: 16384 - RNA, 22 nt, Human
agugauucccagacuuccuggg

SEQ ID NO: 16385 - RNA, 22 nt, Human
agugauuugacucuuuuauugu

SEQ ID NO: 16386 - RNA, 22 nt, Human
agugauuugggugucagaaagu

SEQ ID NO: 16387 - RNA, 22 nt, Human
agugcaaaaguaauuggaguuu

SEQ ID NO: 16388 - RNA, 22 nt, Human
agugcaaagccgagguuucuug

SEQ ID NO: 16389 - RNA, 22 nt, Human
agugcaaagcugcugcuguggu

SEQ ID NO: 16390 - RNA, 22 nt, Human
agugcaaauaucuacgcgguga

SEQ ID NO: 16391 - RNA, 22 nt, Human
agugcaaauuauuuaccugauu

SEQ ID NO: 16392 - RNA, 22 nt, Human
agugcaacuucacguagaguac

SEQ ID NO: 16393 - RNA, 22 nt, Human
agugcaauuuugcuuucccaau

SEQ ID NO: 16394 - RNA, 22 nt, Human
agugcacaacaugcagguuugu

SEQ ID NO: 16395 - RNA, 22 nt, Human
agugcagagagcaauacucuac

SEQ ID NO: 16396 - RNA, 22 nt, Human
agugcagaguacauuuguggca

SEQ ID NO: 16397 - RNA, 22 nt, Human
agugcagauuuuuagucagcuu

SEQ ID NO: 16398 - RNA, 22 nt, Human
agugcagcaacaaacugcccuc

SEQ ID NO: 16399 - RNA, 22 nt, Human
agugcagccgagaucaggugcu

SEQ ID NO: 16400 - RNA, 22 nt, Human
agugcagcuauuacaacagugu

SEQ ID NO: 16401 - RNA, 22 nt, Human
agugcagcucccucaccugcuu

SEQ ID NO: 16402 - RNA, 22 nt, Human
agugcagcuuuuucuuuacaug

SEQ ID NO: 16403 - RNA, 22 nt, Human
agugcaggagccuggccagagc

SEQ ID NO: 16404 - RNA, 22 nt, Human
agugcagggccugcccagcagg

SEQ ID NO: 16405 - RNA, 22 nt, Human
agugcagggggaaagggugucu

SEQ ID NO: 16406 - RNA, 22 nt, Human
agugcauaaaggaaaaacugaa

SEQ ID NO: 16407 - RNA, 22 nt, Human
agugcaugcgcuugggaggggu

SEQ ID NO: 16408 - RNA, 18 nt, Human
agugcaugcuaggggaag

SEQ ID NO: 16409 - RNA, 19 nt, Human
agugcaugggcgaggugca

SEQ ID NO: 16410 - RNA, 22 nt, Human
agugcauucucuaauuacaggu

SEQ ID NO: 16411 - RNA, 22 nt, Human
agugcauugcaucucugcuuca

SEQ ID NO: 16412 - RNA, 22 nt, Human
agugccaaacaguacauaacau

SEQ ID NO: 16413 - RNA, 22 nt, Human
agugccaagguauuaauuuaua

SEQ ID NO: 16414 - RNA, 18 nt, Human
agugccagcucugcuuuc

SEQ ID NO: 16415 - RNA, 20 nt, Human
agugccagggcaggugagag

SEQ ID NO: 16416 - RNA, 22 nt, Human
agugccccaugggugccugggg

SEQ ID NO: 16417 - RNA, 22 nt, Human
agugcccggggugccagacaca

SEQ ID NO: 16418 - RNA, 20 nt, Human
agugcccuccgacauuguuu

SEQ ID NO: 16419 - RNA, 22 nt, Human
agugcccuggcccagcuggacc

SEQ ID NO: 16420 - RNA, 22 nt, Human
agugcccuucaugaagcaagag

SEQ ID NO: 16421 - RNA, 22 nt, Human
agugccuagauauuguuugaac

SEQ ID NO: 16422 - RNA, 22 nt, Human
agugccuggcacauggaaggug

SEQ ID NO: 16423 - RNA, 22 nt, Human
agugccuuggcugugaugggga

SEQ ID NO: 16424 - RNA, 22 nt, Human
agugccuugugugugggcagcc

SEQ ID NO: 16425 - RNA, 22 nt, Human
agugcucaugcacauuuauagu

SEQ ID NO: 16426 - RNA, 22 nt, Human
agugcuccacauugcacuauuc

SEQ ID NO: 16427 - RNA, 22 nt, Human
agugcuccugaagcuugaggca

SEQ ID NO: 16428 - RNA, 22 nt, Human
agugcuccugccagcuuucugg

SEQ ID NO: 16429 - RNA, 22 nt, Human
agugcuccuuucauugcugccc

SEQ ID NO: 16430 - RNA, 22 nt, Human
agugcucuaacagucaaaaaag

SEQ ID NO: 16431 - RNA, 22 nt, Human
agugcucucuccccagugcuac

SEQ ID NO: 16432 - RNA, 22 nt, Human
agugcucuggguccacuccaga

SEQ ID NO: 16433 - RNA, 22 nt, Human
agugcucugucauuggugggau

SEQ ID NO: 16434 - RNA, 23 nt, Human
agugcuggagaagcuucuggcuu

SEQ ID NO: 16435 - RNA, 22 nt, Human
agugcugggauuacaggcauaa

SEQ ID NO: 16436 - RNA, 22 nt, Human
agugcugggauugcaggcauga

SEQ ID NO: 16437 - RNA, 22 nt, Human
agugcuguuagguuaauauagu

SEQ ID NO: 16438 - RNA, 22 nt, Human
agugcuguuggauaaugcuguc

SEQ ID NO: 16439 - RNA, 22 nt, Human
agugcuucuggugggcgugagg

SEQ ID NO: 16440 - RNA, 22 nt, Human
agugcuuggcaaccuucugacc

SEQ ID NO: 16441 - RNA, 22 nt, Human
agugcuuuagaccuuuuggggu

SEQ ID NO: 16442 - RNA, 22 nt, Human
agugcuuuagagaaauggugcu

SEQ ID NO: 16443 - RNA, 22 nt, Human
agugcuuugguauagaacuauu

SEQ ID NO: 16444 - RNA, 22 nt, Human
agcuauagcuggaucuuaagug

SEQ ID NO: 16445 - RNA, 22 nt, Human
agcuauaguacuuggcuuuucu

SEQ ID NO: 16446 - RNA, 22 nt, Human
agcuauauagaugguguguuug

SEQ ID NO: 16447 - RNA, 22 nt, Human
agcuaucaccuuaauaaacuga

SEQ ID NO: 16448 - RNA, 22 nt, Human
agcuauggaacagaguggcugu

SEQ ID NO: 16449 - RNA, 22 nt, Human
agcuauguauuuguguguuaaa

SEQ ID NO: 16450 - RNA, 22 nt, Human
agcuaugugauuuaaacaaggu

SEQ ID NO: 16451 - RNA, 22 nt, Human
agcuauguuauagcauguauca

SEQ ID NO: 16452 - RNA, 22 nt, Human
agcuauuucaaaguuugagaca

SEQ ID NO: 16453 - RNA, 22 nt, Human
agcucaagugcaagcauucuau

SEQ ID NO: 16454 - RNA, 22 nt, Human
agcucacagaaauccugcagga

SEQ ID NO: 16455 - RNA, 22 nt, Human
agcucacaguguccuuccucaa

SEQ ID NO: 16456 - RNA, 22 nt, Human
agcucagaacugcagacaugug

SEQ ID NO: 16457 - RNA, 22 nt, Human
agcucagcuuccucuccaugcu

SEQ ID NO: 16458 - RNA, 22 nt, Human
agcucaggccggagcuacaggc

SEQ ID NO: 16459 - RNA, 22 nt, Human
agcucagggcaaagacucaaau

SEQ ID NO: 16460 - RNA, 22 nt, Human
agcucagggccaggcgcguuuc

SEQ ID NO: 16461 - RNA, 22 nt, Human
agcucagggccaucggcccuuu

SEQ ID NO: 16462 - RNA, 22 nt, Human
agcugcucuugggugacuucaa

SEQ ID NO: 16463 - RNA, 22 nt, Human
agcugcugaagugagagaauug

SEQ ID NO: 16464 - RNA, 19 nt, Human
agcugcugauugguggagg

SEQ ID NO: 16465 - RNA, 22 nt, Human
agcugcugcaaguggugcuaac

SEQ ID NO: 16466 - RNA, 22 nt, Human
agcugcugcgccucacccuggc

SEQ ID NO: 16467 - RNA, 22 nt, Human
agcugcuguccuaggcacugua

SEQ ID NO: 16468 - RNA, 22 nt, Human
agcugcuguggccacaucuggc

SEQ ID NO: 16469 - RNA, 22 nt, Human
agcugcuguggggcucggccug

SEQ ID NO: 16470 - RNA, 22 nt, Human
agcugcugugugcucaggcagg

SEQ ID NO: 16471 - RNA, 22 nt, Human
agcugcuguuucuugcacguau

SEQ ID NO: 16472 - RNA, 18 nt, Human
agcugcuugcaggccuuc

SEQ ID NO: 16473 - RNA, 22 nt, Human
agcugcuugggaaccaucaauu

SEQ ID NO: 16474 - RNA, 22 nt, Human
agcugcuuugccaaugcguucc

SEQ ID NO: 16475 - RNA, 22 nt, Human
agcugcuuugcugggcaggccc

SEQ ID NO: 16476 - RNA, 22 nt, Human
agcugcuuuuagggccgggcuc

SEQ ID NO: 16477 - RNA, 22 nt, Human
agcugcuuuuauuaggacaaug

SEQ ID NO: 16478 - RNA, 22 nt, Human
agcuggaacccgggugggcagc

SEQ ID NO: 16479 - RNA, 21 nt, Human
agcuggaaucuggcugugcuu

SEQ ID NO: 16480 - RNA, 22 nt, Human
agcuggagaaaccugggagggu

SEQ ID NO: 16481 - RNA, 22 nt, Human
agcuggagaugcccagcaccgg

SEQ ID NO: 16482 - RNA, 19 nt, Human
agcuggagauuggagggca

SEQ ID NO: 16483 - RNA, 22 nt, Human
agcuggaggauaacucacuucu

SEQ ID NO: 16484 - RNA, 22 nt, Human
agcuggauuaaauauagcuuuc

SEQ ID NO: 16485 - RNA, 22 nt, Human
agcuggcaaggcaauuuggauu

SEQ ID NO: 16486 - RNA, 22 nt, Human
agcuggcacagaccaggagauc

SEQ ID NO: 16487 - RNA, 22 nt, Human
agcuggcacuagcguuuccaag

SEQ ID NO: 16488 - RNA, 22 nt, Human
agcuggcagagcauuuguggcc

SEQ ID NO: 16489 - RNA, 22 nt, Human
agcuggcaggugaagaugauuu

SEQ ID NO: 16490 - RNA, 22 nt, Human
agcuggcagucggccuugaugc

SEQ ID NO: 16491 - RNA, 22 nt, Human
agcuggcaucgagcauuugaac

SEQ ID NO: 16492 - RNA, 22 nt, Human
agcuggcaucugaagucagggc

SEQ ID NO: 16493 - RNA, 20 nt, Human
agcuggccaauucuauuacu

SEQ ID NO: 16494 - RNA, 22 nt, Human
agcuggcccucgagagccaauu

SEQ ID NO: 16495 - RNA, 22 nt, Human
agcuggccggccuccaggugga

SEQ ID NO: 16496 - RNA, 22 nt, Human
agcuggcuaugcccugugaacc

SEQ ID NO: 16497 - RNA, 21 nt, Human
agcuggcucucucuggagaga

SEQ ID NO: 16498 - RNA, 19 nt, Human
agcuggcucuucuuugucu

SEQ ID NO: 16499 - RNA, 22 nt, Human
agcuggcuugcaugcuaaggag

SEQ ID NO: 16500 - RNA, 22 nt, Human
agcuggcuuugagcugggaggu

SEQ ID NO: 16501 - RNA, 22 nt, Human
agcugggacucaacugucuggg

SEQ ID NO: 16502 - RNA, 23 nt, Human
agcugggcaaggauccgggcucc

SEQ ID NO: 16503 - RNA, 22 nt, Human
agcugggcagacugcagugguu

SEQ ID NO: 16504 - RNA, 23 nt, Human
agcugggccagguggucagaccu

SEQ ID NO: 16505 - RNA, 21 nt, Human
agcugggccucagccugcagu

SEQ ID NO: 16506 - RNA, 22 nt, Human
agcuggggcauuuauccacuaa

SEQ ID NO: 16507 - RNA, 22 nt, Human
agcuggguacagccugugccua

SEQ ID NO: 16508 - RNA, 22 nt, Human
agcuggguacugaugucuucag

SEQ ID NO: 16509 - RNA, 22 nt, Human
agcugggugaaggcagauggcu

SEQ ID NO: 16510 - RNA, 22 nt, Human
agcugggugcgguggcucaugc

SEQ ID NO: 16511 - RNA, 22 nt, Human
agcuggguggagggcccacggu

SEQ ID NO: 16512 - RNA, 21 nt, Human
agcugggugggcugagugaca

SEQ ID NO: 16513 - RNA, 22 nt, Human
agcugguccuuggcaguucuca

SEQ ID NO: 16514 - RNA, 20 nt, Human
agcuggucuuaaguaacuga

SEQ ID NO: 16515 - RNA, 22 nt, Human
agcuggugaggguugaggggua

SEQ ID NO: 16516 - RNA, 22 nt, Human
agcugguggagccuuucuguuu

SEQ ID NO: 16517 - RNA, 21 nt, Human
agcuggugucagagcucuggg

SEQ ID NO: 16518 - RNA, 22 nt, Human
agcugguguccuccuggagcug

SEQ ID NO: 16519 - RNA, 20 nt, Human
agcugguuaucuuaauucuu

SEQ ID NO: 16520 - RNA, 22 nt, Human
agcugguucagaaauuagaugg

SEQ ID NO: 16521 - RNA, 22 nt, Human
agcugguugcuuaaccucucug

SEQ ID NO: 16522 - RNA, 22 nt, Human
agcugguugucauucagaauug

SEQ ID NO: 16523 - RNA, 22 nt, Human
agcuguaagcuuugggcaaguc

SEQ ID NO: 16524 - RNA, 22 nt, Human
agcuguauucucuuuguauuaa

SEQ ID NO: 16525 - RNA, 22 nt, Human
agcugucaccaggagccggacc

SEQ ID NO: 16526 - RNA, 22 nt, Human
agcugucagugcugugccugua

SEQ ID NO: 16527 - RNA, 22 nt, Human
agcugucuggaaguuccucaug

SEQ ID NO: 16528 - RNA, 22 nt, Human
agcugucuuuaagugagcuuug

SEQ ID NO: 16529 - RNA, 22 nt, Human
agcugugauuauccacuggaau

SEQ ID NO: 16530 - RNA, 22 nt, Human
agcugugcacacugugaaguag

SEQ ID NO: 16531 - RNA, 22 nt, Human
agcuguggaguaggggguugga

SEQ ID NO: 16532 - RNA, 22 nt, Human
agcuguggcaaccuugucagac

SEQ ID NO: 16533 - RNA, 22 nt, Human
agcuguggcagcacuuuggagu

SEQ ID NO: 16534 - RNA, 22 nt, Human
agcuguggucuucaaguugccu

SEQ ID NO: 16535 - RNA, 22 nt, Human
agcugugguuagauagaguccu

SEQ ID NO: 16536 - RNA, 23 nt, Human
agcuguguggccuugggcaaguu

SEQ ID NO: 16537 - RNA, 22 nt, Human
agcugugugugcuugggauuau

SEQ ID NO: 16538 - RNA, 22 nt, Human
agcuguguucugguugauucac

SEQ ID NO: 16539 - RNA, 22 nt, Human
agcuguugcagggaucagcacc

SEQ ID NO: 16540 - RNA, 22 nt, Human
agcuguuuaaaugacuuacuuu

SEQ ID NO: 16541 - RNA, 22 nt, Human
agcuguuuaugcacuccugccu

SEQ ID NO: 16542 - RNA, 22 nt, Human
agcuguuuccauaaaugagaca

SEQ ID NO: 16543 - RNA, 22 nt, Human
agcuguuuccauucuugaguag

SEQ ID NO: 16544 - RNA, 22 nt, Human
agcuguuuuccugguuagagac

SEQ ID NO: 16545 - RNA, 22 nt, Human
agcuguuuucuucuaggaagac

SEQ ID NO: 16546 - RNA, 22 nt, Human
agcuuacugggcaguaaagauu

SEQ ID NO: 16547 - RNA, 22 nt, Human
agcuuagugguuguaugaguua

SEQ ID NO: 16548 - RNA, 22 nt, Human
agcuucagcuugcagcugugau

SEQ ID NO: 16549 - RNA, 22 nt, Human
agcuucagggacuuguggcaga

SEQ ID NO: 16550 - RNA, 22 nt, Human
agcuucagguggucuuguuucu

SEQ ID NO: 16551 - RNA, 22 nt, Human
agcuucaucuuuauguacagga

SEQ ID NO: 16552 - RNA, 20 nt, Human
agcuucauuauagcccacag

SEQ ID NO: 16553 - RNA, 23 nt, Human
agcuucauuauuuuccaugaucu

SEQ ID NO: 16554 - RNA, 22 nt, Human
agcuucccaagguuggaagguu

SEQ ID NO: 16555 - RNA, 22 nt, Human
agcuucccggcaggcacguccu

SEQ ID NO: 16556 - RNA, 18 nt, Human
agcuucccucugagaggg

SEQ ID NO: 16557 - RNA, 22 nt, Human
agcuuccuacaaccaucucaga

SEQ ID NO: 16558 - RNA, 21 nt, Human
agcuuccugcagugggagguc

SEQ ID NO: 16559 - RNA, 22 nt, Human
agcuucucagaagaguccugua

SEQ ID NO: 16560 - RNA, 22 nt, Human
agcuucucagcuucagaacugu

SEQ ID NO: 16561 - RNA, 22 nt, Human
agcuucucccuuuccuauuggu

SEQ ID NO: 16562 - RNA, 22 nt, Human
agcuucuccugguacagaacug

SEQ ID NO: 16563 - RNA, 22 nt, Human
aggauuugcacugguguuugag

SEQ ID NO: 16564 - RNA, 22 nt, Human
aggauuuguauagcuuucuuuu

SEQ ID NO: 16565 - RNA, 22 nt, Human
aggauuuugacuuauucaggga

SEQ ID NO: 16566 - RNA, 22 nt, Human
aggcaaaagaaugucauaaaug

SEQ ID NO: 16567 - RNA, 22 nt, Human
aggcaaaauaagccucuccugu

SEQ ID NO: 16568 - RNA, 22 nt, Human
aggcaaaucugagacauuuaaa

SEQ ID NO: 16569 - RNA, 22 nt, Human
aggcaaauuauuguaugcaguu

SEQ ID NO: 16570 - RNA, 22 nt, Human
aggcaaauugugagaaaaugaa

SEQ ID NO: 16571 - RNA, 17 nt, Human
aucaguagcauaucaga

SEQ ID NO: 16572 - RNA, 22 nt, Human
aucagucauauccaaauuagca

SEQ ID NO: 16573 - RNA, 23 nt, Human
aucagucuugguagcugugccca

SEQ ID NO: 16574 - RNA, 22 nt, Human
aucagugacuucuuccaaaguu

SEQ ID NO: 16575 - RNA, 22 nt, Human
aucagugcauccugccacaaag

SEQ ID NO: 16576 - RNA, 22 nt, Human
aucagugccccauggcuaaugc

SEQ ID NO: 16577 - RNA, 22 nt, Human
aucagugcuucauagcccuggu

SEQ ID NO: 16578 - RNA, 22 nt, Human
aucaguguaccuuauggauuuu

SEQ ID NO: 16579 - RNA, 22 nt, Human
aucaguguuccuugagacugcc

SEQ ID NO: 16580 - RNA, 22 nt, Human
aucaguuauuuuuaagcuauaa

SEQ ID NO: 16581 - RNA, 22 nt, Human
aucaguuuaaaugggcuguugg

SEQ ID NO: 16582 - RNA, 22 nt, Human
aucaguuuggaacauucaggcc

SEQ ID NO: 16583 - RNA, 22 nt, Human
aucaguuuggugcuuucaguga

SEQ ID NO: 16584 - RNA, 22 nt, Human
aucaguuuugggggacauacug

SEQ ID NO: 16585 - RNA, 22 nt, Human
aggcugagccugggcguggugg

SEQ ID NO: 16586 - RNA, 23 nt, Human
aggcugagcucucccagcuucag

SEQ ID NO: 16587 - RNA, 22 nt, Human
aggcugaggcagguggaucauu

SEQ ID NO: 16588 - RNA, 22 nt, Human
aggcugaggcuggcagcuccag

SEQ ID NO: 16589 - RNA, 22 nt, Human
aggcugaggcuuuccuuggaga

SEQ ID NO: 16590 - RNA, 22 nt, Human
aggcugagggcuccugagggca

SEQ ID NO: 16591 - RNA, 22 nt, Human
aggcugaggggcgagggacccu

SEQ ID NO: 16592 - RNA, 20 nt, Human
aggcugagggugauuguguc

SEQ ID NO: 16593 - RNA, 22 nt, Human
aggcugagucgggaggaucacu

SEQ ID NO: 16594 - RNA, 20 nt, Human
aggcugaguucuaugcacuu

SEQ ID NO: 16595 - RNA, 22 nt, Human
aggcugaguuucucauucucgc

SEQ ID NO: 16596 - RNA, 22 nt, Human
aggcugaugcuggcugaggcug

SEQ ID NO: 16597 - RNA, 19 nt, Human
aggcugcaagguggugggc

SEQ ID NO: 16598 - RNA, 18 nt, Human
aggcugcacugucuuaaa

SEQ ID NO: 16599 - RNA, 22 nt, Human
aggcugcagaggugcugccaga

SEQ ID NO: 16600 - RNA, 21 nt, Human
aggcugcaugcaugagugugg

SEQ ID NO: 16601 - RNA, 22 nt, Human
aggcugccagaagccuucagga

SEQ ID NO: 16602 - RNA, 22 nt, Human
aggcugccucgugagcucgcug

SEQ ID NO: 16603 - RNA, 22 nt, Human
aggcugcuauaaacauucccgu

SEQ ID NO: 16604 - RNA, 22 nt, Human
aggcugcucaccucccugucug

SEQ ID NO: 16605 - RNA, 21 nt, Human
aggcugcuggcucaggguccu

SEQ ID NO: 16606 - RNA, 22 nt, Human
aggcuggaaagggaccagagug

SEQ ID NO: 16607 - RNA, 22 nt, Human
aggcuggagcaagggggcauau

SEQ ID NO: 16608 - RNA, 22 nt, Human
aggcuggagugcaguggcguga

SEQ ID NO: 16609 - RNA, 22 nt, Human
aggcuggaguguagcagugcag

SEQ ID NO: 16610 - RNA, 22 nt, Human
aggcuggaucucuguugccuuc

SEQ ID NO: 16611 - RNA, 20 nt, Human
aggcuggcacuccuggccag

SEQ ID NO: 16612 - RNA, 22 nt, Human
aggcuggcagccaccucagcag

SEQ ID NO: 16613 - RNA, 22 nt, Human
aggcuggcccaccucuugucuu

SEQ ID NO: 16614 - RNA, 22 nt, Human
aggcuggcccuacuggcugccu

SEQ ID NO: 16615 - RNA, 22 nt, Human
aggcuggcucggcuuuucuguc

SEQ ID NO: 16616 - RNA, 22 nt, Human
aggcuggcugaaaaacacccuu

SEQ ID NO: 16617 - RNA, 22 nt, Human
aggcuggcugacuucugaagca

SEQ ID NO: 16618 - RNA, 22 nt, Human
aggcuggcugagcugcagccug

SEQ ID NO: 16619 - RNA, 22 nt, Human
aggcuggcuggcaggggacaca

SEQ ID NO: 16620 - RNA, 22 nt, Human
aggcuggcuggggaugcgucuu

SEQ ID NO: 16621 - RNA, 22 nt, Human
aggcugggaagguaaaguugua

SEQ ID NO: 16622 - RNA, 22 nt, Human
aggcuggucccagggagggaau

SEQ ID NO: 16623 - RNA, 22 nt, Human
aggcuggucuauacggagacga

SEQ ID NO: 16624 - RNA, 22 nt, Human
aggcuggugucucuguccuguc

SEQ ID NO: 16625 - RNA, 22 nt, Human
aggcugguguguccugaagccu

SEQ ID NO: 16626 - RNA, 22 nt, Human
aggcugucaucuuugcaggcag

SEQ ID NO: 16627 - RNA, 22 nt, Human
aggcugucucaccucaggaggg

SEQ ID NO: 16628 - RNA, 22 nt, Human
aggcugugaacucuaugcugaa

SEQ ID NO: 16629 - RNA, 22 nt, Human
aggcugugaagguuaaagacga

SEQ ID NO: 16630 - RNA, 22 nt, Human
aggcugugacagggucauggag

SEQ ID NO: 16631 - RNA, 21 nt, Human
aggcugugacuuacacuaucu

SEQ ID NO: 16632 - RNA, 22 nt, Human
aggcugugagaaguccuucagu

SEQ ID NO: 16633 - RNA, 19 nt, Human
aggcugugaggggaaggaa

SEQ ID NO: 16634 - RNA, 22 nt, Human
aggcugugaguuuugucucaga

SEQ ID NO: 16635 - RNA, 22 nt, Human
aggcugugauggauguaaagga

SEQ ID NO: 16636 - RNA, 22 nt, Human
aggcugugauuccaccacucuc

SEQ ID NO: 16637 - RNA, 22 nt, Human
aggcugugcgaggucucagagu

SEQ ID NO: 16638 - RNA, 22 nt, Human
aggcuguggcauuaaacguuug

SEQ ID NO: 16639 - RNA, 22 nt, Human
aggcuguggcccuggucuagca

SEQ ID NO: 16640 - RNA, 22 nt, Human
aggcuguguucugguucuuagc

SEQ ID NO: 16641 - RNA, 22 nt, Human
aggcuguucuaggagaguggga

SEQ ID NO: 16642 - RNA, 22 nt, Human
aggcuguuuuguauaaacugga

SEQ ID NO: 16643 - RNA, 22 nt, Human
aggcuuaacuacaauuuuugcc

SEQ ID NO: 16644 - RNA, 22 nt, Human
aggcuuagaaaggguaagugac

SEQ ID NO: 16645 - RNA, 22 nt, Human
aggcuuauuuuaggucucucuu

SEQ ID NO: 16646 - RNA, 22 nt, Human
aggcuucacauuuucuaggccu

SEQ ID NO: 16647 - RNA, 22 nt, Human
aggcuucacgaugggugaggug

SEQ ID NO: 16648 - RNA, 22 nt, Human
aggcuucagaaagaguaauugg

SEQ ID NO: 16649 - RNA, 22 nt, Human
aggcuucagacaaauguuaugg

SEQ ID NO: 16650 - RNA, 22 nt, Human
aggcuucagaugaccuuagcau

SEQ ID NO: 16651 - RNA, 22 nt, Human
aggcuucaguauucaccgcaug

SEQ ID NO: 16652 - RNA, 22 nt, Human
aggcuucauuacagugguucaa

SEQ ID NO: 16653 - RNA, 22 nt, Human
aggcuucauuguggcaucagga

SEQ ID NO: 16654 - RNA, 22 nt, Human
aggcuucccagcugagcucagc

SEQ ID NO: 16655 - RNA, 22 nt, Human
aggcuucuaaaucacaaggaaa

SEQ ID NO: 16656 - RNA, 19 nt, Human
aggcuucuacccuguccag

SEQ ID NO: 16657 - RNA, 21 nt, Human
aggcuucuccgugcaggaaga

SEQ ID NO: 16658 - RNA, 22 nt, Human
aggcuucucuccuuggcuugca

SEQ ID NO: 16659 - RNA, 22 nt, Human
aggcuucuggaauccaguuucu

SEQ ID NO: 16660 - RNA, 22 nt, Human
aggcuucuggggcaccgagcga

SEQ ID NO: 16661 - RNA, 22 nt, Human
aggcuucugucuuuaggaguug

SEQ ID NO: 16662 - RNA, 22 nt, Human
aggcuucuguuucuuaaaggug

SEQ ID NO: 16663 - RNA, 22 nt, Human
aggcuucuugcuuccaaaugca

SEQ ID NO: 16664 - RNA, 22 nt, Human
aggcuucuugggcuucauucug

SEQ ID NO: 16665 - RNA, 22 nt, Human
aggcuuggaaaauuuacagugu

SEQ ID NO: 16666 - RNA, 21 nt, Human
aggcuuggauagguuauguga

SEQ ID NO: 16667 - RNA, 21 nt, Human
aggcuuggaucuagacaggcc

SEQ ID NO: 16668 - RNA, 19 nt, Human
aggcuuggcuagauuuacu

SEQ ID NO: 16669 - RNA, 22 nt, Human
aggcuuggcuggcagcccuggg

SEQ ID NO: 16670 - RNA, 20 nt, Human
aggcuuggcuuggcaggaac

SEQ ID NO: 16671 - RNA, 22 nt, Human
aggcuugguuaauucuguguga

SEQ ID NO: 16672 - RNA, 22 nt, Human
aggcuuuaagcaagcauauugu

SEQ ID NO: 16673 - RNA, 23 nt, Human
aggcuuuaugguagaaaguuugc

SEQ ID NO: 16674 - RNA, 22 nt, Human
aggcuuuauuugaucuauaugc

SEQ ID NO: 16675 - RNA, 22 nt, Human
aggcuuugcaaaaaagcucaua

SEQ ID NO: 16676 - RNA, 22 nt, Human
aggcuuuggaaucagaguucug

SEQ ID NO: 16677 - RNA, 21 nt, Human
agggaaaaggcugagugaggg

SEQ ID NO: 16678 - RNA, 21 nt, Human
agggaaagaaaaugagcuaau

SEQ ID NO: 16679 - RNA, 20 nt, Human
agggaacaauggacgcuguc

SEQ ID NO: 16680 - RNA, 22 nt, Human
aggcagccugguuugaauggaa

SEQ ID NO: 16681 - RNA, 22 nt, Human
aggcagcuagagagugaaacug

SEQ ID NO: 16682 - RNA, 22 nt, Human
aggcagcugcccucuccuuccu

SEQ ID NO: 16683 - RNA, 22 nt, Human
aggcagcuggaaaacuccaggc

SEQ ID NO: 16684 - RNA, 21 nt, Human
aggcagcuggaaggccuggcu

SEQ ID NO: 16685 - RNA, 20 nt, Human
aggcagcuggccaggcaggu

SEQ ID NO: 16686 - RNA, 23 nt, Human
aggcagcuggguagcaucuuucu

SEQ ID NO: 16687 - RNA, 22 nt, Human
aggcagcuuucagugucucuca

SEQ ID NO: 16688 - RNA, 22 nt, Human
aggcaggaggaucauggaugca

SEQ ID NO: 16689 - RNA, 21 nt, Human
aggcaggauucaaacacagag

SEQ ID NO: 16690 - RNA, 22 nt, Human
aggcaggauugcugacaacaau

SEQ ID NO: 16691 - RNA, 22 nt, Human
aggcaggcaaguucauaugagg

SEQ ID NO: 16692 - RNA, 18 nt, Human
aggcaggcggaucacaag

SEQ ID NO: 16693 - RNA, 22 nt, Human
aggcaggcuagucgcuugagcc

SEQ ID NO: 16694 - RNA, 22 nt, Human
aggcaggcucaaugcccagucu

SEQ ID NO: 16695 - RNA, 22 nt, Human
aggcaggcucuggguaugugca

SEQ ID NO: 16696 - RNA, 22 nt, Human
aggcaggcugcuauggaguaga

SEQ ID NO: 16697 - RNA, 22 nt, Human
aggcagggcugggauuagacuc

SEQ ID NO: 16698 - RNA, 22 nt, Human
aggcaggggagcuggaagggua

SEQ ID NO: 16699 - RNA, 17 nt, Human
aggcagguaagaguuau

SEQ ID NO: 16700 - RNA, 22 nt, Human
aggcagguagaaggaucuuuau

SEQ ID NO: 16701 - RNA, 22 nt, Human
aggcaggucuguaucuagucuc

SEQ ID NO: 16702 - RNA, 18 nt, Human
aggcaggugcuaauauuu

SEQ ID NO: 16703 - RNA, 22 nt, Human
aggcagucagcccugcuagggu

SEQ ID NO: 16704 - RNA, 22 nt, Human
aggcuccaugcaaaggcuguuu

SEQ ID NO: 16705 - RNA, 22 nt, Human
aggcuccauucaugugaaggca

SEQ ID NO: 16706 - RNA, 22 nt, Human
aggcuccauuccaggagcuaga

SEQ ID NO: 16707 - RNA, 22 nt, Human
aggcuccguccagucucaggcc

SEQ ID NO: 16708 - RNA, 22 nt, Human
aggcuccuagccuguggcuggu

SEQ ID NO: 16709 - RNA, 22 nt, Human
aggcuccuaucgcuuucagcaa

SEQ ID NO: 16710 - RNA, 20 nt, Human
aggcuccuccaggaugugug

SEQ ID NO: 16711 - RNA, 17 nt, Human
aggcuccuccuaagguc

SEQ ID NO: 16712 - RNA, 22 nt, Human
aggcuccuggguguggccgcca

SEQ ID NO: 16713 - RNA, 20 nt, Human
aggcuccuguaccugaggaa

SEQ ID NO: 16714 - RNA, 22 nt, Human
aggcuccuuauggcuuuggggu

SEQ ID NO: 16715 - RNA, 22 nt, Human
aggcucuaaggagggcugucua

SEQ ID NO: 16716 - RNA, 22 nt, Human
aggcucucacccucugaccaga

SEQ ID NO: 16717 - RNA, 22 nt, Human
aggcucucagaucagccacauu

SEQ ID NO: 16718 - RNA, 21 nt, Human
aggcucucauccagggaccca

SEQ ID NO: 16719 - RNA, 22 nt, Human
aggcucuccuccccaggaccau

SEQ ID NO: 16720 - RNA, 22 nt, Human
aggcucugaggcagauuuucgu

SEQ ID NO: 16721 - RNA, 22 nt, Human
aggcucugaguagagcugccag

SEQ ID NO: 16722 - RNA, 22 nt, Human
aggcucugcagaccccagcugu

SEQ ID NO: 16723 - RNA, 22 nt, Human
aggcucugcagugcuggaggac

SEQ ID NO: 16724 - RNA, 22 nt, Human
aggcucugcauccaggcuuuau

SEQ ID NO: 16725 - RNA, 22 nt, Human
aggcucugccaauuccuuccuc

SEQ ID NO: 16726 - RNA, 20 nt, Human
aggcucugccauugucccug

SEQ ID NO: 16727 - RNA, 22 nt, Human
aggcucugggaacagacgggug

SEQ ID NO: 16728 - RNA, 22 nt, Human
aggcucugggcucuagauuuug

SEQ ID NO: 16729 - RNA, 22 nt, Human
aggcucugguucaucaugaugg

SEQ ID NO: 16730 - RNA, 19 nt, Human
aggcucuguaggagagggc

SEQ ID NO: 16731 - RNA, 22 nt, Human
aggcucuguaugaagguuuggg

SEQ ID NO: 16732 - RNA, 22 nt, Human
aggcucugugauccacaaugag

SEQ ID NO: 16733 - RNA, 22 nt, Human
aggcucugugaugugccaggca

SEQ ID NO: 16734 - RNA, 22 nt, Human
aggcucugugcagccugcaucu

SEQ ID NO: 16735 - RNA, 22 nt, Human
aggcucugugcauccuccccaa

SEQ ID NO: 16736 - RNA, 22 nt, Human
aggcucuuugagacuaccugga

SEQ ID NO: 16737 - RNA, 22 nt, Human
aggcugagaaagugggaagaug

SEQ ID NO: 16738 - RNA, 22 nt, Human
aggcugagcuggcccuugaaau

SEQ ID NO: 16739 - RNA, 22 nt, Human
aggcugagcugguagugaguac

SEQ ID NO: 16740 - RNA, 22 nt, Human
aggcugaggaucccuguguucu

SEQ ID NO: 16741 - RNA, 22 nt, Human
aggcugaggaucguacuuucca

SEQ ID NO: 16742 - RNA, 22 nt, Human
aggcugaggcaagaggaucacu

SEQ ID NO: 16743 - RNA, 22 nt, Human
aggcugaggcagguggaucacc

SEQ ID NO: 16744 - RNA, 22 nt, Human
aggcugaggcgggaggaucacu

SEQ ID NO: 16745 - RNA, 22 nt, Human
aggcugagguaggaggaucgcu

SEQ ID NO: 16746 - RNA, 22 nt, Human
aggcugaggugugcugugaucg

SEQ ID NO: 16747 - RNA, 22 nt, Human
aggcugagugcuccccuagaug

SEQ ID NO: 16748 - RNA, 22 nt, Human
aggcugcagaacagucaggugc

SEQ ID NO: 16749 - RNA, 23 nt, Human
aggcugcagaagaauagggucau

SEQ ID NO: 16750 - RNA, 22 nt, Human
aggcugccaaagcuucugucuc

SEQ ID NO: 16751 - RNA, 23 nt, Human
aggcugccagaaauuggguaagg

SEQ ID NO: 16752 - RNA, 22 nt, Human
aggcugccgcagccaaugguug

SEQ ID NO: 16753 - RNA, 22 nt, Human
aggcugcguuagccucacuccc

SEQ ID NO: 16754 - RNA, 22 nt, Human
aggcugcucaguagauggagcu

SEQ ID NO: 16755 - RNA, 21 nt, Human
aggcugcucuuucuuguggua

SEQ ID NO: 16756 - RNA, 22 nt, Human
aggcugcugaggccaccacgcu

SEQ ID NO: 16757 - RNA, 22 nt, Human
aggcugcuggaggauuuaugcc

SEQ ID NO: 16758 - RNA, 22 nt, Human
aggcugcuuccuuacguggcug

SEQ ID NO: 16759 - RNA, 22 nt, Human
aggcuggagagugcaguggcgu

SEQ ID NO: 16760 - RNA, 22 nt, Human
aggcuggagggcaauggcaaga

SEQ ID NO: 16761 - RNA, 22 nt, Human
aggcuggaguacaguggcuauu

SEQ ID NO: 16762 - RNA, 22 nt, Human
aggcuggagugcaauggcguga

SEQ ID NO: 16763 - RNA, 22 nt, Human
aggcuggagugcuggagugcug

SEQ ID NO: 16764 - RNA, 22 nt, Human
aggcuggagugugcaguggcgc

SEQ ID NO: 16765 - RNA, 22 nt, Human
aggcuggaugugccucaccgag

SEQ ID NO: 16766 - RNA, 22 nt, Human
aggcuggauuuauggggacuuc

SEQ ID NO: 16767 - RNA, 22 nt, Human
aggcuggcauacauuuguucuu

SEQ ID NO: 16768 - RNA, 22 nt, Human
aggcuggccagugcugcagugg

SEQ ID NO: 16769 - RNA, 17 nt, Human
aggcuggcucacaggga

SEQ ID NO: 16770 - RNA, 23 nt, Human
aggcuggcuucaggagccucucc

SEQ ID NO: 16771 - RNA, 22 nt, Human
aggcuggcuucccaagcguccu

SEQ ID NO: 16772 - RNA, 22 nt, Human
aggcuggguaccugucauaugc

SEQ ID NO: 16773 - RNA, 22 nt, Human
aggcuguccucucuugcucagu

SEQ ID NO: 16774 - RNA, 22 nt, Human
aggcugucucagccugcuugca

SEQ ID NO: 16775 - RNA, 22 nt, Human
aggcugugaggggcccgcaugc

SEQ ID NO: 16776 - RNA, 22 nt, Human
aggcugugcaauuaggguaaga

SEQ ID NO: 16777 - RNA, 22 nt, Human
aggcuguggaugcuuaacaaau

SEQ ID NO: 16778 - RNA, 22 nt, Human
aggcuguggcaucacaucagga

SEQ ID NO: 16779 - RNA, 22 nt, Human
aggcugugggaauggcugcuug

SEQ ID NO: 16780 - RNA, 22 nt, Human
aggcugugggaguugagagucu

SEQ ID NO: 16781 - RNA, 22 nt, Human
aggcugugggguucugcuuuca

SEQ ID NO: 16782 - RNA, 22 nt, Human
aggcuguguccucauuuuauau

SEQ ID NO: 16783 - RNA, 22 nt, Human
aggcuguguggauaauauuggg

SEQ ID NO: 16784 - RNA, 22 nt, Human
aggcuguguggaugagucuuac

SEQ ID NO: 16785 - RNA, 22 nt, Human
aggcuguguuucuugcguuuuc

SEQ ID NO: 16786 - RNA, 22 nt, Human
aggcuuaacuuuacuguuaugc

SEQ ID NO: 16787 - RNA, 22 nt, Human
aggcuuaagccugaggccccag

SEQ ID NO: 16788 - RNA, 22 nt, Human
aggcuuagaaauucagcugagu

SEQ ID NO: 16789 - RNA, 22 nt, Human
augcagaaucuugagaaaaauu

SEQ ID NO: 16790 - RNA, 23 nt, Human
augcagagaauaacaaaugccau

SEQ ID NO: 16791 - RNA, 19 nt, Human
augcagagaauggcaguag

SEQ ID NO: 16792 - RNA, 22 nt, Human
augcagagacagauguggcaug

SEQ ID NO: 16793 - RNA, 22 nt, Human
augcagagcuuccaguggccug

SEQ ID NO: 16794 - RNA, 22 nt, Human
augcagauaagaaucagguuug

SEQ ID NO: 16795 - RNA, 22 nt, Human
augcagauaugcaaacuguagu

SEQ ID NO: 16796 - RNA, 22 nt, Human
augcagaucugugaaaggaaua

SEQ ID NO: 16797 - RNA, 22 nt, Human
augcagauguuccuacuguguu

SEQ ID NO: 16798 - RNA, 22 nt, Human
augcagcacugaucuuuagcca

SEQ ID NO: 16799 - RNA, 22 nt, Human
augcagcagccccuugaggugc

SEQ ID NO: 16800 - RNA, 22 nt, Human
augcagcagcuacuugggaagg

SEQ ID NO: 16801 - RNA, 19 nt, Human
augcagcuccugccuccuu

SEQ ID NO: 16802 - RNA, 22 nt, Human
augcagcugaggguaguggagc

SEQ ID NO: 16803 - RNA, 22 nt, Human
augcagcugcucuuccucuauu

SEQ ID NO: 16804 - RNA, 20 nt, Human
augcagcuggaguuggggug

SEQ ID NO: 16805 - RNA, 22 nt, Human
augcagcugugggcaagaaaug

SEQ ID NO: 16806 - RNA, 22 nt, Human
augcaggaagagcccuggagcu

SEQ ID NO: 16807 - RNA, 22 nt, Human
augcaggagcccucuugagggc

SEQ ID NO: 16808 - RNA, 22 nt, Human
augcaggaguuggaaaaaauga

SEQ ID NO: 16809 - RNA, 21 nt, Human
augcaggcugcucagaagcaa

SEQ ID NO: 16810 - RNA, 22 nt, Human
augcagggaccuuugcuuuggu

SEQ ID NO: 16811 - RNA, 22 nt, Human
augcagggagguaagaggugcc

SEQ ID NO: 16812 - RNA, 22 nt, Human
augcagggucuccgugugacga

SEQ ID NO: 16813 - RNA, 22 nt, Human
augcaguacagauaauucuaca

SEQ ID NO: 16814 - RNA, 22 nt, Human
augcaguacugauacaugccac

SEQ ID NO: 16815 - RNA, 22 nt, Human
augcaguauaaaucauuucugg

SEQ ID NO: 16816 - RNA, 22 nt, Human
augcaguuaugugagggcauga

SEQ ID NO: 16817 - RNA, 22 nt, Human
augcaguuuaucuccaaaucau

SEQ ID NO: 16818 - RNA, 22 nt, Human
augcauaaagaaagcuaucugg

SEQ ID NO: 16819 - RNA, 22 nt, Human
augcauacagauuuaaaauuuu

SEQ ID NO: 16820 - RNA, 20 nt, Human
augcauauauguggugucug

SEQ ID NO: 16821 - RNA, 22 nt, Human
augcauauguacccauguucug

SEQ ID NO: 16822 - RNA, 22 nt, Human
augcauaugugugcacacgugu

SEQ ID NO: 16823 - RNA, 22 nt, Human
augcauauucuuagccccuccu

SEQ ID NO: 16824 - RNA, 22 nt, Human
aggcuugggacugcuuaggagc

SEQ ID NO: 16825 - RNA, 18 nt, Human
aggcuugggcccagcagc

SEQ ID NO: 16826 - RNA, 22 nt, Human
aggcuuguggauuggagcgagu

SEQ ID NO: 16827 - RNA, 22 nt, Human
aggcuuguggggaaucugugug

SEQ ID NO: 16828 - RNA, 22 nt, Human
aggcuuguuuuacuaaaagcaa

SEQ ID NO: 16829 - RNA, 22 nt, Human
aggcuuuaaguggccuacagcu

SEQ ID NO: 16830 - RNA, 21 nt, Human
aggcuuuaccucuggguaggu

SEQ ID NO: 16831 - RNA, 22 nt, Human
aggcuuuccugucacucaugcu

SEQ ID NO: 16832 - RNA, 22 nt, Human
aggcuuucgaugaacgcuugcu

SEQ ID NO: 16833 - RNA, 22 nt, Human
aggcuuuguaccuggggucuua

SEQ ID NO: 16834 - RNA, 22 nt, Human
aggcuuuuagaaucuuauuucu

SEQ ID NO: 16835 - RNA, 22 nt, Human
aggcuuuugcucuggcuccucu

SEQ ID NO: 16836 - RNA, 22 nt, Human
agggaaaggcugaugcuguggg

SEQ ID NO: 16837 - RNA, 22 nt, Human
agggaaagguagugaggucaca

SEQ ID NO: 16838 - RNA, 21 nt, Human
agggaaauccagucacuuuuc

SEQ ID NO: 16839 - RNA, 22 nt, Human
agggaaauggagaguguaguuu

SEQ ID NO: 16840 - RNA, 22 nt, Human
agggaaauuaaugugagcaaug

SEQ ID NO: 16841 - RNA, 22 nt, Human
agggaacaaaacucuaaaauuc

SEQ ID NO: 16842 - RNA, 22 nt, Human
agggaacauuugcacuguuggu

SEQ ID NO: 16843 - RNA, 22 nt, Human
agggaacuccaugaggccagag

SEQ ID NO: 16844 - RNA, 23 nt, Human
agggaagaaacaugaagggcugu

SEQ ID NO: 16845 - RNA, 22 nt, Human
agggaagaugucucaucuuagg

SEQ ID NO: 16846 - RNA, 22 nt, Human
agggaagcaggaauagcucuga

SEQ ID NO: 16847 - RNA, 22 nt, Human
agggaagcuuguuacugagaag

SEQ ID NO: 16848 - RNA, 19 nt, Human
agggaaggauucugucauu

SEQ ID NO: 16849 - RNA, 22 nt, Human
agggaaggcuuuugacauuucc

SEQ ID NO: 16850 - RNA, 23 nt, Human
agggaagggggcuuauuccacag

SEQ ID NO: 16851 - RNA, 22 nt, Human
agggaagguagaggucaccggc

SEQ ID NO: 16852 - RNA, 22 nt, Human
agggaagugauggaguucgauc

SEQ ID NO: 16853 - RNA, 22 nt, Human
agggaaguggucugggaacuug

SEQ ID NO: 16854 - RNA, 22 nt, Human
agggacacacuccaguguuauu

SEQ ID NO: 16855 - RNA, 22 nt, Human
agggacaugaggaugaucuaga

SEQ ID NO: 16856 - RNA, 22 nt, Human
agggaccacauccccucugugg

SEQ ID NO: 16857 - RNA, 22 nt, Human
agggacccauagagagaccagu

SEQ ID NO: 16858 - RNA, 22 nt, Human
agggacccugaugacugaggag

SEQ ID NO: 16859 - RNA, 22 nt, Human
agggaccucauguaaguggauu

SEQ ID NO: 16860 - RNA, 22 nt, Human
agggacuccgugcacagugguu

SEQ ID NO: 16861 - RNA, 22 nt, Human
agggacuggcucucugagcagg

SEQ ID NO: 16862 - RNA, 22 nt, Human
agggagaagagaacaaagcccu

SEQ ID NO: 16863 - RNA, 22 nt, Human
agggagaaugaccaagguauau

SEQ ID NO: 16864 - RNA, 22 nt, Human
agggagaggagcguuucacauc

SEQ ID NO: 16865 - RNA, 22 nt, Human
agggagaggcugaacuauccua

SEQ ID NO: 16866 - RNA, 18 nt, Human
agggagcaucugguugcc

SEQ ID NO: 16867 - RNA, 22 nt, Human
agggagcaugggugaagcaggc

SEQ ID NO: 16868 - RNA, 22 nt, Human
agggagccaggggccagcuauu

SEQ ID NO: 16869 - RNA, 22 nt, Human
agggagcccugaaccagagggu

SEQ ID NO: 16870 - RNA, 22 nt, Human
agggagcuauuucaggguuauu

SEQ ID NO: 16871 - RNA, 22 nt, Human
agggagcucugggggcacacgg

SEQ ID NO: 16872 - RNA, 22 nt, Human
agggagcucuuuggucuugccg

SEQ ID NO: 16873 - RNA, 22 nt, Human
agggagcugacuggcugccauu

SEQ ID NO: 16874 - RNA, 22 nt, Human
agggagcugagcugugagcagc

SEQ ID NO: 16875 - RNA, 21 nt, Human
agggagcuggccacacagccu

SEQ ID NO: 16876 - RNA, 22 nt, Human
agggagcugggccacacugauc

SEQ ID NO: 16877 - RNA, 22 nt, Human
agggaggauaguagucaguuua

SEQ ID NO: 16878 - RNA, 22 nt, Human
agggagguaggagcuucuagcu

SEQ ID NO: 16879 - RNA, 22 nt, Human
agggagguccaucccugcagag

SEQ ID NO: 16880 - RNA, 22 nt, Human
agggagugguuaagaaggugca

SEQ ID NO: 16881 - RNA, 19 nt, Human
agggauauuuaaaaagcuc

SEQ ID NO: 16882 - RNA, 22 nt, Human
agggaucagcagaggguguggu

SEQ ID NO: 16883 - RNA, 22 nt, Human
agggaugcuuugcugacagauu

SEQ ID NO: 16884 - RNA, 22 nt, Human
agggauggaagcucgucugcaa

SEQ ID NO: 16885 - RNA, 22 nt, Human
agggaugggucuaacccagaac

SEQ ID NO: 16886 - RNA, 22 nt, Human
agggaugguggagguugcaagu

SEQ ID NO: 16887 - RNA, 22 nt, Human
agggcacaggcuccggguccag

SEQ ID NO: 16888 - RNA, 21 nt, Human
agggcacccccgcugccuacc

SEQ ID NO: 16889 - RNA, 22 nt, Human
agggcacuccuuggcagcucug

SEQ ID NO: 16890 - RNA, 23 nt, Human
agggcacugaagcuggaauuggg

SEQ ID NO: 16891 - RNA, 22 nt, Human
agggcacuugaggcugggccug

SEQ ID NO: 16892 - RNA, 22 nt, Human
agggcagaaaccaccuugaugg

SEQ ID NO: 16893 - RNA, 22 nt, Human
agggcagaccacgugcaaggau

SEQ ID NO: 16894 - RNA, 22 nt, Human
agggcagagcugucuaaauggc

SEQ ID NO: 16895 - RNA, 22 nt, Human
agggcagagggugccucaccug

SEQ ID NO: 16896 - RNA, 22 nt, Human
agggcagcacaaggcauggacu

SEQ ID NO: 16897 - RNA, 22 nt, Human
agggcagcacagcugugcuccu

SEQ ID NO: 16898 - RNA, 22 nt, Human
aggcuucauauuuaggcauaug

SEQ ID NO: 16899 - RNA, 22 nt, Human
aggcuucauguagaugguuccc

SEQ ID NO: 16900 - RNA, 22 nt, Human
aggcuucauguguccuggguga

SEQ ID NO: 16901 - RNA, 22 nt, Human
aggcuucccaagcagcugcaaa

SEQ ID NO: 16902 - RNA, 22 nt, Human
aggcuuccuggaggaagaggua

SEQ ID NO: 16903 - RNA, 22 nt, Human
aggcuucuacguggucccaggg

SEQ ID NO: 16904 - RNA, 22 nt, Human
aggcuucucugcaagauguuaa

SEQ ID NO: 16905 - RNA, 22 nt, Human
aggcuucugagcauggaguuuu

SEQ ID NO: 16906 - RNA, 22 nt, Human
aggcuucugauaccaugagaga

SEQ ID NO: 16907 - RNA, 22 nt, Human
aggcuucugcugauauuucauu

SEQ ID NO: 16908 - RNA, 22 nt, Human
aggcuucuucuuccuauuuagu

SEQ ID NO: 16909 - RNA, 22 nt, Human
aggcuugacaauuuuacaugua

SEQ ID NO: 16910 - RNA, 22 nt, Human
aggcuuggagguucuguagcca

SEQ ID NO: 16911 - RNA, 22 nt, Human
aggcuuggcucuccuaugagaa

SEQ ID NO: 16912 - RNA, 19 nt, Human
aggcuugguguugaauggg

SEQ ID NO: 16913 - RNA, 19 nt, Human
aggcuugguugcagcaagc

SEQ ID NO: 16914 - RNA, 22 nt, Human
aggcuugguuuauagaaguaau

SEQ ID NO: 16915 - RNA, 22 nt, Human
aggcuuuaauuaucuacaggag

SEQ ID NO: 16916 - RNA, 22 nt, Human
aggcuuuacugccucaggacuc

SEQ ID NO: 16917 - RNA, 22 nt, Human
agggaaacuagacugccuuucu

SEQ ID NO: 16918 - RNA, 22 nt, Human
agggaaaguaagcauuucauua

SEQ ID NO: 16919 - RNA, 23 nt, Human
agggaaaguaguaauggccuuug

SEQ ID NO: 16920 - RNA, 23 nt, Human
agggaaauacugcaauuuuugga

SEQ ID NO: 16921 - RNA, 22 nt, Human
agggaaaucuuucaacacuuca

SEQ ID NO: 16922 - RNA, 22 nt, Human
agggaagaagcugguaguaggu

SEQ ID NO: 16923 - RNA, 22 nt, Human
agggaagagcuugcaagaaacc

SEQ ID NO: 16924 - RNA, 22 nt, Human
agggaagggcagggucuaugca

SEQ ID NO: 16925 - RNA, 20 nt, Human
agggaagugcgccaucaggg

SEQ ID NO: 16926 - RNA, 22 nt, Human
agggaauggaugauggcagguu

SEQ ID NO: 16927 - RNA, 22 nt, Human
agggaaugugaaaacaccucuc

SEQ ID NO: 16928 - RNA, 22 nt, Human
agggacagucuacuguucacug

SEQ ID NO: 16929 - RNA, 22 nt, Human
agggaccaaucaccgacaggcu

SEQ ID NO: 16930 - RNA, 22 nt, Human
agggaccucuucuugcagcuga

SEQ ID NO: 16931 - RNA, 22 nt, Human
agggaccuugauggguuuggga

SEQ ID NO: 16932 - RNA, 22 nt, Human
agggacuauuuacccaucucac

SEQ ID NO: 16933 - RNA, 22 nt, Human
agggacucgguugagugccccu

SEQ ID NO: 16934 - RNA, 22 nt, Human
agggacuugaugucagggagau

SEQ ID NO: 16935 - RNA, 22 nt, Human
agggagaaaauuggaugcacaa

SEQ ID NO: 16936 - RNA, 22 nt, Human
agggagaacaguugcagcagac

SEQ ID NO: 16937 - RNA, 22 nt, Human
agggagaggagggucuuguuga

SEQ ID NO: 16938 - RNA, 22 nt, Human
agggagagguugaaaccucagu

SEQ ID NO: 16939 - RNA, 22 nt, Human
agggagaguagauaucaggugu

SEQ ID NO: 16940 - RNA, 22 nt, Human
agggagcagcagccacaggaug

SEQ ID NO: 16941 - RNA, 22 nt, Human
auggaaugggaagaguguguga

SEQ ID NO: 16942 - RNA, 22 nt, Human
auggaauguuuauacacaguug

SEQ ID NO: 16943 - RNA, 22 nt, Human
auggaauuaauaggggaauacu

SEQ ID NO: 16944 - RNA, 22 nt, Human
auggacagcuggccucaaggga

SEQ ID NO: 16945 - RNA, 22 nt, Human
auggacaggaacucccuuggca

SEQ ID NO: 16946 - RNA, 22 nt, Human
auggacagggcacaggcgcaga

SEQ ID NO: 16947 - RNA, 22 nt, Human
auggacagugugaagcagauag

SEQ ID NO: 16948 - RNA, 22 nt, Human
auggacucacuaauuccuccac

SEQ ID NO: 16949 - RNA, 22 nt, Human
auggagacugcgucugccaucc

SEQ ID NO: 16950 - RNA, 22 nt, Human
auggagagagaaggcuugcugu

SEQ ID NO: 16951 - RNA, 22 nt, Human
auggagauuuuuagaauuacag

SEQ ID NO: 16952 - RNA, 22 nt, Human
auggagcuaaauuguaaucaua

SEQ ID NO: 16953 - RNA, 20 nt, Human
auggaggaagggcaagagaa

SEQ ID NO: 16954 - RNA, 22 nt, Human
auggaggaugugcagcaugggc

SEQ ID NO: 16955 - RNA, 22 nt, Human
auggagggaaaaguggagagcc

SEQ ID NO: 16956 - RNA, 22 nt, Human
auggaggugccaggugugaggg

SEQ ID NO: 16957 - RNA, 20 nt, Human
auggagguggaugugacugc

SEQ ID NO: 16958 - RNA, 22 nt, Human
auggagugccuguggcaguggg

SEQ ID NO: 16959 - RNA, 22 nt, Human
auggagugucaccuuccugguu

SEQ ID NO: 16960 - RNA, 22 nt, Human
auggaguugagcucuguugucc

SEQ ID NO: 16961 - RNA, 22 nt, Human
auggaguuuggggucaaauacu

SEQ ID NO: 16962 - RNA, 22 nt, Human
auggauaagucaaagaguaucc

SEQ ID NO: 16963 - RNA, 22 nt, Human
auggauaaugucucuguuuccc

SEQ ID NO: 16964 - RNA, 22 nt, Human
auggauauuggccaaacucauu

SEQ ID NO: 16965 - RNA, 22 nt, Human
auggaucacagugccgugggug

SEQ ID NO: 16966 - RNA, 22 nt, Human
auggaucagaaucccgggaggg

SEQ ID NO: 16967 - RNA, 22 nt, Human
auggaucuucccucauuucuga

SEQ ID NO: 16968 - RNA, 22 nt, Human
auggaugaaggcgaggaugagg

SEQ ID NO: 16969 - RNA, 19 nt, Human
auggaugccucaugccuca

SEQ ID NO: 16970 - RNA, 22 nt, Human
auggauggaaaaguugaggaga

SEQ ID NO: 16971 - RNA, 22 nt, Human
auggauuggauuuuuauggacc

SEQ ID NO: 16972 - RNA, 22 nt, Human
auggauuugcuuauacacaugu

SEQ ID NO: 16973 - RNA, 22 nt, Human
auggauuuggaugagauuacuu

SEQ ID NO: 16974 - RNA, 22 nt, Human
auggcaaaaacugcaguuaccu

SEQ ID NO: 16975 - RNA, 22 nt, Human
auggcaauuguaaauggaaaga

SEQ ID NO: 16976 - RNA, 22 nt, Human
auggcagaaagaauagaggcua

SEQ ID NO: 16977 - RNA, 22 nt, Human
auggcagagggauugaacagcu

SEQ ID NO: 16978 - RNA, 22 nt, Human
auggcagcaguccauugccuca

SEQ ID NO: 16979 - RNA, 22 nt, Human
auggcagcaguuuggagucuuu

SEQ ID NO: 16980 - RNA, 22 nt, Human
auggcagcaugggauugguaga

SEQ ID NO: 16981 - RNA, 22 nt, Human
auggcagcggagcuggaaauga

SEQ ID NO: 16982 - RNA, 22 nt, Human
auggcagggaccaagcugucau

SEQ ID NO: 16983 - RNA, 22 nt, Human
auggcagggcccuuggcuccca

SEQ ID NO: 16984 - RNA, 22 nt, Human
auggcaguagaaugggggaaaa

SEQ ID NO: 16985 - RNA, 22 nt, Human
auggcaguauuucaguacagag

SEQ ID NO: 16986 - RNA, 22 nt, Human
auggcagugacuugaaggguag

SEQ ID NO: 16987 - RNA, 22 nt, Human
auggcaguuguaugggcuguau

SEQ ID NO: 16988 - RNA, 22 nt, Human
auggcaguuuuagaacuuuuca

SEQ ID NO: 16989 - RNA, 22 nt, Human
auggcauuauagcaaugguuug

SEQ ID NO: 16990 - RNA, 22 nt, Human
auggcauuccaagucuucuuuu

SEQ ID NO: 16991 - RNA, 20 nt, Human
auggccaaccugcuuaugac

SEQ ID NO: 16992 - RNA, 22 nt, Human
auggccaagaaguauuccugac

SEQ ID NO: 16993 - RNA, 22 nt, Human
auggccaagagucgauuugggg

SEQ ID NO: 16994 - RNA, 22 nt, Human
auggccaaggggccuaggcagg

SEQ ID NO: 16995 - RNA, 22 nt, Human
auggccacauuuaguaacuggu

SEQ ID NO: 16996 - RNA, 22 nt, Human
auggccaccaucucuaaaacac

SEQ ID NO: 16997 - RNA, 22 nt, Human
auggccaccauuuaaugaagcu

SEQ ID NO: 16998 - RNA, 22 nt, Human
auggccagaugaaauaauagag

SEQ ID NO: 16999 - RNA, 22 nt, Human
auggccagauuauaugguuuuu

SEQ ID NO: 17000 - RNA, 22 nt, Human
auggccagcuuauaggggcuca

SEQ ID NO: 17001 - RNA, 22 nt, Human
auggccaggguggcacuguggu

SEQ ID NO: 17002 - RNA, 22 nt, Human
auggccaguguuucccucaguu

SEQ ID NO: 17003 - RNA, 19 nt, Human
auggccaguuuagagguuu

SEQ ID NO: 17004 - RNA, 22 nt, Human
auggccauagccuuauagcagg

SEQ ID NO: 17005 - RNA, 22 nt, Human
auggcccaaacugcaauuacuu

SEQ ID NO: 17006 - RNA, 22 nt, Human
auggcccaagugcccugaccug

SEQ ID NO: 17007 - RNA, 23 nt, Human
agguggagcugugcagccggggc

SEQ ID NO: 17008 - RNA, 22 nt, Human
agguggagugugcagggagagc

SEQ ID NO: 17009 - RNA, 22 nt, Human
agguggaguuaagugugaacug

SEQ ID NO: 17010 - RNA, 22 nt, Human
agguggcaaggggcgccucucu

SEQ ID NO: 17011 - RNA, 22 nt, Human
agguggcagagugacaggcuga

SEQ ID NO: 17012 - RNA, 22 nt, Human
agguggcaggaggucagagaaa

SEQ ID NO: 17013 - RNA, 22 nt, Human
agguggcaugccugagacauaa

SEQ ID NO: 17014 - RNA, 18 nt, Human
agguggccugggagcuuu

SEQ ID NO: 17015 - RNA, 23 nt, Human
agguggccuuugccucuuucucu

SEQ ID NO: 17016 - RNA, 20 nt, Human
agguggcuccugcugggggu

SEQ ID NO: 17017 - RNA, 20 nt, Human
agguggcucuuccugggcuu

SEQ ID NO: 17018 - RNA, 21 nt, Human
agguggcugcauccucagaag

SEQ ID NO: 17019 - RNA, 22 nt, Human
aggugggcacagauggagaagu

SEQ ID NO: 17020 - RNA, 22 nt, Human
aggugggcauagcuagaauauu

SEQ ID NO: 17021 - RNA, 22 nt, Human
aggugggcgcugcucccgcugg

SEQ ID NO: 17022 - RNA, 22 nt, Human
agguggggcugggaaagauucc

SEQ ID NO: 17023 - RNA, 22 nt, Human
aggugggggcuguguccuugac

SEQ ID NO: 17024 - RNA, 22 nt, Human
agguggggugagcugcagacua

SEQ ID NO: 17025 - RNA, 22 nt, Human
agguggguaucaugagagauua

SEQ ID NO: 17026 - RNA, 22 nt, Human
agguggguucccgacucuggcu

SEQ ID NO: 17027 - RNA, 19 nt, Human
agguggucuaggcuggaga

SEQ ID NO: 17028 - RNA, 21 nt, Human
agguggucugcagcagcugaa

SEQ ID NO: 17029 - RNA, 22 nt, Human
agguggucuuggcccacccagg

SEQ ID NO: 17030 - RNA, 22 nt, Human
aggugguguuugguuacaugag

SEQ ID NO: 17031 - RNA, 22 nt, Human
aggugucauuucucugcaggug

SEQ ID NO: 17032 - RNA, 22 nt, Human
agguguccaauccugguuggau

SEQ ID NO: 17033 - RNA, 20 nt, Human
agguguccacguggcagggu

SEQ ID NO: 17034 - RNA, 22 nt, Human
agguguccaggaagaugcuggc

SEQ ID NO: 17035 - RNA, 22 nt, Human
aggugucuggacuugugaagca

SEQ ID NO: 17036 - RNA, 22 nt, Human
aggugucuggauggguguccuu

SEQ ID NO: 17037 - RNA, 22 nt, Human
aggugugaagaguugacacauu

SEQ ID NO: 17038 - RNA, 19 nt, Human
aggugugggggcugcagac

SEQ ID NO: 17039 - RNA, 22 nt, Human
agguuaaaaaggauucaguuaa

SEQ ID NO: 17040 - RNA, 23 nt, Human
agguuacaguuguuaaguugcaa

SEQ ID NO: 17041 - RNA, 22 nt, Human
agguuagaauguaagaguuuca

SEQ ID NO: 17042 - RNA, 22 nt, Human
agguuagauaguuuauuagaac

SEQ ID NO: 17043 - RNA, 22 nt, Human
agguuaggaauuuggacagaga

SEQ ID NO: 17044 - RNA, 22 nt, Human
agguuaucaucaguugagcacu

SEQ ID NO: 17045 - RNA, 21 nt, Human
agguuccagcagccagagaau

SEQ ID NO: 17046 - RNA, 22 nt, Human
agguuccagggauuaggaugug

SEQ ID NO: 17047 - RNA, 22 nt, Human
agguucccaggaucugucuggg

SEQ ID NO: 17048 - RNA, 22 nt, Human
agguuccuuauggggauggcua

SEQ ID NO: 17049 - RNA, 22 nt, Human
agguucuccuuaucaaugaaga

SEQ ID NO: 17050 - RNA, 18 nt, Human
agguucugacaguccaaa

SEQ ID NO: 17051 - RNA, 22 nt, Human
agguucuuuuggccaaccucau

SEQ ID NO: 17052 - RNA, 22 nt, Human
agguugaaauagguuaucuaag

SEQ ID NO: 17053 - RNA, 22 nt, Human
agguuggccucagggaggcucu

SEQ ID NO: 17054 - RNA, 22 nt, Human
agguuuacugagggugcugguu

SEQ ID NO: 17055 - RNA, 22 nt, Human
agguuuaugauucugcacgugg

SEQ ID NO: 17056 - RNA, 21 nt, Human
agguuuauuucaacuucagga

SEQ ID NO: 17057 - RNA, 22 nt, Human
agguuucaugggagacaacuca

SEQ ID NO: 17058 - RNA, 22 nt, Human
agguuucugcagcauaguggca

SEQ ID NO: 17059 - RNA, 22 nt, Human
agguuucuggauuuauuauggc

SEQ ID NO: 17060 - RNA, 22 nt, Human
agguuucuuuaugcugcuagaa

SEQ ID NO: 17061 - RNA, 22 nt, Human
agguuuggguucauugcuggcu

SEQ ID NO: 17062 - RNA, 22 nt, Human
agguuugguuugacaagacuga

SEQ ID NO: 17063 - RNA, 23 nt, Human
agguuugucucagaggcagaguu

SEQ ID NO: 17064 - RNA, 22 nt, Human
agguuugugucuugcuuaaggu

SEQ ID NO: 17065 - RNA, 22 nt, Human
aguaaaaaguucagaaugguug

SEQ ID NO: 17066 - RNA, 22 nt, Human
aguaaaaucaccaucucuuugu

SEQ ID NO: 17067 - RNA, 22 nt, Human
aguaaaauuaauggaucagaag

SEQ ID NO: 17068 - RNA, 22 nt, Human
aguaaaauuucugcugaggaga

SEQ ID NO: 17069 - RNA, 22 nt, Human
aguaaacaauguaugaggacag

SEQ ID NO: 17070 - RNA, 22 nt, Human
aguaaacagaaagcaagaugau

SEQ ID NO: 17071 - RNA, 22 nt, Human
agucucugccagcuuguccucu

SEQ ID NO: 17072 - RNA, 22 nt, Human
agucucuggacugggagauggc

SEQ ID NO: 17073 - RNA, 22 nt, Human
agucucuuaaagacaguguuga

SEQ ID NO: 17074 - RNA, 22 nt, Human
agucucuuaaugggcagaaagu

SEQ ID NO: 17075 - RNA, 22 nt, Human
agucucuugcacauuguauuaa

SEQ ID NO: 17076 - RNA, 22 nt, Human
agucucuuuaaucacagugucu

SEQ ID NO: 17077 - RNA, 22 nt, Human
agucucuuuguggacucugccu

SEQ ID NO: 17078 - RNA, 23 nt, Human
agucugaauugagaugugcugug

SEQ ID NO: 17079 - RNA, 22 nt, Human
agucugaguaucucugagccag

SEQ ID NO: 17080 - RNA, 22 nt, Human
agucugccaagccagaucaugu

SEQ ID NO: 17081 - RNA, 22 nt, Human
agucugccuuuccaaucccgug

SEQ ID NO: 17082 - RNA, 22 nt, Human
agucuggaaaaugcauguuuca

SEQ ID NO: 17083 - RNA, 22 nt, Human
agucuggauuuagaggugggcc

SEQ ID NO: 17084 - RNA, 22 nt, Human
agucuggcuuuuugaugagcuu

SEQ ID NO: 17085 - RNA, 22 nt, Human
agucugggagggaugccagugu

SEQ ID NO: 17086 - RNA, 21 nt, Human
agucuggggaagggaucccag

SEQ ID NO: 17087 - RNA, 22 nt, Human
agucugguaaacugaaaaauau

SEQ ID NO: 17088 - RNA, 22 nt, Human
agucugguguucucacacuagu

SEQ ID NO: 17089 - RNA, 22 nt, Human
agucugucuacuuaaagucugu

SEQ ID NO: 17090 - RNA, 22 nt, Human
agucugucugucacuucugcag

SEQ ID NO: 17091 - RNA, 22 nt, Human
agucugugaaaagauaggaagu

SEQ ID NO: 17092 - RNA, 23 nt, Human
agucugugcugaagaaguuacaa

SEQ ID NO: 17093 - RNA, 19 nt, Human
agucuguggauuugugggu

SEQ ID NO: 17094 - RNA, 21 nt, Human
agucuguuaggaugacucuga

SEQ ID NO: 17095 - RNA, 22 nt, Human
agucuuaauagagaaaaacugu

SEQ ID NO: 17096 - RNA, 22 nt, Human
agucuuacaugagaaagaaccu

SEQ ID NO: 17097 - RNA, 22 nt, Human
agucuuagaacuacagugccua

SEQ ID NO: 17098 - RNA, 22 nt, Human
agucuuaggcuccauuaguaga

SEQ ID NO: 17099 - RNA, 22 nt, Human
agucuucagagaaauuaacucu

SEQ ID NO: 17100 - RNA, 22 nt, Human
agucuucauuuaguugauccag

SEQ ID NO: 17101 - RNA, 22 nt, Human
agucuucauuuguguucaagac

SEQ ID NO: 17102 - RNA, 20 nt, Human
agucuucccccagaagaggg

SEQ ID NO: 17103 - RNA, 22 nt, Human
agucuucccugugccagagugu

SEQ ID NO: 17104 - RNA, 18 nt, Human
agucuucugauccauuuu

SEQ ID NO: 17105 - RNA, 22 nt, Human
agucuugcucuugcaucugcuu

SEQ ID NO: 17106 - RNA, 22 nt, Human
agucuuggcuaugcauagagcu

SEQ ID NO: 17107 - RNA, 22 nt, Human
agucuugucuuauuuuaauaga

SEQ ID NO: 17108 - RNA, 22 nt, Human
agucuuuaaguaaugauaggca

SEQ ID NO: 17109 - RNA, 22 nt, Human
agucuuuaaugaucauguauuu

SEQ ID NO: 17110 - RNA, 22 nt, Human
agucuuuaugauugucaaagua

SEQ ID NO: 17111 - RNA, 22 nt, Human
agucuuuauucacuauugauaa

SEQ ID NO: 17112 - RNA, 19 nt, Human
agucuuucccacucgucuu

SEQ ID NO: 17113 - RNA, 22 nt, Human
agucuuuccuuuuggaagaaaa

SEQ ID NO: 17114 - RNA, 22 nt, Human
agugaaaacacuaguucuugcc

SEQ ID NO: 17115 - RNA, 22 nt, Human
agugaaauaugcccauugcugu

SEQ ID NO: 17116 - RNA, 22 nt, Human
auuccaaacagugcugcagacu

SEQ ID NO: 17117 - RNA, 22 nt, Human
auuccaaacgccucgcggacuu

SEQ ID NO: 17118 - RNA, 22 nt, Human
auuccaaagacagaagcagcug

SEQ ID NO: 17119 - RNA, 22 nt, Human
auuccaaagguuaaugcccauu

SEQ ID NO: 17120 - RNA, 22 nt, Human
auuccaauuguacuugcuuuua

SEQ ID NO: 17121 - RNA, 22 nt, Human
auuccacagaggacuccgauug

SEQ ID NO: 17122 - RNA, 22 nt, Human
auuccacagcuacaucaaucua

SEQ ID NO: 17123 - RNA, 17 nt, Human
auuccacagggaaucug

SEQ ID NO: 17124 - RNA, 22 nt, Human
auuccacaugaaaggagcugaa

SEQ ID NO: 17125 - RNA, 22 nt, Human
auuccacuccaauaagugucaa

SEQ ID NO: 17126 - RNA, 22 nt, Human
auuccacugccgaaugauacau

SEQ ID NO: 17127 - RNA, 22 nt, Human
auuccacuguuauaaaaugucc

SEQ ID NO: 17128 - RNA, 22 nt, Human
auuccacuuagugacucauuug

SEQ ID NO: 17129 - RNA, 22 nt, Human
auuccagagaaaggccuggcug

SEQ ID NO: 17130 - RNA, 23 nt, Human
auuccagagcuagagucaagugg

SEQ ID NO: 17131 - RNA, 22 nt, Human
auuccagaugcuuguauuuaaa

SEQ ID NO: 17132 - RNA, 22 nt, Human
auuccagguuguagaaaaguuu

SEQ ID NO: 17133 - RNA, 22 nt, Human
auuccagugugcaugguacaca

SEQ ID NO: 17134 - RNA, 22 nt, Human
auuccaguucuccucucuaaag

SEQ ID NO: 17135 - RNA, 22 nt, Human
auuccauucuugcuuuugaucu

SEQ ID NO: 17136 - RNA, 22 nt, Human
auucccagguaaaaguagagcu

SEQ ID NO: 17137 - RNA, 22 nt, Human
auucccuuugacgaucccuagg

SEQ ID NO: 17138 - RNA, 22 nt, Human
auuccuaaggaaggcuggcaag

SEQ ID NO: 17139 - RNA, 20 nt, Human
auuccucagccccagccuca

SEQ ID NO: 17140 - RNA, 22 nt, Human
auuccuucuaaaacgcugcccu

SEQ ID NO: 17141 - RNA, 22 nt, Human
auuccuucuauucucugugggu

SEQ ID NO: 17142 - RNA, 22 nt, Human
auuccuuggaacagaugcgaag

SEQ ID NO: 17143 - RNA, 22 nt, Human
auuccuugggcugccuuauuau

SEQ ID NO: 17144 - RNA, 22 nt, Human
auucgcacauuaacacucauau

SEQ ID NO: 17145 - RNA, 22 nt, Human
auucggaucauguguauguguu

SEQ ID NO: 17146 - RNA, 22 nt, Human
auucuaaaucagagagcucugu

SEQ ID NO: 17147 - RNA, 22 nt, Human
auucuaaauguaauuuagaauu

SEQ ID NO: 17148 - RNA, 21 nt, Human
auucuaaccaggagaggcuga

SEQ ID NO: 17149 - RNA, 20 nt, Human
auucuacaagaauaagcaug

SEQ ID NO: 17150 - RNA, 22 nt, Human
auucuacacaaagcaagaagac

SEQ ID NO: 17151 - RNA, 22 nt, Human
auucuacaccucucucauuuag

SEQ ID NO: 17152 - RNA, 22 nt, Human
auucuacagaugaaagcggcug

SEQ ID NO: 17153 - RNA, 22 nt, Human
auucuacuuuguguaauuaucu

SEQ ID NO: 17154 - RNA, 18 nt, Human
auucuagaagaugccuug

SEQ ID NO: 17155 - RNA, 22 nt, Human
auucuaguguuuccauuacaag

SEQ ID NO: 17156 - RNA, 22 nt, Human
auucuauuaauauuucuaggaa

SEQ ID NO: 17157 - RNA, 22 nt, Human
auucucaaaacauaacuucacu

SEQ ID NO: 17158 - RNA, 22 nt, Human
auucucagaucuuagaggaaua

SEQ ID NO: 17159 - RNA, 22 nt, Human
auucucagggaguauuuucuau

SEQ ID NO: 17160 - RNA, 22 nt, Human
auucucauaggagcgugaaccu

SEQ ID NO: 17161 - RNA, 22 nt, Human
auucucauuugcuggcuauaug

SEQ ID NO: 17162 - RNA, 22 nt, Human
auucuccaguagucauucuauc

SEQ ID NO: 17163 - RNA, 22 nt, Human
auucuccuuauucugaaaaaag

SEQ ID NO: 17164 - RNA, 22 nt, Human
auucucucucuaugaaaacuga

SEQ ID NO: 17165 - RNA, 20 nt, Human
auucucugcucaaguggcac

SEQ ID NO: 17166 - RNA, 22 nt, Human
auucucuggucauugagcauau

SEQ ID NO: 17167 - RNA, 22 nt, Human
auucucuguacagaagguaccg

SEQ ID NO: 17168 - RNA, 22 nt, Human
auucucugucuuuuugaaaaca

SEQ ID NO: 17169 - RNA, 22 nt, Human
auucugaaguugcaggagaagc

SEQ ID NO: 17170 - RNA, 22 nt, Human
auucugacuuucaucugccuuu

SEQ ID NO: 17171 - RNA, 22 nt, Human
auucugagaaaugcauugucag

SEQ ID NO: 17172 - RNA, 22 nt, Human
auucugaggacagagucuagca

SEQ ID NO: 17173 - RNA, 22 nt, Human
auucugaguccaugggggcagg

SEQ ID NO: 17174 - RNA, 22 nt, Human
auucugaguggaaacuaucaau

SEQ ID NO: 17175 - RNA, 21 nt, Human
auucugaguugucagucuuca

SEQ ID NO: 17176 - RNA, 22 nt, Human
auucugaugccuggguacugcc

SEQ ID NO: 17177 - RNA, 22 nt, Human
auucugcaugguggugucucug

SEQ ID NO: 17178 - RNA, 22 nt, Human
auucugcucccaggugaugcug

SEQ ID NO: 17179 - RNA, 22 nt, Human
auucugcugcacaccuuccccc

SEQ ID NO: 17180 - RNA, 22 nt, Human
auucugcugguaacucuauaaa

SEQ ID NO: 17181 - RNA, 22 nt, Human
auucugcuuaagggaggcuguc

SEQ ID NO: 17182 - RNA, 20 nt, Human
auucugcuuugaaaauaagg

SEQ ID NO: 17183 - RNA, 22 nt, Human
auucuggauauuacuuaucuau

SEQ ID NO: 17184 - RNA, 22 nt, Human
auucuggccuuggcucugucac

SEQ ID NO: 17185 - RNA, 22 nt, Human
auucugggaacuuugucucuca

SEQ ID NO: 17186 - RNA, 22 nt, Human
auucugggacuccuuccucccc

SEQ ID NO: 17187 - RNA, 22 nt, Human
auucugggaguguaggaugguu

SEQ ID NO: 17188 - RNA, 22 nt, Human
aggucaagaauugaugugguuu

SEQ ID NO: 17189 - RNA, 22 nt, Human
aggucaagaguaaauuugggua

SEQ ID NO: 17190 - RNA, 22 nt, Human
aggucaaggccaaaagaguggu

SEQ ID NO: 17191 - RNA, 22 nt, Human
aggucacauggauaaugaucag

SEQ ID NO: 17192 - RNA, 22 nt, Human
aggucagacagggugucuuucu

SEQ ID NO: 17193 - RNA, 22 nt, Human
aggucagaugggagaugggaug

SEQ ID NO: 17194 - RNA, 21 nt, Human
aggucagcccagcucuggaag

SEQ ID NO: 17195 - RNA, 22 nt, Human
aggucagcugcugauaggcagc

SEQ ID NO: 17196 - RNA, 18 nt, Human
aggucaggaaagcagagu

SEQ ID NO: 17197 - RNA, 22 nt, Human
aggucaggagguuaagagucuu

SEQ ID NO: 17198 - RNA, 22 nt, Human
aggucaugauccauuggugagu

SEQ ID NO: 17199 - RNA, 22 nt, Human
aggucauuccuugucuucuugc

SEQ ID NO: 17200 - RNA, 22 nt, Human
aggucauuguuaagucaccaua

SEQ ID NO: 17201 - RNA, 22 nt, Human
aggucauuuccuuagaggcaga

SEQ ID NO: 17202 - RNA, 20 nt, Human
agguccacugaggcugccuc

SEQ ID NO: 17203 - RNA, 22 nt, Human
agguccagacuguguacccuag

SEQ ID NO: 17204 - RNA, 22 nt, Human
agguccagaguugagauacaga

SEQ ID NO: 17205 - RNA, 22 nt, Human
agguccagcuguugcagccucc

SEQ ID NO: 17206 - RNA, 22 nt, Human
agguccaggccucaugauggcc

SEQ ID NO: 17207 - RNA, 22 nt, Human
agguccaguugccagaauggcc

SEQ ID NO: 17208 - RNA, 22 nt, Human
agguccaucguggaugaacugc

SEQ ID NO: 17209 - RNA, 22 nt, Human
agguccauggcagcggguacuu

SEQ ID NO: 17210 - RNA, 22 nt, Human
agguccugaggguucgucugca

SEQ ID NO: 17211 - RNA, 22 nt, Human
agguccuggacugcucuuguua

SEQ ID NO: 17212 - RNA, 22 nt, Human
agguccugucuuaucucuguaa

SEQ ID NO: 17213 - RNA, 19 nt, Human
aggucuaaucauaagacaa

SEQ ID NO: 17214 - RNA, 22 nt, Human
aggucucaaguugagaaggcag

SEQ ID NO: 17215 - RNA, 22 nt, Human
aggucucuaaaauagucaaacu

SEQ ID NO: 17216 - RNA, 22 nt, Human
aggucucucacacucacagggc

SEQ ID NO: 17217 - RNA, 22 nt, Human
aggucucugcagaaaguaaguc

SEQ ID NO: 17218 - RNA, 22 nt, Human
aggucugaaagccucagucaca

SEQ ID NO: 17219 - RNA, 20 nt, Human
aggucugaaugucagggcug

SEQ ID NO: 17220 - RNA, 22 nt, Human
aggucugacuucaagccugugg

SEQ ID NO: 17221 - RNA, 18 nt, Human
aggucugaggaagagccu

SEQ ID NO: 17222 - RNA, 22 nt, Human
aggucugaguauggccugagaa

SEQ ID NO: 17223 - RNA, 22 nt, Human
aggucugagucccagggguacc

SEQ ID NO: 17224 - RNA, 22 nt, Human
aggucugagucuauauacauug

SEQ ID NO: 17225 - RNA, 22 nt, Human
gcagaggcauuucugacgcugc

SEQ ID NO: 17226 - RNA, 22 nt, Human
gcagagggcagggguguuuguu

SEQ ID NO: 17227 - RNA, 22 nt, Human
gcagaggucaaauaccucauuu

SEQ ID NO: 17228 - RNA, 22 nt, Human
gcagaggucucuucaaaauaau

SEQ ID NO: 17229 - RNA, 22 nt, Human
gcagagguuggauuggugacuu

SEQ ID NO: 17230 - RNA, 23 nt, Human
gcagagguuuuucaguaugguuu

SEQ ID NO: 17231 - RNA, 23 nt, Human
gcagagucaaguagucaugagug

SEQ ID NO: 17232 - RNA, 22 nt, Human
gcagagucagccuccgagacag

SEQ ID NO: 17233 - RNA, 22 nt, Human
gcagagucugggcagccuccau

SEQ ID NO: 17234 - RNA, 22 nt, Human
gcagagucugggcuaccucuug

SEQ ID NO: 17235 - RNA, 22 nt, Human
gcagagucugguaggugcuggu

SEQ ID NO: 17236 - RNA, 22 nt, Human
gcagagugaagcauuucuuucu

SEQ ID NO: 17237 - RNA, 22 nt, Human
gcagagugaagggagaggugug

SEQ ID NO: 17238 - RNA, 18 nt, Human
gcagagugcgucucugug

SEQ ID NO: 17239 - RNA, 19 nt, Human
gcagagugggguggagggu

SEQ ID NO: 17240 - RNA, 22 nt, Human
gcagauaggguauuaggaguaa

SEQ ID NO: 17241 - RNA, 22 nt, Human
gcagaucuuuaacagggucacu

SEQ ID NO: 17242 - RNA, 20 nt, Human
gcagaugagacucacagagg

SEQ ID NO: 17243 - RNA, 22 nt, Human
gcagaugaggaagcuaaugcug

SEQ ID NO: 17244 - RNA, 19 nt, Human
gcagaugaugaggcugguc

SEQ ID NO: 17245 - RNA, 22 nt, Human
gcagaugauguagacagacagu

SEQ ID NO: 17246 - RNA, 22 nt, Human
gcagaugccagaucaugcaggg

SEQ ID NO: 17247 - RNA, 22 nt, Human
gaugguuuggaaugaaguagcu

SEQ ID NO: 17248 - RNA, 22 nt, Human
gauguaaaaccuauggagcuga

SEQ ID NO: 17249 - RNA, 22 nt, Human
gauguacuuuaaaauacuucag

SEQ ID NO: 17250 - RNA, 22 nt, Human
gauguagagggaagauuuuaaa

SEQ ID NO: 17251 - RNA, 22 nt, Human
gauguauaguauguaauuucug

SEQ ID NO: 17252 - RNA, 23 nt, Human
gauguauauaugagccgucacau

SEQ ID NO: 17253 - RNA, 22 nt, Human
gauguauauucugugccaggau

SEQ ID NO: 17254 - RNA, 22 nt, Human
gauguaucugagcugcuuaggu

SEQ ID NO: 17255 - RNA, 22 nt, Human
gaugucucucacauagaaggua

SEQ ID NO: 17256 - RNA, 22 nt, Human
gaugucugccaaagaaucaagc

SEQ ID NO: 17257 - RNA, 22 nt, Human
gaugucugugagaucaaacuaa

SEQ ID NO: 17258 - RNA, 22 nt, Human
gaugucuucagauggcaagaga

SEQ ID NO: 17259 - RNA, 22 nt, Human
gaugucuucccauguucaugug

SEQ ID NO: 17260 - RNA, 22 nt, Human
gaugucuuguugauuucauucu

SEQ ID NO: 17261 - RNA, 22 nt, Human
gaugucuuugaggcucacugcu

SEQ ID NO: 17262 - RNA, 22 nt, Human
gaugucuuugccaugcaugugu

SEQ ID NO: 17263 - RNA, 22 nt, Human
gaugugaggacucauguggagg

SEQ ID NO: 17264 - RNA, 22 nt, Human
gaugugggugucuucagcuggu

SEQ ID NO: 17265 - RNA, 22 nt, Human
gauguguagagggaauuucaaa

SEQ ID NO: 17266 - RNA, 23 nt, Human
gauguguagggaaagucagacuc

SEQ ID NO: 17267 - RNA, 22 nt, Human
gaugugucuauucaacaugaaa

SEQ ID NO: 17268 - RNA, 22 nt, Human
gaugugucuggcuccccugcaa

SEQ ID NO: 17269 - RNA, 22 nt, Human
gaugugugcugcauaguauauu

SEQ ID NO: 17270 - RNA, 22 nt, Human
gauguguuuccaggauuuguuu

SEQ ID NO: 17271 - RNA, 22 nt, Human
gauguucgagcagaagaccagg

SEQ ID NO: 17272 - RNA, 22 nt, Human
gauguuuauaucuaacuuaagu

SEQ ID NO: 17273 - RNA, 22 nt, Human
gauguuucaugcuagcaugugu

SEQ ID NO: 17274 - RNA, 22 nt, Human
gauuaacauuucuaagaugcca

SEQ ID NO: 17275 - RNA, 22 nt, Human
gauuaauucaggaucaggaaau

SEQ ID NO: 17276 - RNA, 22 nt, Human
gauuacaaaacucaucuaugac

SEQ ID NO: 17277 - RNA, 20 nt, Human
gauuacaaaaugaaaugcau

SEQ ID NO: 17278 - RNA, 22 nt, Human
gauuacugucuacuugggauag

SEQ ID NO: 17279 - RNA, 22 nt, Human
gauuagaagaacuuguuagccu

SEQ ID NO: 17280 - RNA, 22 nt, Human
gauuagaugacuaaugagcugu

SEQ ID NO: 17281 - RNA, 22 nt, Human
gauuaggagggagaggcaagua

SEQ ID NO: 17282 - RNA, 22 nt, Human
gauuaugguaacaaugauuaaa

SEQ ID NO: 17283 - RNA, 22 nt, Human
gauuauuuugugcaauaaucgg

SEQ ID NO: 17284 - RNA, 22 nt, Human
gauucaaagacagacucauuuc

SEQ ID NO: 17285 - RNA, 22 nt, Human
gauucacucauauuuuacguuu

SEQ ID NO: 17286 - RNA, 22 nt, Human
gauuccacggcucagccucaac

SEQ ID NO: 17287 - RNA, 22 nt, Human
gauuccuuuggugaacugccga

SEQ ID NO: 17288 - RNA, 22 nt, Human
gauucucuucauauggcaaagg

SEQ ID NO: 17289 - RNA, 22 nt, Human
gauucugagcugguguuuuacg

SEQ ID NO: 17290 - RNA, 22 nt, Human
gauucugcugucccuaagugcc

SEQ ID NO: 17291 - RNA, 22 nt, Human
gauucugcuuaccauuugaucu

SEQ ID NO: 17292 - RNA, 20 nt, Human
gauucugggcagucaguguc

SEQ ID NO: 17293 - RNA, 22 nt, Human
gauucuuaagacauuauguauu

SEQ ID NO: 17294 - RNA, 22 nt, Human
gauucuuuacaucucugcugac

SEQ ID NO: 17295 - RNA, 22 nt, Human
gauucuuuacucagauuuuguu

SEQ ID NO: 17296 - RNA, 21 nt, Human
gauugaaaccauggcagugag

SEQ ID NO: 17297 - RNA, 22 nt, Human
gauugagucugaggaugcugca

SEQ ID NO: 17298 - RNA, 22 nt, Human
gauugcaaaucauuacaaagga

SEQ ID NO: 17299 - RNA, 22 nt, Human
gauugcugaagaaagugaguga

SEQ ID NO: 17300 - RNA, 22 nt, Human
gauugcuggggcaggcuguagc

SEQ ID NO: 17301 - RNA, 22 nt, Human
gauugcugggucccacucccag

SEQ ID NO: 17302 - RNA, 23 nt, Human
gauugcuguaugcaggagcauuc

SEQ ID NO: 17303 - RNA, 22 nt, Human
gauuguaauucuacuuuccgcu

SEQ ID NO: 17304 - RNA, 22 nt, Human
gauuguacuuauugagcuaaac

SEQ ID NO: 17305 - RNA, 22 nt, Human
gauugucacucccuauauggua

SEQ ID NO: 17306 - RNA, 19 nt, Human
gauuuaaacguggcucuau

SEQ ID NO: 17307 - RNA, 22 nt, Human
gauuuacaaagcucucuagugu

SEQ ID NO: 17308 - RNA, 22 nt, Human
gauuuacagaucuaagggucac

SEQ ID NO: 17309 - RNA, 22 nt, Human
gauuuacagcuauacccaaugg

SEQ ID NO: 17310 - RNA, 22 nt, Human
gauuuagugcugaaaucccugg

SEQ ID NO: 17311 - RNA, 22 nt, Human
gauuuauaaagguugcacugga

SEQ ID NO: 17312 - RNA, 20 nt, Human
gauuucaaagcagaguggcc

SEQ ID NO: 17313 - RNA, 22 nt, Human
gauuucagccccgcucccagcu

SEQ ID NO: 17314 - RNA, 22 nt, Human
gauuucaggcuaucuaugcaga

SEQ ID NO: 17315 - RNA, 22 nt, Human
gauuucccuauaguuuucucuu

SEQ ID NO: 17316 - RNA, 22 nt, Human
gauuuccuugcauauugguaau

SEQ ID NO: 17317 - RNA, 22 nt, Human
gauuucuaaguuuuaccacaaa

SEQ ID NO: 17318 - RNA, 22 nt, Human
gauuucuucauucauuagaugg

SEQ ID NO: 17319 - RNA, 22 nt, Human
gauuucuugaccccugucucag

SEQ ID NO: 17320 - RNA, 22 nt, Human
gauuucuugagcaaguugcuua

SEQ ID NO: 17321 - RNA, 22 nt, Human
gauuucuugauaaguaguguga

SEQ ID NO: 17322 - RNA, 22 nt, Human
gauuucuuuagcucaucagauc

SEQ ID NO: 17323 - RNA, 22 nt, Human
gauuugacaccuggggcauaua

SEQ ID NO: 17324 - RNA, 22 nt, Human
gauuugcauucugaaagcuacc

SEQ ID NO: 17325 - RNA, 21 nt, Human
gauuuguauuauugguuccaa

SEQ ID NO: 17326 - RNA, 22 nt, Human
gauuuguuucaaguuagcaucu

SEQ ID NO: 17327 - RNA, 22 nt, Human
gauuuuacugucuguguaucuc

SEQ ID NO: 17328 - RNA, 22 nt, Human
gauuuuauagucaggaaaaaga

SEQ ID NO: 17329 - RNA, 22 nt, Human
gauuuuauuagcccaaacuuug

SEQ ID NO: 17330 - RNA, 22 nt, Human
gcaaaaaaugcuuguugcuuag

SEQ ID NO: 17331 - RNA, 22 nt, Human
gcaaaaaccacaauuacuuuug

SEQ ID NO: 17332 - RNA, 22 nt, Human
gcaaacaucuuagccauagagu

SEQ ID NO: 17333 - RNA, 22 nt, Human
gcaaacaucuuuauuuggcaag

SEQ ID NO: 17334 - RNA, 22 nt, Human
gcacauggcggccagcagguga

SEQ ID NO: 17335 - RNA, 22 nt, Human
gcacaugugagaguagaggccu

SEQ ID NO: 17336 - RNA, 22 nt, Human
gcacauguugcuaguuacuugc

SEQ ID NO: 17337 - RNA, 22 nt, Human
gcaccacuagaguagagauggu

SEQ ID NO: 17338 - RNA, 22 nt, Human
gcaccagagggggcucugcagg

SEQ ID NO: 17339 - RNA, 22 nt, Human
gcaccagcugccuucugugccc

SEQ ID NO: 17340 - RNA, 22 nt, Human
gcaccauugcugggcuaguucc

SEQ ID NO: 17341 - RNA, 22 nt, Human
gcacccagccagcaucucagag

SEQ ID NO: 17342 - RNA, 22 nt, Human
gcacccagcccagggcgugaug

SEQ ID NO: 17343 - RNA, 20 nt, Human
gcacccagcuucuuguucua

SEQ ID NO: 17344 - RNA, 22 nt, Human
gcacccagugggaugcuuagca

SEQ ID NO: 17345 - RNA, 23 nt, Human
gcaccccagaugugauuaguuag

SEQ ID NO: 17346 - RNA, 22 nt, Human
gcaccccugcgugccuucccuu

SEQ ID NO: 17347 - RNA, 19 nt, Human
gcacccuggccacucccac

SEQ ID NO: 17348 - RNA, 22 nt, Human
gcacccugucaaaauggaccaa

SEQ ID NO: 17349 - RNA, 22 nt, Human
gcacccuguuuauccugaguuc

SEQ ID NO: 17350 - RNA, 22 nt, Human
gcaccucauuuugcagguagaa

SEQ ID NO: 17351 - RNA, 22 nt, Human
gcaccugcucacacaugugacu

SEQ ID NO: 17352 - RNA, 22 nt, Human
gcaccugcuggaaucagucugu

SEQ ID NO: 17353 - RNA, 22 nt, Human
gcaccugggacccagaggcacc

SEQ ID NO: 17354 - RNA, 22 nt, Human
gcaccugggcaaggauucagag

SEQ ID NO: 17355 - RNA, 22 nt, Human
gcaccuuuggaaugaaaaguug

SEQ ID NO: 17356 - RNA, 22 nt, Human
gcaccuuuuucuaggagaaugu

SEQ ID NO: 17357 - RNA, 19 nt, Human
gcacgcuggcuugauaggg

SEQ ID NO: 17358 - RNA, 22 nt, Human
gcacggcuaauuuuuguauuuu

SEQ ID NO: 17359 - RNA, 22 nt, Human
gcacuagauucugaagcagcag

SEQ ID NO: 17360 - RNA, 22 nt, Human
gcacuagguaaguggguggcaa

SEQ ID NO: 17361 - RNA, 22 nt, Human
gcacuagucuaggugcuaagau

SEQ ID NO: 17362 - RNA, 21 nt, Human
gcacucagucacuacucaaga

SEQ ID NO: 17363 - RNA, 23 nt, Human
gcacucaucugaagcuauggugc

SEQ ID NO: 17364 - RNA, 22 nt, Human
gcagauggagacgagguuccgc

SEQ ID NO: 17365 - RNA, 22 nt, Human
gcagauggaucaccugaggucg

SEQ ID NO: 17366 - RNA, 22 nt, Human
gcagauggauguggacggcgcc

SEQ ID NO: 17367 - RNA, 22 nt, Human
gcagaugggagccccaggggag

SEQ ID NO: 17368 - RNA, 22 nt, Human
gcagauguaauggcuggagguc

SEQ ID NO: 17369 - RNA, 22 nt, Human
gcagauuacuggacugauucca

SEQ ID NO: 17370 - RNA, 19 nt, Human
gcagcaaacaaaacaggua

SEQ ID NO: 17371 - RNA, 22 nt, Human
gcagcaagaggugccaucuuga

SEQ ID NO: 17372 - RNA, 22 nt, Human
gcagcaagucuaguuuguaggc

SEQ ID NO: 17373 - RNA, 19 nt, Human
gcagcaauagaagacaaau

SEQ ID NO: 17374 - RNA, 22 nt, Human
gcagcaaucccaagucugagug

SEQ ID NO: 17375 - RNA, 22 nt, Human
gcagcacuaaugggccccagaa

SEQ ID NO: 17376 - RNA, 22 nt, Human
gcagcacugauccuaaacuuag

SEQ ID NO: 17377 - RNA, 22 nt, Human
gcagcagagaccccaggaagga

SEQ ID NO: 17378 - RNA, 17 nt, Human
gcagcagagagacccuc

SEQ ID NO: 17379 - RNA, 22 nt, Human
gcagcagauuguuuuuucaccu

SEQ ID NO: 17380 - RNA, 22 nt, Human
gcagcagcaggcgcucggccgu

SEQ ID NO: 17381 - RNA, 19 nt, Human
gcagcagcauuugguaaua

SEQ ID NO: 17382 - RNA, 22 nt, Human
gcagcagcucccuauccaggcu

SEQ ID NO: 17383 - RNA, 22 nt, Human
gcagcaggcauggccgcccugg

SEQ ID NO: 17384 - RNA, 22 nt, Human
gcagcaggucugucaaugucau

SEQ ID NO: 17385 - RNA, 22 nt, Human
gcagcaguacucaauauccugg

SEQ ID NO: 17386 - RNA, 22 nt, Human
gcagcagugcgggcagcuacag

SEQ ID NO: 17387 - RNA, 22 nt, Human
gcagcaguggcugcagguccca

SEQ ID NO: 17388 - RNA, 22 nt, Human
gcagcauacagggagaguacuc

SEQ ID NO: 17389 - RNA, 22 nt, Human
gcagcauccugggccacagucc

SEQ ID NO: 17390 - RNA, 22 nt, Human
gcagcauggaguuguggaauga

SEQ ID NO: 17391 - RNA, 21 nt, Human
gcagccacagccaccaagcua

SEQ ID NO: 17392 - RNA, 22 nt, Human
gcagccaccucccauggcgggg

SEQ ID NO: 17393 - RNA, 22 nt, Human
gcagccacugggagugcuuaua

SEQ ID NO: 17394 - RNA, 22 nt, Human
gcagccagagggggugugauca

SEQ ID NO: 17395 - RNA, 22 nt, Human
gcagccagcccuagucccacuu

SEQ ID NO: 17396 - RNA, 22 nt, Human
gcagccaggaagcccaggacac

SEQ ID NO: 17397 - RNA, 22 nt, Human
gcagccagguuugaggaccacu

SEQ ID NO: 17398 - RNA, 22 nt, Human
gcagccagugggaugagaaaga

SEQ ID NO: 17399 - RNA, 22 nt, Human
gcagcccaaaaaagagguagau

SEQ ID NO: 17400 - RNA, 22 nt, Human
gcagcccaggaggcgggagccc

SEQ ID NO: 17401 - RNA, 22 nt, Human
gcagcccagguguagcucuuug

SEQ ID NO: 17402 - RNA, 22 nt, Human
gcagcccauaacauuugaggcc

SEQ ID NO: 17403 - RNA, 22 nt, Human
gcagcccucgcuagcucucccc

SEQ ID NO: 17404 - RNA, 22 nt, Human
gcagcccucggguacucacgug

SEQ ID NO: 17405 - RNA, 22 nt, Human
gcagcccuucaggugaggggca

SEQ ID NO: 17406 - RNA, 22 nt, Human
gcagccucagggcacucagaug

SEQ ID NO: 17407 - RNA, 22 nt, Human
gcagccucugcaguucaggagg

SEQ ID NO: 17408 - RNA, 22 nt, Human
gcagcgacaggcacuggucagg

SEQ ID NO: 17409 - RNA, 22 nt, Human
gcagcgaggugaugaaauagcu

SEQ ID NO: 17410 - RNA, 21 nt, Human
gcagcgcccucugaccuugau

SEQ ID NO: 17411 - RNA, 22 nt, Human
gcagcucacagucuccgccauc

SEQ ID NO: 17412 - RNA, 22 nt, Human
gcagcucagggagagggcacca

SEQ ID NO: 17413 - RNA, 22 nt, Human
gcagcucccuugaacuucuccu

SEQ ID NO: 17414 - RNA, 22 nt, Human
gcagcuccuucaaucucaccau

SEQ ID NO: 17415 - RNA, 22 nt, Human
gcagcucuccucugugaggaac

SEQ ID NO: 17416 - RNA, 22 nt, Human
gcagcucugacaaugccuggaa

SEQ ID NO: 17417 - RNA, 22 nt, Human
gcagcucuggggcaggccugag

SEQ ID NO: 17418 - RNA, 22 nt, Human
gcagcucuucacuuacuccuuu

SEQ ID NO: 17419 - RNA, 22 nt, Human
gcagcugaaagggaucucuaca

SEQ ID NO: 17420 - RNA, 22 nt, Human
gcagcugagagaagaacagggc

SEQ ID NO: 17421 - RNA, 22 nt, Human
gcagcugcaagcacuucuggca

SEQ ID NO: 17422 - RNA, 22 nt, Human
gcagcugcaauaggcaucaagc

SEQ ID NO: 17423 - RNA, 18 nt, Human
gcagcugcaguuguagcu

SEQ ID NO: 17424 - RNA, 22 nt, Human
gcagcugccccgacugugaguc

SEQ ID NO: 17425 - RNA, 22 nt, Human
gcagcugccgugagcucacgcc

SEQ ID NO: 17426 - RNA, 22 nt, Human
gcagcugccuucagcuggaugg

SEQ ID NO: 17427 - RNA, 22 nt, Human
gcagcugcucacauucucacaa

SEQ ID NO: 17428 - RNA, 22 nt, Human
gcagcugcuggaaguuccugcc

SEQ ID NO: 17429 - RNA, 22 nt, Human
gcagcugcuggagggaggcagg

SEQ ID NO: 17430 - RNA, 22 nt, Human
gcagcuggauuucaagagggag

SEQ ID NO: 17431 - RNA, 22 nt, Human
gcagcuggccccuuuccuuguu

SEQ ID NO: 17432 - RNA, 22 nt, Human
gcagcuggcucugggaaaaacu

SEQ ID NO: 17433 - RNA, 22 nt, Human
gcagcugggacacugaggccag

SEQ ID NO: 17434 - RNA, 22 nt, Human
gcagcuggggccacacuuaggc

SEQ ID NO: 17435 - RNA, 22 nt, Human
gcagcugggucugugugggcug

SEQ ID NO: 17436 - RNA, 22 nt, Human
gcagcugguuaaugggagaauu

SEQ ID NO: 17437 - RNA, 22 nt, Human
gcagcuguaaagcagaaauagu

SEQ ID NO: 17438 - RNA, 20 nt, Human
gcagcugugcauucuuagga

SEQ ID NO: 17439 - RNA, 19 nt, Human
gcagcugugggaagagcca

SEQ ID NO: 17440 - RNA, 22 nt, Human
gcagcuguggguuccaagucua

SEQ ID NO: 17441 - RNA, 22 nt, Human
gcagcuguggugcugagauagg

SEQ ID NO: 17442 - RNA, 22 nt, Human
gcagcuguguaaugagcccaca

SEQ ID NO: 17443 - RNA, 22 nt, Human
gcccaggagguugggcugugca

SEQ ID NO: 17444 - RNA, 22 nt, Human
gcccaggauaaugcugucccug

SEQ ID NO: 17445 - RNA, 22 nt, Human
gcccaggaucugcucagaucau

SEQ ID NO: 17446 - RNA, 22 nt, Human
gcccaggauggcuggaggugcu

SEQ ID NO: 17447 - RNA, 22 nt, Human
gcccaggaugguguguaguggu

SEQ ID NO: 17448 - RNA, 22 nt, Human
gcccaggcuggagugcaguagc

SEQ ID NO: 17449 - RNA, 22 nt, Human
gcccagggcuucaaagagagaa

SEQ ID NO: 17450 - RNA, 22 nt, Human
gcccaggggaguagucaauuua

SEQ ID NO: 17451 - RNA, 22 nt, Human
gcccagggugaagugcaguugu

SEQ ID NO: 17452 - RNA, 22 nt, Human
gcccagguuggagagcaguggc

SEQ ID NO: 17453 - RNA, 22 nt, Human
gcccagguuucaucugcuccgu

SEQ ID NO: 17454 - RNA, 22 nt, Human
gcccaguaguucaagguugcag

SEQ ID NO: 17455 - RNA, 21 nt, Human
gcccagugauuucuucacagu

SEQ ID NO: 17456 - RNA, 22 nt, Human
gcccagugguaaaagcaggccu

SEQ ID NO: 17457 - RNA, 22 nt, Human
gcccaguuucagcucugccuuu

SEQ ID NO: 17458 - RNA, 22 nt, Human
gcccaugccccuccuucuggca

SEQ ID NO: 17459 - RNA, 22 nt, Human
gcccauggaaaaccuguccucu

SEQ ID NO: 17460 - RNA, 22 nt, Human
gcccauggcuucccuaggcaca

SEQ ID NO: 17461 - RNA, 22 nt, Human
gcccaugggccugaggcccuag

SEQ ID NO: 17462 - RNA, 22 nt, Human
gcccaugggcuccagaccuggg

SEQ ID NO: 17463 - RNA, 22 nt, Human
gcccauggucagggaggcaggg

SEQ ID NO: 17464 - RNA, 22 nt, Human
gcccaugguggcguucggugca

SEQ ID NO: 17465 - RNA, 22 nt, Human
gcccaugucugacagggugggg

SEQ ID NO: 17466 - RNA, 21 nt, Human
gcccaugugggagggguagaa

SEQ ID NO: 17467 - RNA, 22 nt, Human
gccccacagccugcggucucag

SEQ ID NO: 17468 - RNA, 22 nt, Human
gccccacuguggaaccuaaguc

SEQ ID NO: 17469 - RNA, 22 nt, Human
gccccagaaggggaaagccugg

SEQ ID NO: 17470 - RNA, 22 nt, Human
gccccagcagcaaugcgguuga

SEQ ID NO: 17471 - RNA, 22 nt, Human
gccccaggugguaaaccuaaga

SEQ ID NO: 17472 - RNA, 22 nt, Human
gccccagguugccugucccagg

SEQ ID NO: 17473 - RNA, 22 nt, Human
gcccccaggcucuggagaaccu

SEQ ID NO: 17474 - RNA, 22 nt, Human
gcccccucuuuggagccagcca

SEQ ID NO: 17475 - RNA, 22 nt, Human
gcccccuugaccuaaucaccuu

SEQ ID NO: 17476 - RNA, 22 nt, Human
gccccuccauccaucaccgggg

SEQ ID NO: 17477 - RNA, 22 nt, Human
gccccucccagucaggagcacu

SEQ ID NO: 17478 - RNA, 22 nt, Human
gccccucuccuugugcaccugc

SEQ ID NO: 17479 - RNA, 22 nt, Human
gccccuuccaucaugugaggac

SEQ ID NO: 17480 - RNA, 22 nt, Human
gccccuucucugaggaaccugc

SEQ ID NO: 17481 - RNA, 22 nt, Human
gccccuucuucuggagauucaa

SEQ ID NO: 17482 - RNA, 22 nt, Human
gccccuugucuccaggccccaa

SEQ ID NO: 17483 - RNA, 18 nt, Human
gcccguguggagaccaug

SEQ ID NO: 17484 - RNA, 22 nt, Human
gcccuaggcuuuugugacugcc

SEQ ID NO: 17485 - RNA, 22 nt, Human
gcccucagaaugggcucuaauc

SEQ ID NO: 17486 - RNA, 22 nt, Human
gcccucagugaccacugauuca

SEQ ID NO: 17487 - RNA, 22 nt, Human
gcccucaguggauucuuauugu

SEQ ID NO: 17488 - RNA, 19 nt, Human
gcccucaugauauucagau

SEQ ID NO: 17489 - RNA, 22 nt, Human
gcccuccaccagagcccuucuc

SEQ ID NO: 17490 - RNA, 22 nt, Human
gcccuccaccuggucucucugg

SEQ ID NO: 17491 - RNA, 22 nt, Human
gcccucucuucugcagccucca

SEQ ID NO: 17492 - RNA, 22 nt, Human
gcccucugcacagcucugagca

SEQ ID NO: 17493 - RNA, 22 nt, Human
gcccucugcuggccucaccucg

SEQ ID NO: 17494 - RNA, 22 nt, Human
gcccucuggggcacacagagga

SEQ ID NO: 17495 - RNA, 22 nt, Human
gcccucugguggccgccucggc

SEQ ID NO: 17496 - RNA, 22 nt, Human
gcccucuguguaacaauccaga

SEQ ID NO: 17497 - RNA, 22 nt, Human
gcccucuguuauugcauccuua

SEQ ID NO: 17498 - RNA, 22 nt, Human
gcccugaauaauagagugggga

SEQ ID NO: 17499 - RNA, 22 nt, Human
gcccugagaggcaaugacucuu

SEQ ID NO: 17500 - RNA, 22 nt, Human
gcccugagauucuuggauucug

SEQ ID NO: 17501 - RNA, 22 nt, Human
gcccugagcacugcugcugggg

SEQ ID NO: 17502 - RNA, 19 nt, Human
gcccugaguaagcuaggag

SEQ ID NO: 17503 - RNA, 22 nt, Human
gcccugccugucugcugggagg

SEQ ID NO: 17504 - RNA, 22 nt, Human
gcccugcucauuucacguguuu

SEQ ID NO: 17505 - RNA, 22 nt, Human
gcccugcuccaggagaauaccc

SEQ ID NO: 17506 - RNA, 22 nt, Human
gcccugcucuuuugcccaccca

SEQ ID NO: 17507 - RNA, 22 nt, Human
gcccugcugcuggcagaggcgc

SEQ ID NO: 17508 - RNA, 22 nt, Human
gcccugcuuggucauggccuuc

SEQ ID NO: 17509 - RNA, 22 nt, Human
gcccuggacagugacggugacc

SEQ ID NO: 17510 - RNA, 22 nt, Human
gcccuggagggccagcgacugg

SEQ ID NO: 17511 - RNA, 22 nt, Human
gcccuggauggcaggagccauc

SEQ ID NO: 17512 - RNA, 22 nt, Human
gcccuggccuggcgcguuguca

SEQ ID NO: 17513 - RNA, 22 nt, Human
gcccuggccuucaucucagaca

SEQ ID NO: 17514 - RNA, 22 nt, Human
gcccugggauuggguggaggcu

SEQ ID NO: 17515 - RNA, 22 nt, Human
gcccugggcucccugcuccaca

SEQ ID NO: 17516 - RNA, 18 nt, Human
gcccugguggagcuggug

SEQ ID NO: 17517 - RNA, 22 nt, Human
gcccuggugugcccagcauggg

SEQ ID NO: 17518 - RNA, 22 nt, Human
guggcccuuuguuuugauaccu

SEQ ID NO: 17519 - RNA, 22 nt, Human
guggccguguaacuugaguaca

SEQ ID NO: 17520 - RNA, 22 nt, Human
guggccucaugucuauaaagag

SEQ ID NO: 17521 - RNA, 22 nt, Human
guggccuccuccguccgccucu

SEQ ID NO: 17522 - RNA, 19 nt, Human
guggccucggagcgcgcgg

SEQ ID NO: 17523 - RNA, 22 nt, Human
guggccucugugcuccugccua

SEQ ID NO: 17524 - RNA, 22 nt, Human
guggccugccgugugguauggg

SEQ ID NO: 17525 - RNA, 22 nt, Human
guggccuggcuggcaccaccuc

SEQ ID NO: 17526 - RNA, 22 nt, Human
guggccugucagaagccguggg

SEQ ID NO: 17527 - RNA, 22 nt, Human
guggccuuaagaaacaaacaac

SEQ ID NO: 17528 - RNA, 22 nt, Human
guggccuuggcuucuacccuga

SEQ ID NO: 17529 - RNA, 22 nt, Human
guggccuugggcacugaccuug

SEQ ID NO: 17530 - RNA, 22 nt, Human
guggcgaggggagguccuggcg

SEQ ID NO: 17531 - RNA, 22 nt, Human
guggcgcagaggguggcagaga

SEQ ID NO: 17532 - RNA, 22 nt, Human
guggcuauauuugaggauacgu

SEQ ID NO: 17533 - RNA, 22 nt, Human
guggcucaucuuugggaaguaa

SEQ ID NO: 17534 - RNA, 22 nt, Human
guggcucuguaaaaugccugca

SEQ ID NO: 17535 - RNA, 22 nt, Human
guggcugagcagcagagagcug

SEQ ID NO: 17536 - RNA, 17 nt, Human
guggcugcacacacaug

SEQ ID NO: 17537 - RNA, 22 nt, Human
guggcugcagcggcuguggaga

SEQ ID NO: 17538 - RNA, 22 nt, Human
guggcugcuaagucuccuuccu

SEQ ID NO: 17539 - RNA, 22 nt, Human
guggcugcucgggcuccggccc

SEQ ID NO: 17540 - RNA, 22 nt, Human
guggcugguuuccugcaugcaa

SEQ ID NO: 17541 - RNA, 22 nt, Human
guggcuguucuugccccaugcu

SEQ ID NO: 17542 - RNA, 22 nt, Human
guggcuucaccccaguugucuc

SEQ ID NO: 17543 - RNA, 22 nt, Human
guggcuucaugaacacugauga

SEQ ID NO: 17544 - RNA, 22 nt, Human
guggcuuccaugugcaucugac

SEQ ID NO: 17545 - RNA, 22 nt, Human
guggcuugaccaucccugcuac

SEQ ID NO: 17546 - RNA, 22 nt, Human
guggcuuuggaauuguagacuc

SEQ ID NO: 17547 - RNA, 22 nt, Human
guggcuuuguuuccaaaugaaa

SEQ ID NO: 17548 - RNA, 19 nt, Human
gugggacagacauuacaua

SEQ ID NO: 17549 - RNA, 22 nt, Human
gugggacagcuggagggucccu

SEQ ID NO: 17550 - RNA, 22 nt, Human
gugggagaagcccuguucguag

SEQ ID NO: 17551 - RNA, 22 nt, Human
gugggagagaccccgcuuaggg

SEQ ID NO: 17552 - RNA, 22 nt, Human
gccucagaaaguggcagguagg

SEQ ID NO: 17553 - RNA, 22 nt, Human
gccucagagggcagggugguga

SEQ ID NO: 17554 - RNA, 22 nt, Human
gccucagguaaaacuugaguuu

SEQ ID NO: 17555 - RNA, 20 nt, Human
gccucagucacauggccuac

SEQ ID NO: 17556 - RNA, 22 nt, Human
gccucagugauaugugggacaa

SEQ ID NO: 17557 - RNA, 22 nt, Human
gccucaguggcuuuaggaguuc

SEQ ID NO: 17558 - RNA, 22 nt, Human
gccucaguugaucugugugagc

SEQ ID NO: 17559 - RNA, 23 nt, Human
gccuccaaaccucuaggcuggug

SEQ ID NO: 17560 - RNA, 22 nt, Human
gccuccacuuuugcuggcuucu

SEQ ID NO: 17561 - RNA, 22 nt, Human
gccuccccaaagugcugacagc

SEQ ID NO: 17562 - RNA, 22 nt, Human
gccucccuccaccacugcaggu

SEQ ID NO: 17563 - RNA, 22 nt, Human
gccucccuggcccacagcagcg

SEQ ID NO: 17564 - RNA, 18 nt, Human
gccucccuggcuacacuu

SEQ ID NO: 17565 - RNA, 22 nt, Human
gccuccggagucacagugucuu

SEQ ID NO: 17566 - RNA, 22 nt, Human
gccuccuggauuuuagugccau

SEQ ID NO: 17567 - RNA, 22 nt, Human
gccuccuggccuuugcuccuca

SEQ ID NO: 17568 - RNA, 22 nt, Human
gccuccuggguucaugccauuc

SEQ ID NO: 17569 - RNA, 22 nt, Human
gccucgaggcugagaaggcaca

SEQ ID NO: 17570 - RNA, 22 nt, Human
gccucuccgagccacugccucu

SEQ ID NO: 17571 - RNA, 19 nt, Human
gccucugagggcaggacac

SEQ ID NO: 17572 - RNA, 22 nt, Human
gccucugaguuuggagaagagc

SEQ ID NO: 17573 - RNA, 22 nt, Human
gccucugcaauuacauugugcc

SEQ ID NO: 17574 - RNA, 22 nt, Human
gccucugcaccaguacugugcc

SEQ ID NO: 17575 - RNA, 23 nt, Human
gccucugcagccuaguuaguguc

SEQ ID NO: 17576 - RNA, 22 nt, Human
gccucugcaucaucacuccagc

SEQ ID NO: 17577 - RNA, 22 nt, Human
gccucugccaagggggcugcgg

SEQ ID NO: 17578 - RNA, 22 nt, Human
gccucugcccauccaccaucag

SEQ ID NO: 17579 - RNA, 22 nt, Human
gccucugcccuccugggacugc

SEQ ID NO: 17580 - RNA, 22 nt, Human
gccucugcggagcuguacauca

SEQ ID NO: 17581 - RNA, 22 nt, Human
gccucugcggggcccgagcccg

SEQ ID NO: 17582 - RNA, 23 nt, Human
gccucugcucugcguuggggacu

SEQ ID NO: 17583 - RNA, 17 nt, Human
gccucugcuugugucau

SEQ ID NO: 17584 - RNA, 22 nt, Human
gccucuggaagugggaaggggu

SEQ ID NO: 17585 - RNA, 22 nt, Human
gccucuggcuucugcaucagug

SEQ ID NO: 17586 - RNA, 22 nt, Human
gccucuggggcagcugagucau

SEQ ID NO: 17587 - RNA, 22 nt, Human
gccucugggggcucagaccugu

SEQ ID NO: 17588 - RNA, 22 nt, Human
gccucuguaggagugagagcau

SEQ ID NO: 17589 - RNA, 22 nt, Human
gccucugucauagcucauguga

SEQ ID NO: 17590 - RNA, 22 nt, Human
gccugaaggagucagagagggc

SEQ ID NO: 17591 - RNA, 22 nt, Human
gccugaaguuucaugccucuau

SEQ ID NO: 17592 - RNA, 22 nt, Human
gccugagagacccauggggcaa

SEQ ID NO: 17593 - RNA, 22 nt, Human
gccugagagucuccagaccuug

SEQ ID NO: 17594 - RNA, 22 nt, Human
gccugagaucaggagaaagcca

SEQ ID NO: 17595 - RNA, 22 nt, Human
gccugagcaggcguggaccaug

SEQ ID NO: 17596 - RNA, 22 nt, Human
gccugaggaauugaggggguaa

SEQ ID NO: 17597 - RNA, 18 nt, Human
gccugagggucaagugug

SEQ ID NO: 17598 - RNA, 22 nt, Human
gccugagugcaucugcagacau

SEQ ID NO: 17599 - RNA, 22 nt, Human
gccugaucagguccucggcaua

SEQ ID NO: 17600 - RNA, 22 nt, Human
gccugaugagcuuccagcugag

SEQ ID NO: 17601 - RNA, 21 nt, Human
gccugcacacaguaggugcac

SEQ ID NO: 17602 - RNA, 22 nt, Human
gccugcacucaaacacucucuu

SEQ ID NO: 17603 - RNA, 22 nt, Human
gccugcagaacugugaggcaau

SEQ ID NO: 17604 - RNA, 22 nt, Human
gccugcagcaugcuaggucuug

SEQ ID NO: 17605 - RNA, 22 nt, Human
gccugcagccagggaguucucu

SEQ ID NO: 17606 - RNA, 22 nt, Human
gccugcagccccucugcaguag

SEQ ID NO: 17607 - RNA, 22 nt, Human
gccugcaguucugugcuaggca

SEQ ID NO: 17608 - RNA, 22 nt, Human
gccugccaaaagaagcugcugg

SEQ ID NO: 17609 - RNA, 21 nt, Human
gccugccccauguuucuguug

SEQ ID NO: 17610 - RNA, 22 nt, Human
gccugccccuuccugggcaggg

SEQ ID NO: 17611 - RNA, 22 nt, Human
gccugccucaaaaucccaguuc

SEQ ID NO: 17612 - RNA, 21 nt, Human
gccugccugcgugacccucuu

SEQ ID NO: 17613 - RNA, 22 nt, Human
gccugcucuccggaucccugau

SEQ ID NO: 17614 - RNA, 22 nt, Human
gccugcucuggaauccauguaa

SEQ ID NO: 17615 - RNA, 22 nt, Human
gccugcuggacauuggccggcc

SEQ ID NO: 17616 - RNA, 22 nt, Human
gccugcuggaggagccucaggg

SEQ ID NO: 17617 - RNA, 22 nt, Human
gccugcuggaucaagcuuaugc

SEQ ID NO: 17618 - RNA, 22 nt, Human
gccugcuggauguggccaggcc

SEQ ID NO: 17619 - RNA, 22 nt, Human
gccugcuggcuguccauugcag

SEQ ID NO: 17620 - RNA, 21 nt, Human
gccugcuguucacccugccac

SEQ ID NO: 17621 - RNA, 22 nt, Human
gccugcuguugagggaagagcu

SEQ ID NO: 17622 - RNA, 22 nt, Human
gccugcuucucagucagcuugg

SEQ ID NO: 17623 - RNA, 22 nt, Human
gccugcuuuaagucuguugccu

SEQ ID NO: 17624 - RNA, 22 nt, Human
gccuggaaucaugcagggguua

SEQ ID NO: 17625 - RNA, 22 nt, Human
gccuggagaauuaaaaggaagg

SEQ ID NO: 17626 - RNA, 22 nt, Human
gccuggagacagcagaggcggc

SEQ ID NO: 17627 - RNA, 22 nt, Human
gccuggagcagacgugucccgg

SEQ ID NO: 17628 - RNA, 22 nt, Human
gccuggagcucggcugagggcg

SEQ ID NO: 17629 - RNA, 22 nt, Human
gccuggaggggccaggguggua

SEQ ID NO: 17630 - RNA, 22 nt, Human
gccuggaggguugagguuuugu

SEQ ID NO: 17631 - RNA, 22 nt, Human
gccuggaguuguggugaagcca

SEQ ID NO: 17632 - RNA, 22 nt, Human
gccuggcaaggcccuguugacu

SEQ ID NO: 17633 - RNA, 22 nt, Human
gccuggcacaggaauuaggagg

SEQ ID NO: 17634 - RNA, 22 nt, Human
gccuggcacugggcuccuggcc

SEQ ID NO: 17635 - RNA, 22 nt, Human
guguccugcacagcaccuugca

SEQ ID NO: 17636 - RNA, 22 nt, Human
guguccugguuccuuguggcug

SEQ ID NO: 17637 - RNA, 22 nt, Human
guguccuuaugcauaccagagu

SEQ ID NO: 17638 - RNA, 22 nt, Human
gugucgugcuugccauggguac

SEQ ID NO: 17639 - RNA, 22 nt, Human
gugucuacugaucugauucaga

SEQ ID NO: 17640 - RNA, 22 nt, Human
gugucucuuagccugcuaaugc

SEQ ID NO: 17641 - RNA, 22 nt, Human
gugucugccuuuggacuaacug

SEQ ID NO: 17642 - RNA, 19 nt, Human
gugucugccuuugugccac

SEQ ID NO: 17643 - RNA, 22 nt, Human
gugucugcugcacccucacacc

SEQ ID NO: 17644 - RNA, 20 nt, Human
gugucuggaguacuagagag

SEQ ID NO: 17645 - RNA, 22 nt, Human
gugucugugucauuacuaauag

SEQ ID NO: 17646 - RNA, 22 nt, Human
gugucuguuauacagaggagac

SEQ ID NO: 17647 - RNA, 22 nt, Human
gugucuuaggguugcacagagu

SEQ ID NO: 17648 - RNA, 22 nt, Human
gugugacccaaggacacucucu

SEQ ID NO: 17649 - RNA, 22 nt, Human
gugugaccucaucuuaacugga

SEQ ID NO: 17650 - RNA, 22 nt, Human
gugugagagcaaaacugcagga

SEQ ID NO: 17651 - RNA, 22 nt, Human
gugugagccaugauguguccag

SEQ ID NO: 17652 - RNA, 22 nt, Human
gugugcaacuuucauuaauauu

SEQ ID NO: 17653 - RNA, 22 nt, Human
gugugcacagagcuccaguguu

SEQ ID NO: 17654 - RNA, 22 nt, Human
gugugcagaacagggagugggu

SEQ ID NO: 17655 - RNA, 22 nt, Human
gugugcagaagacacaagacau

SEQ ID NO: 17656 - RNA, 22 nt, Human
gugugcagaggcaggaggugcu

SEQ ID NO: 17657 - RNA, 22 nt, Human
gugugcaggccacaggccaggg

SEQ ID NO: 17658 - RNA, 22 nt, Human
gugugcagggaugagugcaggu

SEQ ID NO: 17659 - RNA, 22 nt, Human
gugugcagucugcuaggcaggg

SEQ ID NO: 17660 - RNA, 22 nt, Human
gugugcaucuuuucugcuugau

SEQ ID NO: 17661 - RNA, 22 nt, Human
gcucugguuaaaaagaauuaaa

SEQ ID NO: 17662 - RNA, 22 nt, Human
gcucuguaccugcggagaugag

SEQ ID NO: 17663 - RNA, 21 nt, Human
gcucugucccugcuguguguc

SEQ ID NO: 17664 - RNA, 20 nt, Human
gcucugucuggccuacuuuu

SEQ ID NO: 17665 - RNA, 21 nt, Human
gcucugugaaauuucaccagg

SEQ ID NO: 17666 - RNA, 22 nt, Human
gcucugugaccuuaggcaaguu

SEQ ID NO: 17667 - RNA, 18 nt, Human
gcucugugaccuugagca

SEQ ID NO: 17668 - RNA, 22 nt, Human
gcucugugcuagaacuaagaau

SEQ ID NO: 17669 - RNA, 20 nt, Human
gcucugugcuggcggaggcu

SEQ ID NO: 17670 - RNA, 22 nt, Human
gcucuguggcaggaggucuugu

SEQ ID NO: 17671 - RNA, 20 nt, Human
gcucugugguuugagucucc

SEQ ID NO: 17672 - RNA, 22 nt, Human
gcucuguguccacagcuggaaa

SEQ ID NO: 17673 - RNA, 22 nt, Human
gcucuguguucccuccaggcuc

SEQ ID NO: 17674 - RNA, 22 nt, Human
gcucuucauucucccaaauagg

SEQ ID NO: 17675 - RNA, 22 nt, Human
gcucuuccauuucucuugaacu

SEQ ID NO: 17676 - RNA, 22 nt, Human
gcucuucuaaagaauguacagg

SEQ ID NO: 17677 - RNA, 21 nt, Human
gcucuugaauaagcauaauaa

SEQ ID NO: 17678 - RNA, 22 nt, Human
gcugaggcuccucgggaggaca

SEQ ID NO: 17679 - RNA, 22 nt, Human
gcugaggcugggagcagccugu

SEQ ID NO: 17680 - RNA, 19 nt, Human
gcugagggccacccagccc

SEQ ID NO: 17681 - RNA, 23 nt, Human
gcugagguccugcugaguggugg

SEQ ID NO: 17682 - RNA, 19 nt, Human
gcugagguggaggaaggag

SEQ ID NO: 17683 - RNA, 22 nt, Human
gcugagguuuucugccugcuca

SEQ ID NO: 17684 - RNA, 22 nt, Human
gcugaguauacagacuauguua

SEQ ID NO: 17685 - RNA, 22 nt, Human
gcugagucagauugcagucuug

SEQ ID NO: 17686 - RNA, 22 nt, Human
gcugagugagguccagagcuug

SEQ ID NO: 17687 - RNA, 22 nt, Human
gcugagugauugauauuuuagu

SEQ ID NO: 17688 - RNA, 17 nt, Human
gcugagugcagggaguc

SEQ ID NO: 17689 - RNA, 22 nt, Human
gcugauagacugaauguuggga

SEQ ID NO: 17690 - RNA, 23 nt, Human
gcugauggagacuuguggccucc

SEQ ID NO: 17691 - RNA, 22 nt, Human
gcugauguuuaguugauguuac

SEQ ID NO: 17692 - RNA, 22 nt, Human
gcugauguuucaaguauagcuu

SEQ ID NO: 17693 - RNA, 22 nt, Human
gcugcaaaccugccaccuggug

SEQ ID NO: 17694 - RNA, 22 nt, Human
gcugcaagcaugucauccucac

SEQ ID NO: 17695 - RNA, 22 nt, Human
gcugcaaguccuucccucucuu

SEQ ID NO: 17696 - RNA, 22 nt, Human
gcugcaaguuaguauacauucu

SEQ ID NO: 17697 - RNA, 22 nt, Human
gcugcacuugagccugggagaa

SEQ ID NO: 17698 - RNA, 22 nt, Human
gcugcagacuucucaucucauu

SEQ ID NO: 17699 - RNA, 22 nt, Human
gcugcagccaaauucauuguca

SEQ ID NO: 17700 - RNA, 22 nt, Human
gcugcagcccugcggaucacuu

SEQ ID NO: 17701 - RNA, 23 nt, Human
gcugcagcuguggauguucucag

SEQ ID NO: 17702 - RNA, 22 nt, Human
gcugcagcuuuaggauccagug

SEQ ID NO: 17703 - RNA, 22 nt, Human
gcugcaggagauuuugagaguc

SEQ ID NO: 17704 - RNA, 22 nt, Human
gcugcaggaugaggcucugcuc

SEQ ID NO: 17705 - RNA, 22 nt, Human
gcugcagguuugucuagucugg

SEQ ID NO: 17706 - RNA, 22 nt, Human
gcugcauggagggugcccagga

SEQ ID NO: 17707 - RNA, 22 nt, Human
gcugccaauccagcugugggag

SEQ ID NO: 17708 - RNA, 22 nt, Human
gcugccacauuuucaggacuaa

SEQ ID NO: 17709 - RNA, 19 nt, Human
gcugccaggacaguuacug

SEQ ID NO: 17710 - RNA, 22 nt, Human
gcugccagggaggugguggagg

SEQ ID NO: 17711 - RNA, 21 nt, Human
gcugcccaacccugcaucucc

SEQ ID NO: 17712 - RNA, 22 nt, Human
gcugcccacagcggguguuucg

SEQ ID NO: 17713 - RNA, 22 nt, Human
gcugcccaggaagccugggguu

SEQ ID NO: 17714 - RNA, 22 nt, Human
gcugcccaggcaacauugacuu

SEQ ID NO: 17715 - RNA, 22 nt, Human
gcugcccauuccacuggauggu

SEQ ID NO: 17716 - RNA, 22 nt, Human
gcugcccauugcucucccacuc

SEQ ID NO: 17717 - RNA, 22 nt, Human
gcugccccagcugggggcugga

SEQ ID NO: 17718 - RNA, 22 nt, Human
gcugccccccggacucggcggg

SEQ ID NO: 17719 - RNA, 22 nt, Human
gcugccccgagccauccuucag

SEQ ID NO: 17720 - RNA, 22 nt, Human
gcugcccuagaaguacagagag

SEQ ID NO: 17721 - RNA, 22 nt, Human
gcugcccuccaguucccacagu

SEQ ID NO: 17722 - RNA, 22 nt, Human
gcugcccucucuggccccacac

SEQ ID NO: 17723 - RNA, 22 nt, Human
gcugcccugccucagacuccuc

SEQ ID NO: 17724 - RNA, 21 nt, Human
gcugcccuggcucagcauuca

SEQ ID NO: 17725 - RNA, 22 nt, Human
gcugcccugucugcagcaggac

SEQ ID NO: 17726 - RNA, 22 nt, Human
gcugccgacccacagggguuaa

SEQ ID NO: 17727 - RNA, 22 nt, Human
gcugccucccccauggcuggaa

SEQ ID NO: 17728 - RNA, 22 nt, Human
gcugccuccgccggcuccacag

SEQ ID NO: 17729 - RNA, 22 nt, Human
gcugccuccugaaagcgcucug

SEQ ID NO: 17730 - RNA, 22 nt, Human
gcugccugaaugaaccuuguuc

SEQ ID NO: 17731 - RNA, 22 nt, Human
gcugccugaucauacaccaggg

SEQ ID NO: 17732 - RNA, 22 nt, Human
gcugccugauguccagcaggac

SEQ ID NO: 17733 - RNA, 22 nt, Human
gcugccugcaguguuuucccag

SEQ ID NO: 17734 - RNA, 18 nt, Human
gcugccugcauuccucac

SEQ ID NO: 17735 - RNA, 21 nt, Human
gcugccugccccucgggggcu

SEQ ID NO: 17736 - RNA, 22 nt, Human
gcugccugcccugggucaucug

SEQ ID NO: 17737 - RNA, 22 nt, Human
gcugccugcucggcuccuggga

SEQ ID NO: 17738 - RNA, 22 nt, Human
gcugccuggagaggcagggaug

SEQ ID NO: 17739 - RNA, 22 nt, Human
gcugccuggauuugcaauccuc

SEQ ID NO: 17740 - RNA, 22 nt, Human
gcugccugggcuggcauuccca

SEQ ID NO: 17741 - RNA, 22 nt, Human
gcugccugucugcugacccagg

SEQ ID NO: 17742 - RNA, 19 nt, Human
gcugccugucuuagccagu

SEQ ID NO: 17743 - RNA, 22 nt, Human
gcugccuugaacauccuaagua

SEQ ID NO: 17744 - RNA, 20 nt, Human
gcugccuuggauggcuacac

SEQ ID NO: 17745 - RNA, 22 nt, Human
gcugccuuuuaaagccucgcuu

SEQ ID NO: 17746 - RNA, 18 nt, Human
gcugcgugggaugugacc

SEQ ID NO: 17747 - RNA, 22 nt, Human
gcugcuaagcguuucuguucca

SEQ ID NO: 17748 - RNA, 20 nt, Human
gcugcucuccacggucugca

SEQ ID NO: 17749 - RNA, 22 nt, Human
gcugcucuccauggccgugagu

SEQ ID NO: 17750 - RNA, 22 nt, Human
gcugcucugugacagccuccgg

SEQ ID NO: 17751 - RNA, 22 nt, Human
gcugcugagaauugcaggcaag

SEQ ID NO: 17752 - RNA, 22 nt, Human
gcugcugcaagagccagcucuu

SEQ ID NO: 17753 - RNA, 22 nt, Human
gcugcugcaugaacagcgguca

SEQ ID NO: 17754 - RNA, 22 nt, Human
gcugcugcgcuugucuacuguu

SEQ ID NO: 17755 - RNA, 22 nt, Human
gcugcuggaacaaaucacccca

SEQ ID NO: 17756 - RNA, 22 nt, Human
gcugcuggagagcgagacuguu

SEQ ID NO: 17757 - RNA, 22 nt, Human
gcugcuggcuuccugcuguuuu

SEQ ID NO: 17758 - RNA, 22 nt, Human
gcugcugguccucagagcucau

SEQ ID NO: 17759 - RNA, 22 nt, Human
gcugcuguacuuggggggugcu

SEQ ID NO: 17760 - RNA, 22 nt, Human
gcugcugucacccacaucuguc

SEQ ID NO: 17761 - RNA, 22 nt, Human
gcugcugucagcaggccuuguu

SEQ ID NO: 17762 - RNA, 22 nt, Human
gcugcugucagugguggcaguu

SEQ ID NO: 17763 - RNA, 22 nt, Human
gcugcugugaauuuuuuaaaug

SEQ ID NO: 17764 - RNA, 22 nt, Human
gcugcugugccccaucugcaga

SEQ ID NO: 17765 - RNA, 22 nt, Human
gcugcugugccuggcguccugu

SEQ ID NO: 17766 - RNA, 22 nt, Human
gcugcuguuccuccaguggauc

SEQ ID NO: 17767 - RNA, 22 nt, Human
gcugcuuccuagaaggcccagu

SEQ ID NO: 17768 - RNA, 22 nt, Human
gcugcuuuagaauugaaacaga

SEQ ID NO: 17769 - RNA, 22 nt, Human
gcugcuuucuguuaggaauugg

SEQ ID NO: 17770 - RNA, 23 nt, Human
uacugccuggggccagagagcgg

SEQ ID NO: 17771 - RNA, 22 nt, Human
uacugcugagcuggguagaagg

SEQ ID NO: 17772 - RNA, 22 nt, Human
uacugcuucacccuugagucuu

SEQ ID NO: 17773 - RNA, 22 nt, Human
uacugcuuguuagcuguauuug

SEQ ID NO: 17774 - RNA, 22 nt, Human
uacuggacacguauauauagau

SEQ ID NO: 17775 - RNA, 23 nt, Human
uacugggcagcugcucugacacc

SEQ ID NO: 17776 - RNA, 21 nt, Human
uacuguagccuugcacuguag

SEQ ID NO: 17777 - RNA, 22 nt, Human
uacuguauaugcuuguaucuga

SEQ ID NO: 17778 - RNA, 22 nt, Human
uacuguaugaauuauguuauuu

SEQ ID NO: 17779 - RNA, 22 nt, Human
uacuguauuguuggcucuuuug

SEQ ID NO: 17780 - RNA, 22 nt, Human
uacugucugcuucuuauagcuu

SEQ ID NO: 17781 - RNA, 22 nt, Human
uacugucuggcaauuaagaauc

SEQ ID NO: 17782 - RNA, 22 nt, Human
uacugucuggguucccaagcaa

SEQ ID NO: 17783 - RNA, 22 nt, Human
uacugugacagaguacuuaaac

SEQ ID NO: 17784 - RNA, 22 nt, Human
uacugugcaaaaaugaauauug

SEQ ID NO: 17785 - RNA, 22 nt, Human
uacuguuaauguuaaauucagg

SEQ ID NO: 17786 - RNA, 18 nt, Human
uacuguuuaauugauuac

SEQ ID NO: 17787 - RNA, 22 nt, Human
uacuguuuccugaagcagaugc

SEQ ID NO: 17788 - RNA, 22 nt, Human
uacuguuuucuauaauggcugu

SEQ ID NO: 17789 - RNA, 22 nt, Human
uacuguuuuuaaaauugcaucc

SEQ ID NO: 17790 - RNA, 22 nt, Human
uacuguuuuuuagacucauggu

SEQ ID NO: 17791 - RNA, 22 nt, Human
uacuuaaaaauuaucaaagugg

SEQ ID NO: 17792 - RNA, 22 nt, Human
uacuuacacagcuguagaaggu

SEQ ID NO: 17793 - RNA, 22 nt, Human
gcucuugauuuccaggagcuag

SEQ ID NO: 17794 - RNA, 21 nt, Human
gcucuuggaaggggcucagcu

SEQ ID NO: 17795 - RNA, 22 nt, Human
gcucuuugcacagcucugcccu

SEQ ID NO: 17796 - RNA, 20 nt, Human
gcucuuuguaagggaauuug

SEQ ID NO: 17797 - RNA, 22 nt, Human
gcugaaaaauagugucguguuu

SEQ ID NO: 17798 - RNA, 22 nt, Human
gcugaaaugaaaacacaggucg

SEQ ID NO: 17799 - RNA, 22 nt, Human
gcugaaaugggcacugaaggcc

SEQ ID NO: 17800 - RNA, 22 nt, Human
gcugaaaugucuuuagcagugu

SEQ ID NO: 17801 - RNA, 19 nt, Human
gcugaacaagucagcaacc

SEQ ID NO: 17802 - RNA, 22 nt, Human
gcugaacuacaugaaguugccg

SEQ ID NO: 17803 - RNA, 22 nt, Human
gcugaagagagaugcguccagc

SEQ ID NO: 17804 - RNA, 22 nt, Human
gcugaagaugcaucccuucucu

SEQ ID NO: 17805 - RNA, 22 nt, Human
gcugaagcagauccaggugugg

SEQ ID NO: 17806 - RNA, 22 nt, Human
gcugaagcugacacauagugcu

SEQ ID NO: 17807 - RNA, 22 nt, Human
gcugaaggcccggaggacaggg

SEQ ID NO: 17808 - RNA, 22 nt, Human
gcugaagucugagaauuugcaa

SEQ ID NO: 17809 - RNA, 22 nt, Human
gcugaauaauguguaaugucuc

SEQ ID NO: 17810 - RNA, 22 nt, Human
gcugaauaauucuuuguugugg

SEQ ID NO: 17811 - RNA, 22 nt, Human
gcugaauaggcacagagggcau

SEQ ID NO: 17812 - RNA, 22 nt, Human
gcugaauaggggucccaaagau

SEQ ID NO: 17813 - RNA, 23 nt, Human
gcugaauguaauguucuuugggu

SEQ ID NO: 17814 - RNA, 18 nt, Human
gcugaaugucugcuuugc

SEQ ID NO: 17815 - RNA, 22 nt, Human
gcugacaaacaaggugguguca

SEQ ID NO: 17816 - RNA, 22 nt, Human
gcugaccugcucucagcagaga

SEQ ID NO: 17817 - RNA, 22 nt, Human
gcugacugauggacacagcacc

SEQ ID NO: 17818 - RNA, 23 nt, Human
gcugacugugaaauucuggagcu

SEQ ID NO: 17819 - RNA, 20 nt, Human
gcugacuguuuggguggcgg

SEQ ID NO: 17820 - RNA, 22 nt, Human
gcugacuuugccugucuuuagc

SEQ ID NO: 17821 - RNA, 22 nt, Human
gcugagacugacaugaagaggu

SEQ ID NO: 17822 - RNA, 22 nt, Human
gcugagacuuccacugccaucu

SEQ ID NO: 17823 - RNA, 22 nt, Human
gcugagagcggccagcugggaa

SEQ ID NO: 17824 - RNA, 22 nt, Human
gcugagaggcagccagacccuc

SEQ ID NO: 17825 - RNA, 18 nt, Human
gcugagcaaauuccuccc

SEQ ID NO: 17826 - RNA, 22 nt, Human
gcugagcacaccuaggguagag

SEQ ID NO: 17827 - RNA, 22 nt, Human
gcugagccuagcugucuccugu

SEQ ID NO: 17828 - RNA, 22 nt, Human
gcugagcuagaaaaggaccaca

SEQ ID NO: 17829 - RNA, 22 nt, Human
gcugagcugcuguucauccugc

SEQ ID NO: 17830 - RNA, 22 nt, Human
gcugaggacaucauggaaggaa

SEQ ID NO: 17831 - RNA, 22 nt, Human
gcugaggcaaaccaagaaugua

SEQ ID NO: 17832 - RNA, 22 nt, Human
gcugaggcaagauuugaaccca

SEQ ID NO: 17833 - RNA, 22 nt, Human
gcugaggcggaaggauugcuag

SEQ ID NO: 17834 - RNA, 22 nt, Human
gcugagggauagcugcucacug

SEQ ID NO: 17835 - RNA, 22 nt, Human
gcugagggcagccuccuagguc

SEQ ID NO: 17836 - RNA, 22 nt, Human
gcugagggcuggucacauuugu

SEQ ID NO: 17837 - RNA, 22 nt, Human
gcugagggcuguaacagcagag

SEQ ID NO: 17838 - RNA, 22 nt, Human
gcugaggguaacacuucgggau

SEQ ID NO: 17839 - RNA, 22 nt, Human
gcugagggucuguucauguugc

SEQ ID NO: 17840 - RNA, 22 nt, Human
gcugagguaggagguugcagug

SEQ ID NO: 17841 - RNA, 22 nt, Human
gcugagguccagcauucgccua

SEQ ID NO: 17842 - RNA, 20 nt, Human
gcugaggucccugugguuuu

SEQ ID NO: 17843 - RNA, 22 nt, Human
gcugaggugaggcuggaaagga

SEQ ID NO: 17844 - RNA, 22 nt, Human
gcugagguggagauugcaguga

SEQ ID NO: 17845 - RNA, 20 nt, Human
gcugagguggaggaaggaga

SEQ ID NO: 17846 - RNA, 22 nt, Human
gcugagguggcugccuuaguaa

SEQ ID NO: 17847 - RNA, 22 nt, Human
gcugagguggugaugguucauc

SEQ ID NO: 17848 - RNA, 18 nt, Human
gcugagguggugucagag

SEQ ID NO: 17849 - RNA, 20 nt, Human
gcugagguuucuuccuauau

SEQ ID NO: 17850 - RNA, 22 nt, Human
gcugagucuugagcacugagca

SEQ ID NO: 17851 - RNA, 22 nt, Human
gcugagugaaaguuugcugugu

SEQ ID NO: 17852 - RNA, 22 nt, Human
gcugagugaggaaaagguuaua

SEQ ID NO: 17853 - RNA, 22 nt, Human
gcugagugauucauacgcugcu

SEQ ID NO: 17854 - RNA, 22 nt, Human
gcugaguugaaagcagaggaua

SEQ ID NO: 17855 - RNA, 22 nt, Human
gcugauauaaaauuacagagga

SEQ ID NO: 17856 - RNA, 22 nt, Human
gcugauccuuuuaugucuagcu

SEQ ID NO: 17857 - RNA, 22 nt, Human
gcugaugagagagacaaaugcu

SEQ ID NO: 17858 - RNA, 22 nt, Human
gcugaugcaggguugagaggag

SEQ ID NO: 17859 - RNA, 22 nt, Human
gcugauguauauagugauugag

SEQ ID NO: 17860 - RNA, 22 nt, Human
gcugaugugaugucagaagagg

SEQ ID NO: 17861 - RNA, 22 nt, Human
gcugauuauuacaugucugugg

SEQ ID NO: 17862 - RNA, 22 nt, Human
gcugauuuugucacauagcaag

SEQ ID NO: 17863 - RNA, 22 nt, Human
gcugcaacuguugcucucugca

SEQ ID NO: 17864 - RNA, 22 nt, Human
gcugcagacugggaggcaggug

SEQ ID NO: 17865 - RNA, 22 nt, Human
gcugcagccuuugggaaggaca

SEQ ID NO: 17866 - RNA, 17 nt, Human
gcugcagcgguaggcag

SEQ ID NO: 17867 - RNA, 22 nt, Human
gcugcagcucgccuuccggccu

SEQ ID NO: 17868 - RNA, 22 nt, Human
gcugcaggcauuuuccugggca

SEQ ID NO: 17869 - RNA, 18 nt, Human
gcugcaggcccuccgagg

SEQ ID NO: 17870 - RNA, 22 nt, Human
gcugcaggcgccugcggucucu

SEQ ID NO: 17871 - RNA, 22 nt, Human
gcugcaggcuguggcaggggag

SEQ ID NO: 17872 - RNA, 22 nt, Human
gcugcagggagcuggaaggcuc

SEQ ID NO: 17873 - RNA, 21 nt, Human
gcugcagggcccagggcaccc

SEQ ID NO: 17874 - RNA, 22 nt, Human
gcugcagggcucucacaggggg

SEQ ID NO: 17875 - RNA, 22 nt, Human
gcugcagggggugggcgucucc

SEQ ID NO: 17876 - RNA, 22 nt, Human
gcugcagugagccaagaucgug

SEQ ID NO: 17877 - RNA, 21 nt, Human
gcugccaccgcgugcuccagg

SEQ ID NO: 17878 - RNA, 22 nt, Human
gcugccaccguggagaugagug

SEQ ID NO: 17879 - RNA, 22 nt, Human
uauaugcagauuuucaucaucg

SEQ ID NO: 17880 - RNA, 22 nt, Human
uauaugcaugcccauguauaca

SEQ ID NO: 17881 - RNA, 22 nt, Human
uauaugcuugugcaugucuuug

SEQ ID NO: 17882 - RNA, 22 nt, Human
uauauggauagugaucauaaga

SEQ ID NO: 17883 - RNA, 22 nt, Human
uauauguguggauucuuguaga

SEQ ID NO: 17884 - RNA, 22 nt, Human
uauauguuuuucuaauuaggga

SEQ ID NO: 17885 - RNA, 22 nt, Human
uauauuaaacccucucuguagg

SEQ ID NO: 17886 - RNA, 22 nt, Human
uauauuaaaugaccaguuuuaa

SEQ ID NO: 17887 - RNA, 22 nt, Human
uauauuagugagauuuauccau

SEQ ID NO: 17888 - RNA, 22 nt, Human
uauauuaguggaaugauaugaa

SEQ ID NO: 17889 - RNA, 22 nt, Human
uauauucaaugauuaguaucag

SEQ ID NO: 17890 - RNA, 22 nt, Human
uauauugacuuuaaagaagcaa

SEQ ID NO: 17891 - RNA, 22 nt, Human
uauauugagauuugagcauugu

SEQ ID NO: 17892 - RNA, 22 nt, Human
uauauuguagcugaugacaaau

SEQ ID NO: 17893 - RNA, 22 nt, Human
uauauuuaaauccagguugaaa

SEQ ID NO: 17894 - RNA, 18 nt, Human
uauauuucacacauauuc

SEQ ID NO: 17895 - RNA, 20 nt, Human
uauauuuucucuuuggccuu

SEQ ID NO: 17896 - RNA, 22 nt, Human
uaucaaaaggaguugaaagggg

SEQ ID NO: 17897 - RNA, 22 nt, Human
uaucaaauugaggcagcugggg

SEQ ID NO: 17898 - RNA, 22 nt, Human
uaucaacaauagccaguguuua

SEQ ID NO: 17899 - RNA, 22 nt, Human
uaucaacugagauuaaauauuu

SEQ ID NO: 17900 - RNA, 17 nt, Human
uaucaagaagucuggcc

SEQ ID NO: 17901 - RNA, 22 nt, Human
uaucaagagucucuacauuaau

SEQ ID NO: 17902 - RNA, 22 nt, Human
uaucaauugggccaaaugguac

SEQ ID NO: 17903 - RNA, 22 nt, Human
uaucacauacuucucauccagg

SEQ ID NO: 17904 - RNA, 22 nt, Human
uaucacauaguguuuaguaaau

SEQ ID NO: 17905 - RNA, 22 nt, Human
uaucagaagacuuacaguaucg

SEQ ID NO: 17906 - RNA, 22 nt, Human
uaucagaaggcacauggagucu

SEQ ID NO: 17907 - RNA, 21 nt, Human
uaucagagacauugagaggca

SEQ ID NO: 17908 - RNA, 22 nt, Human
uaucagauaaucuuuuacaagc

SEQ ID NO: 17909 - RNA, 22 nt, Human
uaucagauauagcauucacugg

SEQ ID NO: 17910 - RNA, 22 nt, Human
uaucagcaagauggcaguauag

SEQ ID NO: 17911 - RNA, 22 nt, Human
uaucagcucggaaucuguugaa

SEQ ID NO: 17912 - RNA, 22 nt, Human
uaucaggacuucauuccuuuua

SEQ ID NO: 17913 - RNA, 22 nt, Human
uaucagugauugcuguauacaa

SEQ ID NO: 17914 - RNA, 23 nt, Human
uaucauuucagcucucugccugg

SEQ ID NO: 17915 - RNA, 22 nt, Human
uaucauuuguuauuauuagugg

SEQ ID NO: 17916 - RNA, 22 nt, Human
uauccaaacauauagucucucu

SEQ ID NO: 17917 - RNA, 22 nt, Human
uauccaauucaccauugauggg

SEQ ID NO: 17918 - RNA, 22 nt, Human
uauccacacugggauguuuuga

SEQ ID NO: 17919 - RNA, 22 nt, Human
uauccagggaguuuuagggcuu

SEQ ID NO: 17920 - RNA, 22 nt, Human
uauccauauucagacugugaau

SEQ ID NO: 17921 - RNA, 22 nt, Human
uauccuguguacugucuaguac

SEQ ID NO: 17922 - RNA, 22 nt, Human
uaucgguaagauggaaaucagg

SEQ ID NO: 17923 - RNA, 22 nt, Human
uaucuaaauggaauauuccaga

SEQ ID NO: 17924 - RNA, 22 nt, Human
uaucuaagagagucaauauuua

SEQ ID NO: 17925 - RNA, 22 nt, Human
uaucuacaggugucagguaaga

SEQ ID NO: 17926 - RNA, 22 nt, Human
uaucuacauguagguauguaug

SEQ ID NO: 17927 - RNA, 22 nt, Human
uaucuacauucuuguaucuucu

SEQ ID NO: 17928 - RNA, 22 nt, Human
uaucuacuccucuuucagaugc

SEQ ID NO: 17929 - RNA, 16 nt, Human
uaucuagaguugaggu

SEQ ID NO: 17930 - RNA, 22 nt, Human
uaucucuuucauuuuagaguca

SEQ ID NO: 17931 - RNA, 22 nt, Human
uaucugucaccuguaggguagg

SEQ ID NO: 17932 - RNA, 22 nt, Human
uaucugugaaauguguuuguau

SEQ ID NO: 17933 - RNA, 22 nt, Human
uaucuguuaggaucagagcugg

SEQ ID NO: 17934 - RNA, 22 nt, Human
uaucuguuccaggcacucagcu

SEQ ID NO: 17935 - RNA, 22 nt, Human
uaucuguucugcuugauuuuga

SEQ ID NO: 17936 - RNA, 22 nt, Human
uaucuguuucugaggauacaug

SEQ ID NO: 17937 - RNA, 22 nt, Human
uaucuguuugcucacagguguu

SEQ ID NO: 17938 - RNA, 22 nt, Human
uaucuuggcuugaaagaugcuu

SEQ ID NO: 17939 - RNA, 22 nt, Human
uaucuuguuuaggugcacaggu

SEQ ID NO: 17940 - RNA, 22 nt, Human
uaucuuuaaugcuuggagguua

SEQ ID NO: 17941 - RNA, 22 nt, Human
uaucuuugcaaauaucucuaag

SEQ ID NO: 17942 - RNA, 22 nt, Human
uaucuuuugaguucucaagaug

SEQ ID NO: 17943 - RNA, 22 nt, Human
uaugaaaugauggggaaaauag

SEQ ID NO: 17944 - RNA, 22 nt, Human
uaugaaauugccauuuuuaugg

SEQ ID NO: 17945 - RNA, 22 nt, Human
ggaucuggggcucugcugcuca

SEQ ID NO: 17946 - RNA, 22 nt, Human
ggaugaggaaaccacagugucc

SEQ ID NO: 17947 - RNA, 22 nt, Human
ggaugagguagaugaacaaggg

SEQ ID NO: 17948 - RNA, 21 nt, Human
ggauggauagggaagagauuu

SEQ ID NO: 17949 - RNA, 22 nt, Human
ggauggcagacagugaguggcu

SEQ ID NO: 17950 - RNA, 22 nt, Human
ggaugggagcagaggacgacca

SEQ ID NO: 17951 - RNA, 22 nt, Human
ggaugggcagacaggacggcac

SEQ ID NO: 17952 - RNA, 22 nt, Human
ggauggguuccgugggcaaaug

SEQ ID NO: 17953 - RNA, 22 nt, Human
ggaugucgaggaugggguagca

SEQ ID NO: 17954 - RNA, 22 nt, Human
ggaugucugucauuaugcuuuc

SEQ ID NO: 17955 - RNA, 18 nt, Human
ggaugugauuuugguuuu

SEQ ID NO: 17956 - RNA, 22 nt, Human
ggauguggaccuugccugguga

SEQ ID NO: 17957 - RNA, 22 nt, Human
ggauguugauugaauggccauu

SEQ ID NO: 17958 - RNA, 22 nt, Human
ggauuaagaccugucaguacac

SEQ ID NO: 17959 - RNA, 22 nt, Human
ggauucaggguaaaguuucagu

SEQ ID NO: 17960 - RNA, 22 nt, Human
ggauucuacugaucagcaccac

SEQ ID NO: 17961 - RNA, 20 nt, Human
ggauucugacugugaagagg

SEQ ID NO: 17962 - RNA, 22 nt, Human
ggauugaagggaaccucagaau

SEQ ID NO: 17963 - RNA, 17 nt, Human
ggauugcauauacagug

SEQ ID NO: 17964 - RNA, 23 nt, Human
ggauuggccccaggaguaugggu

SEQ ID NO: 17965 - RNA, 22 nt, Human
ggauuuacccaauggauagaug

SEQ ID NO: 17966 - RNA, 22 nt, Human
ggauuuacuaucuugaaauaua

SEQ ID NO: 17967 - RNA, 22 nt, Human
ggauuuggaagaccgggucaca

SEQ ID NO: 17968 - RNA, 22 nt, Human
ggcaaaaaguucccaucagugu

SEQ ID NO: 17969 - RNA, 22 nt, Human
ggcaaaaaucaccccugguuca

SEQ ID NO: 17970 - RNA, 22 nt, Human
ggcaaagagacaugcaucgggg

SEQ ID NO: 17971 - RNA, 18 nt, Human
ggcaaaugcaauucaaag

SEQ ID NO: 17972 - RNA, 22 nt, Human
ggcaaccugagcuuguggagaa

SEQ ID NO: 17973 - RNA, 22 nt, Human
ggcaacucuucuugcaaugggg

SEQ ID NO: 17974 - RNA, 22 nt, Human
ggcaagaaccucaauuaccuuu

SEQ ID NO: 17975 - RNA, 22 nt, Human
ggcaagagggcagauggagugc

SEQ ID NO: 17976 - RNA, 22 nt, Human
ggcaagagugaggagugucucu

SEQ ID NO: 17977 - RNA, 22 nt, Human
ggcaagcucaggccucaggugu

SEQ ID NO: 17978 - RNA, 22 nt, Human
ggcaaggaagaagccaugaugu

SEQ ID NO: 17979 - RNA, 22 nt, Human
ggcaaggccuugcccagcauuc

SEQ ID NO: 17980 - RNA, 22 nt, Human
ggcaagggacggccgugagaca

SEQ ID NO: 17981 - RNA, 22 nt, Human
ggcaagguacucuagagcacau

SEQ ID NO: 17982 - RNA, 22 nt, Human
ggcaauaaucuacucugccacu

SEQ ID NO: 17983 - RNA, 22 nt, Human
ggcaauaaugacauuuuaaaaa

SEQ ID NO: 17984 - RNA, 22 nt, Human
ggcaauuaaaguacugugaaug

SEQ ID NO: 17985 - RNA, 22 nt, Human
ggcacaagguuuaaauaacauc

SEQ ID NO: 17986 - RNA, 22 nt, Human
ggcacaauugcagcaauaaaca

SEQ ID NO: 17987 - RNA, 22 nt, Human
ggcacacaaaggcagcauuuga

SEQ ID NO: 17988 - RNA, 22 nt, Human
ggagcacagccuugccaguacc

SEQ ID NO: 17989 - RNA, 22 nt, Human
ggagcagagcauuucacagccu

SEQ ID NO: 17990 - RNA, 22 nt, Human
ggagcagaugucuucauggccu

SEQ ID NO: 17991 - RNA, 22 nt, Human
ggagcagccacgucucagggca

SEQ ID NO: 17992 - RNA, 22 nt, Human
ggagcagggcagugaauucugg

SEQ ID NO: 17993 - RNA, 22 nt, Human
ggagcagucuggugauacucag

SEQ ID NO: 17994 - RNA, 22 nt, Human
ggagcaguuguugagcaagcca

SEQ ID NO: 17995 - RNA, 22 nt, Human
ggagcaucugaacagggagaag

SEQ ID NO: 17996 - RNA, 22 nt, Human
ggagcaugcgcucugugaccga

SEQ ID NO: 17997 - RNA, 22 nt, Human
ggagccagagggaugcaguuga

SEQ ID NO: 17998 - RNA, 23 nt, Human
ggagccagccuguggggagcggg

SEQ ID NO: 17999 - RNA, 18 nt, Human
ggagcccacggcguccca

SEQ ID NO: 18000 - RNA, 22 nt, Human
ggagccccaauugagcaguacg

SEQ ID NO: 18001 - RNA, 22 nt, Human
ggagcccucaccggcgagugcc

SEQ ID NO: 18002 - RNA, 22 nt, Human
ggagccugaaaagucugcauuu

SEQ ID NO: 18003 - RNA, 22 nt, Human
ggagccugagcggcccagggcc

SEQ ID NO: 18004 - RNA, 19 nt, Human
ggagccuggagcacgugcc

SEQ ID NO: 18005 - RNA, 22 nt, Human
ggagccuggaguuucugauggg

SEQ ID NO: 18006 - RNA, 22 nt, Human
ggagccuggcaaugcugcgucc

SEQ ID NO: 18007 - RNA, 19 nt, Human
ggagccuggcaggggcgug

SEQ ID NO: 18008 - RNA, 22 nt, Human
ggagccugggcauuaguaauuu

SEQ ID NO: 18009 - RNA, 22 nt, Human
ggagccuggucagguuggcucc

SEQ ID NO: 18010 - RNA, 22 nt, Human
ggagccugugcccaagcccaga

SEQ ID NO: 18011 - RNA, 22 nt, Human
ggagccuuacuagaaugugagc

SEQ ID NO: 18012 - RNA, 22 nt, Human
ggagccuuagacaucugauccu

SEQ ID NO: 18013 - RNA, 22 nt, Human
ggagccuugggcgcucucccau

SEQ ID NO: 18014 - RNA, 22 nt, Human
ggagcucuccugaugugaagau

SEQ ID NO: 18015 - RNA, 22 nt, Human
ggagcugaaccccaucgugcug

SEQ ID NO: 18016 - RNA, 22 nt, Human
ggagcugaugguagaagaauga

SEQ ID NO: 18017 - RNA, 21 nt, Human
ggagcugcaggagccgaaggc

SEQ ID NO: 18018 - RNA, 20 nt, Human
ggagcugcccugggcuggag

SEQ ID NO: 18019 - RNA, 23 nt, Human
ggagcuggacccuuacaccuuuc

SEQ ID NO: 18020 - RNA, 22 nt, Human
ggagcuggagagcuagccuagg

SEQ ID NO: 18021 - RNA, 20 nt, Human
ggagcuggcauccagccucu

SEQ ID NO: 18022 - RNA, 22 nt, Human
ggagcugggaauuggaucaucu

SEQ ID NO: 18023 - RNA, 22 nt, Human
ggagcugucuguagggcacagg

SEQ ID NO: 18024 - RNA, 22 nt, Human
ggagcugugcagugacuacaga

SEQ ID NO: 18025 - RNA, 22 nt, Human
ggagcugugggacgcuguccca

SEQ ID NO: 18026 - RNA, 22 nt, Human
ggagcuguguuauccauuccca

SEQ ID NO: 18027 - RNA, 19 nt, Human
ggagcuugguggcuguggc

SEQ ID NO: 18028 - RNA, 21 nt, Human
ggaggaaaaaggaaugacuug

SEQ ID NO: 18029 - RNA, 22 nt, Human
ggaggaaaggcucccucccucu

SEQ ID NO: 18030 - RNA, 22 nt, Human
ggaggaagagguuguucucuca

SEQ ID NO: 18031 - RNA, 22 nt, Human
ggaggaagcacacggcuuguau

SEQ ID NO: 18032 - RNA, 22 nt, Human
ggaggaaggguagcauaaugua

SEQ ID NO: 18033 - RNA, 22 nt, Human
ggaggaagugcaguucuacuac

SEQ ID NO: 18034 - RNA, 22 nt, Human
ggaggaccugcuggcccugcaa

SEQ ID NO: 18035 - RNA, 22 nt, Human
ggaggagcacuugacggggucu

SEQ ID NO: 18036 - RNA, 22 nt, Human
ggaggaggcaaguaccagaugc

SEQ ID NO: 18037 - RNA, 22 nt, Human
ggaggagguggguuaaguugua

SEQ ID NO: 18038 - RNA, 22 nt, Human
ggaggagucaguugggcugcuu

SEQ ID NO: 18039 - RNA, 17 nt, Human
ggaggcaacagacaggg

SEQ ID NO: 18040 - RNA, 22 nt, Human
ggaggcacaccucagacuggga

SEQ ID NO: 18041 - RNA, 22 nt, Human
ggaggcacuucccgucucagcc

SEQ ID NO: 18042 - RNA, 22 nt, Human
ggaggcagaauagagugugggu

SEQ ID NO: 18043 - RNA, 22 nt, Human
ggaggcaggaaagacagguuca

SEQ ID NO: 18044 - RNA, 22 nt, Human
ggaggcaucucuguggcugucu

SEQ ID NO: 18045 - RNA, 22 nt, Human
ggaggccaaggcgggcggauca

SEQ ID NO: 18046 - RNA, 22 nt, Human
ggaggccacgguuuagcaccga

SEQ ID NO: 18047 - RNA, 15 nt, Human
ggaggccaggcugug

SEQ ID NO: 18048 - RNA, 22 nt, Human
ggaggccauaguuugggaguca

SEQ ID NO: 18049 - RNA, 22 nt, Human
ggaggccaucagggagggcauu

SEQ ID NO: 18050 - RNA, 22 nt, Human
ggaggccaucuggcuggaggcu

SEQ ID NO: 18051 - RNA, 22 nt, Human
ggaggcccagaaggaagcccag

SEQ ID NO: 18052 - RNA, 22 nt, Human
ggaggccuagccagcuccaguu

SEQ ID NO: 18053 - RNA, 22 nt, Human
ggaggccuugccugcaggcaca

SEQ ID NO: 18054 - RNA, 22 nt, Human
ggaggcggagcuugcagugagc

SEQ ID NO: 18055 - RNA, 22 nt, Human
ggaggcuccuaagcugacuuga

SEQ ID NO: 18056 - RNA, 22 nt, Human
ggaggcucgcuggucgcacagc

SEQ ID NO: 18057 - RNA, 22 nt, Human
ggaggcucuccuggccuugucu

SEQ ID NO: 18058 - RNA, 22 nt, Human
ggaggcucugccaucugucaca

SEQ ID NO: 18059 - RNA, 22 nt, Human
ggaggcugagaaguccaagauc

SEQ ID NO: 18060 - RNA, 22 nt, Human
ggaggcugagaggucgcagugg

SEQ ID NO: 18061 - RNA, 22 nt, Human
ggagggagcagagaacccaacc

SEQ ID NO: 18062 - RNA, 22 nt, Human
ggagggcacaggaccagaaauc

SEQ ID NO: 18063 - RNA, 18 nt, Human
uaugugcauaugugugua

SEQ ID NO: 18064 - RNA, 22 nt, Human
uauguggaaaaugcacuuaaaa

SEQ ID NO: 18065 - RNA, 22 nt, Human
uauguggccuuuuaugucugac

SEQ ID NO: 18066 - RNA, 23 nt, Human
uauguguaaggagaaggagugag

SEQ ID NO: 18067 - RNA, 22 nt, Human
uauguguaaucaaacacaugcu

SEQ ID NO: 18068 - RNA, 22 nt, Human
uauguguaggaggaggacaggg

SEQ ID NO: 18069 - RNA, 22 nt, Human
uauguguagugugaucccaaug

SEQ ID NO: 18070 - RNA, 22 nt, Human
uauguguauuuaguucuauaca

SEQ ID NO: 18071 - RNA, 21 nt, Human
uaugugucuguggaaaacuag

SEQ ID NO: 18072 - RNA, 22 nt, Human
uaugugucuuuaucuggcucuu

SEQ ID NO: 18073 - RNA, 19 nt, Human
uaugugugcauuugugcau

SEQ ID NO: 18074 - RNA, 22 nt, Human
uauguguggcagcugggagugu

SEQ ID NO: 18075 - RNA, 22 nt, Human
uauguguguuucaguggaaaug

SEQ ID NO: 18076 - RNA, 22 nt, Human
uauguguuguauaugugcagag

SEQ ID NO: 18077 - RNA, 21 nt, Human
uauguuagugauguuuguagg

SEQ ID NO: 18078 - RNA, 22 nt, Human
uauguuauauuuugucaauugu

SEQ ID NO: 18079 - RNA, 22 nt, Human
uauguucaugucaaacaaaugc

SEQ ID NO: 18080 - RNA, 22 nt, Human
uauguucuaggaaugguugaug

SEQ ID NO: 18081 - RNA, 22 nt, Human
uauguuguggggugcaucaaaa

SEQ ID NO: 18082 - RNA, 22 nt, Human
uauguuucauucuuuucuggua

SEQ ID NO: 18083 - RNA, 22 nt, Human
uauguuuccugagcuuacacca

SEQ ID NO: 18084 - RNA, 22 nt, Human
uauguuucuuccuuuucauaca

SEQ ID NO: 18085 - RNA, 22 nt, Human
uauguuuuuaagagaaugcauu

SEQ ID NO: 18086 - RNA, 23 nt, Human
uauuacaauuggucuuauuaaga

SEQ ID NO: 18087 - RNA, 22 nt, Human
uauuacaguucgaguuucuagg

SEQ ID NO: 18088 - RNA, 22 nt, Human
uauuacauccacuuuuauugca

SEQ ID NO: 18089 - RNA, 22 nt, Human
uauuacugucaauaucacagaa

SEQ ID NO: 18090 - RNA, 22 nt, Human
uauuacuguuacuucacacugu

SEQ ID NO: 18091 - RNA, 22 nt, Human
uauuagagaaaagauggaugug

SEQ ID NO: 18092 - RNA, 22 nt, Human
uauuagaggaaccaagguggag

SEQ ID NO: 18093 - RNA, 22 nt, Human
uauuagcagcaugagaaugggc

SEQ ID NO: 18094 - RNA, 22 nt, Human
uauuagcgucaggaggugagua

SEQ ID NO: 18095 - RNA, 22 nt, Human
uauuagcucaugauuucggugg

SEQ ID NO: 18096 - RNA, 23 nt, Human
uauuagggccaggacuggcaaau

SEQ ID NO: 18097 - RNA, 18 nt, Human
ggagucucaggagaggaa

SEQ ID NO: 18098 - RNA, 22 nt, Human
ggagucugaguccucauagaca

SEQ ID NO: 18099 - RNA, 22 nt, Human
ggagucugcucccagacaugau

SEQ ID NO: 18100 - RNA, 22 nt, Human
ggagucuucagauagaguauuu

SEQ ID NO: 18101 - RNA, 22 nt, Human
ggagugaaagguaaguugagcu

SEQ ID NO: 18102 - RNA, 22 nt, Human
ggagugacucacagcugggaca

SEQ ID NO: 18103 - RNA, 22 nt, Human
ggagugauggaaagugcuuggc

SEQ ID NO: 18104 - RNA, 22 nt, Human
ggagugggaacaaugacauggu

SEQ ID NO: 18105 - RNA, 22 nt, Human
ggaguguggagaggacaugggu

SEQ ID NO: 18106 - RNA, 22 nt, Human
ggagugugggauggagcucagg

SEQ ID NO: 18107 - RNA, 23 nt, Human
ggaguuggauuguacuugcugcu

SEQ ID NO: 18108 - RNA, 22 nt, Human
ggaguuguucugcaggagagaa

SEQ ID NO: 18109 - RNA, 21 nt, Human
ggaguuuuucuggaagggacu

SEQ ID NO: 18110 - RNA, 22 nt, Human
ggauaaagucuuuagguggaca

SEQ ID NO: 18111 - RNA, 21 nt, Human
ggauaaauggucugguuucuc

SEQ ID NO: 18112 - RNA, 19 nt, Human
ggauaagguuggagugauc

SEQ ID NO: 18113 - RNA, 22 nt, Human
ggauacaagguguucuaucacu

SEQ ID NO: 18114 - RNA, 22 nt, Human
ggauagugggagaaugcuaugu

SEQ ID NO: 18115 - RNA, 22 nt, Human
ggaucacacaugcacuguuuga

SEQ ID NO: 18116 - RNA, 22 nt, Human
ggaucaggcugaagcuaggacu

SEQ ID NO: 18117 - RNA, 22 nt, Human
ggauccagaggugaagauggga

SEQ ID NO: 18118 - RNA, 22 nt, Human
ggaucugauuaauaagguggac

SEQ ID NO: 18119 - RNA, 22 nt, Human
ggaugacaaggaaagcaaacca

SEQ ID NO: 18120 - RNA, 22 nt, Human
ggaugcacgaaggcgccucgga

SEQ ID NO: 18121 - RNA, 22 nt, Human
ggaugcaggacggcauggaugu

SEQ ID NO: 18122 - RNA, 22 nt, Human
ggaugcaggaguugaagaagga

SEQ ID NO: 18123 - RNA, 21 nt, Human
ggaugccacgaagcaccagga

SEQ ID NO: 18124 - RNA, 22 nt, Human
ggaugcugacuuuggagcaugg

SEQ ID NO: 18125 - RNA, 22 nt, Human
ggaugcugauauagagcauucu

SEQ ID NO: 18126 - RNA, 18 nt, Human
ggaugcugugugcuccuu

SEQ ID NO: 18127 - RNA, 22 nt, Human
ggauggagguucucagaugcuc

SEQ ID NO: 18128 - RNA, 22 nt, Human
ggauggcaggacaaggacccag

SEQ ID NO: 18129 - RNA, 22 nt, Human
ggauggcagucugcaugagaaa

SEQ ID NO: 18130 - RNA, 20 nt, Human
ggauggccggaccagagccu

SEQ ID NO: 18131 - RNA, 22 nt, Human
ggauggcuguaaaaggugggaa

SEQ ID NO: 18132 - RNA, 22 nt, Human
ggaugggcugaaagguagcccc

SEQ ID NO: 18133 - RNA, 22 nt, Human
ggauguagugcaaggagugaau

SEQ ID NO: 18134 - RNA, 22 nt, Human
ggaugucuaggguuuaugugcc

SEQ ID NO: 18135 - RNA, 22 nt, Human
ggaugucuggucuauuucaagu

SEQ ID NO: 18136 - RNA, 22 nt, Human
ggauuagaggugaugauuauaa

SEQ ID NO: 18137 - RNA, 22 nt, Human
ggauuagcuuuuguucuugacu

SEQ ID NO: 18138 - RNA, 22 nt, Human
ggauucagcgaggcagccugga

SEQ ID NO: 18139 - RNA, 22 nt, Human
ggauuugggcuugcagcagagc

SEQ ID NO: 18140 - RNA, 22 nt, Human
ggauuuuagaguaccuaagugu

SEQ ID NO: 18141 - RNA, 22 nt, Human
ggcaaaaaccauaauuacuuuu

SEQ ID NO: 18142 - RNA, 22 nt, Human
ggcaaaaaccgcaauaacuucu

SEQ ID NO: 18143 - RNA, 22 nt, Human
ggcaaaaguauuaucucuuuaa

SEQ ID NO: 18144 - RNA, 22 nt, Human
ggcaaacacaccucggugagaa

SEQ ID NO: 18145 - RNA, 22 nt, Human
ggcaaacaccaggcgagggagc

SEQ ID NO: 18146 - RNA, 22 nt, Human
ggcaaacuacauuuuugaaaua

SEQ ID NO: 18147 - RNA, 22 nt, Human
ggcaaagcccugccugguucaa

SEQ ID NO: 18148 - RNA, 22 nt, Human
ggcaaagccuuccagcuguuac

SEQ ID NO: 18149 - RNA, 19 nt, Human
ggcaaauugaggccaguca

SEQ ID NO: 18150 - RNA, 22 nt, Human
ggcaaauugcugcaauuacuua

SEQ ID NO: 18151 - RNA, 21 nt, Human
ggcaacagauauuuugcuuag

SEQ ID NO: 18152 - RNA, 22 nt, Human
ggcaagaaccacaauuacuuuu

SEQ ID NO: 18153 - RNA, 20 nt, Human
ggcaagcaacugagggagga

SEQ ID NO: 18154 - RNA, 22 nt, Human
ggcaagcauaaccuguacagcc

SEQ ID NO: 18155 - RNA, 22 nt, Human
ggcaaggccaggccuccaagac

SEQ ID NO: 18156 - RNA, 22 nt, Human
ggcaaggggucaggcugagaca

SEQ ID NO: 18157 - RNA, 22 nt, Human
ggcaaggugcuacagacaguga

SEQ ID NO: 18158 - RNA, 22 nt, Human
ggcaaguaauacaggauuauuu

SEQ ID NO: 18159 - RNA, 22 nt, Human
ggcaagucaggaaguugacauu

SEQ ID NO: 18160 - RNA, 22 nt, Human
ggcaaucauuggcauucucugg

SEQ ID NO: 18161 - RNA, 22 nt, Human
ggcaauguagauucuguagauu

SEQ ID NO: 18162 - RNA, 22 nt, Human
ggcaauguuucgaugggagcug

SEQ ID NO: 18163 - RNA, 21 nt, Human
ggcaauuaggcuucugaguau

SEQ ID NO: 18164 - RNA, 22 nt, Human
ggcaauuucaugugguuuaaac

SEQ ID NO: 18165 - RNA, 22 nt, Human
ggcacagagaggcccuggaagg

SEQ ID NO: 18166 - RNA, 22 nt, Human
ggcacagcaagaagggaaauga

SEQ ID NO: 18167 - RNA, 22 nt, Human
ggcacagcacagagcacaugua

SEQ ID NO: 18168 - RNA, 22 nt, Human
ggcacagcacaguggacccagg

SEQ ID NO: 18169 - RNA, 22 nt, Human
ggcacagcaccuuuucacauug

SEQ ID NO: 18170 - RNA, 22 nt, Human
ggcacagcccucucuguggaca

SEQ ID NO: 18171 - RNA, 22 nt, Human
ggcacagcuacuugcucacucu

SEQ ID NO: 18172 - RNA, 22 nt, Human
ggcacagcugaugcagacacac

SEQ ID NO: 18173 - RNA, 22 nt, Human
ggcacaggaaucugugaagugc

SEQ ID NO: 18174 - RNA, 22 nt, Human
ggcacagggggcugaggacuag

SEQ ID NO: 18175 - RNA, 17 nt, Human
ggcaccagacggagagu

SEQ ID NO: 18176 - RNA, 23 nt, Human
ggcaccaggccauggagcgggag

SEQ ID NO: 18177 - RNA, 22 nt, Human
ggcaccagggaaggaaggcugg

SEQ ID NO: 18178 - RNA, 22 nt, Human
uauuuauguauguggauguguu

SEQ ID NO: 18179 - RNA, 22 nt, Human
uauuuauuggacaguguugcug

SEQ ID NO: 18180 - RNA, 22 nt, Human
uauuucacagcagcucauuuaa

SEQ ID NO: 18181 - RNA, 22 nt, Human
uauuucacuccgagacucuaug

SEQ ID NO: 18182 - RNA, 22 nt, Human
uauuucaggggguacaagaaga

SEQ ID NO: 18183 - RNA, 22 nt, Human
uauuucauucuuuaucaggagc

SEQ ID NO: 18184 - RNA, 22 nt, Human
uauuuccaaaaaggccauauuc

SEQ ID NO: 18185 - RNA, 22 nt, Human
uauuuccaaaagccuauuauga

SEQ ID NO: 18186 - RNA, 22 nt, Human
uauuuccaccuauuauuuucug

SEQ ID NO: 18187 - RNA, 22 nt, Human
uauuuccugcauggugauguaa

SEQ ID NO: 18188 - RNA, 22 nt, Human
uauuucuaagagauaucuguac

SEQ ID NO: 18189 - RNA, 22 nt, Human
uauuucuaagcuguaagucuga

SEQ ID NO: 18190 - RNA, 22 nt, Human
uauuucucagcauuuuacaucc

SEQ ID NO: 18191 - RNA, 22 nt, Human
uauuucucucacgguugccugg

SEQ ID NO: 18192 - RNA, 22 nt, Human
uauuucugaauccaaaagguca

SEQ ID NO: 18193 - RNA, 22 nt, Human
uauuucuuguuauucucguuga

SEQ ID NO: 18194 - RNA, 22 nt, Human
uauuucuuguucccuccaaguu

SEQ ID NO: 18195 - RNA, 22 nt, Human
uauuucuuucagguauguguug

SEQ ID NO: 18196 - RNA, 21 nt, Human
uauuucuuugacucucucccu

SEQ ID NO: 18197 - RNA, 22 nt, Human
uauuugaaaguguacaaaaacu

SEQ ID NO: 18198 - RNA, 20 nt, Human
uauuugaaauggccaagugu

SEQ ID NO: 18199 - RNA, 22 nt, Human
uauuugcaaagaacuacacuag

SEQ ID NO: 18200 - RNA, 22 nt, Human
uauuugcucaacccugccucca

SEQ ID NO: 18201 - RNA, 22 nt, Human
uauuugcucaauaauaguuuua

SEQ ID NO: 18202 - RNA, 22 nt, Human
uauuuggaaaagggaagggaca

SEQ ID NO: 18203 - RNA, 22 nt, Human
uauuuggaaaguuuaucuaucu

SEQ ID NO: 18204 - RNA, 22 nt, Human
uauuuggaagguauaaacacaa

SEQ ID NO: 18205 - RNA, 22 nt, Human
uauuuggagccuauccauagau

SEQ ID NO: 18206 - RNA, 17 nt, Human
agucauauugugcaguu

SEQ ID NO: 18207 - RNA, 22 nt, Human
agucauauuuagcuuguggaau

SEQ ID NO: 18208 - RNA, 22 nt, Human
agucaucauguacagagagcaa

SEQ ID NO: 18209 - RNA, 22 nt, Human
agucaucauuuauaucaagucu

SEQ ID NO: 18210 - RNA, 22 nt, Human
agucaucuccaauauacaaagc

SEQ ID NO: 18211 - RNA, 22 nt, Human
agucaucucugagauagaagcu

SEQ ID NO: 18212 - RNA, 22 nt, Human
agucaucucuucuacaauaugg

SEQ ID NO: 18213 - RNA, 22 nt, Human
agucauguguucaucuuucauu

SEQ ID NO: 18214 - RNA, 22 nt, Human
agucauuaauuaguaggaaggu

SEQ ID NO: 18215 - RNA, 22 nt, Human
agucauuacagcaggcagaagg

SEQ ID NO: 18216 - RNA, 20 nt, Human
agucauuggguguccuucgg

SEQ ID NO: 18217 - RNA, 22 nt, Human
agucauuguaugaaguguacuc

SEQ ID NO: 18218 - RNA, 22 nt, Human
agucauuuggagcaccuuauua

SEQ ID NO: 18219 - RNA, 22 nt, Human
agucauuuugcuaaaugagggu

SEQ ID NO: 18220 - RNA, 22 nt, Human
aguccaaagcagaugagggcca

SEQ ID NO: 18221 - RNA, 22 nt, Human
aguccaagaccaaggugucacc

SEQ ID NO: 18222 - RNA, 22 nt, Human
aguccaagaucaaggugucagg

SEQ ID NO: 18223 - RNA, 22 nt, Human
aguccaaggagagacagcauuu

SEQ ID NO: 18224 - RNA, 22 nt, Human
aguccaauaaccucuuuccuuc

SEQ ID NO: 18225 - RNA, 22 nt, Human
aguccagaccccggcagcuggu

SEQ ID NO: 18226 - RNA, 21 nt, Human
aguccaggaggaggccagguu

SEQ ID NO: 18227 - RNA, 21 nt, Human
aguccaggccugcccacuucc

SEQ ID NO: 18228 - RNA, 22 nt, Human
aguccaggucucugagucacaa

SEQ ID NO: 18229 - RNA, 22 nt, Human
aguccagugaacuguaaauagg

SEQ ID NO: 18230 - RNA, 22 nt, Human
aguccauaguuuacauuacagc

SEQ ID NO: 18231 - RNA, 22 nt, Human
aguccaugaugaaaccagaucc

SEQ ID NO: 18232 - RNA, 22 nt, Human
aguccaugcugucuacagaauc

SEQ ID NO: 18233 - RNA, 22 nt, Human
aguccaugguucugacucaucu

SEQ ID NO: 18234 - RNA, 22 nt, Human
aguccaugguuguaguucucuc

SEQ ID NO: 18235 - RNA, 22 nt, Human
agucccagacuccaguuuucug

SEQ ID NO: 18236 - RNA, 20 nt, Human
agucccagaucaaauuucug

SEQ ID NO: 18237 - RNA, 22 nt, Human
agucccagaucuccauucgguc

SEQ ID NO: 18238 - RNA, 22 nt, Human
agucccaguucgguucuuccuc

SEQ ID NO: 18239 - RNA, 18 nt, Human
agucccaucuucagcucu

SEQ ID NO: 18240 - RNA, 22 nt, Human
aguccccucuaacccaacuuua

SEQ ID NO: 18241 - RNA, 22 nt, Human
agucccuggauugucucuguca

SEQ ID NO: 18242 - RNA, 20 nt, Human
agucccuuuggucagguauu

SEQ ID NO: 18243 - RNA, 22 nt, Human
aguccuagacuuuucugccacu

SEQ ID NO: 18244 - RNA, 22 nt, Human
aguccucugcugugcgucuuug

SEQ ID NO: 18245 - RNA, 22 nt, Human
aguccucuggaguaugccuuau

SEQ ID NO: 18246 - RNA, 18 nt, Human
aguccuggagaucaccaa

SEQ ID NO: 18247 - RNA, 22 nt, Human
aguccuggcauauagguccuca

SEQ ID NO: 18248 - RNA, 22 nt, Human
aguccuggcauggaauuguccc

SEQ ID NO: 18249 - RNA, 22 nt, Human
aguccuggccccaaggaaggau

SEQ ID NO: 18250 - RNA, 22 nt, Human
aguccugggucuggagaaugga

SEQ ID NO: 18251 - RNA, 22 nt, Human
aguccuguaucugagcugaguc

SEQ ID NO: 18252 - RNA, 22 nt, Human
aguccugucaccucuacuuucg

SEQ ID NO: 18253 - RNA, 22 nt, Human
aguccugugaguuuuucuaguu

SEQ ID NO: 18254 - RNA, 22 nt, Human
aguccuuaugagaugcugccuu

SEQ ID NO: 18255 - RNA, 22 nt, Human
aguccuuaugugguggagagag

SEQ ID NO: 18256 - RNA, 22 nt, Human
aguccuucaagaaaucuggaaa

SEQ ID NO: 18257 - RNA, 22 nt, Human
agucuagggugggguccacagg

SEQ ID NO: 18258 - RNA, 22 nt, Human
agucuauugccuaacagagagg

SEQ ID NO: 18259 - RNA, 22 nt, Human
agucuauuuccccuucucuuga

SEQ ID NO: 18260 - RNA, 22 nt, Human
agucuauuuuugguucuucggg

SEQ ID NO: 18261 - RNA, 23 nt, Human
agucucaagcuggagaauuaccu

SEQ ID NO: 18262 - RNA, 22 nt, Human
agucucacuucuugagcuaugc

SEQ ID NO: 18263 - RNA, 22 nt, Human
agucucagaaaagaagcaugga

SEQ ID NO: 18264 - RNA, 18 nt, Human
agucucagcggaggagua

SEQ ID NO: 18265 - RNA, 22 nt, Human
agucucagggccacccggggaa

SEQ ID NO: 18266 - RNA, 22 nt, Human
agucuccuuaaauauuucccag

SEQ ID NO: 18267 - RNA, 22 nt, Human
agucuccuuggccucaaugccu

SEQ ID NO: 18268 - RNA, 20 nt, Human
agucucucccagaaugagca

SEQ ID NO: 18269 - RNA, 19 nt, Human
agucucugaggccuaaguu

SEQ ID NO: 18270 - RNA, 20 nt, Human
agucucugcaacauagugca

SEQ ID NO: 18271 - RNA, 22 nt, Human
agucucugcaugaugcagcaca

SEQ ID NO: 18272 - RNA, 22 nt, Human
agucucuuggcauucugaaaca

SEQ ID NO: 18273 - RNA, 22 nt, Human
agucucuuuguauaaauaggca

SEQ ID NO: 18274 - RNA, 22 nt, Human
agucugaaauaaugucacuaag

SEQ ID NO: 18275 - RNA, 22 nt, Human
agucugaaccagauggcaaggu

SEQ ID NO: 18276 - RNA, 22 nt, Human
agucugaggcacccugaauauu

SEQ ID NO: 18277 - RNA, 21 nt, Human
agucugagguggggccuagga

SEQ ID NO: 18278 - RNA, 22 nt, Human
agucugaguuaguggaaaugua

SEQ ID NO: 18279 - RNA, 22 nt, Human
agucugcacucagguggagguc

SEQ ID NO: 18280 - RNA, 22 nt, Human
agucugcaggaccgcgucacau

SEQ ID NO: 18281 - RNA, 22 nt, Human
agucugcuuccuggagaacuca

SEQ ID NO: 18282 - RNA, 22 nt, Human
agucuggaguagagccuagaaa

SEQ ID NO: 18283 - RNA, 20 nt, Human
agucuggcaccuauuccugu

SEQ ID NO: 18284 - RNA, 22 nt, Human
agucuggccuugccuugucgag

SEQ ID NO: 18285 - RNA, 17 nt, Human
agucugggaccugcgug

SEQ ID NO: 18286 - RNA, 22 nt, Human
agucugggagaaggugagauua

SEQ ID NO: 18287 - RNA, 22 nt, Human
agucugggaggcuuauaaacag

SEQ ID NO: 18288 - RNA, 22 nt, Human
agucugggcauuuaggauguug

SEQ ID NO: 18289 - RNA, 22 nt, Human
agucugggcugucugcaggagu

SEQ ID NO: 18290 - RNA, 22 nt, Human
agucuggggucugguagaacga

SEQ ID NO: 18291 - RNA, 22 nt, Human
agucugggugugaaugaacuug

SEQ ID NO: 18292 - RNA, 22 nt, Human
agucugguaauguagcucaacc

SEQ ID NO: 18293 - RNA, 22 nt, Human
agucuggugcucgcucugcuuc

SEQ ID NO: 18294 - RNA, 22 nt, Human
auuguuuuccaaagaugcugcu

SEQ ID NO: 18295 - RNA, 22 nt, Human
auuuaaauuuucugauggagag

SEQ ID NO: 18296 - RNA, 22 nt, Human
auuuaacuuucagccccucuuc

SEQ ID NO: 18297 - RNA, 22 nt, Human
auuuaagaggcugcuagaguau

SEQ ID NO: 18298 - RNA, 23 nt, Human
auuuaaugcugaguugaauguua

SEQ ID NO: 18299 - RNA, 22 nt, Human
auuuaauggguagacauuguua

SEQ ID NO: 18300 - RNA, 22 nt, Human
auuuaauuaaucauggugaauu

SEQ ID NO: 18301 - RNA, 22 nt, Human
auuuaauuuauagauguggaua

SEQ ID NO: 18302 - RNA, 22 nt, Human
auuuaauuuggagagagaaacc

SEQ ID NO: 18303 - RNA, 22 nt, Human
auuuaauuuucucaacagugcu

SEQ ID NO: 18304 - RNA, 22 nt, Human
auuuacacauucauaagauuuc

SEQ ID NO: 18305 - RNA, 22 nt, Human
auuuacaccuucuucgauucuc

SEQ ID NO: 18306 - RNA, 22 nt, Human
auuuacagacccucccacuaag

SEQ ID NO: 18307 - RNA, 22 nt, Human
auuuacagguagaauuuuaagu

SEQ ID NO: 18308 - RNA, 22 nt, Human
auuuaccauauguacugaguau

SEQ ID NO: 18309 - RNA, 22 nt, Human
auuuaccauccugugaauggcc

SEQ ID NO: 18310 - RNA, 19 nt, Human
auuuacugccuaaaaucuc

SEQ ID NO: 18311 - RNA, 22 nt, Human
auuuacuggaaaaacuaugagc

SEQ ID NO: 18312 - RNA, 22 nt, Human
auuuagaaauuccaaaaguauu

SEQ ID NO: 18313 - RNA, 22 nt, Human
auuuagaaccccuuccaaccug

SEQ ID NO: 18314 - RNA, 22 nt, Human
auuuagacucucaccuccaccu

SEQ ID NO: 18315 - RNA, 22 nt, Human
aguuuacauaaaaaggcagagg

SEQ ID NO: 18316 - RNA, 22 nt, Human
aguuuacaucuucaaucucauu

SEQ ID NO: 18317 - RNA, 22 nt, Human
auagcacuuauagauuuggucu

SEQ ID NO: 18318 - RNA, 22 nt, Human
auagcagcaucaguuuaucucc

SEQ ID NO: 18319 - RNA, 19 nt, Human
auagcagcuauacccagau

SEQ ID NO: 18320 - RNA, 22 nt, Human
auagcagugacauuuuaaugug

SEQ ID NO: 18321 - RNA, 22 nt, Human
auagcauggccaggaagcuggg

SEQ ID NO: 18322 - RNA, 22 nt, Human
auagcauggccugugacacuuu

SEQ ID NO: 18323 - RNA, 22 nt, Human
auagccagcauauagcagggag

SEQ ID NO: 18324 - RNA, 22 nt, Human
auagccuugguccuugcuccac

SEQ ID NO: 18325 - RNA, 22 nt, Human
auagcuguuagauuggggucga

SEQ ID NO: 18326 - RNA, 22 nt, Human
auagcuuacaggugauaucagc

SEQ ID NO: 18327 - RNA, 19 nt, Human
auagcuugucagcugcucc

SEQ ID NO: 18328 - RNA, 20 nt, Human
auaggaaagggaggggcuuu

SEQ ID NO: 18329 - RNA, 22 nt, Human
auaggaaaucgcuauuaaccua

SEQ ID NO: 18330 - RNA, 22 nt, Human
auaggaauuucuucagcacuga

SEQ ID NO: 18331 - RNA, 22 nt, Human
auaggagaucaauaugcaauuu

SEQ ID NO: 18332 - RNA, 22 nt, Human
auaggagccauaaauaaaaucu

SEQ ID NO: 18333 - RNA, 22 nt, Human
auaggcaaauuaauaagucaua

SEQ ID NO: 18334 - RNA, 22 nt, Human
auaggccauuugagggccaggu

SEQ ID NO: 18335 - RNA, 22 nt, Human
auaggcuuauauaaaaacaucu

SEQ ID NO: 18336 - RNA, 22 nt, Human
auaggcuuuccugauucucagg

SEQ ID NO: 18337 - RNA, 22 nt, Human
auaggcuuuguguuuuguuauc

SEQ ID NO: 18338 - RNA, 22 nt, Human
auagggaggaacugagucagga

SEQ ID NO: 18339 - RNA, 22 nt, Human
auagggcauccuuuauugagau

SEQ ID NO: 18340 - RNA, 22 nt, Human
auagggcuguugugaggauuaa

SEQ ID NO: 18341 - RNA, 22 nt, Human
auagguacagcagauauucuua

SEQ ID NO: 18342 - RNA, 22 nt, Human
auaggucugaaaguguauccug

SEQ ID NO: 18343 - RNA, 20 nt, Human
auaguaaugaagucuuguuc

SEQ ID NO: 18344 - RNA, 22 nt, Human
auaguacaagggaagagugaag

SEQ ID NO: 18345 - RNA, 22 nt, Human
auaguacacauccuacaauguu

SEQ ID NO: 18346 - RNA, 22 nt, Human
auaguacagcauuuuuccugag

SEQ ID NO: 18347 - RNA, 22 nt, Human
auaguagcgagaucucagcuca

SEQ ID NO: 18348 - RNA, 23 nt, Human
auagucugcgcaacugagagagg

SEQ ID NO: 18349 - RNA, 22 nt, Human
auagucuuacuuuucucugcua

SEQ ID NO: 18350 - RNA, 22 nt, Human
auagugaaaaugcugucagcau

SEQ ID NO: 18351 - RNA, 22 nt, Human
auagugauugaaaacauucugu

SEQ ID NO: 18352 - RNA, 22 nt, Human
auagugggaauuacgauauacu

SEQ ID NO: 18353 - RNA, 22 nt, Human
auaguggugagcugcauuuaug

SEQ ID NO: 18354 - RNA, 22 nt, Human
auagugguuggauaugucagag

SEQ ID NO: 18355 - RNA, 22 nt, Human
auagugugacugaggaguugaa

SEQ ID NO: 18356 - RNA, 22 nt, Human
auaguguguaaagugcagugau

SEQ ID NO: 18357 - RNA, 22 nt, Human
auagugugugguauagguagag

SEQ ID NO: 18358 - RNA, 22 nt, Human
auaguguuuuacuuagacuucu

SEQ ID NO: 18359 - RNA, 22 nt, Human
auaguuacaaagacuuuuuaaa

SEQ ID NO: 18360 - RNA, 22 nt, Human
auaguuauuagagaagcuggua

SEQ ID NO: 18361 - RNA, 22 nt, Human
auaguuccagcaucuuugguaa

SEQ ID NO: 18362 - RNA, 22 nt, Human
auaguuccuacuuugcacuaau

SEQ ID NO: 18363 - RNA, 22 nt, Human
auaguucucacucagaauuuga

SEQ ID NO: 18364 - RNA, 23 nt, Human
auaguucugcuuagaaaucagug

SEQ ID NO: 18365 - RNA, 22 nt, Human
auaguucuggauguacuuauag

SEQ ID NO: 18366 - RNA, 22 nt, Human
auaguuuacaaaaaugaugcau

SEQ ID NO: 18367 - RNA, 21 nt, Human
auaguuuggagugggaaaguc

SEQ ID NO: 18368 - RNA, 22 nt, Human
auaguuugugaaacacagcagu

SEQ ID NO: 18369 - RNA, 22 nt, Human
auaguuuucuaugcacuguuau

SEQ ID NO: 18370 - RNA, 22 nt, Human
auauaaaguguuuagaaagcug

SEQ ID NO: 18371 - RNA, 22 nt, Human
auauaauacaaccugcuaagug

SEQ ID NO: 18372 - RNA, 22 nt, Human
auauaauaguuucauaaaggcu

SEQ ID NO: 18373 - RNA, 22 nt, Human
auauaauucucagguuugacua

SEQ ID NO: 18374 - RNA, 22 nt, Human
auauacacauguguauacauuu

SEQ ID NO: 18375 - RNA, 22 nt, Human
auauacacauuugcuuaugugu

SEQ ID NO: 18376 - RNA, 22 nt, Human
auauacacucaccaugguauuu

SEQ ID NO: 18377 - RNA, 22 nt, Human
auauacacuccacugauacagg

SEQ ID NO: 18378 - RNA, 22 nt, Human
auauacaugggaauauguggag

SEQ ID NO: 18379 - RNA, 22 nt, Human
auauaccugaaguugguaauua

SEQ ID NO: 18380 - RNA, 22 nt, Human
auauacuguagugguuuagagc

SEQ ID NO: 18381 - RNA, 22 nt, Human
auauacuuggagacuaucauug

SEQ ID NO: 18382 - RNA, 22 nt, Human
auauagaguaauuauuuggugu

SEQ ID NO: 18383 - RNA, 22 nt, Human
auauagguuaucauauuugccc

SEQ ID NO: 18384 - RNA, 22 nt, Human
auauagucaaacauauaugugu

SEQ ID NO: 18385 - RNA, 22 nt, Human
auauagucacacuuugcaggca

SEQ ID NO: 18386 - RNA, 22 nt, Human
auauaguuuaagaaaguacagu

SEQ ID NO: 18387 - RNA, 22 nt, Human
auauaguuuagguucgaauggg

SEQ ID NO: 18388 - RNA, 22 nt, Human
auauauagagcuagauguuaaa

SEQ ID NO: 18389 - RNA, 22 nt, Human
auauauaugcugauggcugcca

SEQ ID NO: 18390 - RNA, 22 nt, Human
auauauucuuaaagaaucugac

SEQ ID NO: 18391 - RNA, 22 nt, Human
auauauuggugucagaaagagu

SEQ ID NO: 18392 - RNA, 22 nt, Human
auaucaagauuauuagggucau

SEQ ID NO: 18393 - RNA, 22 nt, Human
auaucagacagaaagcauugac

SEQ ID NO: 18394 - RNA, 18 nt, Human
auaucagcuacuucaugg

SEQ ID NO: 18395 - RNA, 22 nt, Human
auaucaguaucuauguauuugu

SEQ ID NO: 18396 - RNA, 22 nt, Human
auaucauuauguuaugagcaca

SEQ ID NO: 18397 - RNA, 22 nt, Human
auauccaagaaacaauuaauuc

SEQ ID NO: 18398 - RNA, 22 nt, Human
auauccuuuacugugucacaga

SEQ ID NO: 18399 - RNA, 22 nt, Human
auaucuguguuucccuuuugcu

SEQ ID NO: 18400 - RNA, 21 nt, Human
auaugaacuguggacuuugga

SEQ ID NO: 18401 - RNA, 22 nt, Human
auaugaagaaucuaggauaggc

SEQ ID NO: 18402 - RNA, 22 nt, Human
auaugaaguuacagguaagaaa

SEQ ID NO: 18403 - RNA, 22 nt, Human
auaugaauuuggcuggaaaggu

SEQ ID NO: 18404 - RNA, 22 nt, Human
auaugacagcggauucacauau

SEQ ID NO: 18405 - RNA, 22 nt, Human
auaugacauaaaaucauuuuug

SEQ ID NO: 18406 - RNA, 22 nt, Human
auaugcaucugugugcgugucu

SEQ ID NO: 18407 - RNA, 22 nt, Human
auaugcaugcaugcuugugaga

SEQ ID NO: 18408 - RNA, 20 nt, Human
auaugcauguguuuucacuu

SEQ ID NO: 18409 - RNA, 22 nt, Human
auaugcauuuaccuggcauaua

SEQ ID NO: 18410 - RNA, 22 nt, Human
auaugccagcuccaaguaagag

SEQ ID NO: 18411 - RNA, 22 nt, Human
auaugccauuagcuagaaauaa

SEQ ID NO: 18412 - RNA, 22 nt, Human
auaugcuggaguacaggaaaua

SEQ ID NO: 18413 - RNA, 22 nt, Human
auaugcuuaugaugucucaagu

SEQ ID NO: 18414 - RNA, 22 nt, Human
auauggacuuaaaauuugaugu

SEQ ID NO: 18415 - RNA, 22 nt, Human
auauggcauucuuuuuaagggu

SEQ ID NO: 18416 - RNA, 22 nt, Human
auauggcauuuuaauguaugag

SEQ ID NO: 18417 - RNA, 23 nt, Human
auauggcuguuguguguuaacau

SEQ ID NO: 18418 - RNA, 22 nt, Human
auauguauguacgcacauauuc

SEQ ID NO: 18419 - RNA, 18 nt, Human
auauguuaauuagguagg

SEQ ID NO: 18420 - RNA, 22 nt, Human
auauguuuuuggaaagaacaca

SEQ ID NO: 18421 - RNA, 22 nt, Human
auauuaaugagcaaguaaguga

SEQ ID NO: 18422 - RNA, 22 nt, Human
auauuacauaaacaugagugaa

SEQ ID NO: 18423 - RNA, 22 nt, Human
auauuagcagugaucaaaaugg

SEQ ID NO: 18424 - RNA, 22 nt, Human
auacaacuuuaucuguaaugag

SEQ ID NO: 18425 - RNA, 18 nt, Human
auacaagaucaaguguuc

SEQ ID NO: 18426 - RNA, 20 nt, Human
auacaagaugaguaauuucu

SEQ ID NO: 18427 - RNA, 22 nt, Human
auacaagguggagucaggaaaa

SEQ ID NO: 18428 - RNA, 22 nt, Human
auacaaguugugauaauguaaa

SEQ ID NO: 18429 - RNA, 22 nt, Human
auacaauaguguuuguuuugag

SEQ ID NO: 18430 - RNA, 22 nt, Human
auacaaucuagucugucagcaa

SEQ ID NO: 18431 - RNA, 22 nt, Human
auacacauguuauuguggaagc

SEQ ID NO: 18432 - RNA, 22 nt, Human
auacaccaccuuggaucuuuca

SEQ ID NO: 18433 - RNA, 22 nt, Human
auacacuggccuuugcagagcc

SEQ ID NO: 18434 - RNA, 22 nt, Human
auauucacuccuggugagacua

SEQ ID NO: 18435 - RNA, 22 nt, Human
auauucugcuuuugaugcauuc

SEQ ID NO: 18436 - RNA, 22 nt, Human
auauucuucuuguucagacuau

SEQ ID NO: 18437 - RNA, 22 nt, Human
auauucuugaagggagauuaua

SEQ ID NO: 18438 - RNA, 22 nt, Human
auauugagaugaggauauuaac

SEQ ID NO: 18439 - RNA, 22 nt, Human
auauuguuaguaauauuucgaa

SEQ ID NO: 18440 - RNA, 22 nt, Human
auauuugcugagaaggagggag

SEQ ID NO: 18441 - RNA, 22 nt, Human
auauuuguaaaauucugugucu

SEQ ID NO: 18442 - RNA, 22 nt, Human
auauuugugguuuuuggcuccu

SEQ ID NO: 18443 - RNA, 22 nt, Human
auauuuguuagagucuaugugu

SEQ ID NO: 18444 - RNA, 22 nt, Human
auauuuucuggaacuaugccug

SEQ ID NO: 18445 - RNA, 22 nt, Human
auauuuuggcaaaugucuagau

SEQ ID NO: 18446 - RNA, 22 nt, Human
aucaaagauguuucagggugua

SEQ ID NO: 18447 - RNA, 20 nt, Human
aucaaaggcugauucagucc

SEQ ID NO: 18448 - RNA, 22 nt, Human
aucaaaguaggcauauguuuuu

SEQ ID NO: 18449 - RNA, 22 nt, Human
aucaaauaaagguaccuagcuu

SEQ ID NO: 18450 - RNA, 23 nt, Human
aucaaaugauuggccauucagug

SEQ ID NO: 18451 - RNA, 22 nt, Human
aucaacagguauggaugagauu

SEQ ID NO: 18452 - RNA, 22 nt, Human
aucaacaugaauuucucugaag

SEQ ID NO: 18453 - RNA, 22 nt, Human
aucaacaugucauaaagugaaa

SEQ ID NO: 18454 - RNA, 22 nt, Human
aucaacugccccaaauguauuu

SEQ ID NO: 18455 - RNA, 22 nt, Human
aucaacuuaaagaaaagauacu

SEQ ID NO: 18456 - RNA, 22 nt, Human
aucaacuuguccuugauguuaa

SEQ ID NO: 18457 - RNA, 22 nt, Human
aucaagaacuuauuuuggaaau

SEQ ID NO: 18458 - RNA, 22 nt, Human
aucaagcacuucuacaugacau

SEQ ID NO: 18459 - RNA, 22 nt, Human
aucaagcagugaaaaaugcuag

SEQ ID NO: 18460 - RNA, 23 nt, Human
aucaagucaucagcaaaauacau

SEQ ID NO: 18461 - RNA, 22 nt, Human
aucaauguugggccaaagcaaa

SEQ ID NO: 18462 - RNA, 22 nt, Human
aucacaaaggguuuucucugag

SEQ ID NO: 18463 - RNA, 22 nt, Human
aucacaauguacguuaaaaugu

SEQ ID NO: 18464 - RNA, 22 nt, Human
aucacacuguuauuuuaguuaa

SEQ ID NO: 18465 - RNA, 19 nt, Human
aucacagacgugccucauc

SEQ ID NO: 18466 - RNA, 22 nt, Human
aucacaguggcuaccucuggau

SEQ ID NO: 18467 - RNA, 22 nt, Human
aucacaguuuacaaaccugcug

SEQ ID NO: 18468 - RNA, 22 nt, Human
aucacaguuuugugccuugugg

SEQ ID NO: 18469 - RNA, 22 nt, Human
aucacaucucaccacugcaacc

SEQ ID NO: 18470 - RNA, 22 nt, Human
aucacauggaaugauuuuagac

SEQ ID NO: 18471 - RNA, 21 nt, Human
aucacauuggcuguuauuauu

SEQ ID NO: 18472 - RNA, 22 nt, Human
aucaccauugaaaaacagguuu

SEQ ID NO: 18473 - RNA, 20 nt, Human
aucaccuguagguucuuugu

SEQ ID NO: 18474 - RNA, 22 nt, Human
aucacuaugggcauuauauuua

SEQ ID NO: 18475 - RNA, 22 nt, Human
aucacugggcuucuaaucacug

SEQ ID NO: 18476 - RNA, 22 nt, Human
aucacuguuaucuagaagcaca

SEQ ID NO: 18477 - RNA, 22 nt, Human
aucagaaaaaugagaagagcug

SEQ ID NO: 18478 - RNA, 22 nt, Human
aucagaaacucuuagagcaggg

SEQ ID NO: 18479 - RNA, 22 nt, Human
aucagaaaggugggcaagcaga

SEQ ID NO: 18480 - RNA, 22 nt, Human
aucagaaaucuaggauucagaa

SEQ ID NO: 18481 - RNA, 22 nt, Human
aucagaagaaauggaugugacu

SEQ ID NO: 18482 - RNA, 22 nt, Human
aucagaagcuuguagucucucu

SEQ ID NO: 18483 - RNA, 22 nt, Human
aucagaaggggagguaaagaag

SEQ ID NO: 18484 - RNA, 22 nt, Human
aucagaaguugugcaugcaugg

SEQ ID NO: 18485 - RNA, 21 nt, Human
aucagaaguuuuggucaguag

SEQ ID NO: 18486 - RNA, 22 nt, Human
aucagaauggagcccacauggu

SEQ ID NO: 18487 - RNA, 22 nt, Human
aucagaauuagccagugaggcu

SEQ ID NO: 18488 - RNA, 22 nt, Human
aucagacaauuguugaguacug

SEQ ID NO: 18489 - RNA, 22 nt, Human
aucagagaccggucaagucaug

SEQ ID NO: 18490 - RNA, 22 nt, Human
aucagagcaauggauaaaauca

SEQ ID NO: 18491 - RNA, 22 nt, Human
aucagagccuuaugcuucucau

SEQ ID NO: 18492 - RNA, 21 nt, Human
aucagaguacgcaugcgcuga

SEQ ID NO: 18493 - RNA, 21 nt, Human
aucagcaaaugccugucuccc

SEQ ID NO: 18494 - RNA, 22 nt, Human
aucagcaagauugugucuugua

SEQ ID NO: 18495 - RNA, 19 nt, Human
aucagcaagguaggaugug

SEQ ID NO: 18496 - RNA, 22 nt, Human
aucagcaaguccuguuaauucu

SEQ ID NO: 18497 - RNA, 22 nt, Human
aucagcaaucaaauugcagagu

SEQ ID NO: 18498 - RNA, 22 nt, Human
aucagcacaacguacagagaaa

SEQ ID NO: 18499 - RNA, 22 nt, Human
aucagcagugucuaccucggug

SEQ ID NO: 18500 - RNA, 22 nt, Human
aucagcccaccaucuucauaac

SEQ ID NO: 18501 - RNA, 22 nt, Human
aucagcucauuuugauggaaau

SEQ ID NO: 18502 - RNA, 22 nt, Human
aucagcugaaaaacaggcagca

SEQ ID NO: 18503 - RNA, 19 nt, Human
aucagcugaagccuucaga

SEQ ID NO: 18504 - RNA, 22 nt, Human
aucagcugaugaauggaugaau

SEQ ID NO: 18505 - RNA, 22 nt, Human
aucagcugcuacauuggccucu

SEQ ID NO: 18506 - RNA, 22 nt, Human
aucagcuuuucucaucagaaau

SEQ ID NO: 18507 - RNA, 22 nt, Human
aucaggaagaauuggaugcuac

SEQ ID NO: 18508 - RNA, 22 nt, Human
aucaggaagccagucuaaugga

SEQ ID NO: 18509 - RNA, 22 nt, Human
aucaggaaugaauacuuuugga

SEQ ID NO: 18510 - RNA, 22 nt, Human
aucaggaauuaggugagaugga

SEQ ID NO: 18511 - RNA, 22 nt, Human
aucaggaucugggagccugaaa

SEQ ID NO: 18512 - RNA, 22 nt, Human
aucaggauucaccccagagcug

SEQ ID NO: 18513 - RNA, 22 nt, Human
aucaggauucaguaucuccagc

SEQ ID NO: 18514 - RNA, 20 nt, Human
aucaggauucuugcuuuguu

SEQ ID NO: 18515 - RNA, 22 nt, Human
aucaggcuaguguguguguuca

SEQ ID NO: 18516 - RNA, 20 nt, Human
aucaggcuuucuguugcgau

SEQ ID NO: 18517 - RNA, 21 nt, Human
aucaguaagguuggaggaaga

SEQ ID NO: 18518 - RNA, 22 nt, Human
aucaguauccugcaguuucuau

SEQ ID NO: 18519 - RNA, 22 nt, Human
aucagucuguguuagaaaagag

SEQ ID NO: 18520 - RNA, 22 nt, Human
aucagucuguuggaauaucgcu

SEQ ID NO: 18521 - RNA, 22 nt, Human
aucagugaccugaaauguuuuu

SEQ ID NO: 18522 - RNA, 19 nt, Human
aucagugcaugagugcugu

SEQ ID NO: 18523 - RNA, 22 nt, Human
aucagugcuaagagagggccug

SEQ ID NO: 18524 - RNA, 22 nt, Human
aucagugcugagagacuaucaa

SEQ ID NO: 18525 - RNA, 22 nt, Human
aucagugugucaaaagcacaaa

SEQ ID NO: 18526 - RNA, 22 nt, Human
aucaguguuguugauuggauag

SEQ ID NO: 18527 - RNA, 22 nt, Human
aucaguguuugcaugggagcuu

SEQ ID NO: 18528 - RNA, 22 nt, Human
aucaguuaguuacugcuaagau

SEQ ID NO: 18529 - RNA, 22 nt, Human
aucaguuuaacugucaagagcc

SEQ ID NO: 18530 - RNA, 22 nt, Human
aucaguuuauacuuauaaaucu

SEQ ID NO: 18531 - RNA, 22 nt, Human
aucaguuucuaccauguggaau

SEQ ID NO: 18532 - RNA, 22 nt, Human
aucaguuucugugaagaacaca

SEQ ID NO: 18533 - RNA, 22 nt, Human
auagacauuuugcauucaagca

SEQ ID NO: 18534 - RNA, 23 nt, Human
auagacccaagaguaaaggcauc

SEQ ID NO: 18535 - RNA, 22 nt, Human
auagacuugaggauauaaugaa

SEQ ID NO: 18536 - RNA, 22 nt, Human
auagacuugguuaguaaauuug

SEQ ID NO: 18537 - RNA, 19 nt, Human
auagagacagaguuuaauc

SEQ ID NO: 18538 - RNA, 22 nt, Human
auagagacuauagagcacuuac

SEQ ID NO: 18539 - RNA, 22 nt, Human
auagaguuuuauuuuccaauaa

SEQ ID NO: 18540 - RNA, 22 nt, Human
auagauaauguguagcagugau

SEQ ID NO: 18541 - RNA, 22 nt, Human
auagauauuagcaaaauuuuau

SEQ ID NO: 18542 - RNA, 22 nt, Human
auagaucaaugagcaauuuaau

SEQ ID NO: 18543 - RNA, 22 nt, Human
auagaucauugauacuugcauc

SEQ ID NO: 18544 - RNA, 22 nt, Human
auagauguacguauguaaauca

SEQ ID NO: 18545 - RNA, 22 nt, Human
auagauguguguaaguacauaa

SEQ ID NO: 18546 - RNA, 22 nt, Human
auagauguuuuaguaauacugu

SEQ ID NO: 18547 - RNA, 22 nt, Human
auagcaaaaaugaacaaagcuu

SEQ ID NO: 18548 - RNA, 22 nt, Human
auagcaaacuggcagcuugugg

SEQ ID NO: 18549 - RNA, 22 nt, Human
auagcaaauucuuuaggugcuu

SEQ ID NO: 18550 - RNA, 22 nt, Human
auagcaagguaugacuggagcc

SEQ ID NO: 18551 - RNA, 22 nt, Human
aucaucuugcuuucuguuuacu

SEQ ID NO: 18552 - RNA, 20 nt, Human
aucaucuuuacaaugucagu

SEQ ID NO: 18553 - RNA, 22 nt, Human
aucaugcugacacaguuuaucu

SEQ ID NO: 18554 - RNA, 22 nt, Human
aucauguucaucguauuuaggc

SEQ ID NO: 18555 - RNA, 22 nt, Human
aucauguugcucaaaauuaaac

SEQ ID NO: 18556 - RNA, 22 nt, Human
aucauguuuuaauuagcaaacu

SEQ ID NO: 18557 - RNA, 22 nt, Human
aucauuaaauauaagcuucaca

SEQ ID NO: 18558 - RNA, 22 nt, Human
aucauuaacccuugaugcuggg

SEQ ID NO: 18559 - RNA, 21 nt, Human
aucauuaauugcugagugaca

SEQ ID NO: 18560 - RNA, 22 nt, Human
aucauucuagcuguuguguuga

SEQ ID NO: 18561 - RNA, 23 nt, Human
aucauucuccaaucuggagcagg

SEQ ID NO: 18562 - RNA, 22 nt, Human
aucauugagauuuuuuacaacu

SEQ ID NO: 18563 - RNA, 22 nt, Human
aucauuuggggaauuguggaca

SEQ ID NO: 18564 - RNA, 22 nt, Human
aucauuuugugacaaugccugu

SEQ ID NO: 18565 - RNA, 22 nt, Human
aucauuuuuaagagacucuucu

SEQ ID NO: 18566 - RNA, 22 nt, Human
auccaaaauuuacuguagcauu

SEQ ID NO: 18567 - RNA, 22 nt, Human
auccaaaccuggacaugagugg

SEQ ID NO: 18568 - RNA, 22 nt, Human
auccaaagaaugcuuagaccug

SEQ ID NO: 18569 - RNA, 22 nt, Human
auccaaauauauuuuauucacu

SEQ ID NO: 18570 - RNA, 22 nt, Human
auccaaaucaugucagaagaac

SEQ ID NO: 18571 - RNA, 22 nt, Human
auccaaaucuucacacauaaca

SEQ ID NO: 18572 - RNA, 22 nt, Human
auccaacacguauuugcuggcc

SEQ ID NO: 18573 - RNA, 22 nt, Human
auccaagucagggauaguuuga

SEQ ID NO: 18574 - RNA, 22 nt, Human
auccaauucuaauauuguguuu

SEQ ID NO: 18575 - RNA, 22 nt, Human
auccacaggaggguuuggaaaa

SEQ ID NO: 18576 - RNA, 22 nt, Human
auccacaguggggguggcggaa

SEQ ID NO: 18577 - RNA, 23 nt, Human
auccacauuacaguaucauacaa

SEQ ID NO: 18578 - RNA, 22 nt, Human
auccacccugugguggcuuucu

SEQ ID NO: 18579 - RNA, 22 nt, Human
auccacuccuggaggugcccca

SEQ ID NO: 18580 - RNA, 22 nt, Human
auccacucggagggaauguuua

SEQ ID NO: 18581 - RNA, 22 nt, Human
auccacucuaagaucuguggug

SEQ ID NO: 18582 - RNA, 22 nt, Human
auccacucucccauucaugcau

SEQ ID NO: 18583 - RNA, 22 nt, Human
auccagagacccaaggacagaa

SEQ ID NO: 18584 - RNA, 22 nt, Human
auccagagacuggggcugggau

SEQ ID NO: 18585 - RNA, 22 nt, Human
auccagagagguuaggugacau

SEQ ID NO: 18586 - RNA, 22 nt, Human
auccaggagucguggcgcucag

SEQ ID NO: 18587 - RNA, 22 nt, Human
auccaggccccaagaccccgac

SEQ ID NO: 18588 - RNA, 22 nt, Human
auccaggccuugaaguaccagu

SEQ ID NO: 18589 - RNA, 22 nt, Human
auccaggcugcuaugaggauga

SEQ ID NO: 18590 - RNA, 22 nt, Human
auccagggauaaaaguaagguu

SEQ ID NO: 18591 - RNA, 22 nt, Human
auccagguaugaauugugugac

SEQ ID NO: 18592 - RNA, 22 nt, Human
auccagucaaaauuaguaaggu

SEQ ID NO: 18593 - RNA, 22 nt, Human
auccagugagugcagcuguugu

SEQ ID NO: 18594 - RNA, 22 nt, Human
auccauaucuggacucuacccc

SEQ ID NO: 18595 - RNA, 20 nt, Human
auccaucauguccaugacuu

SEQ ID NO: 18596 - RNA, 21 nt, Human
auccauccaucuuggccuaac

SEQ ID NO: 18597 - RNA, 22 nt, Human
auccaucuuuccugcugaacug

SEQ ID NO: 18598 - RNA, 22 nt, Human
auccauggcuaaguauauagag

SEQ ID NO: 18599 - RNA, 23 nt, Human
auccaugugagaauagacuagca

SEQ ID NO: 18600 - RNA, 22 nt, Human
auccauuauugggccaauaaag

SEQ ID NO: 18601 - RNA, 22 nt, Human
auccauugucuuguuggcuucu

SEQ ID NO: 18602 - RNA, 22 nt, Human
auccauuguggucuuguacauu

SEQ ID NO: 18603 - RNA, 22 nt, Human
auccauuuaauugaggggaagg

SEQ ID NO: 18604 - RNA, 22 nt, Human
auccauuugacauaauuucagc

SEQ ID NO: 18605 - RNA, 22 nt, Human
auccauuuuugcaaaguuguuc

SEQ ID NO: 18606 - RNA, 18 nt, Human
aucccaaaagacaaggaa

SEQ ID NO: 18607 - RNA, 22 nt, Human
aucccacaccccuacaacauau

SEQ ID NO: 18608 - RNA, 21 nt, Human
aucccagcacccaggagugca

SEQ ID NO: 18609 - RNA, 22 nt, Human
aucccaggcggcacagguugca

SEQ ID NO: 18610 - RNA, 23 nt, Human
auccccugccuugggugaguccc

SEQ ID NO: 18611 - RNA, 22 nt, Human
aucccgaaccucuacuucuuuc

SEQ ID NO: 18612 - RNA, 22 nt, Human
aucccugugacgagcaucccua

SEQ ID NO: 18613 - RNA, 22 nt, Human
auccgcuuaucucagcuggcag

SEQ ID NO: 18614 - RNA, 22 nt, Human
auccgggguucauuuucacuga

SEQ ID NO: 18615 - RNA, 22 nt, Human
auccguuuuuaugaaaugucca

SEQ ID NO: 18616 - RNA, 22 nt, Human
auccuaaagaaauauuuauuaa

SEQ ID NO: 18617 - RNA, 19 nt, Human
auccuaaauccaguuucua

SEQ ID NO: 18618 - RNA, 22 nt, Human
auccucacauucucaggacaac

SEQ ID NO: 18619 - RNA, 20 nt, Human
auccucacccucaguccuag

SEQ ID NO: 18620 - RNA, 22 nt, Human
auccucagcaucuagcaugaag

SEQ ID NO: 18621 - RNA, 22 nt, Human
auccugaaaacuuacgaagugg

SEQ ID NO: 18622 - RNA, 23 nt, Human
auccugcugauggcccuccagga

SEQ ID NO: 18623 - RNA, 20 nt, Human
auccuggaauccaaauggag

SEQ ID NO: 18624 - RNA, 22 nt, Human
auccuggaggcuggaggcuugc

SEQ ID NO: 18625 - RNA, 22 nt, Human
auccuggcgggggaacugccca

SEQ ID NO: 18626 - RNA, 22 nt, Human
auccugggcaagucaauguccc

SEQ ID NO: 18627 - RNA, 22 nt, Human
auccugggggcagcuggaaaca

SEQ ID NO: 18628 - RNA, 19 nt, Human
auccuggguccuccagcug

SEQ ID NO: 18629 - RNA, 22 nt, Human
auccuguggcuccagggagccg

SEQ ID NO: 18630 - RNA, 23 nt, Human
auccuguuguaggcaguaauuag

SEQ ID NO: 18631 - RNA, 22 nt, Human
auccuuaaaggaauucugauuu

SEQ ID NO: 18632 - RNA, 22 nt, Human
auccuuagguggugcaucaggg

SEQ ID NO: 18633 - RNA, 22 nt, Human
auccuucagcugcccuguuacc

SEQ ID NO: 18634 - RNA, 22 nt, Human
auccuucaguggaagacaguag

SEQ ID NO: 18635 - RNA, 22 nt, Human
auccuucuccagucguauuuuu

SEQ ID NO: 18636 - RNA, 17 nt, Human
auccuucuguucuuucu

SEQ ID NO: 18637 - RNA, 22 nt, Human
auccuucuucugcuagugucua

SEQ ID NO: 18638 - RNA, 22 nt, Human
auccuugagaaaauaaaugacc

SEQ ID NO: 18639 - RNA, 22 nt, Human
auccuugagccuuaucuuuugu

SEQ ID NO: 18640 - RNA, 21 nt, Human
auccuugaucagaagagugcu

SEQ ID NO: 18641 - RNA, 18 nt, Human
auccuugaugagaggucu

SEQ ID NO: 18642 - RNA, 22 nt, Human
cacauucuugaguuacagucua

SEQ ID NO: 18643 - RNA, 22 nt, Human
cacauugauucaguccugugug

SEQ ID NO: 18644 - RNA, 22 nt, Human
cacauugcuccacaggguuaac

SEQ ID NO: 18645 - RNA, 22 nt, Human
cacauuuaaagguugaagcuga

SEQ ID NO: 18646 - RNA, 22 nt, Human
cacauuuaagcagauguggacc

SEQ ID NO: 18647 - RNA, 22 nt, Human
cacauuuaugggcugggaggca

SEQ ID NO: 18648 - RNA, 22 nt, Human
cacauuuccuuggccuuuaauu

SEQ ID NO: 18649 - RNA, 22 nt, Human
cacauuucuaggaaauuaaaug

SEQ ID NO: 18650 - RNA, 22 nt, Human
cacauuucuuauggauguuggc

SEQ ID NO: 18651 - RNA, 21 nt, Human
cacauuugaaccucacagcaa

SEQ ID NO: 18652 - RNA, 22 nt, Human
cacauuuuuacugccaacuuaa

SEQ ID NO: 18653 - RNA, 20 nt, Human
caccacagaauuggggacag

SEQ ID NO: 18654 - RNA, 22 nt, Human
caccacugaauuguucacuuuc

SEQ ID NO: 18655 - RNA, 22 nt, Human
caccacuguaucccuagcacuu

SEQ ID NO: 18656 - RNA, 22 nt, Human
caccagcccccucacgcuguca

SEQ ID NO: 18657 - RNA, 22 nt, Human
caccagcgacugugaccagcaa

SEQ ID NO: 18658 - RNA, 22 nt, Human
caccagcuacagacuacugugu

SEQ ID NO: 18659 - RNA, 22 nt, Human
caccagcugcaacaccaucucc

SEQ ID NO: 18660 - RNA, 22 nt, Human
caccagcuuugcccacugccca

SEQ ID NO: 18661 - RNA, 22 nt, Human
caccaggcacauaguaggcacu

SEQ ID NO: 18662 - RNA, 22 nt, Human
caccaggcugcccaggacaggg

SEQ ID NO: 18663 - RNA, 22 nt, Human
caccagggccccaggcugugcc

SEQ ID NO: 18664 - RNA, 16 nt, Human
caccaguccuuccugc

SEQ ID NO: 18665 - RNA, 22 nt, Human
caccauaaaaauaagagaugcc

SEQ ID NO: 18666 - RNA, 22 nt, Human
caccaucuauagagguauuugg

SEQ ID NO: 18667 - RNA, 22 nt, Human
cacccacauuccaucacucugc

SEQ ID NO: 18668 - RNA, 22 nt, Human
cacccacauuccucuaguaugu

SEQ ID NO: 18669 - RNA, 22 nt, Human
cacccagcauuggcuaagagag

SEQ ID NO: 18670 - RNA, 22 nt, Human
cacccaggcuggaaugcaaugg

SEQ ID NO: 18671 - RNA, 22 nt, Human
cacccagggcugugccugccca

SEQ ID NO: 18672 - RNA, 22 nt, Human
cacccaguugacuacaaagggg

SEQ ID NO: 18673 - RNA, 22 nt, Human
cacccauguuucccucugucuu

SEQ ID NO: 18674 - RNA, 23 nt, Human
caccccacccugaggaggaggga

SEQ ID NO: 18675 - RNA, 19 nt, Human
caccccaguccucuuuccc

SEQ ID NO: 18676 - RNA, 22 nt, Human
cacccccaccugugggcuccug

SEQ ID NO: 18677 - RNA, 22 nt, Human
caccccuaccugagucaggagu

SEQ ID NO: 18678 - RNA, 22 nt, Human
cacccguggagaagcaggagcg

SEQ ID NO: 18679 - RNA, 20 nt, Human
cacccuacggccucaccucc

SEQ ID NO: 18680 - RNA, 18 nt, Human
cacccuccgcggcugccc

SEQ ID NO: 18681 - RNA, 17 nt, Human
cacccuggcuagucuga

SEQ ID NO: 18682 - RNA, 22 nt, Human
caccguuugguuuggauuuaca

SEQ ID NO: 18683 - RNA, 22 nt, Human
caccucaugucaucaguaaaau

SEQ ID NO: 18684 - RNA, 22 nt, Human
caccugaauggaacuuugaacc

SEQ ID NO: 18685 - RNA, 22 nt, Human
caccugagcaacccugugcggg

SEQ ID NO: 18686 - RNA, 22 nt, Human
caccugcaaggagcuuucauuu

SEQ ID NO: 18687 - RNA, 22 nt, Human
caccugccccagucuuggagcu

SEQ ID NO: 18688 - RNA, 22 nt, Human
caccugccugguccuuagggcu

SEQ ID NO: 18689 - RNA, 22 nt, Human
caccugcucccucaguuccagc

SEQ ID NO: 18690 - RNA, 22 nt, Human
caccugcugagcugcugggggu

SEQ ID NO: 18691 - RNA, 22 nt, Human
caccuggacccugggaggaggg

SEQ ID NO: 18692 - RNA, 22 nt, Human
caccuggaguagcaagguaauu

SEQ ID NO: 18693 - RNA, 22 nt, Human
caccuggcagcuguuggccacg

SEQ ID NO: 18694 - RNA, 22 nt, Human
caccuggcccagcuccagugcu

SEQ ID NO: 18695 - RNA, 21 nt, Human
caccugugagacucucagacc

SEQ ID NO: 18696 - RNA, 20 nt, Human
caccuucaaauuuccuggca

SEQ ID NO: 18697 - RNA, 22 nt, Human
caccuuccaucuccuuggcuag

SEQ ID NO: 18698 - RNA, 22 nt, Human
caccuugagggggaaaauaauc

SEQ ID NO: 18699 - RNA, 22 nt, Human
cacgaaaucuaggagaguaaca

SEQ ID NO: 18700 - RNA, 22 nt, Human
cacgagaaccucucauuugauu

SEQ ID NO: 18701 - RNA, 22 nt, Human
cacgaggccaucuccuucugga

SEQ ID NO: 18702 - RNA, 22 nt, Human
cacgcacgcuggguggaggcgc

SEQ ID NO: 18703 - RNA, 22 nt, Human
cacgccagccggacacugggcc

SEQ ID NO: 18704 - RNA, 22 nt, Human
cacgcgcacacucaggucaagu

SEQ ID NO: 18705 - RNA, 22 nt, Human
cacggguggaaucagggacucc

SEQ ID NO: 18706 - RNA, 22 nt, Human
cacggucacccaucagagucca

SEQ ID NO: 18707 - RNA, 22 nt, Human
cacuaaauguuucaauguggga

SEQ ID NO: 18708 - RNA, 20 nt, Human
cacuacuuguuuuugucaau

SEQ ID NO: 18709 - RNA, 22 nt, Human
cacuaggcaucugugaggguag

SEQ ID NO: 18710 - RNA, 22 nt, Human
cacuaguaauucuugugcugga

SEQ ID NO: 18711 - RNA, 22 nt, Human
cacuaugcuuacaugcuuauau

SEQ ID NO: 18712 - RNA, 22 nt, Human
cacucacccgguccuucccagu

SEQ ID NO: 18713 - RNA, 22 nt, Human
cacucagcccacccauguuugu

SEQ ID NO: 18714 - RNA, 22 nt, Human
cacuccaagaccuacuuucucu

SEQ ID NO: 18715 - RNA, 22 nt, Human
cacuccagccauuuguccccag

SEQ ID NO: 18716 - RNA, 22 nt, Human
cacucccuucaggagccuagga

SEQ ID NO: 18717 - RNA, 22 nt, Human
cacuccuauaauuaaagaugca

SEQ ID NO: 18718 - RNA, 22 nt, Human
cacuccuguuccacuaaaugag

SEQ ID NO: 18719 - RNA, 22 nt, Human
cacucugacuggcccugcagga

SEQ ID NO: 18720 - RNA, 22 nt, Human
cacucugagaaguacaagcucc

SEQ ID NO: 18721 - RNA, 22 nt, Human
cacucugagcccaagcaggcug

SEQ ID NO: 18722 - RNA, 22 nt, Human
cacucugcagcugaagggcugg

SEQ ID NO: 18723 - RNA, 22 nt, Human
cacucugcaggccaaaccaaag

SEQ ID NO: 18724 - RNA, 22 nt, Human
cacucugccugauguuacaugg

SEQ ID NO: 18725 - RNA, 22 nt, Human
cacucuggggaugcaaggagag

SEQ ID NO: 18726 - RNA, 22 nt, Human
cacucugugauugcagcauucc

SEQ ID NO: 18727 - RNA, 22 nt, Human
cacugaaaauuagcuuuccuga

SEQ ID NO: 18728 - RNA, 22 nt, Human
cacugaaaggaaaccagagcau

SEQ ID NO: 18729 - RNA, 22 nt, Human
cacugaaaggcaaugcugacag

SEQ ID NO: 18730 - RNA, 22 nt, Human
cacugaacaacaaauagugaau

SEQ ID NO: 18731 - RNA, 22 nt, Human
cacugaagccacuggaagagga

SEQ ID NO: 18732 - RNA, 22 nt, Human
cacugaaucucaaggggagggu

SEQ ID NO: 18733 - RNA, 22 nt, Human
cacugacaguaucagagcuguu

SEQ ID NO: 18734 - RNA, 22 nt, Human
cacugacuccaaaaauaaagaa

SEQ ID NO: 18735 - RNA, 22 nt, Human
cacugagaguagggcacaagug

SEQ ID NO: 18736 - RNA, 22 nt, Human
cacugagccuugccagcuuggu

SEQ ID NO: 18737 - RNA, 22 nt, Human
cacugagggaggguuucuucug

SEQ ID NO: 18738 - RNA, 22 nt, Human
cacugagggggugguuucagga

SEQ ID NO: 18739 - RNA, 20 nt, Human
cacugaggugcagcucaugc

SEQ ID NO: 18740 - RNA, 22 nt, Human
cacugcaaaggggaaagaagca

SEQ ID NO: 18741 - RNA, 22 nt, Human
cacugcaacaaccucuaccucc

SEQ ID NO: 18742 - RNA, 22 nt, Human
cacugcagccucgcucuccuga

SEQ ID NO: 18743 - RNA, 23 nt, Human
cacugcagcguggucuggcagga

SEQ ID NO: 18744 - RNA, 22 nt, Human
cacugcaggucugagauggggg

SEQ ID NO: 18745 - RNA, 20 nt, Human
cacugccagaauacacuguc

SEQ ID NO: 18746 - RNA, 22 nt, Human
cacugcccagcgucuuaggcac

SEQ ID NO: 18747 - RNA, 22 nt, Human
cacugcccaggaccugccaccc

SEQ ID NO: 18748 - RNA, 22 nt, Human
cacugcccaggcacccaucuug

SEQ ID NO: 18749 - RNA, 22 nt, Human
cacugcuaugaugaugauauuu

SEQ ID NO: 18750 - RNA, 22 nt, Human
cacugcugauuucauaggcagg

SEQ ID NO: 18751 - RNA, 22 nt, Human
aucuguggaaagguaaccagua

SEQ ID NO: 18752 - RNA, 22 nt, Human
aucuguggaaauuggcaagugc

SEQ ID NO: 18753 - RNA, 22 nt, Human
aucuguggccaaaagacuguug

SEQ ID NO: 18754 - RNA, 22 nt, Human
aucuguggcgcaaacaaaggcu

SEQ ID NO: 18755 - RNA, 22 nt, Human
aucuguggucaaaauagaaacu

SEQ ID NO: 18756 - RNA, 23 nt, Human
aucuguguguggguagggaugau

SEQ ID NO: 18757 - RNA, 22 nt, Human
aucuguuaacaaagaagacagc

SEQ ID NO: 18758 - RNA, 22 nt, Human
aucuguuccccuaugcucucua

SEQ ID NO: 18759 - RNA, 19 nt, Human
aucuuacagagcagaguac

SEQ ID NO: 18760 - RNA, 22 nt, Human
aucuuagacccuugguagaaaa

SEQ ID NO: 18761 - RNA, 22 nt, Human
aucuuauguuguauucaaaauc

SEQ ID NO: 18762 - RNA, 22 nt, Human
aucuuauugcuguugccagaua

SEQ ID NO: 18763 - RNA, 22 nt, Human
aucuucaaagaauuucuugucc

SEQ ID NO: 18764 - RNA, 22 nt, Human
aucuucaaagggauguccaugg

SEQ ID NO: 18765 - RNA, 22 nt, Human
aucuucaaggaaaaaauacagu

SEQ ID NO: 18766 - RNA, 22 nt, Human
aucuucaauugaaaacuagccu

SEQ ID NO: 18767 - RNA, 22 nt, Human
aucuucaucaaguucacagugg

SEQ ID NO: 18768 - RNA, 22 nt, Human
aucuucucaagcagcauccugu

SEQ ID NO: 18769 - RNA, 22 nt, Human
aucuuggacuacagaagagagg

SEQ ID NO: 18770 - RNA, 22 nt, Human
aucuuggggaauccucugugua

SEQ ID NO: 18771 - RNA, 22 nt, Human
aucuuggggacugucucuugua

SEQ ID NO: 18772 - RNA, 22 nt, Human
aucuuguuaaaaagcagauucu

SEQ ID NO: 18773 - RNA, 22 nt, Human
aucuuguuaaagugcagauucu

SEQ ID NO: 18774 - RNA, 22 nt, Human
aucuuuaccaccaaagaaugcu

SEQ ID NO: 18775 - RNA, 21 nt, Human
aucuuuagccauccaaucaga

SEQ ID NO: 18776 - RNA, 22 nt, Human
aucuuuaggcaaguuacuuaac

SEQ ID NO: 18777 - RNA, 22 nt, Human
aucuuuaguagaggaauauauu

SEQ ID NO: 18778 - RNA, 22 nt, Human
aucuuuauauaucuccucugaa

SEQ ID NO: 18779 - RNA, 22 nt, Human
aucuuuccuguuuucagacagc

SEQ ID NO: 18780 - RNA, 22 nt, Human
aucuuucuaugguacuuucucc

SEQ ID NO: 18781 - RNA, 22 nt, Human
cacuguacugugaauaaggagg

SEQ ID NO: 18782 - RNA, 22 nt, Human
cacugucccuguuuccuggaaa

SEQ ID NO: 18783 - RNA, 22 nt, Human
cacugugcuccuaacuagcugu

SEQ ID NO: 18784 - RNA, 22 nt, Human
cacuguggagcaaauuuauuua

SEQ ID NO: 18785 - RNA, 22 nt, Human
cacuguggcaaccugugcccaa

SEQ ID NO: 18786 - RNA, 20 nt, Human
cacuguggcacauugguuua

SEQ ID NO: 18787 - RNA, 22 nt, Human
cacuguggugccaaaccuggag

SEQ ID NO: 18788 - RNA, 22 nt, Human
cacuguucuuuuuguaguccaa

SEQ ID NO: 18789 - RNA, 22 nt, Human
cacuguugaagauacuuccucu

SEQ ID NO: 18790 - RNA, 19 nt, Human
cacuguuguccuaguacuu

SEQ ID NO: 18791 - RNA, 22 nt, Human
cacuguuuuacauguuauuuaa

SEQ ID NO: 18792 - RNA, 22 nt, Human
cacuguuuucagucaguucuau

SEQ ID NO: 18793 - RNA, 22 nt, Human
cacuguuuuuauguaaucagug

SEQ ID NO: 18794 - RNA, 22 nt, Human
cacuuaaauguuccuacagcag

SEQ ID NO: 18795 - RNA, 22 nt, Human
cacuuaagcaguuaauuuaucu

SEQ ID NO: 18796 - RNA, 22 nt, Human
cacuuacacuucugaaagccua

SEQ ID NO: 18797 - RNA, 22 nt, Human
cacuuagaaaacuugagcaagu

SEQ ID NO: 18798 - RNA, 22 nt, Human
cacuucaaauaagcucuucuca

SEQ ID NO: 18799 - RNA, 22 nt, Human
cacuucaaccucugaguccugg

SEQ ID NO: 18800 - RNA, 22 nt, Human
cacuucaaggaauaucuagaaa

SEQ ID NO: 18801 - RNA, 19 nt, Human
cacuucaauccuuuaucaa

SEQ ID NO: 18802 - RNA, 19 nt, Human
cacuucacauggugaaagc

SEQ ID NO: 18803 - RNA, 22 nt, Human
cacuucagcuacaaucacauga

SEQ ID NO: 18804 - RNA, 22 nt, Human
cacuugaacuguuugaaugaga

SEQ ID NO: 18805 - RNA, 22 nt, Human
cacuugaauggcauuguuccuu

SEQ ID NO: 18806 - RNA, 22 nt, Human
cacuugauggaagagcagaaga

SEQ ID NO: 18807 - RNA, 17 nt, Human
cacuugcuggucuaccu

SEQ ID NO: 18808 - RNA, 22 nt, Human
cacuugggagcauugcacaugu

SEQ ID NO: 18809 - RNA, 22 nt, Human
cacuuuaaaacugacagcccuu

SEQ ID NO: 18810 - RNA, 21 nt, Human
cacuuuaauggauauuuguuu

SEQ ID NO: 18811 - RNA, 22 nt, Human
cacuuuauauucuaagacggcc

SEQ ID NO: 18812 - RNA, 22 nt, Human
cacuuuaugggaagcaaaaauu

SEQ ID NO: 18813 - RNA, 22 nt, Human
cacuuugcuuagagaacaaggc

SEQ ID NO: 18814 - RNA, 22 nt, Human
cacuuuggaugccacuggucua

SEQ ID NO: 18815 - RNA, 17 nt, Human
cacuuuguugcuguggg

SEQ ID NO: 18816 - RNA, 22 nt, Human
cacuuuuaaauggguccguguu

SEQ ID NO: 18817 - RNA, 22 nt, Human
cagaaacagacaugacgcagua

SEQ ID NO: 18818 - RNA, 22 nt, Human
cagaaaccaaaugggaugggga

SEQ ID NO: 18819 - RNA, 22 nt, Human
cagaaacuguggauucauuaaa

SEQ ID NO: 18820 - RNA, 22 nt, Human
cagaaagaccugggcucaagag

SEQ ID NO: 18821 - RNA, 22 nt, Human
cagaaagcaaaauggaucucug

SEQ ID NO: 18822 - RNA, 23 nt, Human
cagaaagcccuuuccccacagua

SEQ ID NO: 18823 - RNA, 22 nt, Human
cagaaagcuugguacaauaugc

SEQ ID NO: 18824 - RNA, 22 nt, Human
cagaaaggacagagugagggug

SEQ ID NO: 18825 - RNA, 22 nt, Human
cagaaaggcacccacugggucu

SEQ ID NO: 18826 - RNA, 19 nt, Human
cagaaauagcgaaguguaa

SEQ ID NO: 18827 - RNA, 22 nt, Human
cagaaauaucaguugaaagugc

SEQ ID NO: 18828 - RNA, 22 nt, Human
cagaaaucauugugaugacagg

SEQ ID NO: 18829 - RNA, 22 nt, Human
cagaaaugacaaaguaagagga

SEQ ID NO: 18830 - RNA, 22 nt, Human
cagaaauguacugacaugcagu

SEQ ID NO: 18831 - RNA, 22 nt, Human
cagaaaugugauguacacacac

SEQ ID NO: 18832 - RNA, 22 nt, Human
cagaacacaggcuaaacugaga

SEQ ID NO: 18833 - RNA, 22 nt, Human
cagaacagaaguaaaauuuacc

SEQ ID NO: 18834 - RNA, 22 nt, Human
cagaacagacuuaacagggcug

SEQ ID NO: 18835 - RNA, 19 nt, Human
cagaacaggaccaggggcc

SEQ ID NO: 18836 - RNA, 22 nt, Human
cagaacagucgccugcauggau

SEQ ID NO: 18837 - RNA, 22 nt, Human
cagaacauucacucauaugugg

SEQ ID NO: 18838 - RNA, 22 nt, Human
cagaaccaggaacugauggaga

SEQ ID NO: 18839 - RNA, 22 nt, Human
cagaacugaccucugauucuag

SEQ ID NO: 18840 - RNA, 22 nt, Human
cagaacugagucucauggccau

SEQ ID NO: 18841 - RNA, 22 nt, Human
cagaacugggcagggagcagag

SEQ ID NO: 18842 - RNA, 22 nt, Human
cagaagagaugaaauaguauua

SEQ ID NO: 18843 - RNA, 22 nt, Human
cagaagaucucuuaguggaggg

SEQ ID NO: 18844 - RNA, 22 nt, Human
cagaagcaagggccaaagucuu

SEQ ID NO: 18845 - RNA, 22 nt, Human
cagaagcacuaggaggaaacgu

SEQ ID NO: 18846 - RNA, 22 nt, Human
cagaagcagauucuaaagcaag

SEQ ID NO: 18847 - RNA, 22 nt, Human
cagaagcagugagagaugugca

SEQ ID NO: 18848 - RNA, 22 nt, Human
cagaagccuaaauagugcacca

SEQ ID NO: 18849 - RNA, 22 nt, Human
cagaagcuagcaggaaaguuuu

SEQ ID NO: 18850 - RNA, 22 nt, Human
cagaagcugaggagugaggcaa

SEQ ID NO: 18851 - RNA, 22 nt, Human
cagaaggagcgcuaagguccca

SEQ ID NO: 18852 - RNA, 22 nt, Human
cagaaggcuuuguggaguagac

SEQ ID NO: 18853 - RNA, 22 nt, Human
cagaaguaagauuacugugaga

SEQ ID NO: 18854 - RNA, 21 nt, Human
cagaaguaaggguaacuucuc

SEQ ID NO: 18855 - RNA, 22 nt, Human
cagaagucacccucagaauaac

SEQ ID NO: 18856 - RNA, 22 nt, Human
cagaagucuuucuguuucaccu

SEQ ID NO: 18857 - RNA, 22 nt, Human
cagaagugaaugugauaaacca

SEQ ID NO: 18858 - RNA, 22 nt, Human
cagaagugauguugagcuaguc

SEQ ID NO: 18859 - RNA, 22 nt, Human
cagaaguggauauuagaguaau

SEQ ID NO: 18860 - RNA, 22 nt, Human
cagauuuaagagauaaacagug

SEQ ID NO: 18861 - RNA, 22 nt, Human
cagauuugccacuuacucguug

SEQ ID NO: 18862 - RNA, 22 nt, Human
cagcaaaagccagcauaagcuc

SEQ ID NO: 18863 - RNA, 22 nt, Human
cagcaaagcaggcuccuagaac

SEQ ID NO: 18864 - RNA, 22 nt, Human
cagcaaauacuacuaguuuuua

SEQ ID NO: 18865 - RNA, 22 nt, Human
cagcaaaugaguggcagggcag

SEQ ID NO: 18866 - RNA, 22 nt, Human
cagcaacauauaugaaacugug

SEQ ID NO: 18867 - RNA, 22 nt, Human
cagcaacccgggggaccuuucu

SEQ ID NO: 18868 - RNA, 22 nt, Human
cagcaacuccuauauugaaagc

SEQ ID NO: 18869 - RNA, 22 nt, Human
cagcaacuuggacagcagucuu

SEQ ID NO: 18870 - RNA, 22 nt, Human
cagcaagaaaauucacaugcuc

SEQ ID NO: 18871 - RNA, 22 nt, Human
cagcaagaacagccugaugugc

SEQ ID NO: 18872 - RNA, 19 nt, Human
cagcaagaaugaaggcaua

SEQ ID NO: 18873 - RNA, 22 nt, Human
cagcaagacaguuuccuaagug

SEQ ID NO: 18874 - RNA, 22 nt, Human
cagcaagauuuuuaaagcaagg

SEQ ID NO: 18875 - RNA, 22 nt, Human
cagcaagccaaauguggcccga

SEQ ID NO: 18876 - RNA, 22 nt, Human
cagcaaggcauucuguggauua

SEQ ID NO: 18877 - RNA, 22 nt, Human
cagcaaggguuauaucaaagau

SEQ ID NO: 18878 - RNA, 23 nt, Human
cagcaagugaauuccaagagaga

SEQ ID NO: 18879 - RNA, 22 nt, Human
cagcaauaagccagguuagaca

SEQ ID NO: 18880 - RNA, 22 nt, Human
cagcaauauacacagucuaugg

SEQ ID NO: 18881 - RNA, 22 nt, Human
cagcaauccaagcuuucuuuaa

SEQ ID NO: 18882 - RNA, 20 nt, Human
cagcacagagcuuggcucua

SEQ ID NO: 18883 - RNA, 22 nt, Human
cagcacagcacagcggugacuc

SEQ ID NO: 18884 - RNA, 22 nt, Human
cagcacaggaauaugguggaca

SEQ ID NO: 18885 - RNA, 22 nt, Human
cagcacaggccccucucuccca

SEQ ID NO: 18886 - RNA, 22 nt, Human
cagcacagggcuugagaggugu

SEQ ID NO: 18887 - RNA, 22 nt, Human
cagcacagugaccagacccacu

SEQ ID NO: 18888 - RNA, 22 nt, Human
cagcacaguuugcuuggcagag

SEQ ID NO: 18889 - RNA, 22 nt, Human
cagcacaucuccaagaauuucu

SEQ ID NO: 18890 - RNA, 19 nt, Human
cagcacaugcuucucugag

SEQ ID NO: 18891 - RNA, 22 nt, Human
cagcacauggauggaguuagga

SEQ ID NO: 18892 - RNA, 22 nt, Human
cagcacauuuacucagcccuca

SEQ ID NO: 18893 - RNA, 22 nt, Human
cagcaccauuugcagccucuuu

SEQ ID NO: 18894 - RNA, 22 nt, Human
cagcaccuguuagcauuaaaua

SEQ ID NO: 18895 - RNA, 22 nt, Human
cagcacguugaaguagaguaag

SEQ ID NO: 18896 - RNA, 22 nt, Human
cagcacuaugacauuuaauucu

SEQ ID NO: 18897 - RNA, 22 nt, Human
cagcacucccaggagaaccagc

SEQ ID NO: 18898 - RNA, 22 nt, Human
cagcacugcuucgcagccaggg

SEQ ID NO: 18899 - RNA, 22 nt, Human
cagcacuucaaugagcauuuca

SEQ ID NO: 18900 - RNA, 22 nt, Human
cagcacuuuagcggaggcauca

SEQ ID NO: 18901 - RNA, 22 nt, Human
cagcagaaauggauuuugagau

SEQ ID NO: 18902 - RNA, 20 nt, Human
cagcagaaauggggugggaa

SEQ ID NO: 18903 - RNA, 22 nt, Human
cagcagaacaggcagggaagcu

SEQ ID NO: 18904 - RNA, 22 nt, Human
cagcagaacaguuaaagaaacc

SEQ ID NO: 18905 - RNA, 22 nt, Human
cagcagaagcaacauucaggcu

SEQ ID NO: 18906 - RNA, 22 nt, Human
cagcagaagugcauuugugauu

SEQ ID NO: 18907 - RNA, 20 nt, Human
cagcagagacccauggggag

SEQ ID NO: 18908 - RNA, 22 nt, Human
cagcagagcugggcuuugaauu

SEQ ID NO: 18909 - RNA, 22 nt, Human
cagcagagggagccauugaaau

SEQ ID NO: 18910 - RNA, 22 nt, Human
cagcagagguuggaacaguucu

SEQ ID NO: 18911 - RNA, 22 nt, Human
cagcagaguaggugcuacuucu

SEQ ID NO: 18912 - RNA, 22 nt, Human
cagcagaguauggcacucaacu

SEQ ID NO: 18913 - RNA, 22 nt, Human
cagcagcaacaacggaagccuu

SEQ ID NO: 18914 - RNA, 22 nt, Human
augaaaugauugaaaucuuuac

SEQ ID NO: 18915 - RNA, 22 nt, Human
augaaaugucuggaucuuuuuc

SEQ ID NO: 18916 - RNA, 22 nt, Human
augaaaugugaaugcuuuucau

SEQ ID NO: 18917 - RNA, 22 nt, Human
augaacaaguauuugcaugagc

SEQ ID NO: 18918 - RNA, 22 nt, Human
augaacaauaaaauagaucaca

SEQ ID NO: 18919 - RNA, 22 nt, Human
augaacaauaaucaugucuaug

SEQ ID NO: 18920 - RNA, 22 nt, Human
augaacaaugacuacauauuga

SEQ ID NO: 18921 - RNA, 22 nt, Human
augaacauccuaggaggcauuu

SEQ ID NO: 18922 - RNA, 22 nt, Human
augaacaucucugauccaagca

SEQ ID NO: 18923 - RNA, 22 nt, Human
augaacuagccagguugugcug

SEQ ID NO: 18924 - RNA, 22 nt, Human
augaacucuugcuuuauuucag

SEQ ID NO: 18925 - RNA, 22 nt, Human
augaacugcaguauaaacuugg

SEQ ID NO: 18926 - RNA, 22 nt, Human
augaacuuauuucugaacuuuu

SEQ ID NO: 18927 - RNA, 22 nt, Human
augaacuuucuuuacaguuuug

SEQ ID NO: 18928 - RNA, 22 nt, Human
augaagaaacuguucugggugg

SEQ ID NO: 18929 - RNA, 20 nt, Human
augaagacaaauccgacuug

SEQ ID NO: 18930 - RNA, 23 nt, Human
augaagacccgugguguccccac

SEQ ID NO: 18931 - RNA, 22 nt, Human
augaagauacaggcagggccau

SEQ ID NO: 18932 - RNA, 22 nt, Human
augaagauauucuuguuuucug

SEQ ID NO: 18933 - RNA, 22 nt, Human
augaagcaacagcccuccuauu

SEQ ID NO: 18934 - RNA, 21 nt, Human
augaagcaagggucacacgug

SEQ ID NO: 18935 - RNA, 22 nt, Human
augaagcagccucuucccucug

SEQ ID NO: 18936 - RNA, 22 nt, Human
augaagcagcguuguagaguga

SEQ ID NO: 18937 - RNA, 22 nt, Human
augaagcaguuaaggugcauga

SEQ ID NO: 18938 - RNA, 22 nt, Human
augaagcuaaacccugcagcca

SEQ ID NO: 18939 - RNA, 22 nt, Human
augaagcuugaggugagagcug

SEQ ID NO: 18940 - RNA, 22 nt, Human
augaaggacaacaggggagcag

SEQ ID NO: 18941 - RNA, 19 nt, Human
augaaggcacugaguggga

SEQ ID NO: 18942 - RNA, 22 nt, Human
augaaggcaguuuuauaagauu

SEQ ID NO: 18943 - RNA, 22 nt, Human
augaagucucuuuuucaugaga

SEQ ID NO: 18944 - RNA, 22 nt, Human
augaauaaacaggugccucuuc

SEQ ID NO: 18945 - RNA, 22 nt, Human
augaauaugagacugagagccu

SEQ ID NO: 18946 - RNA, 22 nt, Human
augaauccaaaguuuacuauua

SEQ ID NO: 18947 - RNA, 22 nt, Human
augaaugagaaacaggugagau

SEQ ID NO: 18948 - RNA, 21 nt, Human
augaaugauuucuacucuuaa

SEQ ID NO: 18949 - RNA, 22 nt, Human
augaaugcugggacaaauauau

SEQ ID NO: 18950 - RNA, 22 nt, Human
augaauggauggggucaagaua

SEQ ID NO: 18951 - RNA, 22 nt, Human
augaaugggucauuauuugauc

SEQ ID NO: 18952 - RNA, 22 nt, Human
augaauguaccugaaauagccu

SEQ ID NO: 18953 - RNA, 22 nt, Human
augaauguuuggugaucagaua

SEQ ID NO: 18954 - RNA, 19 nt, Human
augaauugagcacuuacua

SEQ ID NO: 18955 - RNA, 22 nt, Human
augaauuguccgauguugugca

SEQ ID NO: 18956 - RNA, 22 nt, Human
augacaaaauucacagguguga

SEQ ID NO: 18957 - RNA, 22 nt, Human
augacaaccugugagcugguau

SEQ ID NO: 18958 - RNA, 22 nt, Human
augacacauuugugcuguugaa

SEQ ID NO: 18959 - RNA, 22 nt, Human
augacacccccacagcauuguu

SEQ ID NO: 18960 - RNA, 23 nt, Human
augacacuccugugcgcacccug

SEQ ID NO: 18961 - RNA, 22 nt, Human
augacagacagaagggauuuuu

SEQ ID NO: 18962 - RNA, 22 nt, Human
augacagauagucuucauuugc

SEQ ID NO: 18963 - RNA, 22 nt, Human
augacauaaagcuaugcuaggu

SEQ ID NO: 18964 - RNA, 22 nt, Human
augacaugauucuuucuuucau

SEQ ID NO: 18965 - RNA, 22 nt, Human
augacauugacagaccugcugc

SEQ ID NO: 18966 - RNA, 22 nt, Human
augaccagacucucaguggggu

SEQ ID NO: 18967 - RNA, 22 nt, Human
augaccaguguugcuggccccg

SEQ ID NO: 18968 - RNA, 22 nt, Human
augacccaagcucauggcuccc

SEQ ID NO: 18969 - RNA, 22 nt, Human
cagcaugagaaaaugaaucaga

SEQ ID NO: 18970 - RNA, 22 nt, Human
cagcauggacagggguggcguu

SEQ ID NO: 18971 - RNA, 22 nt, Human
cagcauggggaucacuguaggc

SEQ ID NO: 18972 - RNA, 22 nt, Human
cagcaugguggagcugcucuuu

SEQ ID NO: 18973 - RNA, 22 nt, Human
cagcauugaucccaggcugugg

SEQ ID NO: 18974 - RNA, 22 nt, Human
cagcauuuagaauuugaagugu

SEQ ID NO: 18975 - RNA, 22 nt, Human
cagcauuuggugaucaucuuaa

SEQ ID NO: 18976 - RNA, 22 nt, Human
cagccacuacaauugguuccau

SEQ ID NO: 18977 - RNA, 22 nt, Human
cagccacucucagacaguccca

SEQ ID NO: 18978 - RNA, 22 nt, Human
cagccagagaaagggcacugcc

SEQ ID NO: 18979 - RNA, 22 nt, Human
cagccagaggggccagagucgg

SEQ ID NO: 18980 - RNA, 22 nt, Human
cagccagcuucagauccaagcc

SEQ ID NO: 18981 - RNA, 22 nt, Human
cagccaggacagggaaacuagu

SEQ ID NO: 18982 - RNA, 22 nt, Human
cagccaggagccucugcaacua

SEQ ID NO: 18983 - RNA, 22 nt, Human
cagccaggagcucccccugcuc

SEQ ID NO: 18984 - RNA, 22 nt, Human
cagccaggcccccgagucguug

SEQ ID NO: 18985 - RNA, 22 nt, Human
cagccagggagcaaagaguuga

SEQ ID NO: 18986 - RNA, 22 nt, Human
cagccagguaugggcgugcggg

SEQ ID NO: 18987 - RNA, 22 nt, Human
cagccagguucaaguccuuaua

SEQ ID NO: 18988 - RNA, 22 nt, Human
cagccaucaguaaagacagcuu

SEQ ID NO: 18989 - RNA, 22 nt, Human
cagcccacgucagggccacuca

SEQ ID NO: 18990 - RNA, 22 nt, Human
cagcccacuucccagcaccuac

SEQ ID NO: 18991 - RNA, 22 nt, Human
cagcccagagauguuaucuagu

SEQ ID NO: 18992 - RNA, 21 nt, Human
cagcccagagcaguggggcca

SEQ ID NO: 18993 - RNA, 22 nt, Human
cagcccagcagucuuagccugc

SEQ ID NO: 18994 - RNA, 22 nt, Human
cagcccagccgagggccuggcu

SEQ ID NO: 18995 - RNA, 22 nt, Human
cagcccagcugggaucacacuc

SEQ ID NO: 18996 - RNA, 21 nt, Human
cagcccagcuucuuccccagu

SEQ ID NO: 18997 - RNA, 22 nt, Human
cagcccaggcucagauguuggg

SEQ ID NO: 18998 - RNA, 22 nt, Human
cagcccaguaccaagcaguugg

SEQ ID NO: 18999 - RNA, 22 nt, Human
cagcccagugcauuuguguacu

SEQ ID NO: 19000 - RNA, 22 nt, Human
cagcccauuucugggaccugag

SEQ ID NO: 19001 - RNA, 22 nt, Human
cagccccucccucaggcaggug

SEQ ID NO: 19002 - RNA, 22 nt, Human
cagcccucucugggccccaagg

SEQ ID NO: 19003 - RNA, 23 nt, Human
cagcccugaaaucgaggugacac

SEQ ID NO: 19004 - RNA, 22 nt, Human
cagcccugcagccauggccugu

SEQ ID NO: 19005 - RNA, 22 nt, Human
cagcccugcggagguguauacu

SEQ ID NO: 19006 - RNA, 22 nt, Human
cagcccugcugguuuugggcaa

SEQ ID NO: 19007 - RNA, 22 nt, Human
cagcccugcuuccccgcuaguu

SEQ ID NO: 19008 - RNA, 22 nt, Human
cagcccuggcagcuuucagggu

SEQ ID NO: 19009 - RNA, 22 nt, Human
cagcccuggcccaggugccuua

SEQ ID NO: 19010 - RNA, 22 nt, Human
cagcccuggccucuucgcuuuc

SEQ ID NO: 19011 - RNA, 22 nt, Human
cagcccugggaucuuagugccu

SEQ ID NO: 19012 - RNA, 22 nt, Human
cagcccugggucccugcccugg

SEQ ID NO: 19013 - RNA, 22 nt, Human
cagcccuguccaaugucugcuc

SEQ ID NO: 19014 - RNA, 22 nt, Human
cagcccuguccagcagagggug

SEQ ID NO: 19015 - RNA, 22 nt, Human
cagcccuuccuucuguuuauac

SEQ ID NO: 19016 - RNA, 22 nt, Human
cagcccuucuuccaaccagcuu

SEQ ID NO: 19017 - RNA, 22 nt, Human
cagcccuugcgacacccuggcu

SEQ ID NO: 19018 - RNA, 22 nt, Human
cagcccuuguuugggaaggaug

SEQ ID NO: 19019 - RNA, 19 nt, Human
cagccucaaucccucgggc

SEQ ID NO: 19020 - RNA, 22 nt, Human
cagccuccugggacacucaccg

SEQ ID NO: 19021 - RNA, 22 nt, Human
cagccucucuguaucucaggau

SEQ ID NO: 19022 - RNA, 22 nt, Human
cagccugacuauggcugcaggu

SEQ ID NO: 19023 - RNA, 22 nt, Human
cagccugagccuucuguagcaa

SEQ ID NO: 19024 - RNA, 22 nt, Human
cagccugcaggaggccgucagc

SEQ ID NO: 19025 - RNA, 16 nt, Human
cagccugcagugguca

SEQ ID NO: 19026 - RNA, 22 nt, Human
cagccugcauuuguaucuguau

SEQ ID NO: 19027 - RNA, 22 nt, Human
cagccugcuagggcaaugccuu

SEQ ID NO: 19028 - RNA, 22 nt, Human
cagccugucggcuccuucauuc

SEQ ID NO: 19029 - RNA, 22 nt, Human
cagccuguggcagaggucuaau

SEQ ID NO: 19030 - RNA, 22 nt, Human
cagccuuuaagcuuggauaggu

SEQ ID NO: 19031 - RNA, 22 nt, Human
cagccuuucuguuuccuaaggu

SEQ ID NO: 19032 - RNA, 22 nt, Human
augauauuugcaaugugcuugc

SEQ ID NO: 19033 - RNA, 22 nt, Human
augaucagcaguuuucaguguu

SEQ ID NO: 19034 - RNA, 22 nt, Human
augaucauggaagugcacccau

SEQ ID NO: 19035 - RNA, 22 nt, Human
augauccagauuuugggcaguu

SEQ ID NO: 19036 - RNA, 22 nt, Human
augaucugauaaucauccacua

SEQ ID NO: 19037 - RNA, 18 nt, Human
augaucuuagcaaauauu

SEQ ID NO: 19038 - RNA, 22 nt, Human
augaugaagaguaacaggcuga

SEQ ID NO: 19039 - RNA, 19 nt, Human
augaugcagagcugacuca

SEQ ID NO: 19040 - RNA, 22 nt, Human
augauggaauauuauucaggca

SEQ ID NO: 19041 - RNA, 19 nt, Human
augauggucccauucaccu

SEQ ID NO: 19042 - RNA, 22 nt, Human
augauguaaauagagccuaggu

SEQ ID NO: 19043 - RNA, 22 nt, Human
augaugucuggaggcaugcugu

SEQ ID NO: 19044 - RNA, 22 nt, Human
augauuacucccauuugauaga

SEQ ID NO: 19045 - RNA, 22 nt, Human
augauucagcccaauuuuucua

SEQ ID NO: 19046 - RNA, 22 nt, Human
augauugaaaaugacauugcca

SEQ ID NO: 19047 - RNA, 22 nt, Human
augauuuaaagucauugugaac

SEQ ID NO: 19048 - RNA, 22 nt, Human
augauuuguuaacagacuuaau

SEQ ID NO: 19049 - RNA, 22 nt, Human
augcaaaagacuauuuguugcu

SEQ ID NO: 19050 - RNA, 22 nt, Human
augcaaaaguaguugcaguuuu

SEQ ID NO: 19051 - RNA, 22 nt, Human
augcaaacauucgcuugucucu

SEQ ID NO: 19052 - RNA, 22 nt, Human
augcaaauaaacagucuaguug

SEQ ID NO: 19053 - RNA, 22 nt, Human
augcaaaugcagccauugcaga

SEQ ID NO: 19054 - RNA, 22 nt, Human
augcaaaugcuagagaauguug

SEQ ID NO: 19055 - RNA, 22 nt, Human
augcaaauucuuaggcuccauc

SEQ ID NO: 19056 - RNA, 22 nt, Human
augcaaauucuuugcuucuucu

SEQ ID NO: 19057 - RNA, 22 nt, Human
augcaacagagaaaauauugag

SEQ ID NO: 19058 - RNA, 22 nt, Human
augcaacauacauucugaagcu

SEQ ID NO: 19059 - RNA, 22 nt, Human
augcaagaucacaccaaacacg

SEQ ID NO: 19060 - RNA, 22 nt, Human
augcaaggguaaccccagacau

SEQ ID NO: 19061 - RNA, 22 nt, Human
augcaauaccuucugaaaauaa

SEQ ID NO: 19062 - RNA, 22 nt, Human
augcaaugguauauggucaccu

SEQ ID NO: 19063 - RNA, 22 nt, Human
augcaauuuacuguacauaaau

SEQ ID NO: 19064 - RNA, 21 nt, Human
augcacaaaaagacucuuucu

SEQ ID NO: 19065 - RNA, 22 nt, Human
augcacaaacccacaauuaguc

SEQ ID NO: 19066 - RNA, 19 nt, Human
augcacacauugaagagga

SEQ ID NO: 19067 - RNA, 22 nt, Human
augcacagcagugaguucagug

SEQ ID NO: 19068 - RNA, 22 nt, Human
augcacagcugaacacucuaaa

SEQ ID NO: 19069 - RNA, 22 nt, Human
augcacaucuuacagaugcaga

SEQ ID NO: 19070 - RNA, 22 nt, Human
augcacauuguagccacacaau

SEQ ID NO: 19071 - RNA, 22 nt, Human
augcacccagugucuggacuau

SEQ ID NO: 19072 - RNA, 22 nt, Human
augcacccuuaugaauaugauc

SEQ ID NO: 19073 - RNA, 22 nt, Human
augcacuacuagaugcaaaagu

SEQ ID NO: 19074 - RNA, 22 nt, Human
augcacuacuuggcuuuacuga

SEQ ID NO: 19075 - RNA, 22 nt, Human
augcacuguaggugccaucugc

SEQ ID NO: 19076 - RNA, 22 nt, Human
augcacuguuggauauauuugu

SEQ ID NO: 19077 - RNA, 22 nt, Human
augcacuucaagcaucucucug

SEQ ID NO: 19078 - RNA, 22 nt, Human
ggcuuagauugacacugaucuc

SEQ ID NO: 19079 - RNA, 22 nt, Human
ggcuuaggugucucucugcacc

SEQ ID NO: 19080 - RNA, 22 nt, Human
ggcuuaguguuucugcucagcc

SEQ ID NO: 19081 - RNA, 22 nt, Human
ggcuuauguuugucaagcaauc

SEQ ID NO: 19082 - RNA, 22 nt, Human
ggcuucaaauggagcaaccaga

SEQ ID NO: 19083 - RNA, 22 nt, Human
ggcuucacauagcaaugugagc

SEQ ID NO: 19084 - RNA, 22 nt, Human
ggcuucaccgcgggguugcagg

SEQ ID NO: 19085 - RNA, 22 nt, Human
ggcuucagugacuggugcccuc

SEQ ID NO: 19086 - RNA, 22 nt, Human
ggcuagggacacagcucugcuc

SEQ ID NO: 19087 - RNA, 22 nt, Human
ggcuagggaucuagaccaggac

SEQ ID NO: 19088 - RNA, 22 nt, Human
ggcuauguguccagcaucuuug

SEQ ID NO: 19089 - RNA, 22 nt, Human
ggcucacacaugacugggcucu

SEQ ID NO: 19090 - RNA, 22 nt, Human
ggcucacuuuggggucagcugg

SEQ ID NO: 19091 - RNA, 22 nt, Human
ggcucagaaaccucuggugucu

SEQ ID NO: 19092 - RNA, 22 nt, Human
ggcucagaaacuaaaggcgcug

SEQ ID NO: 19093 - RNA, 22 nt, Human
ggcucagagaccugcgaucuga

SEQ ID NO: 19094 - RNA, 22 nt, Human
ggcucagaggagcuggaacggu

SEQ ID NO: 19095 - RNA, 22 nt, Human
ggcucagcuuaucugggcaggc

SEQ ID NO: 19096 - RNA, 22 nt, Human
ggcucaggacugcagcguagag

SEQ ID NO: 19097 - RNA, 22 nt, Human
ggcucaggagaggggcuaaaag

SEQ ID NO: 19098 - RNA, 22 nt, Human
ggcucaggcuggagugcagugg

SEQ ID NO: 19099 - RNA, 22 nt, Human
ggcucaguaagucagguucauu

SEQ ID NO: 19100 - RNA, 22 nt, Human
ggcucagugggaacaagcugag

SEQ ID NO: 19101 - RNA, 22 nt, Human
ggcucauguaugaaagggugug

SEQ ID NO: 19102 - RNA, 22 nt, Human
ggcuccacccugcuuccagaag

SEQ ID NO: 19103 - RNA, 22 nt, Human
ggcuccagaaacuucaguccau

SEQ ID NO: 19104 - RNA, 22 nt, Human
ggcuccaggguaccccuggaug

SEQ ID NO: 19105 - RNA, 22 nt, Human
ggcuccaguuuccccuuggggc

SEQ ID NO: 19106 - RNA, 22 nt, Human
ggcuccaguuugugccuucagc

SEQ ID NO: 19107 - RNA, 22 nt, Human
ggcucccuguucuauucccugg

SEQ ID NO: 19108 - RNA, 22 nt, Human
ggcuccugaggaccaggcacag

SEQ ID NO: 19109 - RNA, 23 nt, Human
ggcuccuggauucaaauccugcc

SEQ ID NO: 19110 - RNA, 22 nt, Human
ggcuccugggaugggacugagc

SEQ ID NO: 19111 - RNA, 22 nt, Human
ggcuccugggcagcugcucccu

SEQ ID NO: 19112 - RNA, 19 nt, Human
ggcuccuggggcucagccc

SEQ ID NO: 19113 - RNA, 22 nt, Human
ggcuccuuaucucuccuaugcc

SEQ ID NO: 19114 - RNA, 22 nt, Human
ggcuccuucaaagcaccuggcu

SEQ ID NO: 19115 - RNA, 22 nt, Human
ggcucuagagacucuagagaaa

SEQ ID NO: 19116 - RNA, 22 nt, Human
ggcucuccacuauggaugagaa

SEQ ID NO: 19117 - RNA, 19 nt, Human
ggcucucuuaaagcuguuu

SEQ ID NO: 19118 - RNA, 17 nt, Human
ggcucucuuccagacuu

SEQ ID NO: 19119 - RNA, 22 nt, Human
ggcucugaaauucucacuuuua

SEQ ID NO: 19120 - RNA, 22 nt, Human
ggcucugaagggugacagguuu

SEQ ID NO: 19121 - RNA, 22 nt, Human
ggcucugaguuuagaagggugg

SEQ ID NO: 19122 - RNA, 22 nt, Human
ggcucugcaaaaguagauacuu

SEQ ID NO: 19123 - RNA, 22 nt, Human
ggcucugcaugugagugggugg

SEQ ID NO: 19124 - RNA, 22 nt, Human
ggcucugccacuucuuggcugu

SEQ ID NO: 19125 - RNA, 22 nt, Human
ggcucugcuucucaccuguucc

SEQ ID NO: 19126 - RNA, 20 nt, Human
ggcucugcuugugagcagcc

SEQ ID NO: 19127 - RNA, 22 nt, Human
ggcucuggagauguccgaccug

SEQ ID NO: 19128 - RNA, 22 nt, Human
ggcucuggcaaggggaggcuac

SEQ ID NO: 19129 - RNA, 22 nt, Human
ggcucuggcuacuccacccugu

SEQ ID NO: 19130 - RNA, 22 nt, Human
ggcucugggccuccaaggucug

SEQ ID NO: 19131 - RNA, 22 nt, Human
ggcucuggggccuccucccuug

SEQ ID NO: 19132 - RNA, 22 nt, Human
ggcucuggggggaagucuguug

SEQ ID NO: 19133 - RNA, 22 nt, Human
ggcucuggguaaggcguuugac

SEQ ID NO: 19134 - RNA, 22 nt, Human
ggcucugggucuguggggagcg

SEQ ID NO: 19135 - RNA, 17 nt, Human
ggcucugggugucacau

SEQ ID NO: 19136 - RNA, 22 nt, Human
ggcucuggugcccuggcuccca

SEQ ID NO: 19137 - RNA, 22 nt, Human
ggcucuggugugaagcagccuc

SEQ ID NO: 19138 - RNA, 23 nt, Human
ggcucugugcugggccugcagga

SEQ ID NO: 19139 - RNA, 22 nt, Human
ggcucuguucuaaauuaauaag

SEQ ID NO: 19140 - RNA, 22 nt, Human
ggcucuucacacagugauguca

SEQ ID NO: 19141 - RNA, 22 nt, Human
ggcucuucuacuucagaugggg

SEQ ID NO: 19142 - RNA, 22 nt, Human
ggcugaaaggugggaggauggc

SEQ ID NO: 19143 - RNA, 20 nt, Human
ggcugaaaguagaaaguauu

SEQ ID NO: 19144 - RNA, 22 nt, Human
ggcugaaauucagaguaaauuc

SEQ ID NO: 19145 - RNA, 22 nt, Human
ggcugaauguuggacacuuacg

SEQ ID NO: 19146 - RNA, 22 nt, Human
ggcugagaacaggcccagccuc

SEQ ID NO: 19147 - RNA, 22 nt, Human
ggcugagaguggaucccaggga

SEQ ID NO: 19148 - RNA, 22 nt, Human
ggcugagaguuuccucuggggc

SEQ ID NO: 19149 - RNA, 22 nt, Human
ggcugagcacuuuaggcaggag

SEQ ID NO: 19150 - RNA, 22 nt, Human
ggcugagggccagggcuagucu

SEQ ID NO: 19151 - RNA, 18 nt, Human
ggcugagguugacuagaa

SEQ ID NO: 19152 - RNA, 22 nt, Human
ggcugaguucucuugcugaauc

SEQ ID NO: 19153 - RNA, 22 nt, Human
ggcugaugagcuuagcuagaga

SEQ ID NO: 19154 - RNA, 22 nt, Human
ggcugcaagacaagguugguuu

SEQ ID NO: 19155 - RNA, 22 nt, Human
ggcugcacgccucucagcuugc

SEQ ID NO: 19156 - RNA, 22 nt, Human
ggcugcagagcuggugcccugg

SEQ ID NO: 19157 - RNA, 22 nt, Human
ggcugcagauuguagucuguua

SEQ ID NO: 19158 - RNA, 22 nt, Human
ggcugcaggcagaggcugucug

SEQ ID NO: 19159 - RNA, 22 nt, Human
ggcugcagguugguuggcagcu

SEQ ID NO: 19160 - RNA, 17 nt, Human
ggcugcaguccaggagg

SEQ ID NO: 19161 - RNA, 20 nt, Human
ggcugcagugcaccucaucu

SEQ ID NO: 19162 - RNA, 22 nt, Human
ggcugccagugagugcagaccg

SEQ ID NO: 19163 - RNA, 22 nt, Human
ggcugccauaacagaguaccac

SEQ ID NO: 19164 - RNA, 22 nt, Human
ggcugccccagugcucauggcu

SEQ ID NO: 19165 - RNA, 22 nt, Human
ggcugcccuagagcuggcaagg

SEQ ID NO: 19166 - RNA, 22 nt, Human
ggcugcccugggaggcaagggu

SEQ ID NO: 19167 - RNA, 22 nt, Human
ggcugccuaacccuuaaguguc

SEQ ID NO: 19168 - RNA, 22 nt, Human
ggcugccuccucgagacaggau

SEQ ID NO: 19169 - RNA, 22 nt, Human
ggcugccucuggaagcuggaga

SEQ ID NO: 19170 - RNA, 22 nt, Human
ggcugccugaacuuuggggaaa

SEQ ID NO: 19171 - RNA, 22 nt, Human
ggcugccugaggcagugagaga

SEQ ID NO: 19172 - RNA, 22 nt, Human
ggcugccugcucaggugcggcg

SEQ ID NO: 19173 - RNA, 22 nt, Human
ggcugccuggaccuccucuuuc

SEQ ID NO: 19174 - RNA, 22 nt, Human
ggcugccugggagcccuccucu

SEQ ID NO: 19175 - RNA, 18 nt, Human
ggcugccuguuccugaag

SEQ ID NO: 19176 - RNA, 22 nt, Human
ggcugccuguugaguauguccc

SEQ ID NO: 19177 - RNA, 22 nt, Human
ggcugccuugacccuggcuccg

SEQ ID NO: 19178 - RNA, 22 nt, Human
ggcugccuuggggguugucauu

SEQ ID NO: 19179 - RNA, 22 nt, Human
ggcugcggccgcgggucugugc

SEQ ID NO: 19180 - RNA, 18 nt, Human
ggcugcuccucucccuac

SEQ ID NO: 19181 - RNA, 22 nt, Human
ggcugcucugcacaggggcugg

SEQ ID NO: 19182 - RNA, 22 nt, Human
ggcugcucugccuuccagcugg

SEQ ID NO: 19183 - RNA, 22 nt, Human
ggcugcucuucuuggcgaccuc

SEQ ID NO: 19184 - RNA, 22 nt, Human
ggcugcugaguuggccaggaga

SEQ ID NO: 19185 - RNA, 22 nt, Human
ggcugcugugaccucaggugau

SEQ ID NO: 19186 - RNA, 17 nt, Human
ggcugcugugcuggugc

SEQ ID NO: 19187 - RNA, 22 nt, Human
gggaacacuccagggcuuggaa

SEQ ID NO: 19188 - RNA, 22 nt, Human
gggaacagggccugagcugggg

SEQ ID NO: 19189 - RNA, 22 nt, Human
gggaaccagccgcuuccgccuc

SEQ ID NO: 19190 - RNA, 22 nt, Human
gggaaccugccccaggccucug

SEQ ID NO: 19191 - RNA, 22 nt, Human
gggaacuugccccagaggaauu

SEQ ID NO: 19192 - RNA, 22 nt, Human
gggaagacuuagucgguucaau

SEQ ID NO: 19193 - RNA, 22 nt, Human
gggaagagauuuccacaucauu

SEQ ID NO: 19194 - RNA, 18 nt, Human
gggaagaggaucuggccc

SEQ ID NO: 19195 - RNA, 22 nt, Human
gggaagaguaacuagcccaugu

SEQ ID NO: 19196 - RNA, 22 nt, Human
gggaagcagcauugugcuggcu

SEQ ID NO: 19197 - RNA, 22 nt, Human
gggaagcaggugcagcucgccu

SEQ ID NO: 19198 - RNA, 22 nt, Human
gggaagcaucugaggguccacu

SEQ ID NO: 19199 - RNA, 22 nt, Human
gggaagcugaagcuagagaaaa

SEQ ID NO: 19200 - RNA, 22 nt, Human
gggaaggaaaguuauuagcaga

SEQ ID NO: 19201 - RNA, 22 nt, Human
gggaaggagccugcuugcuaga

SEQ ID NO: 19202 - RNA, 23 nt, Human
gggaagugaggagccccucagcc

SEQ ID NO: 19203 - RNA, 17 nt, Human
gggaaguggagaaagcu

SEQ ID NO: 19204 - RNA, 22 nt, Human
gggcagguggcaaagccagagg

SEQ ID NO: 19205 - RNA, 22 nt, Human
gggcagguggcagggucucugg

SEQ ID NO: 19206 - RNA, 22 nt, Human
gggcaggugugcagagcuguug

SEQ ID NO: 19207 - RNA, 22 nt, Human
gggcagguuggcaucccgggca

SEQ ID NO: 19208 - RNA, 22 nt, Human
gggcagugggaccaggcaccag

SEQ ID NO: 19209 - RNA, 22 nt, Human
gggcagugucggggcccaggga

SEQ ID NO: 19210 - RNA, 22 nt, Human
gggcagugucugcaaaugaaca

SEQ ID NO: 19211 - RNA, 22 nt, Human
gggcaguguggucgugccuuug

SEQ ID NO: 19212 - RNA, 20 nt, Human
gggcaguucaaugccacucu

SEQ ID NO: 19213 - RNA, 22 nt, Human
gggcaucuucuguagccaucuc

SEQ ID NO: 19214 - RNA, 20 nt, Human
gggcaucuuugcuccuguuu

SEQ ID NO: 19215 - RNA, 22 nt, Human
gggcaugagagggcagcuggca

SEQ ID NO: 19216 - RNA, 22 nt, Human
gggcaugagcgagcugcuuuga

SEQ ID NO: 19217 - RNA, 19 nt, Human
gggcaugcuggcucuagag

SEQ ID NO: 19218 - RNA, 19 nt, Human
gggcauggaugagcuuacc

SEQ ID NO: 19219 - RNA, 18 nt, Human
gggcauggaugcagcauc

SEQ ID NO: 19220 - RNA, 22 nt, Human
gggcauggccaggugagggguc

SEQ ID NO: 19221 - RNA, 22 nt, Human
gggcauggggcggaccugguuc

SEQ ID NO: 19222 - RNA, 22 nt, Human
gggcauggugagggauaugaag

SEQ ID NO: 19223 - RNA, 22 nt, Human
gggcauggugaugugcaccugu

SEQ ID NO: 19224 - RNA, 22 nt, Human
gggccacacagaaccuccuggu

SEQ ID NO: 19225 - RNA, 22 nt, Human
gggccacacagggcagcucccu

SEQ ID NO: 19226 - RNA, 22 nt, Human
gggccaccuggauuccaugugu

SEQ ID NO: 19227 - RNA, 22 nt, Human
gggccagagcacagaggauguu

SEQ ID NO: 19228 - RNA, 22 nt, Human
gggccagucugacucugcuggu

SEQ ID NO: 19229 - RNA, 22 nt, Human
gggccagugagucgggagagcu

SEQ ID NO: 19230 - RNA, 22 nt, Human
gggccagugggaccugggucuc

SEQ ID NO: 19231 - RNA, 22 nt, Human
gggccaguucuccgccucuuuu

SEQ ID NO: 19232 - RNA, 22 nt, Human
gggcccaggccuccuuccuucc

SEQ ID NO: 19233 - RNA, 22 nt, Human
gggccccaagaaccuccuccug

SEQ ID NO: 19234 - RNA, 22 nt, Human
gggcccucagucccaggccuuc

SEQ ID NO: 19235 - RNA, 22 nt, Human
gggcccucugcagcugcccagg

SEQ ID NO: 19236 - RNA, 20 nt, Human
gggcccugggauucagagca

SEQ ID NO: 19237 - RNA, 19 nt, Human
gggccucacccacaccucc

SEQ ID NO: 19238 - RNA, 22 nt, Human
gggccuccgugugcuggugcuc

SEQ ID NO: 19239 - RNA, 22 nt, Human
gggccucuccggccuuugcauc

SEQ ID NO: 19240 - RNA, 22 nt, Human
gggccucugugcagaggggccu

SEQ ID NO: 19241 - RNA, 22 nt, Human
gggccugaggcccagacacugg

SEQ ID NO: 19242 - RNA, 22 nt, Human
gggccugccauugcugccccag

SEQ ID NO: 19243 - RNA, 22 nt, Human
gggccugcuggugcuuccauug

SEQ ID NO: 19244 - RNA, 22 nt, Human
gggccuggggacaccaccauga

SEQ ID NO: 19245 - RNA, 22 nt, Human
gggccuugccauggagccugag

SEQ ID NO: 19246 - RNA, 22 nt, Human
gggcgagggcgaaagcgagagc

SEQ ID NO: 19247 - RNA, 22 nt, Human
gggcgcagccaauccuggcccu

SEQ ID NO: 19248 - RNA, 22 nt, Human
gggcgcgggaaggagcccgaga

SEQ ID NO: 19249 - RNA, 17 nt, Human
gggcgcggguagagccc

SEQ ID NO: 19250 - RNA, 22 nt, Human
gggcggcgucggcgaggccauc

SEQ ID NO: 19251 - RNA, 22 nt, Human
gggcggggggagcuggaaugaa

SEQ ID NO: 19252 - RNA, 22 nt, Human
gggcggugccugucuccgaagc

SEQ ID NO: 19253 - RNA, 22 nt, Human
gggcuaaguggaucagucagga

SEQ ID NO: 19254 - RNA, 22 nt, Human
gggcuacauugugagagaaguu

SEQ ID NO: 19255 - RNA, 22 nt, Human
gggcuacugagcuggaacuggg

SEQ ID NO: 19256 - RNA, 20 nt, Human
gggcuagaccagggcagagg

SEQ ID NO: 19257 - RNA, 18 nt, Human
gggcuaggcaaggaccac

SEQ ID NO: 19258 - RNA, 18 nt, Human
gggcucacacaggucauc

SEQ ID NO: 19259 - RNA, 21 nt, Human
gggcucagcgcucggcuccuc

SEQ ID NO: 19260 - RNA, 22 nt, Human
gggcucagcuccuuccuuccua

SEQ ID NO: 19261 - RNA, 22 nt, Human
gggcucagucggcaagccccuu

SEQ ID NO: 19262 - RNA, 22 nt, Human
gggcucaguucugcuucaugcu

SEQ ID NO: 19263 - RNA, 22 nt, Human
gggcucaucaagccucuccgcc

SEQ ID NO: 19264 - RNA, 22 nt, Human
gggcucaugauguaggcuggua

SEQ ID NO: 19265 - RNA, 22 nt, Human
gggcucauucaucugggcuugg

SEQ ID NO: 19266 - RNA, 22 nt, Human
gggcuccaaaguaagcuuuagu

SEQ ID NO: 19267 - RNA, 22 nt, Human
gggcuccaacggugagcaugga

SEQ ID NO: 19268 - RNA, 22 nt, Human
gggcuccaacuacaucagccuu

SEQ ID NO: 19269 - RNA, 22 nt, Human
gggcuccagaggcucacccugg

SEQ ID NO: 19270 - RNA, 22 nt, Human
gggcuccagccaggugucccca

SEQ ID NO: 19271 - RNA, 22 nt, Human
gggcuccagggcccgagucguc

SEQ ID NO: 19272 - RNA, 22 nt, Human
gggcucucaaggcagggcccca

SEQ ID NO: 19273 - RNA, 22 nt, Human
gggcucugaaucccaggucugc

SEQ ID NO: 19274 - RNA, 18 nt, Human
gggcucugauccuucacc

SEQ ID NO: 19275 - RNA, 22 nt, Human
gggcucugcagugacuugaggg

SEQ ID NO: 19276 - RNA, 22 nt, Human
gggcucuggaguucuagaaaga

SEQ ID NO: 19277 - RNA, 18 nt, Human
gggcucuggcaucugggu

SEQ ID NO: 19278 - RNA, 22 nt, Human
gggcucugggauucagagcaag

SEQ ID NO: 19279 - RNA, 22 nt, Human
gggcucugggucgugucuccau

SEQ ID NO: 19280 - RNA, 22 nt, Human
gggcucuguuuagaucagagau

SEQ ID NO: 19281 - RNA, 22 nt, Human
gggcugaaagcucucacagucu

SEQ ID NO: 19282 - RNA, 22 nt, Human
gggcugaacucaagucagcucc

SEQ ID NO: 19283 - RNA, 22 nt, Human
gggcugacaguuuccccugaaa

SEQ ID NO: 19284 - RNA, 22 nt, Human
gggcugacucaaccuugcaaag

SEQ ID NO: 19285 - RNA, 22 nt, Human
gggcugagaauucagcuuuccu

SEQ ID NO: 19286 - RNA, 22 nt, Human
gggcugagauuggugcccuguc

SEQ ID NO: 19287 - RNA, 22 nt, Human
gggcugagcuguucugaguuua

SEQ ID NO: 19288 - RNA, 22 nt, Human
gggcugagggguaucucauggg

SEQ ID NO: 19289 - RNA, 22 nt, Human
gggcugagucugcugccuguca

SEQ ID NO: 19290 - RNA, 22 nt, Human
gggcugagugaccucaggccaa

SEQ ID NO: 19291 - RNA, 22 nt, Human
gggcugagugggccucuuacuu

SEQ ID NO: 19292 - RNA, 22 nt, Human
gggcugaguuccugccucacuc

SEQ ID NO: 19293 - RNA, 22 nt, Human
gggcugcguguggaggauguaa

SEQ ID NO: 19294 - RNA, 22 nt, Human
gggcugcugcugccagcgacac

SEQ ID NO: 19295 - RNA, 22 nt, Human
gggcugcuuuuuucuuagcaga

SEQ ID NO: 19296 - RNA, 22 nt, Human
gggcuggaagugcauugaugcu

SEQ ID NO: 19297 - RNA, 22 nt, Human
gggucaggcucagcagggcagc

SEQ ID NO: 19298 - RNA, 22 nt, Human
gggucagggaggccccaccaug

SEQ ID NO: 19299 - RNA, 22 nt, Human
ggguccagaaugagaaugggcu

SEQ ID NO: 19300 - RNA, 23 nt, Human
ggguccagagacaggcaugggug

SEQ ID NO: 19301 - RNA, 22 nt, Human
ggguccagcgacagcaggcuca

SEQ ID NO: 19302 - RNA, 22 nt, Human
ggguccaggcacuaugcuaagu

SEQ ID NO: 19303 - RNA, 22 nt, Human
ggguccaggcggcauaguugua

SEQ ID NO: 19304 - RNA, 22 nt, Human
ggguccagggccaguggcugag

SEQ ID NO: 19305 - RNA, 19 nt, Human
gggucccaaaagaugugcu

SEQ ID NO: 19306 - RNA, 18 nt, Human
ggguccuguucuuggaag

SEQ ID NO: 19307 - RNA, 19 nt, Human
gggucgggaaguugagaau

SEQ ID NO: 19308 - RNA, 22 nt, Human
gggucgggcaggcgcccucguc

SEQ ID NO: 19309 - RNA, 22 nt, Human
gggucucucucggcuccacgcg

SEQ ID NO: 19310 - RNA, 21 nt, Human
gggucugaauaucuggugcug

SEQ ID NO: 19311 - RNA, 22 nt, Human
gggucuggcaugcugagaugga

SEQ ID NO: 19312 - RNA, 22 nt, Human
gggugaagcuccugcaggggcc

SEQ ID NO: 19313 - RNA, 22 nt, Human
gggugacauuucccaaugagcc

SEQ ID NO: 19314 - RNA, 20 nt, Human
gggugagauguaggagaggg

SEQ ID NO: 19315 - RNA, 22 nt, Human
gggugagggaugagccuucuuc

SEQ ID NO: 19316 - RNA, 22 nt, Human
gggugcaacuaagaagagguga

SEQ ID NO: 19317 - RNA, 22 nt, Human
gggugcaagcaaguggcacaga

SEQ ID NO: 19318 - RNA, 22 nt, Human
gggugcaugguguaugacugga

SEQ ID NO: 19319 - RNA, 22 nt, Human
ggguggagaggcuaaguccagu

SEQ ID NO: 19320 - RNA, 22 nt, Human
ggguggagccugagaauuugca

SEQ ID NO: 19321 - RNA, 20 nt, Human
ggguggaguugcggucugug

SEQ ID NO: 19322 - RNA, 22 nt, Human
ggguggcacaggugcagagggu

SEQ ID NO: 19323 - RNA, 21 nt, Human
ggguggccgcaugggugcgug

SEQ ID NO: 19324 - RNA, 22 nt, Human
ggguggcuccuaugggcauagc

SEQ ID NO: 19325 - RNA, 22 nt, Human
gggugggaacaggaugccagga

SEQ ID NO: 19326 - RNA, 22 nt, Human
gggugggaaggcuaagggauug

SEQ ID NO: 19327 - RNA, 22 nt, Human
gggugggacucuuuggccugag

SEQ ID NO: 19328 - RNA, 22 nt, Human
gggugggacugaagucugaggg

SEQ ID NO: 19329 - RNA, 22 nt, Human
gggugggagaaaugaguaucua

SEQ ID NO: 19330 - RNA, 22 nt, Human
gggugggagucuggcccucaaa

SEQ ID NO: 19331 - RNA, 22 nt, Human
gggugggaucuguggagccuca

SEQ ID NO: 19332 - RNA, 23 nt, Human
gggugggccaaauuagguagccu

SEQ ID NO: 19333 - RNA, 21 nt, Human
gggugggguuccagccuuuuc

SEQ ID NO: 19334 - RNA, 22 nt, Human
ggguggguggcagcaccgaggc

SEQ ID NO: 19335 - RNA, 22 nt, Human
ggguggucaucugaaggucugg

SEQ ID NO: 19336 - RNA, 22 nt, Human
ggguggugagauguagcugaug

SEQ ID NO: 19337 - RNA, 22 nt, Human
gggugguggccagcagugggca

SEQ ID NO: 19338 - RNA, 18 nt, Human
ggguggugugcucuucgc

SEQ ID NO: 19339 - RNA, 22 nt, Human
ggguguagacacauguucaucu

SEQ ID NO: 19340 - RNA, 22 nt, Human
ggguguggcugcgugccaauaa

SEQ ID NO: 19341 - RNA, 22 nt, Human
gggugugucuuuugcuccugga

SEQ ID NO: 19342 - RNA, 20 nt, Human
gggugugugcagggccuggu

SEQ ID NO: 19343 - RNA, 22 nt, Human
ggguuacugcuucaaaaaauua

SEQ ID NO: 19344 - RNA, 22 nt, Human
ggguuaggucccucccuucugg

SEQ ID NO: 19345 - RNA, 22 nt, Human
ggguuaguugguaguuaauuga

SEQ ID NO: 19346 - RNA, 22 nt, Human
ggguucagugaugccuucagga

SEQ ID NO: 19347 - RNA, 22 nt, Human
ggguucaucaaaggacagacuc

SEQ ID NO: 19348 - RNA, 22 nt, Human
ggguuccaaacauagucuuccu

SEQ ID NO: 19349 - RNA, 22 nt, Human
ggguucuuauaguaucagagcu

SEQ ID NO: 19350 - RNA, 22 nt, Human
ggguuggauuacuuagggagaa

SEQ ID NO: 19351 - RNA, 22 nt, Human
ggguuggggcccagcagucugc

SEQ ID NO: 19352 - RNA, 23 nt, Human
ggguuuccuucuggcuccuccuu

SEQ ID NO: 19353 - RNA, 22 nt, Human
ggguuuuaugguucacuugcaa

SEQ ID NO: 19354 - RNA, 22 nt, Human
gguaaaaugcagauucuuagcc

SEQ ID NO: 19355 - RNA, 22 nt, Human
gguaaacuaaccauuuuaauuu

SEQ ID NO: 19356 - RNA, 22 nt, Human
gguaaauuuuauguuauguaua

SEQ ID NO: 19357 - RNA, 22 nt, Human
gguaacaaggccgauagaaaca

SEQ ID NO: 19358 - RNA, 22 nt, Human
gggugcagggucuccagcagcu

SEQ ID NO: 19359 - RNA, 22 nt, Human
gggugccacagagcuuccacuu

SEQ ID NO: 19360 - RNA, 22 nt, Human
gggugcugacuggggccugaaa

SEQ ID NO: 19361 - RNA, 22 nt, Human
gggugcugaggaagacagcagg

SEQ ID NO: 19362 - RNA, 18 nt, Human
gggugcuggggccccuug

SEQ ID NO: 19363 - RNA, 22 nt, Human
ggguggaaaguauuuggggacc

SEQ ID NO: 19364 - RNA, 22 nt, Human
ggguggaggagaacaggcccca

SEQ ID NO: 19365 - RNA, 22 nt, Human
ggguggaguagaaagaugaauu

SEQ ID NO: 19366 - RNA, 22 nt, Human
ggguggcaaaggcgcugaaagg

SEQ ID NO: 19367 - RNA, 22 nt, Human
ggguggcauagggugauggcuu

SEQ ID NO: 19368 - RNA, 22 nt, Human
gggugggccugucuggccaugu

SEQ ID NO: 19369 - RNA, 22 nt, Human
ggguggggccaggcaauuugca

SEQ ID NO: 19370 - RNA, 22 nt, Human
gggugggguguaucggauccua

SEQ ID NO: 19371 - RNA, 22 nt, Human
gggugggguucaggaaucuuca

SEQ ID NO: 19372 - RNA, 22 nt, Human
ggguggugggcacagaaucugg

SEQ ID NO: 19373 - RNA, 22 nt, Human
gggugguguauuagagcugcag

SEQ ID NO: 19374 - RNA, 22 nt, Human
gggugugcaggucauggcgucu

SEQ ID NO: 19375 - RNA, 20 nt, Human
gggugugggcccggccaggc

SEQ ID NO: 19376 - RNA, 22 nt, Human
ggguuaaaacaggaagaucagc

SEQ ID NO: 19377 - RNA, 22 nt, Human
ggguuagguucuagaggcacaa

SEQ ID NO: 19378 - RNA, 22 nt, Human
ggguucagguuggccugagcac

SEQ ID NO: 19379 - RNA, 22 nt, Human
ggguuccaaugaugagcaagag

SEQ ID NO: 19380 - RNA, 22 nt, Human
ggguuccagucugaaacuacag

SEQ ID NO: 19381 - RNA, 22 nt, Human
ggguuggcagcaccagaggagg

SEQ ID NO: 19382 - RNA, 22 nt, Human
ggguugggacugucaucuggag

SEQ ID NO: 19383 - RNA, 22 nt, Human
ggguuguagagcuggaagggga

SEQ ID NO: 19384 - RNA, 22 nt, Human
gguaacacaggugcaguuuuaa

SEQ ID NO: 19385 - RNA, 22 nt, Human
gguaacaguauguagaguaaga

SEQ ID NO: 19386 - RNA, 22 nt, Human
gguaacugaggccauauucuga

SEQ ID NO: 19387 - RNA, 22 nt, Human
gguaacuuagcucauggcugug

SEQ ID NO: 19388 - RNA, 22 nt, Human
gguacaauccacuguggguuag

SEQ ID NO: 19389 - RNA, 22 nt, Human
gguacaauggaccauaaaagcu

SEQ ID NO: 19390 - RNA, 22 nt, Human
gguacaaugguucauuuuaugu

SEQ ID NO: 19391 - RNA, 22 nt, Human
gguacaauucugggguaugcuc

SEQ ID NO: 19392 - RNA, 22 nt, Human
gguaccaccaauucagcugcca

SEQ ID NO: 19393 - RNA, 22 nt, Human
gguaccaugagaugccacuaau

SEQ ID NO: 19394 - RNA, 22 nt, Human
gguagaaagcccaagucccccu

SEQ ID NO: 19395 - RNA, 22 nt, Human
gguagacaauggaauguggccu

SEQ ID NO: 19396 - RNA, 22 nt, Human
gguagacugucaaacacuagcc

SEQ ID NO: 19397 - RNA, 22 nt, Human
gguagcaagcgcuugcccugcg

SEQ ID NO: 19398 - RNA, 22 nt, Human
gguagcagggcugugagucaga

SEQ ID NO: 19399 - RNA, 22 nt, Human
gguagcaucuuuggauguuauu

SEQ ID NO: 19400 - RNA, 22 nt, Human
gguagccaauuuaaacauuucc

SEQ ID NO: 19401 - RNA, 22 nt, Human
gguagcugcagcaggcuggcaa

SEQ ID NO: 19402 - RNA, 22 nt, Human
gguaggggcagggccaagcugu

SEQ ID NO: 19403 - RNA, 22 nt, Human
gguauaguauuauuugaaagag

SEQ ID NO: 19404 - RNA, 22 nt, Human
gguaugaaaugauuccauguua

SEQ ID NO: 19405 - RNA, 22 nt, Human
gguauggaucagaugggcucaa

SEQ ID NO: 19406 - RNA, 22 nt, Human
ggugauuuauccauuuucuggu

SEQ ID NO: 19407 - RNA, 22 nt, Human
ggugauuuccuuuugcaaaguc

SEQ ID NO: 19408 - RNA, 22 nt, Human
ggugauuuucgaguuucauguu

SEQ ID NO: 19409 - RNA, 22 nt, Human
ggugcaaaaguaaucacaguuu

SEQ ID NO: 19410 - RNA, 22 nt, Human
ggugcaaagauggcaguugcaa

SEQ ID NO: 19411 - RNA, 22 nt, Human
ggugcaaguuuuuugaggaagu

SEQ ID NO: 19412 - RNA, 22 nt, Human
ggugcaauaaaguuguagaacc

SEQ ID NO: 19413 - RNA, 22 nt, Human
ggugcagaaggaagggagcugg

SEQ ID NO: 19414 - RNA, 22 nt, Human
ggugcagaguccacagaaagcu

SEQ ID NO: 19415 - RNA, 22 nt, Human
ggugcagccuccccagugacag

SEQ ID NO: 19416 - RNA, 22 nt, Human
ggugcagccuuuguuucuacuu

SEQ ID NO: 19417 - RNA, 22 nt, Human
ggugcagcugcagccugggagc

SEQ ID NO: 19418 - RNA, 22 nt, Human
ggugcaggaaaauuaccuggag

SEQ ID NO: 19419 - RNA, 22 nt, Human
ggugcaggcgguggggcaagua

SEQ ID NO: 19420 - RNA, 22 nt, Human
ggugcagggagaggcaggcccc

SEQ ID NO: 19421 - RNA, 20 nt, Human
ggugcagguaacgcugugcu

SEQ ID NO: 19422 - RNA, 22 nt, Human
ggugcagugguguggcaaaggg

SEQ ID NO: 19423 - RNA, 22 nt, Human
ggugcaugguggaggugacccu

SEQ ID NO: 19424 - RNA, 22 nt, Human
ggugccacugcacucuggccug

SEQ ID NO: 19425 - RNA, 22 nt, Human
ggugccaggcucccagcucagg

SEQ ID NO: 19426 - RNA, 22 nt, Human
ggugcccuggaagcugcugcau

SEQ ID NO: 19427 - RNA, 22 nt, Human
ggugcccuucagacagugggca

SEQ ID NO: 19428 - RNA, 22 nt, Human
ggugcucaagagggcauccucu

SEQ ID NO: 19429 - RNA, 22 nt, Human
ggugcugaaggacuauaacggu

SEQ ID NO: 19430 - RNA, 19 nt, Human
ggugcugacaucaugcuuu

SEQ ID NO: 19431 - RNA, 22 nt, Human
ggugcugauuaagaacuguaua

SEQ ID NO: 19432 - RNA, 22 nt, Human
ggugcuucugggcauagcagga

SEQ ID NO: 19433 - RNA, 22 nt, Human
gguggaaggcagcagucucagg

SEQ ID NO: 19434 - RNA, 17 nt, Human
gguggaaguuucuaguu

SEQ ID NO: 19435 - RNA, 22 nt, Human
gguggacaaaugaaugacugaa

SEQ ID NO: 19436 - RNA, 22 nt, Human
gguggagagcuggaugagaggu

SEQ ID NO: 19437 - RNA, 22 nt, Human
gguggaugcugacuguucugcu

SEQ ID NO: 19438 - RNA, 22 nt, Human
gguggcagagacauaggacaua

SEQ ID NO: 19439 - RNA, 22 nt, Human
gguggcagcgucuaucugacau

SEQ ID NO: 19440 - RNA, 22 nt, Human
gguggcaggcuggcauuggcaa

SEQ ID NO: 19441 - RNA, 22 nt, Human
gguggcagggagugucccuggg

SEQ ID NO: 19442 - RNA, 18 nt, Human
gguggcaggucagaugcc

SEQ ID NO: 19443 - RNA, 22 nt, Human
gguggcagucuuaagagaucuu

SEQ ID NO: 19444 - RNA, 22 nt, Human
gguggcaguggucucugacaga

SEQ ID NO: 19445 - RNA, 22 nt, Human
gguggcaguuacaggggcaaau

SEQ ID NO: 19446 - RNA, 22 nt, Human
gguggcauaagaacacuaaaga

SEQ ID NO: 19447 - RNA, 22 nt, Human
gguggcauacaacauagaggcu

SEQ ID NO: 19448 - RNA, 22 nt, Human
gguggcaucucaguucaugggc

SEQ ID NO: 19449 - RNA, 22 nt, Human
gguggcaucucuuuccagauuu

SEQ ID NO: 19450 - RNA, 22 nt, Human
gguggccauaggaccagccugg

SEQ ID NO: 19451 - RNA, 22 nt, Human
gguggccucagcaaggcuggca

SEQ ID NO: 19452 - RNA, 22 nt, Human
gguggccugcccugaucccugg

SEQ ID NO: 19453 - RNA, 21 nt, Human
gguggcuagaaagcagugaga

SEQ ID NO: 19454 - RNA, 22 nt, Human
gguggcucaaagagagcacaga

SEQ ID NO: 19455 - RNA, 19 nt, Human
gguggcucagggcccagcc

SEQ ID NO: 19456 - RNA, 18 nt, Human
gguggcuggggacggaca

SEQ ID NO: 19457 - RNA, 22 nt, Human
gguggcugguuuuauaagaggu

SEQ ID NO: 19458 - RNA, 22 nt, Human
ggugggaaauaauuaggauuau

SEQ ID NO: 19459 - RNA, 18 nt, Human
ggugggaagccagggccu

SEQ ID NO: 19460 - RNA, 22 nt, Human
ggugggagccaacacccuucug

SEQ ID NO: 19461 - RNA, 22 nt, Human
ggugggaggacuguuugaggca

SEQ ID NO: 19462 - RNA, 22 nt, Human
ggugggcaacauuuggccugag

SEQ ID NO: 19463 - RNA, 22 nt, Human
ggugggcagcucuuggcaggca

SEQ ID NO: 19464 - RNA, 22 nt, Human
gguggggcuaggaccucaggau

SEQ ID NO: 19465 - RNA, 22 nt, Human
gguggggcucagcaaucugugu

SEQ ID NO: 19466 - RNA, 22 nt, Human
gguggggcugcaagcaguucgg

SEQ ID NO: 19467 - RNA, 16 nt, Human
ggugggguaguuagaa

SEQ ID NO: 19468 - RNA, 22 nt, Human
gguggguaaaacugcuggcacu

SEQ ID NO: 19469 - RNA, 22 nt, Human
ggugggugagcccugggagcug

SEQ ID NO: 19470 - RNA, 22 nt, Human
gguggguuuggaagagcaggcu

SEQ ID NO: 19471 - RNA, 22 nt, Human
ggugguggagccagcugggagu

SEQ ID NO: 19472 - RNA, 22 nt, Human
ggugguggucccgacuugggag

SEQ ID NO: 19473 - RNA, 22 nt, Human
ggugguugcauaggccagcagc

SEQ ID NO: 19474 - RNA, 22 nt, Human
ggugucaaaauaccauuucagg

SEQ ID NO: 19475 - RNA, 22 nt, Human
uccucaugccgggucucacgcu

SEQ ID NO: 19476 - RNA, 22 nt, Human
uccuccaagcguggguguuuga

SEQ ID NO: 19477 - RNA, 20 nt, Human
uccuccagaagggcagggug

SEQ ID NO: 19478 - RNA, 22 nt, Human
uccuccagcccucuaggaaaau

SEQ ID NO: 19479 - RNA, 22 nt, Human
uccuccaggcaccucacuggcu

SEQ ID NO: 19480 - RNA, 22 nt, Human
uccuccaggucuaggguggcuu

SEQ ID NO: 19481 - RNA, 22 nt, Human
uccuccagucuuggugagguug

SEQ ID NO: 19482 - RNA, 23 nt, Human
uccucccaaauuucagccucauu

SEQ ID NO: 19483 - RNA, 22 nt, Human
uccucccugaguggggacagcu

SEQ ID NO: 19484 - RNA, 22 nt, Human
uccucccugggagcuucugagu

SEQ ID NO: 19485 - RNA, 19 nt, Human
uccucccuuugguguccug

SEQ ID NO: 19486 - RNA, 22 nt, Human
uccuccucacgcuguugcuugu

SEQ ID NO: 19487 - RNA, 22 nt, Human
uccuccuccucacagucaccug

SEQ ID NO: 19488 - RNA, 23 nt, Human
uccuccugacacagccugaguga

SEQ ID NO: 19489 - RNA, 22 nt, Human
uccuccugcuguuagucuugaa

SEQ ID NO: 19490 - RNA, 22 nt, Human
uccuccugucuaccaguuccug

SEQ ID NO: 19491 - RNA, 19 nt, Human
uccucugaagguucuuuua

SEQ ID NO: 19492 - RNA, 22 nt, Human
uccucugacuucugguugaguu

SEQ ID NO: 19493 - RNA, 22 nt, Human
uccucugcucagcauuccucac

SEQ ID NO: 19494 - RNA, 22 nt, Human
uccucugggccuauuuguucac

SEQ ID NO: 19495 - RNA, 22 nt, Human
uccucuucugcccaucagaggc

SEQ ID NO: 19496 - RNA, 22 nt, Human
uccucuuuaaaugcuuuuaucu

SEQ ID NO: 19497 - RNA, 22 nt, Human
uccugaaaugugcacaugacau

SEQ ID NO: 19498 - RNA, 22 nt, Human
uccugaacauuaugcaagcuuc

SEQ ID NO: 19499 - RNA, 22 nt, Human
uccugaagaugaaaagagaggu

SEQ ID NO: 19500 - RNA, 22 nt, Human
uccugaaugaguugaucacaau

SEQ ID NO: 19501 - RNA, 22 nt, Human
uccugaauuucccagcaugaac

SEQ ID NO: 19502 - RNA, 20 nt, Human
uccugagaccugggaagguu

SEQ ID NO: 19503 - RNA, 22 nt, Human
uccugagagccuuggcuucaga

SEQ ID NO: 19504 - RNA, 22 nt, Human
uccugagagucaagaaugcagg

SEQ ID NO: 19505 - RNA, 22 nt, Human
uccugagaugcugauuucgggg

SEQ ID NO: 19506 - RNA, 22 nt, Human
uccugagauucugcauuucuaa

SEQ ID NO: 19507 - RNA, 20 nt, Human
uccugagccuccaccauguc

SEQ ID NO: 19508 - RNA, 22 nt, Human
uccugagcucccaugaacaggc

SEQ ID NO: 19509 - RNA, 22 nt, Human
uccugaggagaagagugcuagg

SEQ ID NO: 19510 - RNA, 22 nt, Human
uccugaggaugguugaagugca

SEQ ID NO: 19511 - RNA, 22 nt, Human
uccugagguggauugagcagag

SEQ ID NO: 19512 - RNA, 22 nt, Human
uccugagugagagcugggaggu

SEQ ID NO: 19513 - RNA, 22 nt, Human
uccugagugguuguuuucuucc

SEQ ID NO: 19514 - RNA, 22 nt, Human
uccugaguguuuggccaggcca

SEQ ID NO: 19515 - RNA, 22 nt, Human
gucugccucuauugccuaccug

SEQ ID NO: 19516 - RNA, 22 nt, Human
gucugccucuuucuuucugggu

SEQ ID NO: 19517 - RNA, 22 nt, Human
gucugccugcaauccagagacu

SEQ ID NO: 19518 - RNA, 22 nt, Human
gucugccuggaggcagcugcug

SEQ ID NO: 19519 - RNA, 22 nt, Human
gucugccuuuaucaucuccuua

SEQ ID NO: 19520 - RNA, 22 nt, Human
gucugcucaugcuaccgcgggc

SEQ ID NO: 19521 - RNA, 22 nt, Human
gucugcuguagguaggacagca

SEQ ID NO: 19522 - RNA, 22 nt, Human
gucugcuuuucugaauugccug

SEQ ID NO: 19523 - RNA, 22 nt, Human
gucugcuuuucugcccuuucau

SEQ ID NO: 19524 - RNA, 22 nt, Human
gucugcuuuuguuuuacuggua

SEQ ID NO: 19525 - RNA, 22 nt, Human
gucuggaaauucaauuuaaugc

SEQ ID NO: 19526 - RNA, 22 nt, Human
gucuggaaauuuaagguaugag

SEQ ID NO: 19527 - RNA, 22 nt, Human
gucuggaagagcaggaauaaac

SEQ ID NO: 19528 - RNA, 22 nt, Human
gucuggaagugucuuguuaagu

SEQ ID NO: 19529 - RNA, 22 nt, Human
gucuggacaggacuauuucuaa

SEQ ID NO: 19530 - RNA, 22 nt, Human
gucuggagccccagucaaugag

SEQ ID NO: 19531 - RNA, 22 nt, Human
gucuggaggcacuuucucauga

SEQ ID NO: 19532 - RNA, 17 nt, Human
gucuggaguggccuuca

SEQ ID NO: 19533 - RNA, 22 nt, Human
gucuggaguggggccugagaau

SEQ ID NO: 19534 - RNA, 22 nt, Human
gucuggcauaugcaaagugcau

SEQ ID NO: 19535 - RNA, 22 nt, Human
gucuggcauucuuccuggagaa

SEQ ID NO: 19536 - RNA, 22 nt, Human
gucuggccauuugcccauugug

SEQ ID NO: 19537 - RNA, 22 nt, Human
gucuggccuuuuuagcuugugg

SEQ ID NO: 19538 - RNA, 22 nt, Human
gucuggcuagagacacccuccc

SEQ ID NO: 19539 - RNA, 22 nt, Human
gucuggcucaguccuagcugua

SEQ ID NO: 19540 - RNA, 22 nt, Human
gucugggaguuuggugcugccg

SEQ ID NO: 19541 - RNA, 22 nt, Human
gucugggcaggaaucugcauuc

SEQ ID NO: 19542 - RNA, 22 nt, Human
gucugggccaggcgagccgagg

SEQ ID NO: 19543 - RNA, 22 nt, Human
gucugggcuuagggacauggca

SEQ ID NO: 19544 - RNA, 17 nt, Human
gucugggcuuuagagac

SEQ ID NO: 19545 - RNA, 22 nt, Human
gucugguccucuucacaguggc

SEQ ID NO: 19546 - RNA, 22 nt, Human
gucuggugggauuccaaguggc

SEQ ID NO: 19547 - RNA, 22 nt, Human
gucuguagauauucacuccuuc

SEQ ID NO: 19548 - RNA, 22 nt, Human
gucuguagucacacaggugaca

SEQ ID NO: 19549 - RNA, 22 nt, Human
gucuguaucagaggagugaaug

SEQ ID NO: 19550 - RNA, 22 nt, Human
gucugucauacggcuuauguaa

SEQ ID NO: 19551 - RNA, 22 nt, Human
gucuguccacuuggaagcuccc

SEQ ID NO: 19552 - RNA, 22 nt, Human
gucugucucccugugacugaga

SEQ ID NO: 19553 - RNA, 22 nt, Human
gucugugguagacaggaaggca

SEQ ID NO: 19554 - RNA, 22 nt, Human
gucuguggucccugcuggggac

SEQ ID NO: 19555 - RNA, 19 nt, Human
gucuguguauuuguugcug

SEQ ID NO: 19556 - RNA, 22 nt, Human
gucuguguuuucaggccuuugu

SEQ ID NO: 19557 - RNA, 22 nt, Human
gucuuaagaaugaaugcugaga

SEQ ID NO: 19558 - RNA, 19 nt, Human
gucuuacaggcaacaugag

SEQ ID NO: 19559 - RNA, 22 nt, Human
gucuuaccgcaccucaugaacu

SEQ ID NO: 19560 - RNA, 22 nt, Human
gucuuagauuucaccgauaaug

SEQ ID NO: 19561 - RNA, 22 nt, Human
gucuuauaguacaauuugaagu

SEQ ID NO: 19562 - RNA, 22 nt, Human
gucuuauuaaauugaacccuca

SEQ ID NO: 19563 - RNA, 22 nt, Human
gucuuauugcguauguauacaa

SEQ ID NO: 19564 - RNA, 22 nt, Human
gucuuauuuaaagagaucauac

SEQ ID NO: 19565 - RNA, 22 nt, Human
gucuuauuuaaccuaaauuucu

SEQ ID NO: 19566 - RNA, 22 nt, Human
gucuuauuuucugucuacuaaa

SEQ ID NO: 19567 - RNA, 22 nt, Human
gucuucaacaauaacuaccacu

SEQ ID NO: 19568 - RNA, 22 nt, Human
gucuucauucaacaaauauuca

SEQ ID NO: 19569 - RNA, 22 nt, Human
gucuuccacauuucaagaggcu

SEQ ID NO: 19570 - RNA, 22 nt, Human
gucuucuaaguaucaaagcaga

SEQ ID NO: 19571 - RNA, 20 nt, Human
gucuucuauucccagaaagu

SEQ ID NO: 19572 - RNA, 22 nt, Human
gucuucugccuccauuagaguu

SEQ ID NO: 19573 - RNA, 22 nt, Human
gucuucugucugucuggcaugu

SEQ ID NO: 19574 - RNA, 22 nt, Human
gucuucuuugucaucuuagguu

SEQ ID NO: 19575 - RNA, 22 nt, Human
gucuugaaauucuguuaaagga

SEQ ID NO: 19576 - RNA, 20 nt, Human
gucuugaaggggucauggag

SEQ ID NO: 19577 - RNA, 22 nt, Human
gucuuggccgugcagaugaaga

SEQ ID NO: 19578 - RNA, 19 nt, Human
gucuuguaacacauaagug

SEQ ID NO: 19579 - RNA, 22 nt, Human
gucuuuauauuuacuaaagaau

SEQ ID NO: 19580 - RNA, 22 nt, Human
gucuuuauuacaaauccuuuuc

SEQ ID NO: 19581 - RNA, 22 nt, Human
gucuuuauuugagauugucauu

SEQ ID NO: 19582 - RNA, 21 nt, Human
gucuuucuaccucuauguggc

SEQ ID NO: 19583 - RNA, 22 nt, Human
gucuuuuuuacaccuuacauca

SEQ ID NO: 19584 - RNA, 22 nt, Human
gugaaaauaaggcugguucuug

SEQ ID NO: 19585 - RNA, 22 nt, Human
gugaacuaaggauucaaacuuc

SEQ ID NO: 19586 - RNA, 22 nt, Human
gugaagaccagggaacgcuggc

SEQ ID NO: 19587 - RNA, 22 nt, Human
gugaagacuuggagaaguuaag

SEQ ID NO: 19588 - RNA, 17 nt, Human
gugaagagucauugaau

SEQ ID NO: 19589 - RNA, 22 nt, Human
gugaagaucugagcccucaggu

SEQ ID NO: 19590 - RNA, 22 nt, Human
gugaagcagaguguggaagcaa

SEQ ID NO: 19591 - RNA, 22 nt, Human
gugaagcaguugcguggguucc

SEQ ID NO: 19592 - RNA, 22 nt, Human
gugaaggacugaaugaaaaugu

SEQ ID NO: 19593 - RNA, 22 nt, Human
gugaaggaggggccacagauau

SEQ ID NO: 19594 - RNA, 22 nt, Human
gugaaggauuggagggcaucuu

SEQ ID NO: 19595 - RNA, 22 nt, Human
gugaauaagaccuaaggaugaa

SEQ ID NO: 19596 - RNA, 21 nt, Human
gugaauuaauuauaugccuua

SEQ ID NO: 19597 - RNA, 22 nt, Human
gugaauuucugacuaaaagugc

SEQ ID NO: 19598 - RNA, 22 nt, Human
gugacagaaacagggcuagaau

SEQ ID NO: 19599 - RNA, 16 nt, Human
gugacagacaauaggc

SEQ ID NO: 19600 - RNA, 22 nt, Human
gugacagagauuaauagcuugg

SEQ ID NO: 19601 - RNA, 22 nt, Human
gugacagauuugcugcgcaugg

SEQ ID NO: 19602 - RNA, 18 nt, Human
gugacagcugcuagcuca

SEQ ID NO: 19603 - RNA, 22 nt, Human
gugacaggauagucagcuuugu

SEQ ID NO: 19604 - RNA, 22 nt, Human
gugacaggcauggggucaugca

SEQ ID NO: 19605 - RNA, 22 nt, Human
gugacaggcccagugggaugca

SEQ ID NO: 19606 - RNA, 22 nt, Human
gugacagguauacucaccauug

SEQ ID NO: 19607 - RNA, 22 nt, Human
gugacauguuauggacuggcua

SEQ ID NO: 19608 - RNA, 22 nt, Human
gugacauuuuuacugaugagag

SEQ ID NO: 19609 - RNA, 20 nt, Human
gugaccagaagacagugggu

SEQ ID NO: 19610 - RNA, 22 nt, Human
gugaccaucagagaauaacaaa

SEQ ID NO: 19611 - RNA, 22 nt, Human
gugacccaggacacuguguauc

SEQ ID NO: 19612 - RNA, 22 nt, Human
gugacgugaggggcuccuguug

SEQ ID NO: 19613 - RNA, 22 nt, Human
gugacucacacaggccugggcu

SEQ ID NO: 19614 - RNA, 22 nt, Human
gugacucuacuuaagauuaagc

SEQ ID NO: 19615 - RNA, 22 nt, Human
gugacucugcauuuuauggauc

SEQ ID NO: 19616 - RNA, 22 nt, Human
gugacucuguuucugaaaacag

SEQ ID NO: 19617 - RNA, 18 nt, Human
gugacugccccaaaaggc

SEQ ID NO: 19618 - RNA, 22 nt, Human
gugacuguaauuaccuuagcaa

SEQ ID NO: 19619 - RNA, 22 nt, Human
gugacuuuaacuucagauuaga

SEQ ID NO: 19620 - RNA, 22 nt, Human
gugagaauaccagcagugagaa

SEQ ID NO: 19621 - RNA, 22 nt, Human
gugagacacccaagagucagau

SEQ ID NO: 19622 - RNA, 22 nt, Human
gugagacaucuugggaagugau

SEQ ID NO: 19623 - RNA, 22 nt, Human
gugagagaucccccacucaucu

SEQ ID NO: 19624 - RNA, 22 nt, Human
gugccagccuggugcgccuggg

SEQ ID NO: 19625 - RNA, 20 nt, Human
gugccaggcaagacaggugg

SEQ ID NO: 19626 - RNA, 22 nt, Human
gugccagggaguggaggagcuu

SEQ ID NO: 19627 - RNA, 22 nt, Human
gugcccaggggccagcugccgg

SEQ ID NO: 19628 - RNA, 22 nt, Human
gugcccaguaaaugaaagcuuu

SEQ ID NO: 19629 - RNA, 22 nt, Human
gugcccucacaaaguggaaaga

SEQ ID NO: 19630 - RNA, 22 nt, Human
gugcccucaugaaacgaaggau

SEQ ID NO: 19631 - RNA, 22 nt, Human
ucugaagaaauacagcuggggu

SEQ ID NO: 19632 - RNA, 22 nt, Human
ucugaagaauaggauguugugu

SEQ ID NO: 19633 - RNA, 23 nt, Human
ucugaagaugcuguuuccaguga

SEQ ID NO: 19634 - RNA, 22 nt, Human
ucugaagauuaccagcuaaaug

SEQ ID NO: 19635 - RNA, 22 nt, Human
ucugaagcacagcaggaagggu

SEQ ID NO: 19636 - RNA, 22 nt, Human
ucugaagccaccucugcuuguc

SEQ ID NO: 19637 - RNA, 22 nt, Human
ucugaaggucugagaaccagga

SEQ ID NO: 19638 - RNA, 22 nt, Human
ucugaagguugagaagggcuga

SEQ ID NO: 19639 - RNA, 19 nt, Human
ucugaaugggaugaguugg

SEQ ID NO: 19640 - RNA, 22 nt, Human
ucugaauguuaggaaacuuucu

SEQ ID NO: 19641 - RNA, 22 nt, Human
ucugaauucugacaauuugaau

SEQ ID NO: 19642 - RNA, 19 nt, Human
ucugacacuuacacacccc

SEQ ID NO: 19643 - RNA, 22 nt, Human
ucugacagaggugguagauaca

SEQ ID NO: 19644 - RNA, 22 nt, Human
ucugacagcuccaggcagcaau

SEQ ID NO: 19645 - RNA, 22 nt, Human
ucugacagugugaauauugacu

SEQ ID NO: 19646 - RNA, 22 nt, Human
ucugaccaggcuggcucagggc

SEQ ID NO: 19647 - RNA, 23 nt, Human
ucugaccauuugacaacauccug

SEQ ID NO: 19648 - RNA, 22 nt, Human
ucugacccuacucagcacuuug

SEQ ID NO: 19649 - RNA, 22 nt, Human
ucugacccucagaucaugucca

SEQ ID NO: 19650 - RNA, 22 nt, Human
ucugacuuauuuguccuuggug

SEQ ID NO: 19651 - RNA, 22 nt, Human
ucugagaaaguacuguauguuc

SEQ ID NO: 19652 - RNA, 21 nt, Human
ucugagaacuucugcugcagc

SEQ ID NO: 19653 - RNA, 20 nt, Human
ucugagaagcaaacaauguu

SEQ ID NO: 19654 - RNA, 22 nt, Human
ucugagaagcaccuucuggaca

SEQ ID NO: 19655 - RNA, 22 nt, Human
ucugagaagcgggagccuguga

SEQ ID NO: 19656 - RNA, 22 nt, Human
ucugagaaggugcaucagcugc

SEQ ID NO: 19657 - RNA, 22 nt, Human
ucugagaauaaaaauugcauuu

SEQ ID NO: 19658 - RNA, 22 nt, Human
ucugagacaggaaguggagggu

SEQ ID NO: 19659 - RNA, 21 nt, Human
ucugagacuggguuagaaugu

SEQ ID NO: 19660 - RNA, 22 nt, Human
ucugagagauacaaggaggcaa

SEQ ID NO: 19661 - RNA, 22 nt, Human
ucugagagcaaggcauuagcag

SEQ ID NO: 19662 - RNA, 22 nt, Human
ucugagagcaucacugggguac

SEQ ID NO: 19663 - RNA, 22 nt, Human
ucugagagcucuggggccccuu

SEQ ID NO: 19664 - RNA, 22 nt, Human
ucugagagcuguagaagccuau

SEQ ID NO: 19665 - RNA, 22 nt, Human
ucugagaggcagaccuuccuaa

SEQ ID NO: 19666 - RNA, 22 nt, Human
ucugagaggugaauucagcaaa

SEQ ID NO: 19667 - RNA, 22 nt, Human
ucugagagguuaagcaauuuga

SEQ ID NO: 19668 - RNA, 22 nt, Human
ucugagagucucugaggcagau

SEQ ID NO: 19669 - RNA, 22 nt, Human
ucugagagucuuucuucaagug

SEQ ID NO: 19670 - RNA, 22 nt, Human
ucugagauuaagcagagaugga

SEQ ID NO: 19671 - RNA, 16 nt, Human
ucugagcacaaaacac

SEQ ID NO: 19672 - RNA, 22 nt, Human
ucugagcaccuuauauucuuga

SEQ ID NO: 19673 - RNA, 22 nt, Human
ucugagcagaugcucgcucucc

SEQ ID NO: 19674 - RNA, 22 nt, Human
ucugagccaccugagcccaugg

SEQ ID NO: 19675 - RNA, 22 nt, Human
ucugagccauaagaguacagga

SEQ ID NO: 19676 - RNA, 22 nt, Human
ucugagcccucuuuugcagccc

SEQ ID NO: 19677 - RNA, 22 nt, Human
ucugagcuaauccuguugccga

SEQ ID NO: 19678 - RNA, 22 nt, Human
ucugagcuacgaugccugucac

SEQ ID NO: 19679 - RNA, 22 nt, Human
ucugagcucaagugacaguuag

SEQ ID NO: 19680 - RNA, 22 nt, Human
ucugagcuccaugcaggaggcu

SEQ ID NO: 19681 - RNA, 21 nt, Human
ucugagcugaguccucuaggu

SEQ ID NO: 19682 - RNA, 19 nt, Human
ucugagcugauaugacauu

SEQ ID NO: 19683 - RNA, 22 nt, Human
ucugagcugcagaguggggugg

SEQ ID NO: 19684 - RNA, 22 nt, Human
ucugagcugcuagguaugcauu

SEQ ID NO: 19685 - RNA, 22 nt, Human
ucugagcugggcacagaaggcg

SEQ ID NO: 19686 - RNA, 22 nt, Human
ucugagcuucugcauuuccaac

SEQ ID NO: 19687 - RNA, 22 nt, Human
ucugaggaagcagcaggaagug

SEQ ID NO: 19688 - RNA, 22 nt, Human
ucugaggaauaagaaggaagug

SEQ ID NO: 19689 - RNA, 18 nt, Human
ucugaggaauggaagagc

SEQ ID NO: 19690 - RNA, 22 nt, Human
ucugaggaauucugcagugaga

SEQ ID NO: 19691 - RNA, 21 nt, Human
ucugaggagaaacucuuggug

SEQ ID NO: 19692 - RNA, 22 nt, Human
ucugaggagugacccucuugca

SEQ ID NO: 19693 - RNA, 22 nt, Human
ucugaggaguugggccagugcu

SEQ ID NO: 19694 - RNA, 22 nt, Human
ucugaggcaaacagaggagugu

SEQ ID NO: 19695 - RNA, 22 nt, Human
ucugaggcagcuugccacucua

SEQ ID NO: 19696 - RNA, 17 nt, Human
ucugaggccucuaggag

SEQ ID NO: 19697 - RNA, 22 nt, Human
ucugaggccuucagcaugaauc

SEQ ID NO: 19698 - RNA, 20 nt, Human
ucugaggcugagcccagcgu

SEQ ID NO: 19699 - RNA, 20 nt, Human
ucugaggcugagcucuacuu

SEQ ID NO: 19700 - RNA, 22 nt, Human
ucugaggcuucagacuguacug

SEQ ID NO: 19701 - RNA, 22 nt, Human
ucugagggacaauuuugauggu

SEQ ID NO: 19702 - RNA, 22 nt, Human
ucugaggggguguuuauaagcu

SEQ ID NO: 19703 - RNA, 22 nt, Human
ucugagguaccagcugguuuau

SEQ ID NO: 19704 - RNA, 22 nt, Human
ucugaggucagugcugcaguua

SEQ ID NO: 19705 - RNA, 19 nt, Human
ucugagguggaacuggggg

SEQ ID NO: 19706 - RNA, 23 nt, Human
ucugagugauuagccucuggggu

SEQ ID NO: 19707 - RNA, 22 nt, Human
ucugaguuacacaagcaagggu

SEQ ID NO: 19708 - RNA, 20 nt, Human
ucugauaaaaacuacuccau

SEQ ID NO: 19709 - RNA, 22 nt, Human
ucugauaaaugccaucuuuuug

SEQ ID NO: 19710 - RNA, 22 nt, Human
ucugaucugugccuuaggccug

SEQ ID NO: 19711 - RNA, 21 nt, Human
ucugauguguuuaaugguggg

SEQ ID NO: 19712 - RNA, 22 nt, Human
ucugauuccagugacccuagga

SEQ ID NO: 19713 - RNA, 22 nt, Human
ucugauuuauauaugcagauac

SEQ ID NO: 19714 - RNA, 22 nt, Human
ucugcaaaaguguucauaaaga

SEQ ID NO: 19715 - RNA, 20 nt, Human
ucugcaaacaaguuuuagac

SEQ ID NO: 19716 - RNA, 22 nt, Human
ucugcaagagcuucaagguaga

SEQ ID NO: 19717 - RNA, 19 nt, Human
ucugcaagugucagaggcg

SEQ ID NO: 19718 - RNA, 22 nt, Human
ucugcacaggagggccguggug

SEQ ID NO: 19719 - RNA, 22 nt, Human
ucugcaccucugaaauugguca

SEQ ID NO: 19720 - RNA, 22 nt, Human
ucugcagaaggaaucagcugag

SEQ ID NO: 19721 - RNA, 19 nt, Human
ucugcagaaggcauacaug

SEQ ID NO: 19722 - RNA, 22 nt, Human
ucugcagacaggaagcugaggc

SEQ ID NO: 19723 - RNA, 23 nt, Human
ucugcagacgcuguucuauuguc

SEQ ID NO: 19724 - RNA, 19 nt, Human
ucugcagacuauauuguga

SEQ ID NO: 19725 - RNA, 22 nt, Human
ucugcagacuugccuaagugug

SEQ ID NO: 19726 - RNA, 20 nt, Human
ucugcagauaagggaaagac

SEQ ID NO: 19727 - RNA, 22 nt, Human
ucugcagauuuaucagcagcug

SEQ ID NO: 19728 - RNA, 22 nt, Human
ucugcagcaaccuuucaccucc

SEQ ID NO: 19729 - RNA, 22 nt, Human
ucugcagcuuacuuucacauga

SEQ ID NO: 19730 - RNA, 22 nt, Human
ucugcagcuuuuugguggggug

SEQ ID NO: 19731 - RNA, 22 nt, Human
ucugcaggaaaaaagugccugg

SEQ ID NO: 19732 - RNA, 22 nt, Human
ucugcaggagagugcccuagag

SEQ ID NO: 19733 - RNA, 22 nt, Human
ucugcaggcuuauaggaugggu

SEQ ID NO: 19734 - RNA, 20 nt, Human
uaaaugcaugaauguaaggc

SEQ ID NO: 19735 - RNA, 18 nt, Human
uaaaugcauguuaauaac

SEQ ID NO: 19736 - RNA, 22 nt, Human
uaaaugcuccauacauacacca

SEQ ID NO: 19737 - RNA, 20 nt, Human
uaaauggugcauuucuuaua

SEQ ID NO: 19738 - RNA, 22 nt, Human
uaaauguaccuucugccuuacu

SEQ ID NO: 19739 - RNA, 22 nt, Human
uaaauguauaggcacuaaaccu

SEQ ID NO: 19740 - RNA, 22 nt, Human
uaaaugucuguuaacaugaaug

SEQ ID NO: 19741 - RNA, 22 nt, Human
uaaaugucuuugucacguuggg

SEQ ID NO: 19742 - RNA, 22 nt, Human
uaaaugugggggccacgggcuu

SEQ ID NO: 19743 - RNA, 22 nt, Human
uaaauguguaaaccuccauuac

SEQ ID NO: 19744 - RNA, 22 nt, Human
uaaauguuacuuuccuuucaca

SEQ ID NO: 19745 - RNA, 22 nt, Human
uaaauuauggcuggcagagcag

SEQ ID NO: 19746 - RNA, 22 nt, Human
uaaauuauguuccauguccuuu

SEQ ID NO: 19747 - RNA, 22 nt, Human
uaaauucagugaguaauuucug

SEQ ID NO: 19748 - RNA, 22 nt, Human
gugcccugacacaccuggugug

SEQ ID NO: 19749 - RNA, 22 nt, Human
gugcccuggcucacagugucuc

SEQ ID NO: 19750 - RNA, 22 nt, Human
gugcccugguccccagcauaua

SEQ ID NO: 19751 - RNA, 22 nt, Human
gugcccugugaacuguaaggaa

SEQ ID NO: 19752 - RNA, 22 nt, Human
gugccgcgacgcagucggugcc

SEQ ID NO: 19753 - RNA, 22 nt, Human
gugccgugggccuuagugaucu

SEQ ID NO: 19754 - RNA, 22 nt, Human
gugccucccgggaccaugcacu

SEQ ID NO: 19755 - RNA, 22 nt, Human
gugccucccggggcucuuccuu

SEQ ID NO: 19756 - RNA, 22 nt, Human
gugccucucauuggcugagccc

SEQ ID NO: 19757 - RNA, 22 nt, Human
gugccucugagcucugcuacag

SEQ ID NO: 19758 - RNA, 22 nt, Human
gugccugcaggugccggcuuca

SEQ ID NO: 19759 - RNA, 22 nt, Human
gugccugguuuggggaauguuc

SEQ ID NO: 19760 - RNA, 22 nt, Human
gugccugugccaggggugugcu

SEQ ID NO: 19761 - RNA, 22 nt, Human
gugccugugcggacucagggaa

SEQ ID NO: 19762 - RNA, 17 nt, Human
gugccuguuguccugga

SEQ ID NO: 19763 - RNA, 22 nt, Human
gugcgcacccucccggcauccc

SEQ ID NO: 19764 - RNA, 22 nt, Human
gugcgugaggccccugagcgaa

SEQ ID NO: 19765 - RNA, 22 nt, Human
gugcuaaugaauuggagugccu

SEQ ID NO: 19766 - RNA, 22 nt, Human
gugcucagaaacuugcucauuu

SEQ ID NO: 19767 - RNA, 22 nt, Human
gugcucauagaugaugcucuuu

SEQ ID NO: 19768 - RNA, 22 nt, Human
gugcucauguccuuucacugca

SEQ ID NO: 19769 - RNA, 22 nt, Human
gugcuccaacauuagugugcuu

SEQ ID NO: 19770 - RNA, 19 nt, Human
gugcuccagggcaaggagu

SEQ ID NO: 19771 - RNA, 22 nt, Human
gugcucuaaggcaccacugagc

SEQ ID NO: 19772 - RNA, 22 nt, Human
gugcucuagggucauuauggua

SEQ ID NO: 19773 - RNA, 22 nt, Human
gugcucuaggugauuccaaaau

SEQ ID NO: 19774 - RNA, 22 nt, Human
gugcucuauagagaucuaaucg

SEQ ID NO: 19775 - RNA, 22 nt, Human
gugcucuaugaggauauagggu

SEQ ID NO: 19776 - RNA, 22 nt, Human
gugcucuccagccccacgugga

SEQ ID NO: 19777 - RNA, 22 nt, Human
gugcucugaucugucugacauc

SEQ ID NO: 19778 - RNA, 21 nt, Human
gugcucugggcagcagagggc

SEQ ID NO: 19779 - RNA, 22 nt, Human
gugcugaaauagaggagguggc

SEQ ID NO: 19780 - RNA, 22 nt, Human
gugcugaacauuugggacuugu

SEQ ID NO: 19781 - RNA, 18 nt, Human
gugcugaauaacuacuuu

SEQ ID NO: 19782 - RNA, 22 nt, Human
gugcugagaacaaaaguggaca

SEQ ID NO: 19783 - RNA, 22 nt, Human
gugcugagaauugauguccuug

SEQ ID NO: 19784 - RNA, 22 nt, Human
gugcugagauuacaggugugag

SEQ ID NO: 19785 - RNA, 22 nt, Human
gugcugagcacaaggcccagag

SEQ ID NO: 19786 - RNA, 22 nt, Human
gugcugaggccaaugucagggu

SEQ ID NO: 19787 - RNA, 20 nt, Human
gugcugagggcugggcaaug

SEQ ID NO: 19788 - RNA, 22 nt, Human
gugcugauugggagcugggauu

SEQ ID NO: 19789 - RNA, 23 nt, Human
gugcugcaaaaucggccacugca

SEQ ID NO: 19790 - RNA, 22 nt, Human
gugcugcagggucagcacccuc

SEQ ID NO: 19791 - RNA, 22 nt, Human
gugcugccggcauagcagugaa

SEQ ID NO: 19792 - RNA, 22 nt, Human
gugcugcucaagggacaggaca

SEQ ID NO: 19793 - RNA, 22 nt, Human
gugcuggcugccaggaggcugc

SEQ ID NO: 19794 - RNA, 22 nt, Human
gugcuggggagauaggaagaga

SEQ ID NO: 19795 - RNA, 22 nt, Human
gugcugguauaugacugaguuu

SEQ ID NO: 19796 - RNA, 22 nt, Human
gugcuguaucagaaucugcucu

SEQ ID NO: 19797 - RNA, 22 nt, Human
gugcugucauuagcaucuagag

SEQ ID NO: 19798 - RNA, 18 nt, Human
gugcugugggcaguggcc

SEQ ID NO: 19799 - RNA, 22 nt, Human
gugcugugucuaucaggaauaa

SEQ ID NO: 19800 - RNA, 22 nt, Human
gugcuuaugugggagggagagg

SEQ ID NO: 19801 - RNA, 22 nt, Human
gugcuuccucugccaacacucu

SEQ ID NO: 19802 - RNA, 22 nt, Human
gugcuuccuguauugauuccau

SEQ ID NO: 19803 - RNA, 22 nt, Human
gugcuucucuucacacccaacu

SEQ ID NO: 19804 - RNA, 22 nt, Human
gugcuugggggaaguaacagac

SEQ ID NO: 19805 - RNA, 22 nt, Human
gugcuuuacuggcagugaugua

SEQ ID NO: 19806 - RNA, 22 nt, Human
gugcuuuagcugaguuggucaa

SEQ ID NO: 19807 - RNA, 22 nt, Human
gugcuuuccauccucccugcug

SEQ ID NO: 19808 - RNA, 22 nt, Human
gugcuuucugcugcauuccucu

SEQ ID NO: 19809 - RNA, 22 nt, Human
gugcuuugucuucaggaucaua

SEQ ID NO: 19810 - RNA, 22 nt, Human
gugcuuuucugcaggguccuau

SEQ ID NO: 19811 - RNA, 22 nt, Human
guggaacagccugugcaaaccu

SEQ ID NO: 19812 - RNA, 22 nt, Human
guggaagcaguaaggcaaguuu

SEQ ID NO: 19813 - RNA, 22 nt, Human
guggaagccuacucuugugguu

SEQ ID NO: 19814 - RNA, 22 nt, Human
guggaagcugaugggagacagg

SEQ ID NO: 19815 - RNA, 22 nt, Human
guggaaugaauagauuugcauu

SEQ ID NO: 19816 - RNA, 22 nt, Human
guggaauggccaugggauccuu

SEQ ID NO: 19817 - RNA, 22 nt, Human
guggacagacauaauccuaauu

SEQ ID NO: 19818 - RNA, 22 nt, Human
guggaccaagguggaagauaaa

SEQ ID NO: 19819 - RNA, 22 nt, Human
guggacguuaggauuguguaga

SEQ ID NO: 19820 - RNA, 22 nt, Human
guggacuugcuguccuggacuu

SEQ ID NO: 19821 - RNA, 22 nt, Human
guggagacgggacagaagcuaa

SEQ ID NO: 19822 - RNA, 22 nt, Human
guggagcaggacuagcugagaa

SEQ ID NO: 19823 - RNA, 22 nt, Human
guggagcaugugaggacugagu

SEQ ID NO: 19824 - RNA, 23 nt, Human
guggagccacaucacaggcuccu

SEQ ID NO: 19825 - RNA, 22 nt, Human
guggagcccugguagggacccc

SEQ ID NO: 19826 - RNA, 19 nt, Human
guggagcuaagaaaaggaa

SEQ ID NO: 19827 - RNA, 22 nt, Human
guggagggaaugaaucuucucu

SEQ ID NO: 19828 - RNA, 22 nt, Human
guggaugagauaacuguagaag

SEQ ID NO: 19829 - RNA, 22 nt, Human
guggaugcuuaggcagccuggg

SEQ ID NO: 19830 - RNA, 22 nt, Human
guggauggugguccaguaucau

SEQ ID NO: 19831 - RNA, 22 nt, Human
guggcacagagauggggcauga

SEQ ID NO: 19832 - RNA, 22 nt, Human
guggcacagccaagccucacuc

SEQ ID NO: 19833 - RNA, 22 nt, Human
guggcacagugggagagcccca

SEQ ID NO: 19834 - RNA, 22 nt, Human
guggcacaugcugcugcuucug

SEQ ID NO: 19835 - RNA, 22 nt, Human
guggcagaagaguaggaugggc

SEQ ID NO: 19836 - RNA, 22 nt, Human
guggcagagccuugcggcuuug

SEQ ID NO: 19837 - RNA, 22 nt, Human
guggcagagguuccucagugug

SEQ ID NO: 19838 - RNA, 22 nt, Human
guggcagauugcucaccauggu

SEQ ID NO: 19839 - RNA, 22 nt, Human
guggcagcaaaauccugcauuc

SEQ ID NO: 19840 - RNA, 22 nt, Human
guggcagcagaggggugguaug

SEQ ID NO: 19841 - RNA, 22 nt, Human
guggcagcagguacucacgcac

SEQ ID NO: 19842 - RNA, 22 nt, Human
guggcagcucauguuguuuuaa

SEQ ID NO: 19843 - RNA, 22 nt, Human
uaaaagauaucuuagggauuug

SEQ ID NO: 19844 - RNA, 21 nt, Human
uaaaagaugacaagacagcuc

SEQ ID NO: 19845 - RNA, 22 nt, Human
uaaaaguggauaagcuguagga

SEQ ID NO: 19846 - RNA, 22 nt, Human
uaaaaguuuuaguuguacauaa

SEQ ID NO: 19847 - RNA, 22 nt, Human
uaaaauagcaugugcagugaaa

SEQ ID NO: 19848 - RNA, 22 nt, Human
uaaaaucaugacagauugacau

SEQ ID NO: 19849 - RNA, 22 nt, Human
uaaaauuugucccugaguguug

SEQ ID NO: 19850 - RNA, 22 nt, Human
uaaacaagaaacauuuucuguu

SEQ ID NO: 19851 - RNA, 22 nt, Human
uaaacaagcugucugauauucu

SEQ ID NO: 19852 - RNA, 22 nt, Human
uaaacagagaagacuuugagca

SEQ ID NO: 19853 - RNA, 22 nt, Human
uaaacagagaugccugggucug

SEQ ID NO: 19854 - RNA, 22 nt, Human
uaaacagccuccccuuucacuc

SEQ ID NO: 19855 - RNA, 22 nt, Human
uaaacagcuacugugucaaagg

SEQ ID NO: 19856 - RNA, 21 nt, Human
uaaacauaaccuuguauggcu

SEQ ID NO: 19857 - RNA, 22 nt, Human
uaaacaucugucauguguuuau

SEQ ID NO: 19858 - RNA, 22 nt, Human
uaaacuaucuguguuugaaguu

SEQ ID NO: 19859 - RNA, 22 nt, Human
uaaacucucaacagagaaccac

SEQ ID NO: 19860 - RNA, 22 nt, Human
uaaagaauagauggguagggag

SEQ ID NO: 19861 - RNA, 23 nt, Human
uaaagacagccuucaggauucug

SEQ ID NO: 19862 - RNA, 22 nt, Human
uaaagauaagacaucaacugag

SEQ ID NO: 19863 - RNA, 17 nt, Human
uaaagaucagccaugua

SEQ ID NO: 19864 - RNA, 22 nt, Human
uaaagaucuuaggaagauuuuc

SEQ ID NO: 19865 - RNA, 22 nt, Human
uaaagaugcuauagugaaggag

SEQ ID NO: 19866 - RNA, 22 nt, Human
uaaagcaagacacacccauagc

SEQ ID NO: 19867 - RNA, 22 nt, Human
uaaagcaaggcaaauuguuggu

SEQ ID NO: 19868 - RNA, 22 nt, Human
uaaagcacaguaugagcauugg

SEQ ID NO: 19869 - RNA, 22 nt, Human
uaaagcaggcaucucucuccuc

SEQ ID NO: 19870 - RNA, 22 nt, Human
uaaagcaggccacauaugugau

SEQ ID NO: 19871 - RNA, 22 nt, Human
uaaagcaggugcucagugacca

SEQ ID NO: 19872 - RNA, 22 nt, Human
uaaagcaguaugauggaaggau

SEQ ID NO: 19873 - RNA, 22 nt, Human
uaaagcagugugguuguguccc

SEQ ID NO: 19874 - RNA, 22 nt, Human
uaaagcaguguugggucggacg

SEQ ID NO: 19875 - RNA, 22 nt, Human
uaaagccaacacuuuacugcuc

SEQ ID NO: 19876 - RNA, 22 nt, Human
uaaagcccucugaucacacugg

SEQ ID NO: 19877 - RNA, 22 nt, Human
uaaagcuaaccuuagugaacac

SEQ ID NO: 19878 - RNA, 22 nt, Human
uaaagcuauugcuguuuauugu

SEQ ID NO: 19879 - RNA, 22 nt, Human
uaaagcugcaggcucagaaaac

SEQ ID NO: 19880 - RNA, 22 nt, Human
uaaaggcaaauguguguuugug

SEQ ID NO: 19881 - RNA, 22 nt, Human
uaaaggcacggaguuguuaugg

SEQ ID NO: 19882 - RNA, 22 nt, Human
uaaaggccaugauggaggauca

SEQ ID NO: 19883 - RNA, 22 nt, Human
uaaaggcucacuggcuuggggu

SEQ ID NO: 19884 - RNA, 22 nt, Human
uaaaggcuucugcagggacuga

SEQ ID NO: 19885 - RNA, 22 nt, Human
uaaagguaguuuuaaaggugcu

SEQ ID NO: 19886 - RNA, 22 nt, Human
uaaagguuuauucaacaaaaua

SEQ ID NO: 19887 - RNA, 22 nt, Human
uaaaguauauuuuuucucaaua

SEQ ID NO: 19888 - RNA, 22 nt, Human
uaaagucagagauccuuggcuu

SEQ ID NO: 19889 - RNA, 22 nt, Human
uaaagucaucuuuacaucuuug

SEQ ID NO: 19890 - RNA, 22 nt, Human
uaaagugaaguucagaauggcu

SEQ ID NO: 19891 - RNA, 22 nt, Human
uaaagugcucauaaaaauggau

SEQ ID NO: 19892 - RNA, 22 nt, Human
uaaagugcuuaugauaaccaag

SEQ ID NO: 19893 - RNA, 22 nt, Human
uaaagugguggugcuaauguau

SEQ ID NO: 19894 - RNA, 22 nt, Human
uaaaguguggacaguaucuaua

SEQ ID NO: 19895 - RNA, 22 nt, Human
uaaaguguggauaugauuagua

SEQ ID NO: 19896 - RNA, 22 nt, Human
uaaaguguuuguaugcagauaa

SEQ ID NO: 19897 - RNA, 22 nt, Human
uaaaguuuauuggcaccaccau

SEQ ID NO: 19898 - RNA, 22 nt, Human
uaaaguuuguagcaauugauau

SEQ ID NO: 19899 - RNA, 20 nt, Human
uacucacaaaugguuuagca

SEQ ID NO: 19900 - RNA, 22 nt, Human
uacucagagucauugcccuucu

SEQ ID NO: 19901 - RNA, 22 nt, Human
uacucaguuuaugauuucaagu

SEQ ID NO: 19902 - RNA, 22 nt, Human
uacucaugacugaugaauaccu

SEQ ID NO: 19903 - RNA, 22 nt, Human
uacucucaggguuaguacagga

SEQ ID NO: 19904 - RNA, 22 nt, Human
uacucucuggaaauuauaguga

SEQ ID NO: 19905 - RNA, 22 nt, Human
uacucugccacuaggaguucug

SEQ ID NO: 19906 - RNA, 22 nt, Human
uacucugccccagccaauaaug

SEQ ID NO: 19907 - RNA, 22 nt, Human
uacucuggaguugagaugcgag

SEQ ID NO: 19908 - RNA, 22 nt, Human
uacugaaauggcagauauauaa

SEQ ID NO: 19909 - RNA, 21 nt, Human
uacugagaccucacagugugc

SEQ ID NO: 19910 - RNA, 22 nt, Human
uacugagcugguccacugaggu

SEQ ID NO: 19911 - RNA, 22 nt, Human
uacugauaagaguuguaggagu

SEQ ID NO: 19912 - RNA, 22 nt, Human
uacugauagcacaaaugacauu

SEQ ID NO: 19913 - RNA, 22 nt, Human
uacugauauuuucaacuagaag

SEQ ID NO: 19914 - RNA, 22 nt, Human
uacugcaaaccauuuacaguag

SEQ ID NO: 19915 - RNA, 22 nt, Human
uacugcagauggccuuguucuu

SEQ ID NO: 19916 - RNA, 22 nt, Human
uacugcauagacacugggauau

SEQ ID NO: 19917 - RNA, 22 nt, Human
uacugcaugggugcaugcugcu

SEQ ID NO: 19918 - RNA, 22 nt, Human
uacugcauuaucaaggggaagg

SEQ ID NO: 19919 - RNA, 22 nt, Human
uacugcuugguguuguuguauc

SEQ ID NO: 19920 - RNA, 22 nt, Human
uacuggaaggcuggaagucagg

SEQ ID NO: 19921 - RNA, 20 nt, Human
uacugggcaagcccacagac

SEQ ID NO: 19922 - RNA, 20 nt, Human
uacugggucuggguccugga

SEQ ID NO: 19923 - RNA, 22 nt, Human
uacuguaaugagauuagcuucc

SEQ ID NO: 19924 - RNA, 22 nt, Human
uacuguacucaacaugugaguu

SEQ ID NO: 19925 - RNA, 22 nt, Human
uacuguacugucuuuuuugcug

SEQ ID NO: 19926 - RNA, 21 nt, Human
uacuguauagauguguucuug

SEQ ID NO: 19927 - RNA, 22 nt, Human
uacugucuggaguugccaaagg

SEQ ID NO: 19928 - RNA, 22 nt, Human
uacugucuuuagggguagaaau

SEQ ID NO: 19929 - RNA, 22 nt, Human
uacugugguaacauuuuaaauu

SEQ ID NO: 19930 - RNA, 22 nt, Human
uacugugugauuccauuuacgu

SEQ ID NO: 19931 - RNA, 22 nt, Human
uacuguguggugagcugucucc

SEQ ID NO: 19932 - RNA, 22 nt, Human
uacuguuagagcgauuuguccu

SEQ ID NO: 19933 - RNA, 22 nt, Human
uacuguuauauauagcagcagu

SEQ ID NO: 19934 - RNA, 22 nt, Human
uacuguucaugccuucauaaag

SEQ ID NO: 19935 - RNA, 20 nt, Human
uacuguuguugcuguugcca

SEQ ID NO: 19936 - RNA, 22 nt, Human
uacuguuuucuuuauaguacag

SEQ ID NO: 19937 - RNA, 22 nt, Human
uacuguuuuugccucuuuagaa

SEQ ID NO: 19938 - RNA, 22 nt, Human
uacuuacauaaaaacugaaugu

SEQ ID NO: 19939 - RNA, 20 nt, Human
uacuuaggcuuguuuuggcc

SEQ ID NO: 19940 - RNA, 22 nt, Human
uacuuaggugagauauuuucuu

SEQ ID NO: 19941 - RNA, 22 nt, Human
uacuucaugaguuaauaugcag

SEQ ID NO: 19942 - RNA, 22 nt, Human
uacuuccauguccuuagagucc

SEQ ID NO: 19943 - RNA, 22 nt, Human
uacuucccacuggggucuacca

SEQ ID NO: 19944 - RNA, 22 nt, Human
uacuuccuguuuccaugucugu

SEQ ID NO: 19945 - RNA, 22 nt, Human
uacuucugaaugugaguuuguu

SEQ ID NO: 19946 - RNA, 22 nt, Human
uacuucuggauauucagaacuu

SEQ ID NO: 19947 - RNA, 22 nt, Human
uacuugaguauagucgcuucac

SEQ ID NO: 19948 - RNA, 22 nt, Human
uacuugcuggguguaauuuucu

SEQ ID NO: 19949 - RNA, 22 nt, Human
uacuugcuuggauuucaccaga

SEQ ID NO: 19950 - RNA, 22 nt, Human
uacuuguuaggaauuucuacua

SEQ ID NO: 19951 - RNA, 22 nt, Human
uacuuguuaucaucuuuuccuu

SEQ ID NO: 19952 - RNA, 22 nt, Human
ugacagagcugggauuugaagc

SEQ ID NO: 19953 - RNA, 22 nt, Human
ugacagaggcugaguuagucug

SEQ ID NO: 19954 - RNA, 22 nt, Human
ugacagcaauaauuuuaucuuc

SEQ ID NO: 19955 - RNA, 21 nt, Human
ugacagcacaugcaaucggag

SEQ ID NO: 19956 - RNA, 22 nt, Human
ugacagcagcauagugagcaau

SEQ ID NO: 19957 - RNA, 22 nt, Human
ugacagcagccaccucucaccc

SEQ ID NO: 19958 - RNA, 23 nt, Human
ugacagcaggaacugauuaugua

SEQ ID NO: 19959 - RNA, 22 nt, Human
ugacagcauaacacuggucuug

SEQ ID NO: 19960 - RNA, 22 nt, Human
ugacagcugccacaaaggccau

SEQ ID NO: 19961 - RNA, 22 nt, Human
ugacaggaaacaugcagugauu

SEQ ID NO: 19962 - RNA, 22 nt, Human
ugacaggauaguaggaagaucu

SEQ ID NO: 19963 - RNA, 21 nt, Human
ugacaggcacccuggcuguga

SEQ ID NO: 19964 - RNA, 23 nt, Human
ugacaggccagaagagcagcugg

SEQ ID NO: 19965 - RNA, 22 nt, Human
ugacaggcguuuuucucuagua

SEQ ID NO: 19966 - RNA, 22 nt, Human
ugacaggcuugcuaagacauag

SEQ ID NO: 19967 - RNA, 22 nt, Human
ugacagggaaagguccucuuuu

SEQ ID NO: 19968 - RNA, 22 nt, Human
ugacagggccaugcugcacugc

SEQ ID NO: 19969 - RNA, 22 nt, Human
ugacagggcuagaggcaaugca

SEQ ID NO: 19970 - RNA, 22 nt, Human
ugacagggucagagcugagcug

SEQ ID NO: 19971 - RNA, 21 nt, Human
ugacagguauuuaucuggaaa

SEQ ID NO: 19972 - RNA, 22 nt, Human
ugacaggucauauaagcuugca

SEQ ID NO: 19973 - RNA, 22 nt, Human
ugacagugagcuugggguacuu

SEQ ID NO: 19974 - RNA, 22 nt, Human
ugacagugcggguacaucauag

SEQ ID NO: 19975 - RNA, 22 nt, Human
ugacaguucaggucagauuuau

SEQ ID NO: 19976 - RNA, 22 nt, Human
ugacaguuguauuacaugggaa

SEQ ID NO: 19977 - RNA, 20 nt, Human
ugacaguuucauaugguuca

SEQ ID NO: 19978 - RNA, 21 nt, Human
ugacauaauccauaguacaaa

SEQ ID NO: 19979 - RNA, 22 nt, Human
ugacauccggccacuagacucc

SEQ ID NO: 19980 - RNA, 22 nt, Human
ugacauccuacaccccuggguc

SEQ ID NO: 19981 - RNA, 20 nt, Human
ugacaucuguugaggaggaa

SEQ ID NO: 19982 - RNA, 22 nt, Human
ugacaugaaacuguguugcuac

SEQ ID NO: 19983 - RNA, 22 nt, Human
ugacauguaguuagaaaauagg

SEQ ID NO: 19984 - RNA, 22 nt, Human
ugacauguauguauuuguuuau

SEQ ID NO: 19985 - RNA, 22 nt, Human
ugacaugugcucaucuuggcua

SEQ ID NO: 19986 - RNA, 22 nt, Human
ugacauucuguuaagucucaua

SEQ ID NO: 19987 - RNA, 22 nt, Human
ugacauuuaagccucugauuuc

SEQ ID NO: 19988 - RNA, 22 nt, Human
ugacauuuacuauuccugguua

SEQ ID NO: 19989 - RNA, 21 nt, Human
ugacauuuaguagcauuguca

SEQ ID NO: 19990 - RNA, 22 nt, Human
ugacauuuaucaaagaaauggu

SEQ ID NO: 19991 - RNA, 22 nt, Human
ugacauuuaucuucuacaauga

SEQ ID NO: 19992 - RNA, 22 nt, Human
ugacauuucagauaugguauuu

SEQ ID NO: 19993 - RNA, 18 nt, Human
ugacauuuccagagugua

SEQ ID NO: 19994 - RNA, 22 nt, Human
ugacauuugagagagauauaca

SEQ ID NO: 19995 - RNA, 22 nt, Human
ugaccaauacuguggaugccag

SEQ ID NO: 19996 - RNA, 22 nt, Human
ugaccacauugauuucucaucc

SEQ ID NO: 19997 - RNA, 22 nt, Human
ugaccauggcacauguuugccu

SEQ ID NO: 19998 - RNA, 22 nt, Human
ugaccauggugugcccugugcg

SEQ ID NO: 19999 - RNA, 22 nt, Human
ugacccauuaaccacuuucccu

SEQ ID NO: 20000 - RNA, 22 nt, Human
ugacccuuagugaacauuagaa

SEQ ID NO: 20001 - RNA, 22 nt, Human
ugacccuucugguuccuaccaa

SEQ ID NO: 20002 - RNA, 16 nt, Human
ugacccuugaccagcc

SEQ ID NO: 20003 - RNA, 22 nt, Human
ugacccuugccaaguuccuuuu

SEQ ID NO: 20004 - RNA, 22 nt, Human
ugacccuuggucagagugcccu

SEQ ID NO: 20005 - RNA, 22 nt, Human
ugaccuauuagauuuccuugcc

SEQ ID NO: 20006 - RNA, 22 nt, Human
ugaccuuucuuugagauuccug

SEQ ID NO: 20007 - RNA, 22 nt, Human
ugacuaauuauguuacuaauca

SEQ ID NO: 20008 - RNA, 22 nt, Human
ugacuaauugauaacucuguaa

SEQ ID NO: 20009 - RNA, 21 nt, Human
ugacuaauugugauaaagugc

SEQ ID NO: 20010 - RNA, 22 nt, Human
ugacucaagagccugacucauc

SEQ ID NO: 20011 - RNA, 22 nt, Human
ugacucacaguggagaaagagg

SEQ ID NO: 20012 - RNA, 22 nt, Human
ugacucugauugccuuagcuug

SEQ ID NO: 20013 - RNA, 22 nt, Human
ugacucuguaccugucugccuu

SEQ ID NO: 20014 - RNA, 22 nt, Human
ugacugaaauggcgacagugaa

SEQ ID NO: 20015 - RNA, 21 nt, Human
ugacugaggcuucuucacaca

SEQ ID NO: 20016 - RNA, 22 nt, Human
guuugcauguguacuuaauugg

SEQ ID NO: 20017 - RNA, 22 nt, Human
guuugcauuccaauuuagggga

SEQ ID NO: 20018 - RNA, 22 nt, Human
guuugcuaauuuaaagcuauuu

SEQ ID NO: 20019 - RNA, 22 nt, Human
guuuggaauagcaguaaacauu

SEQ ID NO: 20020 - RNA, 22 nt, Human
guuuggcacuaugaugaggcua

SEQ ID NO: 20021 - RNA, 21 nt, Human
guuuguaaggcacuguguucu

SEQ ID NO: 20022 - RNA, 22 nt, Human
guuuguaugaauguuuuaugcu

SEQ ID NO: 20023 - RNA, 22 nt, Human
guuugucaggagguugaaguca

SEQ ID NO: 20024 - RNA, 22 nt, Human
guuuguuagaagagcagaaucu

SEQ ID NO: 20025 - RNA, 22 nt, Human
guuuguucauggcugaugcuug

SEQ ID NO: 20026 - RNA, 22 nt, Human
guuuguuuguagggaagccgug

SEQ ID NO: 20027 - RNA, 22 nt, Human
guuuuacaaaugacggcauuca

SEQ ID NO: 20028 - RNA, 22 nt, Human
guuuuacaagguuaaucagcag

SEQ ID NO: 20029 - RNA, 22 nt, Human
guuuuacacaccuaugaaagac

SEQ ID NO: 20030 - RNA, 22 nt, Human
guuuuagauaaagcuguccuug

SEQ ID NO: 20031 - RNA, 22 nt, Human
guuuuaugagaccucaggaaua

SEQ ID NO: 20032 - RNA, 22 nt, Human
guuuucaaggggauuuaacuga

SEQ ID NO: 20033 - RNA, 22 nt, Human
guuuucaauuauaagauggcuu

SEQ ID NO: 20034 - RNA, 22 nt, Human
guuuucagccaggagcacauuu

SEQ ID NO: 20035 - RNA, 22 nt, Human
guuuucauuacugcugugauuu

SEQ ID NO: 20036 - RNA, 22 nt, Human
guuuuccugaaacugauggugu

SEQ ID NO: 20037 - RNA, 22 nt, Human
guuuucuaccagggaagagagu

SEQ ID NO: 20038 - RNA, 22 nt, Human
guuuucucugagaugccuuucu

SEQ ID NO: 20039 - RNA, 19 nt, Human
guuuucugaucuugccccc

SEQ ID NO: 20040 - RNA, 22 nt, Human
guuuucuuccugcaauuggcau

SEQ ID NO: 20041 - RNA, 22 nt, Human
guuuucuuugaaugcuucuaga

SEQ ID NO: 20042 - RNA, 18 nt, Human
guuuugaauugucuuaca

SEQ ID NO: 20043 - RNA, 19 nt, Human
guuuugcaggcagagggga

SEQ ID NO: 20044 - RNA, 22 nt, Human
guuuugcuucucauguuaagug

SEQ ID NO: 20045 - RNA, 22 nt, Human
guuuuggcagccguguucacau

SEQ ID NO: 20046 - RNA, 22 nt, Human
guuuugugaggcacccacaggu

SEQ ID NO: 20047 - RNA, 22 nt, Human
guuuuguucaugaacauugggu

SEQ ID NO: 20048 - RNA, 22 nt, Human
guuuuguugcugcagagcucaa

SEQ ID NO: 20049 - RNA, 22 nt, Human
guuuuuauauccuguggagugu

SEQ ID NO: 20050 - RNA, 21 nt, Human
guuuuucagcccugaggugag

SEQ ID NO: 20051 - RNA, 20 nt, Human
guuuuucucucuugccacua

SEQ ID NO: 20052 - RNA, 22 nt, Human
guuuuucucugaaauaguugac

SEQ ID NO: 20053 - RNA, 22 nt, Human
guuuuucuuugugugaagacaa

SEQ ID NO: 20054 - RNA, 22 nt, Human
guuuuuucaugaguaguuaucu

SEQ ID NO: 20055 - RNA, 22 nt, Human
uaaaaaucuuaugaauggcaag

SEQ ID NO: 20056 - RNA, 22 nt, Human
uaaaacaccuguagugucugcc

SEQ ID NO: 20057 - RNA, 22 nt, Human
uaaaaccauuccugcuuucaug

SEQ ID NO: 20058 - RNA, 22 nt, Human
uaaaacuagugguugggacuaa

SEQ ID NO: 20059 - RNA, 22 nt, Human
uaaaagacccucuagaguccca

SEQ ID NO: 20060 - RNA, 22 nt, Human
uaaaagauuuuauaggaacaag

SEQ ID NO: 20061 - RNA, 17 nt, Human
auguaagaagaaagcag

SEQ ID NO: 20062 - RNA, 22 nt, Human
auguaagagcuuugcagggaaa

SEQ ID NO: 20063 - RNA, 22 nt, Human
auguaaguauucaaaauauuuc

SEQ ID NO: 20064 - RNA, 22 nt, Human
auguaauuuagaaaugaacaca

SEQ ID NO: 20065 - RNA, 22 nt, Human
auguaauuuauguuauccauaa

SEQ ID NO: 20066 - RNA, 22 nt, Human
auguaauuugcccucaaguuaa

SEQ ID NO: 20067 - RNA, 22 nt, Human
auguacaaaauguuuugaaaug

SEQ ID NO: 20068 - RNA, 22 nt, Human
auguacaauucuccuugguagg

SEQ ID NO: 20069 - RNA, 22 nt, Human
auguacaauuuuugcuuagggg

SEQ ID NO: 20070 - RNA, 22 nt, Human
auguacacacaaguuugcacgc

SEQ ID NO: 20071 - RNA, 22 nt, Human
auguacacuuuggaagagucac

SEQ ID NO: 20072 - RNA, 22 nt, Human
auguacagccacuucacaguua

SEQ ID NO: 20073 - RNA, 22 nt, Human
auguacaguuucuagacucaaa

SEQ ID NO: 20074 - RNA, 22 nt, Human
auguacauuuagaucauuucug

SEQ ID NO: 20075 - RNA, 18 nt, Human
auguacauuugcuaaagc

SEQ ID NO: 20076 - RNA, 19 nt, Human
auguacccagugucaaucc

SEQ ID NO: 20077 - RNA, 22 nt, Human
auguagaaaguucauagaugcg

SEQ ID NO: 20078 - RNA, 22 nt, Human
auguagaagugggcauuauaga

SEQ ID NO: 20079 - RNA, 22 nt, Human
auguagagcaguguuguccaau

SEQ ID NO: 20080 - RNA, 22 nt, Human
auguagauguucacuugauuuu

SEQ ID NO: 20081 - RNA, 22 nt, Human
auguagcagaagauguuuuccu

SEQ ID NO: 20082 - RNA, 22 nt, Human
auguagcagauauuugugcaca

SEQ ID NO: 20083 - RNA, 21 nt, Human
auguagcuuacaagauaaagg

SEQ ID NO: 20084 - RNA, 21 nt, Human
auguaggaguuauuggaacag

SEQ ID NO: 20085 - RNA, 21 nt, Human
auguaggguuugccuucucua

SEQ ID NO: 20086 - RNA, 22 nt, Human
auguaguauuuggaaauguaaa

SEQ ID NO: 20087 - RNA, 22 nt, Human
auguauaaugcuaauuagcuag

SEQ ID NO: 20088 - RNA, 22 nt, Human
auguauaggaguuaucuguugu

SEQ ID NO: 20089 - RNA, 22 nt, Human
auguauauacuuacaugugugg

SEQ ID NO: 20090 - RNA, 22 nt, Human
auguauaugcaugcauucaaag

SEQ ID NO: 20091 - RNA, 22 nt, Human
auguauaugugaaagauguuua

SEQ ID NO: 20092 - RNA, 22 nt, Human
auguauaugugugcacgcacag

SEQ ID NO: 20093 - RNA, 20 nt, Human
auguauauuacuggcuguga

SEQ ID NO: 20094 - RNA, 22 nt, Human
auguaucaacaaauuguacagu

SEQ ID NO: 20095 - RNA, 19 nt, Human
auguaugaggucuucugcu

SEQ ID NO: 20096 - RNA, 22 nt, Human
auguaugcuuugauuuuagaug

SEQ ID NO: 20097 - RNA, 18 nt, Human
auguauguacauauuuau

SEQ ID NO: 20098 - RNA, 22 nt, Human
auguaugucugaugcacaugca

SEQ ID NO: 20099 - RNA, 22 nt, Human
auguauguuaguguauuaucua

SEQ ID NO: 20100 - RNA, 22 nt, Human
auguauugucucuuuuccuuaa

SEQ ID NO: 20101 - RNA, 22 nt, Human
auguauuucuauguagugaaga

SEQ ID NO: 20102 - RNA, 22 nt, Human
auguauuugcguauggacauac

SEQ ID NO: 20103 - RNA, 22 nt, Human
auguauuuuaagauuugccuca

SEQ ID NO: 20104 - RNA, 22 nt, Human
augucaacaggccuuuaaacau

SEQ ID NO: 20105 - RNA, 22 nt, Human
augucacaaaagucccauuaug

SEQ ID NO: 20106 - RNA, 18 nt, Human
augucacagagggcugaa

SEQ ID NO: 20107 - RNA, 22 nt, Human
augucacagcaggaguauucuu

SEQ ID NO: 20108 - RNA, 22 nt, Human
augucacauggccuguacuuug

SEQ ID NO: 20109 - RNA, 22 nt, Human
augucacuuuugagacuagguu

SEQ ID NO: 20110 - RNA, 22 nt, Human
augucagaaucuacauucuacu

SEQ ID NO: 20111 - RNA, 22 nt, Human
augucagauguuuaucugauuu

SEQ ID NO: 20112 - RNA, 22 nt, Human
augucaggacccuacugcauug

SEQ ID NO: 20113 - RNA, 22 nt, Human
augucauugccaagaugcuaau

SEQ ID NO: 20114 - RNA, 22 nt, Human
auguccaauuucugaggcugcu

SEQ ID NO: 20115 - RNA, 22 nt, Human
auguccagaggugagucagagc

SEQ ID NO: 20116 - RNA, 22 nt, Human
auguccagaguaaagcacauuc

SEQ ID NO: 20117 - RNA, 22 nt, Human
auguccagcaugacacauucuc

SEQ ID NO: 20118 - RNA, 22 nt, Human
auguccaggaagucuuaacuca

SEQ ID NO: 20119 - RNA, 22 nt, Human
auguccagggggcuugacuggu

SEQ ID NO: 20120 - RNA, 22 nt, Human
augucccagcugagagacaacu

SEQ ID NO: 20121 - RNA, 22 nt, Human
augucccucacuccucauucag

SEQ ID NO: 20122 - RNA, 20 nt, Human
auguccucagccacugcccu

SEQ ID NO: 20123 - RNA, 23 nt, Human
auguccugcauaguugcuucugu

SEQ ID NO: 20124 - RNA, 22 nt, Human
auguccuggucuagcuuccggg

SEQ ID NO: 20125 - RNA, 20 nt, Human
auguccuguugcugccccag

SEQ ID NO: 20126 - RNA, 22 nt, Human
auguccuguuuuggcuugcucu

SEQ ID NO: 20127 - RNA, 22 nt, Human
auguccuugagacccuccucgg

SEQ ID NO: 20128 - RNA, 22 nt, Human
augucucagaguggucacuggg

SEQ ID NO: 20129 - RNA, 23 nt, Human
augucucugggcaguagggcuug

SEQ ID NO: 20130 - RNA, 22 nt, Human
augcagaaagagaauguaaugu

SEQ ID NO: 20131 - RNA, 22 nt, Human
augcagaagaaaccauggcuuc

SEQ ID NO: 20132 - RNA, 22 nt, Human
augcagaugggugccaaagucu

SEQ ID NO: 20133 - RNA, 22 nt, Human
augcagauguuugguucauugu

SEQ ID NO: 20134 - RNA, 22 nt, Human
augcagcaguuuacaaagcaau

SEQ ID NO: 20135 - RNA, 22 nt, Human
augcagcugcugacagcuuuca

SEQ ID NO: 20136 - RNA, 22 nt, Human
augcagcugucagggagaacau

SEQ ID NO: 20137 - RNA, 22 nt, Human
augcaggagaccaauuggaugg

SEQ ID NO: 20138 - RNA, 22 nt, Human
augcaggagagcauguuuaaga

SEQ ID NO: 20139 - RNA, 22 nt, Human
augcaggaguucgaggcuguau

SEQ ID NO: 20140 - RNA, 22 nt, Human
augcaggcagacacugugggca

SEQ ID NO: 20141 - RNA, 22 nt, Human
augcagggauuaaaugacugcc

SEQ ID NO: 20142 - RNA, 22 nt, Human
augcagggcagaguacguuagc

SEQ ID NO: 20143 - RNA, 22 nt, Human
augcaggguucugggcuagaga

SEQ ID NO: 20144 - RNA, 22 nt, Human
augcagguauauuuuauuaaag

SEQ ID NO: 20145 - RNA, 22 nt, Human
augcaguccacaggccacagug

SEQ ID NO: 20146 - RNA, 22 nt, Human
augcaguggcuucagugucagu

SEQ ID NO: 20147 - RNA, 22 nt, Human
augcaguguuuggaagcuuaag

SEQ ID NO: 20148 - RNA, 22 nt, Human
augcaguuagcacuacagaaga

SEQ ID NO: 20149 - RNA, 22 nt, Human
augcaguuagcaguagcucccc

SEQ ID NO: 20150 - RNA, 22 nt, Human
augcaguuagguaauagucuca

SEQ ID NO: 20151 - RNA, 22 nt, Human
augcaguugcaauggaggacuc

SEQ ID NO: 20152 - RNA, 18 nt, Human
augcaguugguacucuca

SEQ ID NO: 20153 - RNA, 22 nt, Human
augcaguuuuaaaucauuucag

SEQ ID NO: 20154 - RNA, 22 nt, Human
augcaguuuuaggggaaggguu

SEQ ID NO: 20155 - RNA, 22 nt, Human
augcauaauguauguauugacu

SEQ ID NO: 20156 - RNA, 22 nt, Human
augcauauaaggcacauguauu

SEQ ID NO: 20157 - RNA, 22 nt, Human
augcauaugcaaugcacaauuu

SEQ ID NO: 20158 - RNA, 22 nt, Human
augcauaugccguagaauaagu

SEQ ID NO: 20159 - RNA, 22 nt, Human
augcauauguacuugcauaugu

SEQ ID NO: 20160 - RNA, 22 nt, Human
augcauauuggauuagcagcca

SEQ ID NO: 20161 - RNA, 22 nt, Human
augcauauuucaugaaucuuug

SEQ ID NO: 20162 - RNA, 22 nt, Human
augcauauuucuuggagcaccu

SEQ ID NO: 20163 - RNA, 22 nt, Human
augcauauuuucuacuauaucg

SEQ ID NO: 20164 - RNA, 22 nt, Human
augcauauuuucuguuggugac

SEQ ID NO: 20165 - RNA, 22 nt, Human
augcaucaaagucugaaauuuc

SEQ ID NO: 20166 - RNA, 22 nt, Human
augcaucacuugaggucaggag

SEQ ID NO: 20167 - RNA, 21 nt, Human
augcaucuaucuucuacucca

SEQ ID NO: 20168 - RNA, 22 nt, Human
augcaugauccugagcaaccca

SEQ ID NO: 20169 - RNA, 22 nt, Human
augcaugcacacacugcauugc

SEQ ID NO: 20170 - RNA, 22 nt, Human
auguggaggaaaugaguguaca

SEQ ID NO: 20171 - RNA, 22 nt, Human
auguggaucacagggguguguc

SEQ ID NO: 20172 - RNA, 22 nt, Human
auguggauuugggagugaucag

SEQ ID NO: 20173 - RNA, 22 nt, Human
auguggcauucuuggucauuuc

SEQ ID NO: 20174 - RNA, 22 nt, Human
auguggccagucauguaguaac

SEQ ID NO: 20175 - RNA, 21 nt, Human
auguggccauuguaguccacg

SEQ ID NO: 20176 - RNA, 22 nt, Human
auguggccuuagguucuagugg

SEQ ID NO: 20177 - RNA, 22 nt, Human
auguggcuaguccaauuaauga

SEQ ID NO: 20178 - RNA, 22 nt, Human
auguggcuaguccucugcggca

SEQ ID NO: 20179 - RNA, 18 nt, Human
auguggcuagugcaacug

SEQ ID NO: 20180 - RNA, 22 nt, Human
auguggcuagugcaacugagaa

SEQ ID NO: 20181 - RNA, 22 nt, Human
auguggcuagugcagaugaaua

SEQ ID NO: 20182 - RNA, 18 nt, Human
auguggcuagugcuacug

SEQ ID NO: 20183 - RNA, 22 nt, Human
auguggcuaguggcuaugaucu

SEQ ID NO: 20184 - RNA, 22 nt, Human
auguggcucacauagcuggaaa

SEQ ID NO: 20185 - RNA, 22 nt, Human
auguggcucagcaggcucccgu

SEQ ID NO: 20186 - RNA, 22 nt, Human
auguggcugccaccugccugaa

SEQ ID NO: 20187 - RNA, 22 nt, Human
auguggcugucacagcauaaug

SEQ ID NO: 20188 - RNA, 22 nt, Human
auguggcuugucgauauuagca

SEQ ID NO: 20189 - RNA, 22 nt, Human
auguggcuuucaugauuaagca

SEQ ID NO: 20190 - RNA, 22 nt, Human
augugggagauuucaggaggug

SEQ ID NO: 20191 - RNA, 22 nt, Human
auguguacaaccaagcacuaaa

SEQ ID NO: 20192 - RNA, 22 nt, Human
auguguacacuggacuucugau

SEQ ID NO: 20193 - RNA, 22 nt, Human
auguguagaacuguaaugccca

SEQ ID NO: 20194 - RNA, 22 nt, Human
auguguauauuuggugucaaua

SEQ ID NO: 20195 - RNA, 22 nt, Human
auguguaugagugugcuucuuu

SEQ ID NO: 20196 - RNA, 22 nt, Human
auguguaugauaccuuugcuga

SEQ ID NO: 20197 - RNA, 22 nt, Human
auguguaugcaugcacuaagau

SEQ ID NO: 20198 - RNA, 22 nt, Human
auguguauuuuguacuauuggg

SEQ ID NO: 20199 - RNA, 22 nt, Human
augugucaauuuucaaaugcuu

SEQ ID NO: 20200 - RNA, 22 nt, Human
auguguccacaggugugagaga

SEQ ID NO: 20201 - RNA, 22 nt, Human
auguguccauuaucaguucugg

SEQ ID NO: 20202 - RNA, 17 nt, Human
augugucuagugcaacc

SEQ ID NO: 20203 - RNA, 22 nt, Human
augugucugaccacuguauugg

SEQ ID NO: 20204 - RNA, 17 nt, Human
augugucugaguguccu

SEQ ID NO: 20205 - RNA, 22 nt, Human
augugucuggcauggaaagugu

SEQ ID NO: 20206 - RNA, 20 nt, Human
augugucuuagagcaucagg

SEQ ID NO: 20207 - RNA, 22 nt, Human
augugugcauguuagagagagu

SEQ ID NO: 20208 - RNA, 22 nt, Human
augugugccugagugauggacu

SEQ ID NO: 20209 - RNA, 22 nt, Human
auguguguacacacgugacucu

SEQ ID NO: 20210 - RNA, 22 nt, Human
auguguuggauauuagugggga

SEQ ID NO: 20211 - RNA, 22 nt, Human
auguguuugguuauaugguauu

SEQ ID NO: 20212 - RNA, 22 nt, Human
auguguuuuuauucuggcaugu

SEQ ID NO: 20213 - RNA, 23 nt, Human
auguuaaacauaacugaagagcc

SEQ ID NO: 20214 - RNA, 22 nt, Human
auguuaaagauggugggaaauu

SEQ ID NO: 20215 - RNA, 22 nt, Human
auguuaaaugguuuauuauuaa

SEQ ID NO: 20216 - RNA, 23 nt, Human
auguuaagaagguaguuaggaua

SEQ ID NO: 20217 - RNA, 22 nt, Human
auguuacaaauccuacagguag

SEQ ID NO: 20218 - RNA, 22 nt, Human
auguuacacauaggcauaaaug

SEQ ID NO: 20219 - RNA, 22 nt, Human
auguuacaugaaacggccuacu

SEQ ID NO: 20220 - RNA, 22 nt, Human
auguuacugugaucaugauacu

SEQ ID NO: 20221 - RNA, 22 nt, Human
auguuaggcaaucuuucuuguu

SEQ ID NO: 20222 - RNA, 22 nt, Human
auguuaugacaagcaugacaga

SEQ ID NO: 20223 - RNA, 22 nt, Human
auguuaugugcaagauacauaa

SEQ ID NO: 20224 - RNA, 21 nt, Human
auguuauucuguuccuccagc

SEQ ID NO: 20225 - RNA, 22 nt, Human
auguuauuuauuauccucgguu

SEQ ID NO: 20226 - RNA, 22 nt, Human
auguucaaacuuuuuacacacc

SEQ ID NO: 20227 - RNA, 22 nt, Human
auguuccugguauaucaugacc

SEQ ID NO: 20228 - RNA, 22 nt, Human
auguucuauaucauuauuguga

SEQ ID NO: 20229 - RNA, 22 nt, Human
auguucugaauaaugugcauua

SEQ ID NO: 20230 - RNA, 22 nt, Human
auguucugccuccauuuugagu

SEQ ID NO: 20231 - RNA, 22 nt, Human
auguucuuggauguuguguaua

SEQ ID NO: 20232 - RNA, 22 nt, Human
auguucuuucagccagugcauc

SEQ ID NO: 20233 - RNA, 22 nt, Human
auguucuuugaaauauuuuaga

SEQ ID NO: 20234 - RNA, 22 nt, Human
auguucuuuggaauuuaugaaa

SEQ ID NO: 20235 - RNA, 22 nt, Human
auguucuuugugauucugagcu

SEQ ID NO: 20236 - RNA, 22 nt, Human
auguugagagcugagaucagcc

SEQ ID NO: 20237 - RNA, 22 nt, Human
auguugcacaaaguccauccau

SEQ ID NO: 20238 - RNA, 22 nt, Human
auguuggcuggauuuuagauuu

SEQ ID NO: 20239 - RNA, 22 nt, Human
auguuguagcauaugaaauaua

SEQ ID NO: 20240 - RNA, 22 nt, Human
auguuuaaaggguugagaaaua

SEQ ID NO: 20241 - RNA, 22 nt, Human
auguuuacaaaaaggaggcuug

SEQ ID NO: 20242 - RNA, 22 nt, Human
auguuuacaauucaguauuaca

SEQ ID NO: 20243 - RNA, 22 nt, Human
auguuuacugaaaagauuucaa

SEQ ID NO: 20244 - RNA, 22 nt, Human
auguuucaggcgaacuaacaug

SEQ ID NO: 20245 - RNA, 22 nt, Human
auguuucaugacugagcaaaau

SEQ ID NO: 20246 - RNA, 22 nt, Human
auguuuccagauaugucacccu

SEQ ID NO: 20247 - RNA, 22 nt, Human
augcugggagugaagccccugg

SEQ ID NO: 20248 - RNA, 22 nt, Human
augcuggggccucagaccagaa

SEQ ID NO: 20249 - RNA, 22 nt, Human
augcuggugguugauggcagga

SEQ ID NO: 20250 - RNA, 22 nt, Human
augcuguauacauaugaaauua

SEQ ID NO: 20251 - RNA, 22 nt, Human
augcugugaaaaagaaggcuga

SEQ ID NO: 20252 - RNA, 22 nt, Human
augcugugccuggaaagcggcu

SEQ ID NO: 20253 - RNA, 22 nt, Human
augcugugcuggcuaaccaugg

SEQ ID NO: 20254 - RNA, 22 nt, Human
augcuguggaugccuugcccca

SEQ ID NO: 20255 - RNA, 22 nt, Human
augcuguguauuuuacucuuuc

SEQ ID NO: 20256 - RNA, 22 nt, Human
augcuguguuuuaaauggaaau

SEQ ID NO: 20257 - RNA, 22 nt, Human
augcuguuaagauaauggguuc

SEQ ID NO: 20258 - RNA, 22 nt, Human
augcuguuauucuaauguguga

SEQ ID NO: 20259 - RNA, 22 nt, Human
augcuuaacucuguacauaguu

SEQ ID NO: 20260 - RNA, 22 nt, Human
augcuucagugcuaccuucaaa

SEQ ID NO: 20261 - RNA, 22 nt, Human
augcuuccagauugguaggggu

SEQ ID NO: 20262 - RNA, 22 nt, Human
augcuucccuuugcuccacaug

SEQ ID NO: 20263 - RNA, 22 nt, Human
augcuucucagcucaaggcaaa

SEQ ID NO: 20264 - RNA, 22 nt, Human
augcuucuccugaacaucccug

SEQ ID NO: 20265 - RNA, 22 nt, Human
augcuucugaagaagaaaagac

SEQ ID NO: 20266 - RNA, 22 nt, Human
augcuucuuguauuuggcugac

SEQ ID NO: 20267 - RNA, 22 nt, Human
augcuuggcagaguucuuuuuc

SEQ ID NO: 20268 - RNA, 22 nt, Human
augcuuggcguuucacuuccug

SEQ ID NO: 20269 - RNA, 22 nt, Human
augcuuuagugucaaguuuggg

SEQ ID NO: 20270 - RNA, 19 nt, Human
augcuuuauguuauuucuu

SEQ ID NO: 20271 - RNA, 22 nt, Human
augcuuuauugcuucugggcac

SEQ ID NO: 20272 - RNA, 22 nt, Human
augcuuugaaguuuuuccucau

SEQ ID NO: 20273 - RNA, 18 nt, Human
augcuuugcuuacguuau

SEQ ID NO: 20274 - RNA, 22 nt, Human
augcuuuggccaaugagaagug

SEQ ID NO: 20275 - RNA, 22 nt, Human
augcuuuuaacuccuuuauccc

SEQ ID NO: 20276 - RNA, 22 nt, Human
auggaaaaggcugauuucauua

SEQ ID NO: 20277 - RNA, 19 nt, Human
auggaaaauuguacucaau

SEQ ID NO: 20278 - RNA, 22 nt, Human
auggaaagccaguguuccauca

SEQ ID NO: 20279 - RNA, 22 nt, Human
auuagagaaugugcugacauug

SEQ ID NO: 20280 - RNA, 22 nt, Human
auuagagagagcauauuacugg

SEQ ID NO: 20281 - RNA, 22 nt, Human
auuagagcaguguauuaugaua

SEQ ID NO: 20282 - RNA, 22 nt, Human
auuagauacacagauuuccacu

SEQ ID NO: 20283 - RNA, 22 nt, Human
auuagaucagaucggcaguaau

SEQ ID NO: 20284 - RNA, 22 nt, Human
auuagauuguaaauguuuucac

SEQ ID NO: 20285 - RNA, 22 nt, Human
auuagcaaaacaacuuuucuau

SEQ ID NO: 20286 - RNA, 22 nt, Human
auuagcaaggcagcaucaggca

SEQ ID NO: 20287 - RNA, 22 nt, Human
auuagcaaguuuuccagcuaau

SEQ ID NO: 20288 - RNA, 22 nt, Human
auuagcaaucugaaaauugcgg

SEQ ID NO: 20289 - RNA, 22 nt, Human
auuagcaauuguuucauugauc

SEQ ID NO: 20290 - RNA, 22 nt, Human
auuagcauauuaaauagucauu

SEQ ID NO: 20291 - RNA, 22 nt, Human
auuagccuccuugucucaugcg

SEQ ID NO: 20292 - RNA, 22 nt, Human
auuagccugcucuuuagugaaa

SEQ ID NO: 20293 - RNA, 22 nt, Human
auuagcugugacgaggcauugu

SEQ ID NO: 20294 - RNA, 22 nt, Human
auuagcuuccuauaguaagggg

SEQ ID NO: 20295 - RNA, 22 nt, Human
auuagcuugguaugccauaaag

SEQ ID NO: 20296 - RNA, 22 nt, Human
auuaggacagagaugucaagag

SEQ ID NO: 20297 - RNA, 22 nt, Human
auuaggauguguauauuguguu

SEQ ID NO: 20298 - RNA, 22 nt, Human
auuaggcagugccauuguacgg

SEQ ID NO: 20299 - RNA, 22 nt, Human
auuaggcauuauggggauaagg

SEQ ID NO: 20300 - RNA, 22 nt, Human
auuagggaaacugacuugucuc

SEQ ID NO: 20301 - RNA, 22 nt, Human
auuagguaguauaaucuuuguu

SEQ ID NO: 20302 - RNA, 22 nt, Human
auuaggucauggggaggcccua

SEQ ID NO: 20303 - RNA, 22 nt, Human
auuaguauucaguuuauaacac

SEQ ID NO: 20304 - RNA, 22 nt, Human
auuagugcccaggcugccucuu

SEQ ID NO: 20305 - RNA, 22 nt, Human
auuaguguucuuaucuucuagg

SEQ ID NO: 20306 - RNA, 22 nt, Human
auuaguguuguggcuucauggc

SEQ ID NO: 20307 - RNA, 22 nt, Human
auuauauaggacuugcccuucc

SEQ ID NO: 20308 - RNA, 22 nt, Human
auuauaugugggauagaauuua

SEQ ID NO: 20309 - RNA, 22 nt, Human
auuauauugaguauaaccagag

SEQ ID NO: 20310 - RNA, 22 nt, Human
auuaucaaguuuacugugugga

SEQ ID NO: 20311 - RNA, 22 nt, Human
auuaucacauggacuuugcuuu

SEQ ID NO: 20312 - RNA, 22 nt, Human
auuaucuauguagaaugauuuu

SEQ ID NO: 20313 - RNA, 22 nt, Human
auuaugagaggagaaaagucag

SEQ ID NO: 20314 - RNA, 22 nt, Human
auuaugcauauacauuugacua

SEQ ID NO: 20315 - RNA, 22 nt, Human
auuaugcauuccaaccuuauuc

SEQ ID NO: 20316 - RNA, 22 nt, Human
auuauggauggaggcauuaguc

SEQ ID NO: 20317 - RNA, 22 nt, Human
auuauuaaagcuacaucaagga

SEQ ID NO: 20318 - RNA, 23 nt, Human
auuauuaaggacauggacuuugu

SEQ ID NO: 20319 - RNA, 22 nt, Human
auuauuaggugcucucugacaa

SEQ ID NO: 20320 - RNA, 22 nt, Human
auuauuagugauguuguuacug

SEQ ID NO: 20321 - RNA, 22 nt, Human
auuauuauuguugauguuaggg

SEQ ID NO: 20322 - RNA, 22 nt, Human
auuauuauuuuagagagaggcc

SEQ ID NO: 20323 - RNA, 22 nt, Human
auuauucaacacuugagaaauu

SEQ ID NO: 20324 - RNA, 22 nt, Human
auuauucagucuuguaaggagu

SEQ ID NO: 20325 - RNA, 22 nt, Human
auuauucuuugauaaauggcag

SEQ ID NO: 20326 - RNA, 22 nt, Human
auuauugugauaggugucagug

SEQ ID NO: 20327 - RNA, 22 nt, Human
auuauuuacagugugcucgaag

SEQ ID NO: 20328 - RNA, 22 nt, Human
auuauuugaguuccucucuacc

SEQ ID NO: 20329 - RNA, 22 nt, Human
auucaaacacuuugagaaguuc

SEQ ID NO: 20330 - RNA, 22 nt, Human
auucaaacaggccaauugaccu

SEQ ID NO: 20331 - RNA, 22 nt, Human
auucaaaccccauagacaacuu

SEQ ID NO: 20332 - RNA, 21 nt, Human
auucaaagaagaggaaggccc

SEQ ID NO: 20333 - RNA, 22 nt, Human
auucaaaugucaaauccaccag

SEQ ID NO: 20334 - RNA, 22 nt, Human
auucaagguauuuaaaacauaa

SEQ ID NO: 20335 - RNA, 22 nt, Human
auucaaguccagcuucucuaca

SEQ ID NO: 20336 - RNA, 22 nt, Human
auucaaguggcugcuauguuaa

SEQ ID NO: 20337 - RNA, 22 nt, Human
auucacaaagucacccuuacac

SEQ ID NO: 20338 - RNA, 22 nt, Human
auucacaaguugauggauauuu

SEQ ID NO: 20339 - RNA, 22 nt, Human
auucacacauacucauguguga

SEQ ID NO: 20340 - RNA, 22 nt, Human
auucacacuguauacacaggau

SEQ ID NO: 20341 - RNA, 22 nt, Human
auucacacuuuacuucuuucca

SEQ ID NO: 20342 - RNA, 22 nt, Human
auucacagggggagaaggguau

SEQ ID NO: 20343 - RNA, 22 nt, Human
auucacaguauggacgaaauga

SEQ ID NO: 20344 - RNA, 22 nt, Human
auucacaguuacugcugaacca

SEQ ID NO: 20345 - RNA, 22 nt, Human
auucacauucuagggcccuacu

SEQ ID NO: 20346 - RNA, 22 nt, Human
auucacauugagcuucacugug

SEQ ID NO: 20347 - RNA, 22 nt, Human
auucagaaagcaagugcugggu

SEQ ID NO: 20348 - RNA, 22 nt, Human
auucagaaaguugucauauuug

SEQ ID NO: 20349 - RNA, 22 nt, Human
auucagaagcaaucacagugag

SEQ ID NO: 20350 - RNA, 22 nt, Human
auucagagcacuggguagaauu

SEQ ID NO: 20351 - RNA, 22 nt, Human
auucagcauucauuuccaacuu

SEQ ID NO: 20352 - RNA, 22 nt, Human
auucagcuaagugcuucaugcu

SEQ ID NO: 20353 - RNA, 18 nt, Human
auucaggggcugaaugug

SEQ ID NO: 20354 - RNA, 22 nt, Human
auucaguagaaguuagcuauua

SEQ ID NO: 20355 - RNA, 22 nt, Human
auucaguaggucuagaauaaga

SEQ ID NO: 20356 - RNA, 22 nt, Human
auucagugauucauuuguacaa

SEQ ID NO: 20357 - RNA, 22 nt, Human
auucagugcuguaauacgcuaa

SEQ ID NO: 20358 - RNA, 22 nt, Human
auucaguguaucaaugaaugcu

SEQ ID NO: 20359 - RNA, 22 nt, Human
auucaguuagccacagcuauuc

SEQ ID NO: 20360 - RNA, 22 nt, Human
auucaguuccuugugauuguag

SEQ ID NO: 20361 - RNA, 22 nt, Human
auucaguuguaaucuuuguuag

SEQ ID NO: 20362 - RNA, 22 nt, Human
auucaguugucuacuacugccu

SEQ ID NO: 20363 - RNA, 22 nt, Human
auucaguuucaaucauuguagu

SEQ ID NO: 20364 - RNA, 22 nt, Human
auucaguuucauggcacagcua

SEQ ID NO: 20365 - RNA, 21 nt, Human
auucaguuugacaucuagcag

SEQ ID NO: 20366 - RNA, 22 nt, Human
auucaguuuuuauuggaccagc

SEQ ID NO: 20367 - RNA, 22 nt, Human
auucaguuuuugaagggaaauu

SEQ ID NO: 20368 - RNA, 22 nt, Human
auucauaacggcaaaugucacc

SEQ ID NO: 20369 - RNA, 22 nt, Human
auucauacaggcuuugcucuua

SEQ ID NO: 20370 - RNA, 22 nt, Human
auucaucaacugauagccauag

SEQ ID NO: 20371 - RNA, 22 nt, Human
auucauccuuaccaguccccgg

SEQ ID NO: 20372 - RNA, 22 nt, Human
auucaucucugcauauagaguc

SEQ ID NO: 20373 - RNA, 19 nt, Human
auucaugaaggcuugaagg

SEQ ID NO: 20374 - RNA, 22 nt, Human
auucaugaaucuacauuguggu

SEQ ID NO: 20375 - RNA, 22 nt, Human
auucaugcaggauugucuccaa

SEQ ID NO: 20376 - RNA, 22 nt, Human
auucauguaaaauuggauagac

SEQ ID NO: 20377 - RNA, 22 nt, Human
auucauguaacauuagagaaau

SEQ ID NO: 20378 - RNA, 20 nt, Human
cagggccuaagagcugaaaa

SEQ ID NO: 20379 - RNA, 20 nt, Human
cagggccuaugauugagcuu

SEQ ID NO: 20380 - RNA, 22 nt, Human
cagggccucauugucaguccug

SEQ ID NO: 20381 - RNA, 22 nt, Human
cagggccuccccggcagucuuu

SEQ ID NO: 20382 - RNA, 22 nt, Human
cagggccucuccuccaggaacu

SEQ ID NO: 20383 - RNA, 22 nt, Human
cagggccugcaagagaccuggg

SEQ ID NO: 20384 - RNA, 22 nt, Human
cagggccugccugguuccugga

SEQ ID NO: 20385 - RNA, 22 nt, Human
cagggccugucacgacgcucau

SEQ ID NO: 20386 - RNA, 22 nt, Human
cagggccuuauccugccauuga

SEQ ID NO: 20387 - RNA, 22 nt, Human
cagggccuuucaggguaaaagg

SEQ ID NO: 20388 - RNA, 22 nt, Human
auuauuugacuugagaacaggu

SEQ ID NO: 20389 - RNA, 22 nt, Human
auuauuuggaauaggcauugca

SEQ ID NO: 20390 - RNA, 22 nt, Human
auuauuuuaugugcggccugau

SEQ ID NO: 20391 - RNA, 22 nt, Human
auucaaaagaccaugcagacuc

SEQ ID NO: 20392 - RNA, 22 nt, Human
auucaaacuguguuaggcagca

SEQ ID NO: 20393 - RNA, 22 nt, Human
auucaaagaaccuuuagcauug

SEQ ID NO: 20394 - RNA, 22 nt, Human
auucaaagcccaguaaacauug

SEQ ID NO: 20395 - RNA, 22 nt, Human
auucaaagucuagauguagugu

SEQ ID NO: 20396 - RNA, 22 nt, Human
auucaacauauucugaguaaaa

SEQ ID NO: 20397 - RNA, 22 nt, Human
auucaacggguagaagggucuu

SEQ ID NO: 20398 - RNA, 22 nt, Human
auucaacuagugauuguguuau

SEQ ID NO: 20399 - RNA, 22 nt, Human
auucaacuauguauagucuucu

SEQ ID NO: 20400 - RNA, 22 nt, Human
auucaacuuauaagauauuaau

SEQ ID NO: 20401 - RNA, 22 nt, Human
auucaagauuaauucuauguca

SEQ ID NO: 20402 - RNA, 22 nt, Human
auucaagguuggcucaggaauu

SEQ ID NO: 20403 - RNA, 22 nt, Human
auucaaguucuucugucuuugc

SEQ ID NO: 20404 - RNA, 22 nt, Human
auucaauaagucacuguggaau

SEQ ID NO: 20405 - RNA, 20 nt, Human
auucacaaagccaguguugc

SEQ ID NO: 20406 - RNA, 22 nt, Human
auucacaaaugcugccccauuc

SEQ ID NO: 20407 - RNA, 22 nt, Human
auucacaacugauccuugcuca

SEQ ID NO: 20408 - RNA, 22 nt, Human
auucacaauuagaaguagauaa

SEQ ID NO: 20409 - RNA, 22 nt, Human
auucacacacauuuagagcaga

SEQ ID NO: 20410 - RNA, 22 nt, Human
auucacagagugguuaguggua

SEQ ID NO: 20411 - RNA, 21 nt, Human
auucacagguauccucucccu

SEQ ID NO: 20412 - RNA, 22 nt, Human
auucacaguucauuagcuguaa

SEQ ID NO: 20413 - RNA, 22 nt, Human
auucacaugcccaagcagcacc

SEQ ID NO: 20414 - RNA, 22 nt, Human
auucacauuuacaaagcacuca

SEQ ID NO: 20415 - RNA, 22 nt, Human
auucaccuguuaguaaaaaucu

SEQ ID NO: 20416 - RNA, 22 nt, Human
auucacugucagcuugcauggg

SEQ ID NO: 20417 - RNA, 22 nt, Human
auucagaaacucugggcagaac

SEQ ID NO: 20418 - RNA, 21 nt, Human
auucagaaagggaauaaacuc

SEQ ID NO: 20419 - RNA, 22 nt, Human
auucagaauugugggcaguaca

SEQ ID NO: 20420 - RNA, 22 nt, Human
auucagacugucuaaaugguuu

SEQ ID NO: 20421 - RNA, 21 nt, Human
auucagaguaauucaucuuua

SEQ ID NO: 20422 - RNA, 22 nt, Human
auucagcaaacauuuauugugu

SEQ ID NO: 20423 - RNA, 22 nt, Human
auucagcauaaucaguagcuug

SEQ ID NO: 20424 - RNA, 22 nt, Human
auucagcauucauuaugcgcca

SEQ ID NO: 20425 - RNA, 19 nt, Human
auucagcauucugcacuuc

SEQ ID NO: 20426 - RNA, 22 nt, Human
auucaggagugugccaggaagg

SEQ ID NO: 20427 - RNA, 22 nt, Human
auucaguauucugcugcauaau

SEQ ID NO: 20428 - RNA, 22 nt, Human
auucagugaguguuuaccggaa

SEQ ID NO: 20429 - RNA, 22 nt, Human
auucagugccaaggagaacuug

SEQ ID NO: 20430 - RNA, 22 nt, Human
auucaguguaguuauuaucuuu

SEQ ID NO: 20431 - RNA, 22 nt, Human
auucagugucuacuccauugcc

SEQ ID NO: 20432 - RNA, 19 nt, Human
auucagugucucugacuuc

SEQ ID NO: 20433 - RNA, 22 nt, Human
auucagugucuugaucugggaa

SEQ ID NO: 20434 - RNA, 22 nt, Human
auucaguguggacccauuuaaa

SEQ ID NO: 20435 - RNA, 22 nt, Human
auucaguuaaaaacuguacuuc

SEQ ID NO: 20436 - RNA, 22 nt, Human
auucaguuacucuagacacuuc

SEQ ID NO: 20437 - RNA, 22 nt, Human
auucaguuauucagagaaggga

SEQ ID NO: 20438 - RNA, 22 nt, Human
auucaguuauuuacuuugcuau

SEQ ID NO: 20439 - RNA, 22 nt, Human
auucaguucugcugguucugcu

SEQ ID NO: 20440 - RNA, 22 nt, Human
auucauaaguaaaugauuaccu

SEQ ID NO: 20441 - RNA, 22 nt, Human
auucaucuguacuucaauaucu

SEQ ID NO: 20442 - RNA, 17 nt, Human
auucaugaacauguccu

SEQ ID NO: 20443 - RNA, 22 nt, Human
auucauggcagugguaacguuu

SEQ ID NO: 20444 - RNA, 20 nt, Human
auucaugucuuuauaaaagc

SEQ ID NO: 20445 - RNA, 22 nt, Human
auucauguggggagccuucugu

SEQ ID NO: 20446 - RNA, 22 nt, Human
auucauguucggggccacguug

SEQ ID NO: 20447 - RNA, 22 nt, Human
auucauuccaggucagucagac

SEQ ID NO: 20448 - RNA, 22 nt, Human
auucauucugaccucaagagaa

SEQ ID NO: 20449 - RNA, 22 nt, Human
auucauucuugguaugaacagc

SEQ ID NO: 20450 - RNA, 19 nt, Human
auucauuggccaggguggu

SEQ ID NO: 20451 - RNA, 22 nt, Human
auucauuggcuugaacuccacc

SEQ ID NO: 20452 - RNA, 22 nt, Human
auuccaaacucuuucccugucg

SEQ ID NO: 20453 - RNA, 22 nt, Human
auuccaaacuuaccccagagga

SEQ ID NO: 20454 - RNA, 22 nt, Human
auuccaaagcacaucagaacua

SEQ ID NO: 20455 - RNA, 22 nt, Human
auuccaaagccugaauaaugga

SEQ ID NO: 20456 - RNA, 22 nt, Human
auuccacagccgauaccaugac

SEQ ID NO: 20457 - RNA, 22 nt, Human
auuccacagcucagccucucuu

SEQ ID NO: 20458 - RNA, 22 nt, Human
auuccacuuauaugaaguaacg

SEQ ID NO: 20459 - RNA, 20 nt, Human
auuccacuuguuugagguac

SEQ ID NO: 20460 - RNA, 22 nt, Human
auuccacuuuaugucuguauga

SEQ ID NO: 20461 - RNA, 22 nt, Human
auuccagaauaccggcaagaug

SEQ ID NO: 20462 - RNA, 22 nt, Human
auuccagacagguaaauuaggu

SEQ ID NO: 20463 - RNA, 22 nt, Human
auuccagauggcuucaaguaag

SEQ ID NO: 20464 - RNA, 22 nt, Human
auuccaggauuccaggacaaau

SEQ ID NO: 20465 - RNA, 22 nt, Human
auuccaggcaugcaggaacaag

SEQ ID NO: 20466 - RNA, 22 nt, Human
auuccaguccaaauguuuuccu

SEQ ID NO: 20467 - RNA, 22 nt, Human
auuccaguuggguucuaauaca

SEQ ID NO: 20468 - RNA, 22 nt, Human
auuccauuguguaaggauaucg

SEQ ID NO: 20469 - RNA, 22 nt, Human
auucccacagcugguauaaaua

SEQ ID NO: 20470 - RNA, 22 nt, Human
auucccauagccauccggagag

SEQ ID NO: 20471 - RNA, 22 nt, Human
auucccaucgucaacuucacug

SEQ ID NO: 20472 - RNA, 22 nt, Human
auuccuaaaguaauacacuaga

SEQ ID NO: 20473 - RNA, 22 nt, Human
auuccucaaagguagcccauua

SEQ ID NO: 20474 - RNA, 19 nt, Human
auuccucaaggacagaaau

SEQ ID NO: 20475 - RNA, 22 nt, Human
auuccucagcaggccuuuuguu

SEQ ID NO: 20476 - RNA, 22 nt, Human
auuccucauuuguugagaacca

SEQ ID NO: 20477 - RNA, 23 nt, Human
auuccugaggcuccuuaugcacc

SEQ ID NO: 20478 - RNA, 22 nt, Human
auuccuucuuugagaauaagca

SEQ ID NO: 20479 - RNA, 22 nt, Human
auuccuugcacaucagauaguu

SEQ ID NO: 20480 - RNA, 22 nt, Human
auuccuugcucucaucaaccuu

SEQ ID NO: 20481 - RNA, 22 nt, Human
auuccuuguauaucuacaugca

SEQ ID NO: 20482 - RNA, 22 nt, Human
auucuaaagcuuguggagcuua

SEQ ID NO: 20483 - RNA, 22 nt, Human
auucuaaugcccuggccccagc

SEQ ID NO: 20484 - RNA, 22 nt, Human
auucuacaaaagaacuggaucu

SEQ ID NO: 20485 - RNA, 22 nt, Human
auucuacaaucauguagauccu

SEQ ID NO: 20486 - RNA, 22 nt, Human
auucuacacaacaugaugaugg

SEQ ID NO: 20487 - RNA, 22 nt, Human
auucuagacaucugcaguuguu

SEQ ID NO: 20488 - RNA, 22 nt, Human
auucuagcaguuacaggcugau

SEQ ID NO: 20489 - RNA, 22 nt, Human
auucuagcugaguaucagcccc

SEQ ID NO: 20490 - RNA, 22 nt, Human
auucuaggacuugagagcuaag

SEQ ID NO: 20491 - RNA, 22 nt, Human
auucuaucaagcugucuucuuu

SEQ ID NO: 20492 - RNA, 22 nt, Human
auucuauuuuuuaagaaguagu

SEQ ID NO: 20493 - RNA, 22 nt, Human
auucucaauuuugccaaagggu

SEQ ID NO: 20494 - RNA, 22 nt, Human
auucucagcuuucaaauagaca

SEQ ID NO: 20495 - RNA, 23 nt, Human
cagugccauuugucuugccuaug

SEQ ID NO: 20496 - RNA, 22 nt, Human
cagugccugugggcuucuucca

SEQ ID NO: 20497 - RNA, 22 nt, Human
auugcuggcagcuggaucugca

SEQ ID NO: 20498 - RNA, 22 nt, Human
auugcuggcccagaugcuuuag

SEQ ID NO: 20499 - RNA, 22 nt, Human
auugcugggaggauguguguuc

SEQ ID NO: 20500 - RNA, 22 nt, Human
auugcugugaugauguucugag

SEQ ID NO: 20501 - RNA, 22 nt, Human
auuccagaugaauugcauaguu

SEQ ID NO: 20502 - RNA, 22 nt, Human
auuccaggcaaagcagagaaga

SEQ ID NO: 20503 - RNA, 22 nt, Human
auuccaggcagaccagagagau

SEQ ID NO: 20504 - RNA, 21 nt, Human
auuccaguauaagccucuuug

SEQ ID NO: 20505 - RNA, 22 nt, Human
auuccagugugcuuccuugcua

SEQ ID NO: 20506 - RNA, 22 nt, Human
auuccaguuaguggcagcuuau

SEQ ID NO: 20507 - RNA, 22 nt, Human
auuccauuguauguguagacua

SEQ ID NO: 20508 - RNA, 22 nt, Human
auucccagauuuauauugauag

SEQ ID NO: 20509 - RNA, 22 nt, Human
auuccucauuauuuacugagga

SEQ ID NO: 20510 - RNA, 22 nt, Human
auuccugagacuuaucuguuuc

SEQ ID NO: 20511 - RNA, 22 nt, Human
auuccugcauuggucaacccau

SEQ ID NO: 20512 - RNA, 22 nt, Human
auuccugguggcagaaacauga

SEQ ID NO: 20513 - RNA, 22 nt, Human
auuccuuuggacuccuccuugc

SEQ ID NO: 20514 - RNA, 22 nt, Human
auucgcgggccuggaggguggg

SEQ ID NO: 20515 - RNA, 20 nt, Human
auucuaaagcucugcucuuu

SEQ ID NO: 20516 - RNA, 22 nt, Human
auucuacaggacuggcaauccc

SEQ ID NO: 20517 - RNA, 22 nt, Human
auucuacaugauagaagggaga

SEQ ID NO: 20518 - RNA, 22 nt, Human
auucuacauuuggagugauguc

SEQ ID NO: 20519 - RNA, 22 nt, Human
auucuagaaggcaaagcaaggg

SEQ ID NO: 20520 - RNA, 21 nt, Human
auucuagacaacacugaaauc

SEQ ID NO: 20521 - RNA, 22 nt, Human
auucuagaugcuguaaguagca

SEQ ID NO: 20522 - RNA, 22 nt, Human
auucuagcagauauuggaaauu

SEQ ID NO: 20523 - RNA, 22 nt, Human
auucuagccauuguauucuucc

SEQ ID NO: 20524 - RNA, 22 nt, Human
auucuagcccuggaacggcgac

SEQ ID NO: 20525 - RNA, 22 nt, Human
auucuaucucuauauuucugca

SEQ ID NO: 20526 - RNA, 22 nt, Human
auucucaaacaagugguuugau

SEQ ID NO: 20527 - RNA, 21 nt, Human
auucucaggcccauccucagg

SEQ ID NO: 20528 - RNA, 22 nt, Human
auucucauuuuuauagaugaga

SEQ ID NO: 20529 - RNA, 22 nt, Human
auucuccacuguaagguuauua

SEQ ID NO: 20530 - RNA, 22 nt, Human
auucucucauuuaucuguccua

SEQ ID NO: 20531 - RNA, 22 nt, Human
auucucucuagaagcugagaug

SEQ ID NO: 20532 - RNA, 20 nt, Human
auucucugacaccgcccccg

SEQ ID NO: 20533 - RNA, 22 nt, Human
auucucuuuguauaacaucuug

SEQ ID NO: 20534 - RNA, 22 nt, Human
auucugaguagaaauuauucuu

SEQ ID NO: 20535 - RNA, 22 nt, Human
auucugauaugaacacacauau

SEQ ID NO: 20536 - RNA, 22 nt, Human
auucugaucauucaagauguca

SEQ ID NO: 20537 - RNA, 22 nt, Human
auucugcagguggaggauggca

SEQ ID NO: 20538 - RNA, 22 nt, Human
auucugcauguagguuugcuca

SEQ ID NO: 20539 - RNA, 22 nt, Human
auucugcuaguaacagaugaag

SEQ ID NO: 20540 - RNA, 22 nt, Human
auucugcucauuuuauuuccag

SEQ ID NO: 20541 - RNA, 22 nt, Human
auucugcuccacacugauucau

SEQ ID NO: 20542 - RNA, 16 nt, Human
auucugcugccugcuc

SEQ ID NO: 20543 - RNA, 22 nt, Human
auucugcuucuuauuucacgug

SEQ ID NO: 20544 - RNA, 22 nt, Human
auucugcuuuugcugaccuacc

SEQ ID NO: 20545 - RNA, 22 nt, Human
auucuggaagcaagcuuuuaaa

SEQ ID NO: 20546 - RNA, 22 nt, Human
auucuggaauucuaagauucug

SEQ ID NO: 20547 - RNA, 22 nt, Human
auucugggagguagaacugaaa

SEQ ID NO: 20548 - RNA, 22 nt, Human
auucugggcaagccuucuuaua

SEQ ID NO: 20549 - RNA, 22 nt, Human
auucuggggcugguuauuuuga

SEQ ID NO: 20550 - RNA, 22 nt, Human
auucugucuaagcuggcuacgu

SEQ ID NO: 20551 - RNA, 22 nt, Human
auucugucuuuuuaaaauaaua

SEQ ID NO: 20552 - RNA, 22 nt, Human
auucugucuuuuuauacaucua

SEQ ID NO: 20553 - RNA, 22 nt, Human
auucuguguuaggauagauggu

SEQ ID NO: 20554 - RNA, 22 nt, Human
auucuguuacuuggugaucuuc

SEQ ID NO: 20555 - RNA, 22 nt, Human
auucuuaauugccaugcuguau

SEQ ID NO: 20556 - RNA, 22 nt, Human
auucuuacuccauagaaugaau

SEQ ID NO: 20557 - RNA, 22 nt, Human
auucuuauuaaauagccagaag

SEQ ID NO: 20558 - RNA, 22 nt, Human
auucuucacauaagugcuguac

SEQ ID NO: 20559 - RNA, 22 nt, Human
auucuucaccauggauaauuug

SEQ ID NO: 20560 - RNA, 22 nt, Human
auucuucagcaggggacacuau

SEQ ID NO: 20561 - RNA, 19 nt, Human
auucuucagcagugagacc

SEQ ID NO: 20562 - RNA, 22 nt, Human
auucuucaguauguguggauug

SEQ ID NO: 20563 - RNA, 22 nt, Human
auucuucauaccuacugagguu

SEQ ID NO: 20564 - RNA, 22 nt, Human
auucuucauggcugugaguccu

SEQ ID NO: 20565 - RNA, 22 nt, Human
auucuucauguugaagcuguca

SEQ ID NO: 20566 - RNA, 22 nt, Human
auucuucauuuacuguuacuug

SEQ ID NO: 20567 - RNA, 22 nt, Human
auucuuccucaucaaucuguag

SEQ ID NO: 20568 - RNA, 19 nt, Human
auucuucucaaauauccau

SEQ ID NO: 20569 - RNA, 22 nt, Human
auucuucucuggguuggguuca

SEQ ID NO: 20570 - RNA, 22 nt, Human
auucuucugccuacuuucaucc

SEQ ID NO: 20571 - RNA, 22 nt, Human
auucuugggaugggugucacaa

SEQ ID NO: 20572 - RNA, 22 nt, Human
auucuuguuuaauuugcauccc

SEQ ID NO: 20573 - RNA, 22 nt, Human
auucuuuaauucaauugaagga

SEQ ID NO: 20574 - RNA, 22 nt, Human
auucuuuacauuggcuucuucc

SEQ ID NO: 20575 - RNA, 22 nt, Human
auucuuuauugcugaugguuau

SEQ ID NO: 20576 - RNA, 22 nt, Human
auucuuucaaggaauaguuauu

SEQ ID NO: 20577 - RNA, 22 nt, Human
auucuuugcaucucuggguggc

SEQ ID NO: 20578 - RNA, 22 nt, Human
auucuuuuaagccccagggauu

SEQ ID NO: 20579 - RNA, 22 nt, Human
auugaaaaaugacuauugcuua

SEQ ID NO: 20580 - RNA, 22 nt, Human
auugaaaauaaggccagaaaca

SEQ ID NO: 20581 - RNA, 22 nt, Human
auugaaagguuuugagcagaua

SEQ ID NO: 20582 - RNA, 21 nt, Human
auugaaagucaacaaucaguu

SEQ ID NO: 20583 - RNA, 22 nt, Human
auugaaaucccuaccucagagg

SEQ ID NO: 20584 - RNA, 22 nt, Human
auugaaauugaugaaauucuug

SEQ ID NO: 20585 - RNA, 22 nt, Human
auugaacuaaauaagcagucau

SEQ ID NO: 20586 - RNA, 22 nt, Human
auugaacuauaauuaugauuug

SEQ ID NO: 20587 - RNA, 22 nt, Human
auugaacugauauuugguguag

SEQ ID NO: 20588 - RNA, 22 nt, Human
auugaacuguuggagagguuuu

SEQ ID NO: 20589 - RNA, 22 nt, Human
auugaacuuaacaguaaguggc

SEQ ID NO: 20590 - RNA, 22 nt, Human
auugaagacuugguauccgugg

SEQ ID NO: 20591 - RNA, 22 nt, Human
auugacaagcaguaugucuuag

SEQ ID NO: 20592 - RNA, 22 nt, Human
auugacaaucuacuauguucug

SEQ ID NO: 20593 - RNA, 22 nt, Human
auugacagaaaagauguuggau

SEQ ID NO: 20594 - RNA, 20 nt, Human
auugacagaaaguguucacc

SEQ ID NO: 20595 - RNA, 22 nt, Human
auugacaggucuuugggaguau

SEQ ID NO: 20596 - RNA, 22 nt, Human
auugaccugauuguuccuggaa

SEQ ID NO: 20597 - RNA, 22 nt, Human
auugagaaaauaaguauggaua

SEQ ID NO: 20598 - RNA, 22 nt, Human
auugagaaauauaaucuggaaa

SEQ ID NO: 20599 - RNA, 22 nt, Human
auugagaagcuugcagauuuuu

SEQ ID NO: 20600 - RNA, 23 nt, Human
auugagaaggauacauuguucuc

SEQ ID NO: 20601 - RNA, 22 nt, Human
auugagaaucugagagccuagg

SEQ ID NO: 20602 - RNA, 22 nt, Human
auugagaaugcaaucuacuaug

SEQ ID NO: 20603 - RNA, 22 nt, Human
auugagaguguauagcugaucu

SEQ ID NO: 20604 - RNA, 22 nt, Human
auugagaucugcaucauaagcu

SEQ ID NO: 20605 - RNA, 22 nt, Human
auugauggcggccucuccauau

SEQ ID NO: 20606 - RNA, 22 nt, Human
auuuauaacgugcagccagggu

SEQ ID NO: 20607 - RNA, 22 nt, Human
auuuauagggcauugaaaacug

SEQ ID NO: 20608 - RNA, 22 nt, Human
auuuauauuuugggagcuccug

SEQ ID NO: 20609 - RNA, 22 nt, Human
auuuaucaacauguaccauugg

SEQ ID NO: 20610 - RNA, 22 nt, Human
auuuaucaucagaccuuuuaaa

SEQ ID NO: 20611 - RNA, 22 nt, Human
auuuaugagcugaaccaugaaa

SEQ ID NO: 20612 - RNA, 22 nt, Human
auuuauuaugggauuuggcaca

SEQ ID NO: 20613 - RNA, 22 nt, Human
auuuauuaugggauuuggcuca

SEQ ID NO: 20614 - RNA, 22 nt, Human
auuuauuccugauuccuggcuu

SEQ ID NO: 20615 - RNA, 22 nt, Human
auuuauugaacacugacuaugu

SEQ ID NO: 20616 - RNA, 22 nt, Human
auuuauugagccuuuccuaugu

SEQ ID NO: 20617 - RNA, 19 nt, Human
auuuauuguaugauuccau

SEQ ID NO: 20618 - RNA, 20 nt, Human
caucugagcccacagaaguc

SEQ ID NO: 20619 - RNA, 22 nt, Human
caucugcaggggaagccaguuu

SEQ ID NO: 20620 - RNA, 22 nt, Human
caucugccuaaguggcccuguu

SEQ ID NO: 20621 - RNA, 17 nt, Human
caucugcucugccccuu

SEQ ID NO: 20622 - RNA, 22 nt, Human
caucugcugcuacaaaaagcuu

SEQ ID NO: 20623 - RNA, 22 nt, Human
caucugcugcugaagccagcau

SEQ ID NO: 20624 - RNA, 22 nt, Human
caucuguaaaguaggaauauug

SEQ ID NO: 20625 - RNA, 22 nt, Human
caucuguagcuccaugacaauu

SEQ ID NO: 20626 - RNA, 22 nt, Human
caucuguugcuuccuaacaagu

SEQ ID NO: 20627 - RNA, 22 nt, Human
caucuuaauaaaucuccucccu

SEQ ID NO: 20628 - RNA, 21 nt, Human
caucuuagguuguacauauau

SEQ ID NO: 20629 - RNA, 22 nt, Human
caucuucaggggcuacaucugu

SEQ ID NO: 20630 - RNA, 22 nt, Human
caucuugccugcuauucuguug

SEQ ID NO: 20631 - RNA, 22 nt, Human
caucuugcuugucuuuaguaag

SEQ ID NO: 20632 - RNA, 17 nt, Human
caucuuuaaaauccuga

SEQ ID NO: 20633 - RNA, 22 nt, Human
caucuuuaaaggggagacaccc

SEQ ID NO: 20634 - RNA, 22 nt, Human
caucuuuaacagaauggauuug

SEQ ID NO: 20635 - RNA, 22 nt, Human
caucuuucaguuuauaagucug

SEQ ID NO: 20636 - RNA, 22 nt, Human
caucuuuggagaaacuuccguu

SEQ ID NO: 20637 - RNA, 22 nt, Human
caucuuugguuuucuauaugcc

SEQ ID NO: 20638 - RNA, 22 nt, Human
caucuuuguucuguaaacuuuu

SEQ ID NO: 20639 - RNA, 22 nt, Human
caucuuuguuucaucuguccag

SEQ ID NO: 20640 - RNA, 22 nt, Human
caucuuuucagaagccauucug

SEQ ID NO: 20641 - RNA, 22 nt, Human
caucuuuuggccuauucugagg

SEQ ID NO: 20642 - RNA, 22 nt, Human
caugaaaaauuuacuguuaaca

SEQ ID NO: 20643 - RNA, 22 nt, Human
caugaaauauuaguaacuguuu

SEQ ID NO: 20644 - RNA, 22 nt, Human
caugaaaucacaagcugaggac

SEQ ID NO: 20645 - RNA, 22 nt, Human
caugaacagauucuucauuucu

SEQ ID NO: 20646 - RNA, 22 nt, Human
caugaacauuuguuuacaucug

SEQ ID NO: 20647 - RNA, 22 nt, Human
caugaagauccuguauguuuuu

SEQ ID NO: 20648 - RNA, 22 nt, Human
caugaagcacagcucucuuuuu

SEQ ID NO: 20649 - RNA, 21 nt, Human
caugaagccgguucccuguuu

SEQ ID NO: 20650 - RNA, 22 nt, Human
caugaaggaauuaagguaagga

SEQ ID NO: 20651 - RNA, 22 nt, Human
caugaauauuuaguauuuacuu

SEQ ID NO: 20652 - RNA, 22 nt, Human
caugaaugaguaauuuacaaag

SEQ ID NO: 20653 - RNA, 22 nt, Human
caugaauuauuuuucacaagau

SEQ ID NO: 20654 - RNA, 22 nt, Human
caugacaauauguucuuucauu

SEQ ID NO: 20655 - RNA, 20 nt, Human
caugacacuguuccucugcc

SEQ ID NO: 20656 - RNA, 22 nt, Human
caugacaguccugaagagaacg

SEQ ID NO: 20657 - RNA, 22 nt, Human
caugacaucugcuuaguaugaa

SEQ ID NO: 20658 - RNA, 22 nt, Human
caugacauuuuaaaaagaacau

SEQ ID NO: 20659 - RNA, 22 nt, Human
caugaccccccaaggccugcag

SEQ ID NO: 20660 - RNA, 22 nt, Human
caugagaagguuuuggcauaua

SEQ ID NO: 20661 - RNA, 22 nt, Human
caugagacugccuuuucaaacc

SEQ ID NO: 20662 - RNA, 22 nt, Human
caugagauaauuuuucuccagu

SEQ ID NO: 20663 - RNA, 22 nt, Human
caugagcauaaaucagucacga

SEQ ID NO: 20664 - RNA, 22 nt, Human
caugagcauuuuggucuaguuu

SEQ ID NO: 20665 - RNA, 18 nt, Human
caugagcugccccuagac

SEQ ID NO: 20666 - RNA, 22 nt, Human
caugagcugcugggagccuguc

SEQ ID NO: 20667 - RNA, 22 nt, Human
caugaguucaaaaugccugccu

SEQ ID NO: 20668 - RNA, 21 nt, Human
caugauaaugaagguguuauu

SEQ ID NO: 20669 - RNA, 20 nt, Human
caugauacuuggaagggcuu

SEQ ID NO: 20670 - RNA, 22 nt, Human
caugauagguauuuaauuaaau

SEQ ID NO: 20671 - RNA, 22 nt, Human
caugauauaaaguaguagauaa

SEQ ID NO: 20672 - RNA, 22 nt, Human
caugaucugguccuacuguggg

SEQ ID NO: 20673 - RNA, 19 nt, Human
caugaugagcauccugcag

SEQ ID NO: 20674 - RNA, 22 nt, Human
caugauuauauuaauggcuuca

SEQ ID NO: 20675 - RNA, 22 nt, Human
caugauuuugucuuguguuaau

SEQ ID NO: 20676 - RNA, 23 nt, Human
caugcaaacacuauugcauuugg

SEQ ID NO: 20677 - RNA, 22 nt, Human
caugcaagaagauagauuaaau

SEQ ID NO: 20678 - RNA, 22 nt, Human
caugcaauuuuugguucucuau

SEQ ID NO: 20679 - RNA, 22 nt, Human
caugcagaugucaugaggcaug

SEQ ID NO: 20680 - RNA, 22 nt, Human
caugcagauuugcugagauaau

SEQ ID NO: 20681 - RNA, 22 nt, Human
caugcagccugugaacaguguc

SEQ ID NO: 20682 - RNA, 22 nt, Human
caugcagcggcguuugguuuaa

SEQ ID NO: 20683 - RNA, 22 nt, Human
caugcaggccuauggagcagug

SEQ ID NO: 20684 - RNA, 22 nt, Human
caugcaggcgcaacuucuacaa

SEQ ID NO: 20685 - RNA, 22 nt, Human
caugcagggacuagagaacagg

SEQ ID NO: 20686 - RNA, 22 nt, Human
caugcagggacuugugcuccau

SEQ ID NO: 20687 - RNA, 22 nt, Human
caugcaggucuggagcuugggg

SEQ ID NO: 20688 - RNA, 22 nt, Human
caugcagucaauaaacaugugu

SEQ ID NO: 20689 - RNA, 22 nt, Human
caugcagucuggagccuucugu

SEQ ID NO: 20690 - RNA, 22 nt, Human
caugcagugguaaaaagucagg

SEQ ID NO: 20691 - RNA, 22 nt, Human
caugcaguguguaucuacuuaa

SEQ ID NO: 20692 - RNA, 22 nt, Human
caugcaguugaagcacagagag

SEQ ID NO: 20693 - RNA, 22 nt, Human
caugcauaugucaaaaaagcua

SEQ ID NO: 20694 - RNA, 22 nt, Human
caugcaucagaaucaccuagag

SEQ ID NO: 20695 - RNA, 22 nt, Human
caugcauuacaauugcauagua

SEQ ID NO: 20696 - RNA, 22 nt, Human
caugcauuucuaccaaggaaua

SEQ ID NO: 20697 - RNA, 22 nt, Human
caugcauuuucuauucacucag

SEQ ID NO: 20698 - RNA, 22 nt, Human
caugccaggacucuggaggcuu

SEQ ID NO: 20699 - RNA, 22 nt, Human
caugccaguuuugagaugcacc

SEQ ID NO: 20700 - RNA, 22 nt, Human
caugccauuaacauuagcuagc

SEQ ID NO: 20701 - RNA, 22 nt, Human
caugccauucccugauccuaac

SEQ ID NO: 20702 - RNA, 22 nt, Human
caugccauuuacuuggaggaga

SEQ ID NO: 20703 - RNA, 22 nt, Human
caugccuguauuucugaucuau

SEQ ID NO: 20704 - RNA, 22 nt, Human
caugcgaggcgggaggaggccu

SEQ ID NO: 20705 - RNA, 22 nt, Human
caugcuccaaaaacaagagaau

SEQ ID NO: 20706 - RNA, 22 nt, Human
caugcugaugaacuucuacuug

SEQ ID NO: 20707 - RNA, 22 nt, Human
caugcuggucagccaguggaug

SEQ ID NO: 20708 - RNA, 22 nt, Human
caugcuuucuguccaaauguua

SEQ ID NO: 20709 - RNA, 22 nt, Human
cauggaaagcacucagcccagu

SEQ ID NO: 20710 - RNA, 22 nt, Human
cauggaacugugcugaaaagug

SEQ ID NO: 20711 - RNA, 22 nt, Human
cauggaaggcaaaagacacaga

SEQ ID NO: 20712 - RNA, 22 nt, Human
cauggaauuuucuaggcauaaa

SEQ ID NO: 20713 - RNA, 22 nt, Human
cauggcaauaaaccuacacagu

SEQ ID NO: 20714 - RNA, 22 nt, Human
cauggcaauuucauaaacaggu

SEQ ID NO: 20715 - RNA, 22 nt, Human
auuucacucauucauguuacuu

SEQ ID NO: 20716 - RNA, 22 nt, Human
auuucacucuuaauugcuuccu

SEQ ID NO: 20717 - RNA, 22 nt, Human
auuucagaauguccuaauuuag

SEQ ID NO: 20718 - RNA, 22 nt, Human
auuucagaugaccaaauggaaa

SEQ ID NO: 20719 - RNA, 22 nt, Human
auuucagcccaguaugagcccc

SEQ ID NO: 20720 - RNA, 22 nt, Human
auuucaggagcaguuucagugg

SEQ ID NO: 20721 - RNA, 22 nt, Human
auuucaggauagccuaguuuug

SEQ ID NO: 20722 - RNA, 22 nt, Human
auuucagggugucuuccaacug

SEQ ID NO: 20723 - RNA, 22 nt, Human
auuucaguaguccuuacuugua

SEQ ID NO: 20724 - RNA, 22 nt, Human
auuucaguauuauacaacugcu

SEQ ID NO: 20725 - RNA, 22 nt, Human
auuucagugagaaagcaaucaa

SEQ ID NO: 20726 - RNA, 22 nt, Human
auuucagugucuucuucucccu

SEQ ID NO: 20727 - RNA, 22 nt, Human
auuucauacuaaggcucaaaaa

SEQ ID NO: 20728 - RNA, 22 nt, Human
auuucauauguaucaccuagcc

SEQ ID NO: 20729 - RNA, 22 nt, Human
auuucaugaauuccagaagcuu

SEQ ID NO: 20730 - RNA, 22 nt, Human
auuucaugaguuauuauagugg

SEQ ID NO: 20731 - RNA, 16 nt, Human
auuucaugggcaguga

SEQ ID NO: 20732 - RNA, 22 nt, Human
auuucaugguacaucgugacuu

SEQ ID NO: 20733 - RNA, 22 nt, Human
cauggcuucugaucaaggaacu

SEQ ID NO: 20734 - RNA, 22 nt, Human
cauggcuugucuugucuucuga

SEQ ID NO: 20735 - RNA, 22 nt, Human
cauggcuuuguucuguuagaug

SEQ ID NO: 20736 - RNA, 22 nt, Human
cauggcuuuuagcccuacauga

SEQ ID NO: 20737 - RNA, 22 nt, Human
cauggcuuuugcuuuugcccau

SEQ ID NO: 20738 - RNA, 22 nt, Human
cauggcuuuuuagcauauucaa

SEQ ID NO: 20739 - RNA, 22 nt, Human
caugggaauaaaguuauuucaa

SEQ ID NO: 20740 - RNA, 22 nt, Human
caugggaggucugcaaggugcu

SEQ ID NO: 20741 - RNA, 22 nt, Human
caugggcucucugagcuccagg

SEQ ID NO: 20742 - RNA, 22 nt, Human
caugggcugcugacaggggcuc

SEQ ID NO: 20743 - RNA, 22 nt, Human
caugggcugugaacccaggcug

SEQ ID NO: 20744 - RNA, 23 nt, Human
cauggggagcagugcuccugacc

SEQ ID NO: 20745 - RNA, 22 nt, Human
caugggggucuggacaacaggc

SEQ ID NO: 20746 - RNA, 22 nt, Human
caugguacugccacagaagagu

SEQ ID NO: 20747 - RNA, 22 nt, Human
caugguuuggucuuuguagugg

SEQ ID NO: 20748 - RNA, 22 nt, Human
cauguaaaccauugugagcauc

SEQ ID NO: 20749 - RNA, 22 nt, Human
cauguaaagaauuucacacaag

SEQ ID NO: 20750 - RNA, 22 nt, Human
cauguaauccuggggagaugaa

SEQ ID NO: 20751 - RNA, 22 nt, Human
cauguaaugcugggagcugggc

SEQ ID NO: 20752 - RNA, 23 nt, Human
cauguacacacagcuguacagug

SEQ ID NO: 20753 - RNA, 23 nt, Human
cauguacagaguuugauaaagug

SEQ ID NO: 20754 - RNA, 22 nt, Human
cauguacagccaggguugagaa

SEQ ID NO: 20755 - RNA, 22 nt, Human
cauguacaugccuacuaucaau

SEQ ID NO: 20756 - RNA, 22 nt, Human
cauguacauucuguagauggag

SEQ ID NO: 20757 - RNA, 22 nt, Human
cauguaguccuaaugcugguga

SEQ ID NO: 20758 - RNA, 22 nt, Human
cauguauagacacucauacagu

SEQ ID NO: 20759 - RNA, 22 nt, Human
cauguauagcaaauauuuguuc

SEQ ID NO: 20760 - RNA, 22 nt, Human
cauguaucuuaauugcuuugga

SEQ ID NO: 20761 - RNA, 18 nt, Human
cauguaugcaaauaagca

SEQ ID NO: 20762 - RNA, 17 nt, Human
cauguauuugaaacaga

SEQ ID NO: 20763 - RNA, 22 nt, Human
caugucacaauucuuaauggga

SEQ ID NO: 20764 - RNA, 22 nt, Human
cauguccacaguucugagaggc

SEQ ID NO: 20765 - RNA, 22 nt, Human
caugucugaguagagugugauu

SEQ ID NO: 20766 - RNA, 22 nt, Human
caugucuggguauaugcauaug

SEQ ID NO: 20767 - RNA, 22 nt, Human
caugucuuauauccugucuuca

SEQ ID NO: 20768 - RNA, 21 nt, Human
caugucuuccacacuguagua

SEQ ID NO: 20769 - RNA, 22 nt, Human
caugucuugcccugauuaguag

SEQ ID NO: 20770 - RNA, 22 nt, Human
caugucuuucaaaccacacagu

SEQ ID NO: 20771 - RNA, 22 nt, Human
caugugaccgcugggugagcga

SEQ ID NO: 20772 - RNA, 22 nt, Human
caugugcagacggugggcugga

SEQ ID NO: 20773 - RNA, 22 nt, Human
cauguggauggucuccucauca

SEQ ID NO: 20774 - RNA, 22 nt, Human
cauguggcacaaagaaggaaau

SEQ ID NO: 20775 - RNA, 22 nt, Human
cauguggcuuuggcaugugccc

SEQ ID NO: 20776 - RNA, 22 nt, Human
caugugggaagaggccagcugg

SEQ ID NO: 20777 - RNA, 22 nt, Human
caugugggacuccugcuguuuu

SEQ ID NO: 20778 - RNA, 22 nt, Human
caugugguucaaguacuccaca

SEQ ID NO: 20779 - RNA, 23 nt, Human
cauguguaauuucugguugggug

SEQ ID NO: 20780 - RNA, 22 nt, Human
cauguguccuagcuauucuccu

SEQ ID NO: 20781 - RNA, 22 nt, Human
caugugucuaaucuacuaauau

SEQ ID NO: 20782 - RNA, 22 nt, Human
caugugucuuuauggagccaca

SEQ ID NO: 20783 - RNA, 22 nt, Human
caugugugggacccuuagguug

SEQ ID NO: 20784 - RNA, 22 nt, Human
cauguguugucucauuuaaucc

SEQ ID NO: 20785 - RNA, 22 nt, Human
cauguuaaaauauacauucuga

SEQ ID NO: 20786 - RNA, 22 nt, Human
cauguuaaguguuugauaacca

SEQ ID NO: 20787 - RNA, 22 nt, Human
cauguuaauaugcauugaguac

SEQ ID NO: 20788 - RNA, 22 nt, Human
cauguucuaacaaugagaaacc

SEQ ID NO: 20789 - RNA, 22 nt, Human
cauguucucuuaauguuaacua

SEQ ID NO: 20790 - RNA, 22 nt, Human
cauguuggcugaggcuguauuu

SEQ ID NO: 20791 - RNA, 22 nt, Human
cauguuggugugcugcacccau

SEQ ID NO: 20792 - RNA, 22 nt, Human
cauguuuacuaccaggagaaug

SEQ ID NO: 20793 - RNA, 22 nt, Human
cauuaaguauuucaguuacugu

SEQ ID NO: 20794 - RNA, 22 nt, Human
cauuaagucuguuaacuggaga

SEQ ID NO: 20795 - RNA, 22 nt, Human
cauuacagugucagaggaacug

SEQ ID NO: 20796 - RNA, 22 nt, Human
cauuacaugguccaggauauau

SEQ ID NO: 20797 - RNA, 21 nt, Human
cauuacaugguuuuagugaac

SEQ ID NO: 20798 - RNA, 22 nt, Human
cauuacauuucaaaauguuucc

SEQ ID NO: 20799 - RNA, 22 nt, Human
cauuagaaccuauaaaaagcau

SEQ ID NO: 20800 - RNA, 22 nt, Human
cauuagaauuagguuguuuacc

SEQ ID NO: 20801 - RNA, 22 nt, Human
cauuagcacaugacggaaagca

SEQ ID NO: 20802 - RNA, 22 nt, Human
cauuagcagucauuacugugcu

SEQ ID NO: 20803 - RNA, 22 nt, Human
cauuagcauucagugacuugua

SEQ ID NO: 20804 - RNA, 22 nt, Human
cauuagcucagauaccucugag

SEQ ID NO: 20805 - RNA, 22 nt, Human
cauuagggccaccauaacaaaa

SEQ ID NO: 20806 - RNA, 22 nt, Human
cauuaggguaauugaacacuua

SEQ ID NO: 20807 - RNA, 22 nt, Human
cauuaugcaaagaacacuugag

SEQ ID NO: 20808 - RNA, 22 nt, Human
cauuauggaagacaguguggug

SEQ ID NO: 20809 - RNA, 22 nt, Human
cauuauggcagccaggauauug

SEQ ID NO: 20810 - RNA, 20 nt, Human
cauuaugguugggcacagug

SEQ ID NO: 20811 - RNA, 22 nt, Human
cauuaugugagugauuaauuca

SEQ ID NO: 20812 - RNA, 22 nt, Human
cauuauugaugcaacagcccuu

SEQ ID NO: 20813 - RNA, 22 nt, Human
cauucacaaaaccacaugccau

SEQ ID NO: 20814 - RNA, 22 nt, Human
cauucacucagcgaugccagua

SEQ ID NO: 20815 - RNA, 22 nt, Human
cauucauaaguuuuugugcugg

SEQ ID NO: 20816 - RNA, 22 nt, Human
cauucauaggaagaaaaugggc

SEQ ID NO: 20817 - RNA, 22 nt, Human
cauucaucuaucaaaugguacc

SEQ ID NO: 20818 - RNA, 22 nt, Human
cauucauuuaugaaauaucuau

SEQ ID NO: 20819 - RNA, 22 nt, Human
cauucauuugcccaguaaguca

SEQ ID NO: 20820 - RNA, 22 nt, Human
cauuccuggacaaacaucaaaa

SEQ ID NO: 20821 - RNA, 22 nt, Human
cauuccuuaacguggggagucu

SEQ ID NO: 20822 - RNA, 22 nt, Human
cauucugacccuaugauuuaag

SEQ ID NO: 20823 - RNA, 22 nt, Human
cauucugggucuggcucaggga

SEQ ID NO: 20824 - RNA, 22 nt, Human
caagcuuuauccgccauguagg

SEQ ID NO: 20825 - RNA, 22 nt, Human
caaggaaaagaaguauuucaga

SEQ ID NO: 20826 - RNA, 22 nt, Human
caaggaaggagagaugaugggu

SEQ ID NO: 20827 - RNA, 22 nt, Human
caaggaauauuuaagaacguca

SEQ ID NO: 20828 - RNA, 22 nt, Human
caaggaaucccauuucuaacuc

SEQ ID NO: 20829 - RNA, 22 nt, Human
caaggacacugagcuuuguaaa

SEQ ID NO: 20830 - RNA, 21 nt, Human
caaggacagguugcagggcaa

SEQ ID NO: 20831 - RNA, 22 nt, Human
caaggcaaucucauggcuucuu

SEQ ID NO: 20832 - RNA, 22 nt, Human
caaggcagaauucagacucagg

SEQ ID NO: 20833 - RNA, 22 nt, Human
caaggcagcuuaauagaauuug

SEQ ID NO: 20834 - RNA, 22 nt, Human
caaggcaggccaguuucaaggc

SEQ ID NO: 20835 - RNA, 22 nt, Human
caaggcaugaaaggagugagug

SEQ ID NO: 20836 - RNA, 22 nt, Human
caaggcauuaccauggcuagag

SEQ ID NO: 20837 - RNA, 22 nt, Human
caaggccacguucugcaugcgg

SEQ ID NO: 20838 - RNA, 22 nt, Human
caaggccaguccauuuuggaag

SEQ ID NO: 20839 - RNA, 22 nt, Human
caaggccauaagagauacaaaa

SEQ ID NO: 20840 - RNA, 22 nt, Human
caaggccuucuugggagagauu

SEQ ID NO: 20841 - RNA, 22 nt, Human
caaggcuauaauguugcuggaa

SEQ ID NO: 20842 - RNA, 22 nt, Human
caaggcucugcuucuaucacau

SEQ ID NO: 20843 - RNA, 22 nt, Human
caaggcugaucauuuucccaua

SEQ ID NO: 20844 - RNA, 22 nt, Human
caaggcuggcucacaauaauga

SEQ ID NO: 20845 - RNA, 22 nt, Human
caaggcugugcaggguccauau

SEQ ID NO: 20846 - RNA, 22 nt, Human
caaggcuuauuuuccuccuucc

SEQ ID NO: 20847 - RNA, 22 nt, Human
caaggcuuucucauuauccuuu

SEQ ID NO: 20848 - RNA, 22 nt, Human
caagggaguuacugagggcggg

SEQ ID NO: 20849 - RNA, 22 nt, Human
caagggccuccaccuugcucgu

SEQ ID NO: 20850 - RNA, 22 nt, Human
caagggcucaaacggugguugc

SEQ ID NO: 20851 - RNA, 22 nt, Human
caagggcucacggucugcuggg

SEQ ID NO: 20852 - RNA, 22 nt, Human
caagggcuucaaguggccaaga

SEQ ID NO: 20853 - RNA, 19 nt, Human
caaggguugggucugucau

SEQ ID NO: 20854 - RNA, 22 nt, Human
caagguuccagaauuaugcucu

SEQ ID NO: 20855 - RNA, 22 nt, Human
caagguuugaaaacgccauggc

SEQ ID NO: 20856 - RNA, 22 nt, Human
caaguaacuugauuaagguaag

SEQ ID NO: 20857 - RNA, 22 nt, Human
caaguagaaggaugugauugua

SEQ ID NO: 20858 - RNA, 22 nt, Human
caaguauucuguaaaaagucaa

SEQ ID NO: 20859 - RNA, 22 nt, Human
caaguauuuccugauggccugu

SEQ ID NO: 20860 - RNA, 23 nt, Human
caagucauggauuggaguuucag

SEQ ID NO: 20861 - RNA, 22 nt, Human
caaguccaacaguuuuucagac

SEQ ID NO: 20862 - RNA, 22 nt, Human
caaguccuaggucugauugaac

SEQ ID NO: 20863 - RNA, 21 nt, Human
caaguccuuugccaaagugcu

SEQ ID NO: 20864 - RNA, 22 nt, Human
caaggcuaagcuuuggcuuucu

SEQ ID NO: 20865 - RNA, 22 nt, Human
caaggcuggaguguaauggcau

SEQ ID NO: 20866 - RNA, 22 nt, Human
caaggcuuagucagagggugcu

SEQ ID NO: 20867 - RNA, 22 nt, Human
caaggcuucacguccccagugc

SEQ ID NO: 20868 - RNA, 22 nt, Human
caaggcuucagugugacaaaac

SEQ ID NO: 20869 - RNA, 22 nt, Human
caagggaauugugugugagagg

SEQ ID NO: 20870 - RNA, 22 nt, Human
caagggcagaggcagggccccg

SEQ ID NO: 20871 - RNA, 22 nt, Human
caagggcucuuuugaggaaugu

SEQ ID NO: 20872 - RNA, 20 nt, Human
caaggggaguaguaugggcc

SEQ ID NO: 20873 - RNA, 22 nt, Human
caagggugaaggcagaggacau

SEQ ID NO: 20874 - RNA, 22 nt, Human
caaggugaacuugcuguacagc

SEQ ID NO: 20875 - RNA, 22 nt, Human
caaggugcagcguugucaagcu

SEQ ID NO: 20876 - RNA, 22 nt, Human
caagguucuauagcaaaaucug

SEQ ID NO: 20877 - RNA, 22 nt, Human
caagguuuacuuuaugauccag

SEQ ID NO: 20878 - RNA, 22 nt, Human
caaguacuuugaaaaguugaau

SEQ ID NO: 20879 - RNA, 22 nt, Human
caaguagaacagagcuaccuug

SEQ ID NO: 20880 - RNA, 22 nt, Human
caaguagagauuacagugugca

SEQ ID NO: 20881 - RNA, 22 nt, Human
caaguagaguucacuugucuuu

SEQ ID NO: 20882 - RNA, 22 nt, Human
caaguauauuugaacauguaaa

SEQ ID NO: 20883 - RNA, 22 nt, Human
caaguauuugcggaguuccacg

SEQ ID NO: 20884 - RNA, 22 nt, Human
caagucaacucaaauuguuauc

SEQ ID NO: 20885 - RNA, 22 nt, Human
caagucaaugauuauaagaguc

SEQ ID NO: 20886 - RNA, 22 nt, Human
caagucaucauagaaguucccc

SEQ ID NO: 20887 - RNA, 22 nt, Human
caagucauuacugaaaugucac

SEQ ID NO: 20888 - RNA, 22 nt, Human
caaguccaagaucaagaagcca

SEQ ID NO: 20889 - RNA, 22 nt, Human
caaguccaucagauaagcaaga

SEQ ID NO: 20890 - RNA, 22 nt, Human
caaguccauccuacugccuucu

SEQ ID NO: 20891 - RNA, 22 nt, Human
caaguccuaaauguauuuguug

SEQ ID NO: 20892 - RNA, 22 nt, Human
caagucuagcuuggucacuugg

SEQ ID NO: 20893 - RNA, 19 nt, Human
caagugaagccugggaugg

SEQ ID NO: 20894 - RNA, 22 nt, Human
caagugacuucuuugagcccgu

SEQ ID NO: 20895 - RNA, 22 nt, Human
caagugagugaccagaguuggu

SEQ ID NO: 20896 - RNA, 22 nt, Human
caagugaucagacacugaaguc

SEQ ID NO: 20897 - RNA, 22 nt, Human
caaguguccaugauagucuuag

SEQ ID NO: 20898 - RNA, 22 nt, Human
caagugugacuauuuuuucaua

SEQ ID NO: 20899 - RNA, 22 nt, Human
caaguuaguuauucuugugagc

SEQ ID NO: 20900 - RNA, 22 nt, Human
caaguuaucagggcaguuagag

SEQ ID NO: 20901 - RNA, 22 nt, Human
caaguucaaguccuggcucugc

SEQ ID NO: 20902 - RNA, 21 nt, Human
caaguucugugucuuacuccu

SEQ ID NO: 20903 - RNA, 22 nt, Human
caaguuggucuccuguagcaac

SEQ ID NO: 20904 - RNA, 22 nt, Human
caaguuuacaauguguaugugu

SEQ ID NO: 20905 - RNA, 22 nt, Human
caaguuugcugauccuuguuuu

SEQ ID NO: 20906 - RNA, 22 nt, Human
caaguuuggauuaugaaaaagu

SEQ ID NO: 20907 - RNA, 22 nt, Human
caaguuuguguucuaucauucu

SEQ ID NO: 20908 - RNA, 22 nt, Human
caaguuuuagcaaguggaaagg

SEQ ID NO: 20909 - RNA, 22 nt, Human
caaguuuugcauaguucuguau

SEQ ID NO: 20910 - RNA, 21 nt, Human
caauaaacugcacauugagac

SEQ ID NO: 20911 - RNA, 22 nt, Human
caauaaagaagauuuuugcaau

SEQ ID NO: 20912 - RNA, 22 nt, Human
caauaacuaguaauuauuccgg

SEQ ID NO: 20913 - RNA, 22 nt, Human
caauaagccagguguuuguguu

SEQ ID NO: 20914 - RNA, 20 nt, Human
caauaauuuacuucccuauu

SEQ ID NO: 20915 - RNA, 22 nt, Human
caauacuauucggaccaucucu

SEQ ID NO: 20916 - RNA, 22 nt, Human
caauacuuuaguaaaauggccc

SEQ ID NO: 20917 - RNA, 22 nt, Human
caauagaaaacucaauacuuaa

SEQ ID NO: 20918 - RNA, 22 nt, Human
caauagaaggcacagauaggua

SEQ ID NO: 20919 - RNA, 22 nt, Human
caauagcagaccuagaaagcaa

SEQ ID NO: 20920 - RNA, 22 nt, Human
caauaguaaauuacggaggaga

SEQ ID NO: 20921 - RNA, 22 nt, Human
caauagugucugcuuguuucua

SEQ ID NO: 20922 - RNA, 22 nt, Human
caauaugcaagcuauuaaguau

SEQ ID NO: 20923 - RNA, 22 nt, Human
caaucaguaaccggaucauggu

SEQ ID NO: 20924 - RNA, 22 nt, Human
caaucaguuucuguuguauaau

SEQ ID NO: 20925 - RNA, 22 nt, Human
caauccaucaauuacacaggcu

SEQ ID NO: 20926 - RNA, 22 nt, Human
caaucuauagagcuuuagacua

SEQ ID NO: 20927 - RNA, 22 nt, Human
caaucugaguugggaauguauu

SEQ ID NO: 20928 - RNA, 22 nt, Human
caaucuuagagagauucuuuua

SEQ ID NO: 20929 - RNA, 22 nt, Human
caaucuuaguggcuuacaaaga

SEQ ID NO: 20930 - RNA, 22 nt, Human
caaugaaaauuuaaguugcagc

SEQ ID NO: 20931 - RNA, 22 nt, Human
caaugaaagcaacugccuauaa

SEQ ID NO: 20932 - RNA, 22 nt, Human
caaugaacacagcaauuucaua

SEQ ID NO: 20933 - RNA, 22 nt, Human
caauucaugugagcggacucuu

SEQ ID NO: 20934 - RNA, 22 nt, Human
caauugcugauaugcagaagac

SEQ ID NO: 20935 - RNA, 23 nt, Human
caauuguauaaagcaaaugguuu

SEQ ID NO: 20936 - RNA, 22 nt, Human
caauuucaagauucuguucuuu

SEQ ID NO: 20937 - RNA, 22 nt, Human
caauuucacuaaugaugugggg

SEQ ID NO: 20938 - RNA, 22 nt, Human
caauuucacugacacccuggaa

SEQ ID NO: 20939 - RNA, 22 nt, Human
caauuucagguggauagguuuu

SEQ ID NO: 20940 - RNA, 21 nt, Human
caauuucaugggaagauggga

SEQ ID NO: 20941 - RNA, 22 nt, Human
caauuucucgaacucuaaucca

SEQ ID NO: 20942 - RNA, 19 nt, Human
caauuuggcagauucuccc

SEQ ID NO: 20943 - RNA, 22 nt, Human
caauuugguuuauguguucaga

SEQ ID NO: 20944 - RNA, 18 nt, Human
caauuuuacccagucccu

SEQ ID NO: 20945 - RNA, 23 nt, Human
cacaaagguuccauucucucacc

SEQ ID NO: 20946 - RNA, 19 nt, Human
cacaaaugaugaggaccug

SEQ ID NO: 20947 - RNA, 22 nt, Human
cacaaaugugcagaaaugugag

SEQ ID NO: 20948 - RNA, 23 nt, Human
cacaacuaaucagaaucucuagg

SEQ ID NO: 20949 - RNA, 22 nt, Human
cacaacugccagccaggaaagg

SEQ ID NO: 20950 - RNA, 19 nt, Human
cacaacuucgcuugauucc

SEQ ID NO: 20951 - RNA, 20 nt, Human
cacaagaggaguucccugag

SEQ ID NO: 20952 - RNA, 22 nt, Human
cacaaggacauguauauuuaug

SEQ ID NO: 20953 - RNA, 22 nt, Human
cacaaggacuggauggaguggg

SEQ ID NO: 20954 - RNA, 22 nt, Human
cacaaggcugggacaagugcug

SEQ ID NO: 20955 - RNA, 22 nt, Human
cacaagggcuuuguaggcuuug

SEQ ID NO: 20956 - RNA, 22 nt, Human
cacaagucuguggucuccaaca

SEQ ID NO: 20957 - RNA, 22 nt, Human
cacaauaaauguuugcugauga

SEQ ID NO: 20958 - RNA, 22 nt, Human
cacaauacuauuuuuaggucuu

SEQ ID NO: 20959 - RNA, 22 nt, Human
cacaauguguuggguuaaguuu

SEQ ID NO: 20960 - RNA, 22 nt, Human
cacaauuacuuuugcaccaaca

SEQ ID NO: 20961 - RNA, 19 nt, Human
cacaauuaugagacacuua

SEQ ID NO: 20962 - RNA, 22 nt, Human
cacaauuuccaagucauguuau

SEQ ID NO: 20963 - RNA, 22 nt, Human
cacaauuuccauugagcagcag

SEQ ID NO: 20964 - RNA, 22 nt, Human
cacaauuuggacuucacugguu

SEQ ID NO: 20965 - RNA, 22 nt, Human
cacaauuuggggugcccacugu

SEQ ID NO: 20966 - RNA, 22 nt, Human
cacaauuuggugcuaaagaaag

SEQ ID NO: 20967 - RNA, 22 nt, Human
cacaauuuuaauacacagucaa

SEQ ID NO: 20968 - RNA, 22 nt, Human
cacaauuuuccuuuaaguguau

SEQ ID NO: 20969 - RNA, 22 nt, Human
cacacacuggagcaaggagaug

SEQ ID NO: 20970 - RNA, 22 nt, Human
cacacacuguuaauguaggagu

SEQ ID NO: 20971 - RNA, 22 nt, Human
cacacagacagcucucugaaga

SEQ ID NO: 20972 - RNA, 15 nt, Human
cacacagacagcuug

SEQ ID NO: 20973 - RNA, 22 nt, Human
cacacagcaacaagaauagcca

SEQ ID NO: 20974 - RNA, 22 nt, Human
cacacaggaaaauuggaauuaa

SEQ ID NO: 20975 - RNA, 22 nt, Human
cacacaggagagugcuggaggu

SEQ ID NO: 20976 - RNA, 22 nt, Human
cacacagggagaaagaaagccu

SEQ ID NO: 20977 - RNA, 22 nt, Human
cacacagguauauauauguaca

SEQ ID NO: 20978 - RNA, 22 nt, Human
cacacaguaggcacucauuaau

SEQ ID NO: 20979 - RNA, 22 nt, Human
cacacaucaaccuagacauugu

SEQ ID NO: 20980 - RNA, 22 nt, Human
cacacaugaaucccuaguaccu

SEQ ID NO: 20981 - RNA, 22 nt, Human
cacacaugacccacuuuuaccg

SEQ ID NO: 20982 - RNA, 22 nt, Human
cacacauggcugccagggaggu

SEQ ID NO: 20983 - RNA, 22 nt, Human
cacacaugucucuccaugcucu

SEQ ID NO: 20984 - RNA, 22 nt, Human
cacacauugagcagcuguuugu

SEQ ID NO: 20985 - RNA, 22 nt, Human
cacacauuucagaugcuacaau

SEQ ID NO: 20986 - RNA, 22 nt, Human
cacaccagagguuaccugcaaa

SEQ ID NO: 20987 - RNA, 23 nt, Human
cacaccaggagccgucugggcca

SEQ ID NO: 20988 - RNA, 22 nt, Human
cacacccaaauucuaacaguag

SEQ ID NO: 20989 - RNA, 22 nt, Human
cacaccuguaauaccagcuacu

SEQ ID NO: 20990 - RNA, 22 nt, Human
cacacgagcccuggagccagca

SEQ ID NO: 20991 - RNA, 22 nt, Human
cacacgaugugaauucuugccc

SEQ ID NO: 20992 - RNA, 22 nt, Human
cacacuagucuauccauuagcu

SEQ ID NO: 20993 - RNA, 22 nt, Human
cacacuaucuuccuauccuggc

SEQ ID NO: 20994 - RNA, 22 nt, Human
cacacugcuuacacaaaaugau

SEQ ID NO: 20995 - RNA, 22 nt, Human
cacacuguccccuucuccccag

SEQ ID NO: 20996 - RNA, 22 nt, Human
cacacuugugaccgauauaaug

SEQ ID NO: 20997 - RNA, 22 nt, Human
cacagaacauuuuuagaugcag

SEQ ID NO: 20998 - RNA, 22 nt, Human
cacagaacugguuaauagcaga

SEQ ID NO: 20999 - RNA, 22 nt, Human
cacagaaguuucauagucucga

SEQ ID NO: 21000 - RNA, 22 nt, Human
cacagaaucauauugucaguuu

SEQ ID NO: 21001 - RNA, 22 nt, Human
cacagagagcuacgugcagcgu

SEQ ID NO: 21002 - RNA, 22 nt, Human
cacagagaggcuugucuccaag

SEQ ID NO: 21003 - RNA, 22 nt, Human
cacagagauggucuggcaggug

SEQ ID NO: 21004 - RNA, 22 nt, Human
cacagagcaggggucuguguca

SEQ ID NO: 21005 - RNA, 22 nt, Human
cacagaggacuguagcggggag

SEQ ID NO: 21006 - RNA, 22 nt, Human
cacagaggauuuuuagggcagu

SEQ ID NO: 21007 - RNA, 22 nt, Human
cacagaggcaaccuucuggggu

SEQ ID NO: 21008 - RNA, 22 nt, Human
cacagaggcucaaagccaggug

SEQ ID NO: 21009 - RNA, 22 nt, Human
cacagauaaggcuuugucccca

SEQ ID NO: 21010 - RNA, 22 nt, Human
cacagauaccuagugaaacaua

SEQ ID NO: 21011 - RNA, 22 nt, Human
cacagauagaccuuaugagauu

SEQ ID NO: 21012 - RNA, 20 nt, Human
cacagaugggacaggaaagg

SEQ ID NO: 21013 - RNA, 22 nt, Human
cacagcagaaauaugaaggcag

SEQ ID NO: 21014 - RNA, 22 nt, Human
cacagcagagggagccauugaa

SEQ ID NO: 21015 - RNA, 22 nt, Human
cacagcagccagaacauuuuug

SEQ ID NO: 21016 - RNA, 22 nt, Human
cacagcagcguuccuccgugug

SEQ ID NO: 21017 - RNA, 21 nt, Human
cacagcaggguuccugggcuc

SEQ ID NO: 21018 - RNA, 22 nt, Human
cacagcaggugcuuaaugauua

SEQ ID NO: 21019 - RNA, 22 nt, Human
cacagcauuaacugggacagcu

SEQ ID NO: 21020 - RNA, 19 nt, Human
cacagccacagccaaccuc

SEQ ID NO: 21021 - RNA, 22 nt, Human
cacagcccccuugacacucugg

SEQ ID NO: 21022 - RNA, 22 nt, Human
cacagcuaauggaaguggaauc

SEQ ID NO: 21023 - RNA, 22 nt, Human
cacagcugccauggcugcacuu

SEQ ID NO: 21024 - RNA, 22 nt, Human
cacagcugcccuaacuguacuc

SEQ ID NO: 21025 - RNA, 22 nt, Human
cacagcuggaaugggguaccug

SEQ ID NO: 21026 - RNA, 22 nt, Human
cacagcuggugacagagcccag

SEQ ID NO: 21027 - RNA, 22 nt, Human
cacagcuggugcacuagcucug

SEQ ID NO: 21028 - RNA, 22 nt, Human
cacagcuucccgugcauggaga

SEQ ID NO: 21029 - RNA, 22 nt, Human
cacagcuucugagugaggauuu

SEQ ID NO: 21030 - RNA, 20 nt, Human
cacagcuugccuuuuaugac

SEQ ID NO: 21031 - RNA, 22 nt, Human
cacagcuuugcuuuccuuaaua

SEQ ID NO: 21032 - RNA, 22 nt, Human
cacaggaaaauaaaagaucuaa

SEQ ID NO: 21033 - RNA, 22 nt, Human
cacaggaacaaagaagacaauu

SEQ ID NO: 21034 - RNA, 22 nt, Human
cacaggaagagguauacaauuc

SEQ ID NO: 21035 - RNA, 22 nt, Human
cacaggaaggccuucucacaau

SEQ ID NO: 21036 - RNA, 22 nt, Human
cacaggaaucagcauuaauggc

SEQ ID NO: 21037 - RNA, 22 nt, Human
cacaggaaucgucacuuagcgc

SEQ ID NO: 21038 - RNA, 22 nt, Human
cacaggaaucugcauuuugacc

SEQ ID NO: 21039 - RNA, 22 nt, Human
cacaggaaugaacagggaaaga

SEQ ID NO: 21040 - RNA, 22 nt, Human
cacaggaauuagcagccuaaaa

SEQ ID NO: 21041 - RNA, 22 nt, Human
cacaggaccaauucacauucca

SEQ ID NO: 21042 - RNA, 22 nt, Human
ugcagagggacagccacagcuc

SEQ ID NO: 21043 - RNA, 22 nt, Human
ugcagaggugugcauucuuaag

SEQ ID NO: 21044 - RNA, 22 nt, Human
ugcagagguuuccaggcaaguu

SEQ ID NO: 21045 - RNA, 22 nt, Human
ugcagagguuuuuaauacauuu

SEQ ID NO: 21046 - RNA, 22 nt, Human
ugcagagugggagaggugcggg

SEQ ID NO: 21047 - RNA, 22 nt, Human
ugcagaguugcuuugauagucc

SEQ ID NO: 21048 - RNA, 22 nt, Human
ugcagauagcgucauucuugcu

SEQ ID NO: 21049 - RNA, 22 nt, Human
ugcagaugagggaugaaaauga

SEQ ID NO: 21050 - RNA, 22 nt, Human
ugcagauucaaaugaaaugcaa

SEQ ID NO: 21051 - RNA, 22 nt, Human
ugcagcaaaaggucagagggag

SEQ ID NO: 21052 - RNA, 22 nt, Human
ugcagcaaacaggccuucaggg

SEQ ID NO: 21053 - RNA, 22 nt, Human
ugcagcaagcaaguaugguucu

SEQ ID NO: 21054 - RNA, 22 nt, Human
ugcagcaaguaaccaucuuccu

SEQ ID NO: 21055 - RNA, 22 nt, Human
ugcagcacuguucacaauagcc

SEQ ID NO: 21056 - RNA, 20 nt, Human
ugcagcagaagcccaugcuc

SEQ ID NO: 21057 - RNA, 22 nt, Human
ugcagcagacauaauguggauu

SEQ ID NO: 21058 - RNA, 22 nt, Human
ugcagcagagugggccugggug

SEQ ID NO: 21059 - RNA, 21 nt, Human
ugcagcagauuugggggaaga

SEQ ID NO: 21060 - RNA, 22 nt, Human
ugcagcagccucaucugguuuc

SEQ ID NO: 21061 - RNA, 22 nt, Human
ugcagcagcuccagguuacccu

SEQ ID NO: 21062 - RNA, 22 nt, Human
ugcagcaggcacaggacggaag

SEQ ID NO: 21063 - RNA, 22 nt, Human
ugcagcagguauggcaagcucc

SEQ ID NO: 21064 - RNA, 17 nt, Human
ugcagcaguucccaucu

SEQ ID NO: 21065 - RNA, 22 nt, Human
ugcagcaucuccuugugccaug

SEQ ID NO: 21066 - RNA, 22 nt, Human
ugcagcauuaguacaagucuca

SEQ ID NO: 21067 - RNA, 22 nt, Human
ugcagcauuugcugaagcagga

SEQ ID NO: 21068 - RNA, 19 nt, Human
ugcagccacgugagagacu

SEQ ID NO: 21069 - RNA, 22 nt, Human
ugcagccuagacauucugguca

SEQ ID NO: 21070 - RNA, 18 nt, Human
ugcagccuguagucuugu

SEQ ID NO: 21071 - RNA, 22 nt, Human
ugcagcgguaguucucguggaa

SEQ ID NO: 21072 - RNA, 19 nt, Human
ugcagcucagggcaggggc

SEQ ID NO: 21073 - RNA, 22 nt, Human
ugcagcucauugguguccuggu

SEQ ID NO: 21074 - RNA, 22 nt, Human
ugcagcugaggccagcuaugcc

SEQ ID NO: 21075 - RNA, 22 nt, Human
ugcagcugauaauuacauguuc

SEQ ID NO: 21076 - RNA, 22 nt, Human
ugcagcugauuaaagggcagac

SEQ ID NO: 21077 - RNA, 20 nt, Human
ugcagcugcaggaggguggg

SEQ ID NO: 21078 - RNA, 22 nt, Human
ugcagcugccuagggcuggcuu

SEQ ID NO: 21079 - RNA, 23 nt, Human
ugcagcugccucuggcgggccgg

SEQ ID NO: 21080 - RNA, 22 nt, Human
ugcagcugcucuucauuucccc

SEQ ID NO: 21081 - RNA, 22 nt, Human
ugcagcugcugguggcugaaag

SEQ ID NO: 21082 - RNA, 22 nt, Human
ugcagcugguaucccauggauu

SEQ ID NO: 21083 - RNA, 22 nt, Human
ugcagcugguuuagaacuagau

SEQ ID NO: 21084 - RNA, 22 nt, Human
ugcagcuguaacagaggccuca

SEQ ID NO: 21085 - RNA, 22 nt, Human
ugcagcugugggagaaucucug

SEQ ID NO: 21086 - RNA, 22 nt, Human
ugcagcuucacucaggaagcca

SEQ ID NO: 21087 - RNA, 22 nt, Human
ugcagcuuugcucuggucccca

SEQ ID NO: 21088 - RNA, 22 nt, Human
ugcaggaaaaauaaauaguguu

SEQ ID NO: 21089 - RNA, 22 nt, Human
ugcaggaacauagguuccuugg

SEQ ID NO: 21090 - RNA, 22 nt, Human
ugcaggaacugggagggauagu

SEQ ID NO: 21091 - RNA, 22 nt, Human
ugcaggaacuugguuuuacuca

SEQ ID NO: 21092 - RNA, 22 nt, Human
ugcaggaaguuuccugaacuuu

SEQ ID NO: 21093 - RNA, 22 nt, Human
ugcaggaaugagguucucaguu

SEQ ID NO: 21094 - RNA, 22 nt, Human
ugcaggacaguuuggaagagag

SEQ ID NO: 21095 - RNA, 22 nt, Human
ugcaggaccuugauccuggacu

SEQ ID NO: 21096 - RNA, 22 nt, Human
ugcaggacucaaggguagcagg

SEQ ID NO: 21097 - RNA, 22 nt, Human
ugcaggacuggggagcggaagg

SEQ ID NO: 21098 - RNA, 22 nt, Human
ugcaggagaaaguacggagcgu

SEQ ID NO: 21099 - RNA, 22 nt, Human
ugcaggagcagagauggcugga

SEQ ID NO: 21100 - RNA, 22 nt, Human
ugcaggagcccaggaauacuau

SEQ ID NO: 21101 - RNA, 22 nt, Human
ugcaggagcugcuguccugcuc

SEQ ID NO: 21102 - RNA, 21 nt, Human
ugcaggagucugugagucagg

SEQ ID NO: 21103 - RNA, 21 nt, Human
ugcaggaguguaaugugaccc

SEQ ID NO: 21104 - RNA, 22 nt, Human
ugcaggaguuaagugcucuccu

SEQ ID NO: 21105 - RNA, 22 nt, Human
ugcaggcaggggaugagcagcc

SEQ ID NO: 21106 - RNA, 22 nt, Human
ugcaggcucacccuggagcuga

SEQ ID NO: 21107 - RNA, 17 nt, Human
ugcaggcuccugucccu

SEQ ID NO: 21108 - RNA, 22 nt, Human
ugcaggcucugugugugccugg

SEQ ID NO: 21109 - RNA, 22 nt, Human
ugcaggcugaggcuggcucaac

SEQ ID NO: 21110 - RNA, 22 nt, Human
ugcaggcugcagucucaggugg

SEQ ID NO: 21111 - RNA, 22 nt, Human
ugcaggcugcucaagacuuagu

SEQ ID NO: 21112 - RNA, 22 nt, Human
ugcaggcuggauuugcuuuugu

SEQ ID NO: 21113 - RNA, 22 nt, Human
ugcaggcuggcagauaucucau

SEQ ID NO: 21114 - RNA, 22 nt, Human
ugcaggcuguuugguggaucuc

SEQ ID NO: 21115 - RNA, 20 nt, Human
ugcaggcuucgcucuaggag

SEQ ID NO: 21116 - RNA, 22 nt, Human
ugcagggaagcaaggguggcuc

SEQ ID NO: 21117 - RNA, 22 nt, Human
ugcagggaagucccagcuccug

SEQ ID NO: 21118 - RNA, 22 nt, Human
ugcagggacacgaagacaaaua

SEQ ID NO: 21119 - RNA, 22 nt, Human
ugcagggacaggcucuggggau

SEQ ID NO: 21120 - RNA, 21 nt, Human
ugcagggaucuuucugccuga

SEQ ID NO: 21121 - RNA, 22 nt, Human
ugcagggcacacgcacgggugu

SEQ ID NO: 21122 - RNA, 22 nt, Human
ugcagggcaguuuguuucggca

SEQ ID NO: 21123 - RNA, 22 nt, Human
ugcagggccaugguggcggcug

SEQ ID NO: 21124 - RNA, 22 nt, Human
ugcagggccccucugcaugagu

SEQ ID NO: 21125 - RNA, 19 nt, Human
ugcagggcugcgccugggg

SEQ ID NO: 21126 - RNA, 23 nt, Human
ugcaggggaggcuuaaagcaggu

SEQ ID NO: 21127 - RNA, 22 nt, Human
ugcaggguagaugcaggcugug

SEQ ID NO: 21128 - RNA, 22 nt, Human
ugcagggugguuugaagggucu

SEQ ID NO: 21129 - RNA, 22 nt, Human
ugcaggguguccggaggaucac

SEQ ID NO: 21130 - RNA, 22 nt, Human
ugcaggucaucccugugcuucu

SEQ ID NO: 21131 - RNA, 22 nt, Human
ugcaggugagugcaggggcuca

SEQ ID NO: 21132 - RNA, 22 nt, Human
ugcaggugauucugaugcaguu

SEQ ID NO: 21133 - RNA, 22 nt, Human
ugcaggugcuccgggggugccc

SEQ ID NO: 21134 - RNA, 22 nt, Human
ugcagguggcuccagggacugc

SEQ ID NO: 21135 - RNA, 20 nt, Human
ugcaggugggcccuucuggg

SEQ ID NO: 21136 - RNA, 22 nt, Human
ugcaggugguacuucuuuuucu

SEQ ID NO: 21137 - RNA, 22 nt, Human
ugcaggugguuuggacacugcu

SEQ ID NO: 21138 - RNA, 22 nt, Human
ugcaguaggcacguggcuguga

SEQ ID NO: 21139 - RNA, 22 nt, Human
ugcaguccaagagucuccuggu

SEQ ID NO: 21140 - RNA, 21 nt, Human
ugcaguccuuugacaugauuc

SEQ ID NO: 21141 - RNA, 22 nt, Human
ugcagugaugcuucuggcucag

SEQ ID NO: 21142 - RNA, 22 nt, Human
ugcagugccucggcagugcagc

SEQ ID NO: 21143 - RNA, 22 nt, Human
ugcaguggaaagacucagacuu

SEQ ID NO: 21144 - RNA, 22 nt, Human
ugcaguggaagagguggagauc

SEQ ID NO: 21145 - RNA, 22 nt, Human
ugcagugugaccuguagcgagc

SEQ ID NO: 21146 - RNA, 22 nt, Human
ugcagugugagguccacaucug

SEQ ID NO: 21147 - RNA, 22 nt, Human
ugcagugugauuuucuggcuga

SEQ ID NO: 21148 - RNA, 22 nt, Human
ugcaguucuaucacccaccccg

SEQ ID NO: 21149 - RNA, 22 nt, Human
uauuaacacguauaaaguguuu

SEQ ID NO: 21150 - RNA, 22 nt, Human
uauuaacaugaacugacuuuuc

SEQ ID NO: 21151 - RNA, 22 nt, Human
uaccuucuaggugaugguuaca

SEQ ID NO: 21152 - RNA, 22 nt, Human
uaccuucucuagaucuuuauuc

SEQ ID NO: 21153 - RNA, 22 nt, Human
uagaaacaugagagaaacucuu

SEQ ID NO: 21154 - RNA, 22 nt, Human
uagaaacauucaguugcagucc

SEQ ID NO: 21155 - RNA, 22 nt, Human
uagaaacccaggauuuguauuu

SEQ ID NO: 21156 - RNA, 22 nt, Human
uagaaacccauguuuauucagu

SEQ ID NO: 21157 - RNA, 22 nt, Human
uagaaaccucagggaaaucuuu

SEQ ID NO: 21158 - RNA, 22 nt, Human
uagaaacuacuagaauaagaga

SEQ ID NO: 21159 - RNA, 19 nt, Human
uagaaagaugauggguggg

SEQ ID NO: 21160 - RNA, 22 nt, Human
uagaaagcaaaauccuaccaag

SEQ ID NO: 21161 - RNA, 22 nt, Human
uagaaagcugaguaauacauuu

SEQ ID NO: 21162 - RNA, 22 nt, Human
uagaaagcuggaggaauucuuu

SEQ ID NO: 21163 - RNA, 22 nt, Human
uagaaaggaagcuacuuagggg

SEQ ID NO: 21164 - RNA, 22 nt, Human
uagaaaguagccacuuacagag

SEQ ID NO: 21165 - RNA, 22 nt, Human
uagaaagucaaaacacuguguu

SEQ ID NO: 21166 - RNA, 22 nt, Human
uagaaaugaauguuuaaaaguc

SEQ ID NO: 21167 - RNA, 22 nt, Human
uagaaaugagccaugguagagc

SEQ ID NO: 21168 - RNA, 22 nt, Human
uagaaaugcccagauucugcua

SEQ ID NO: 21169 - RNA, 22 nt, Human
uagaaauguugguauuaacauu

SEQ ID NO: 21170 - RNA, 22 nt, Human
uagaaauucaaugcucugagua

SEQ ID NO: 21171 - RNA, 22 nt, Human
uagaacacagaaauguguggcc

SEQ ID NO: 21172 - RNA, 22 nt, Human
uagaacagaaggcaccuucucu

SEQ ID NO: 21173 - RNA, 22 nt, Human
uagaacagcauuuggcuauuaa

SEQ ID NO: 21174 - RNA, 22 nt, Human
uagaacaggcugucagagcggg

SEQ ID NO: 21175 - RNA, 22 nt, Human
uagaaccaguccacagaauuug

SEQ ID NO: 21176 - RNA, 22 nt, Human
uagaaccuccacaggaccucca

SEQ ID NO: 21177 - RNA, 22 nt, Human
uagaaccucugauuauguuacu

SEQ ID NO: 21178 - RNA, 22 nt, Human
uagaacuacaagcauuaaaagu

SEQ ID NO: 21179 - RNA, 22 nt, Human
uagaacuagaacaaggauuuga

SEQ ID NO: 21180 - RNA, 22 nt, Human
uagaacucuggucuucucaucc

SEQ ID NO: 21181 - RNA, 22 nt, Human
uagaacugcucucauacuugcu

SEQ ID NO: 21182 - RNA, 22 nt, Human
uagaacuggcggcuagaccacu

SEQ ID NO: 21183 - RNA, 22 nt, Human
uagaacuguccaagucugagcu

SEQ ID NO: 21184 - RNA, 22 nt, Human
uagaacuuauuuggcauuauuu

SEQ ID NO: 21185 - RNA, 22 nt, Human
uagaacuugugaaauaucaaug

SEQ ID NO: 21186 - RNA, 22 nt, Human
uagaacuuugccuuagggcaaa

SEQ ID NO: 21187 - RNA, 22 nt, Human
uagaagaaaagcacuuagagau

SEQ ID NO: 21188 - RNA, 22 nt, Human
uagaagauucauuuccucugaa

SEQ ID NO: 21189 - RNA, 22 nt, Human
uagaagcacagguuaaaggcau

SEQ ID NO: 21190 - RNA, 22 nt, Human
uagaagcagcaggaguaaaggc

SEQ ID NO: 21191 - RNA, 22 nt, Human
uagaaguuaaaggaauacagaa

SEQ ID NO: 21192 - RNA, 22 nt, Human
uagaaguuaggaaauaggaaua

SEQ ID NO: 21193 - RNA, 22 nt, Human
uagaaguuaugauaauaauagu

SEQ ID NO: 21194 - RNA, 22 nt, Human
uagaaguugaacuaaaaauauu

SEQ ID NO: 21195 - RNA, 22 nt, Human
uagaaguuuaaauucaccaugc

SEQ ID NO: 21196 - RNA, 22 nt, Human
uagaaguuucaaaagacuucau

SEQ ID NO: 21197 - RNA, 22 nt, Human
uagaauaaguugaugauauaug

SEQ ID NO: 21198 - RNA, 22 nt, Human
uagaauacaguuuaagaacuac

SEQ ID NO: 21199 - RNA, 22 nt, Human
uagaauaugugguguauacuuu

SEQ ID NO: 21200 - RNA, 21 nt, Human
uagaaucacuaauaagaugua

SEQ ID NO: 21201 - RNA, 22 nt, Human
uagaauccaccuacacaagaga

SEQ ID NO: 21202 - RNA, 22 nt, Human
uagaaucuaguucauucauuug

SEQ ID NO: 21203 - RNA, 22 nt, Human
uagaaucugauggcccgucugg

SEQ ID NO: 21204 - RNA, 22 nt, Human
uagaaucugccugcagcaaaga

SEQ ID NO: 21205 - RNA, 22 nt, Human
uagaaucuguguucaaaccuac

SEQ ID NO: 21206 - RNA, 22 nt, Human
uagaaugugccuggaauacagu

SEQ ID NO: 21207 - RNA, 22 nt, Human
uagaauguuaagaauauguaua

SEQ ID NO: 21208 - RNA, 22 nt, Human
uagaauucauguuacuguuagc

SEQ ID NO: 21209 - RNA, 22 nt, Human
uagaauuuucugcuuugauagu

SEQ ID NO: 21210 - RNA, 22 nt, Human
uagacacaucaaggaucaguuu

SEQ ID NO: 21211 - RNA, 22 nt, Human
uagacacaucaaguauaguuaa

SEQ ID NO: 21212 - RNA, 22 nt, Human
uagacagauguuuucuggcugu

SEQ ID NO: 21213 - RNA, 22 nt, Human
uagacagauuucuuguuagaca

SEQ ID NO: 21214 - RNA, 22 nt, Human
uagacagugagcuaugaguggu

SEQ ID NO: 21215 - RNA, 22 nt, Human
uagacaguuaaacuacuggugg

SEQ ID NO: 21216 - RNA, 22 nt, Human
uagacauuugaaugugaaauga

SEQ ID NO: 21217 - RNA, 22 nt, Human
uagaccauuuuacaauagugug

SEQ ID NO: 21218 - RNA, 22 nt, Human
uagacuagaggaucagcaaggg

SEQ ID NO: 21219 - RNA, 22 nt, Human
uagacuauagcucacagugcuu

SEQ ID NO: 21220 - RNA, 22 nt, Human
uagacucuuggggaaaucugca

SEQ ID NO: 21221 - RNA, 23 nt, Human
uagacugcaggcuccuugagggc

SEQ ID NO: 21222 - RNA, 22 nt, Human
uagacugugagcuccuugaggg

SEQ ID NO: 21223 - RNA, 19 nt, Human
uagacuuuuccagcaggca

SEQ ID NO: 21224 - RNA, 23 nt, Human
uagagaaagccaccgagucucuc

SEQ ID NO: 21225 - RNA, 22 nt, Human
uagagaaauaagcuuugccuug

SEQ ID NO: 21226 - RNA, 22 nt, Human
uagagacaccaguaccauucug

SEQ ID NO: 21227 - RNA, 22 nt, Human
uagagacagaaaguagaauggu

SEQ ID NO: 21228 - RNA, 22 nt, Human
uagagagagcugugguggcucu

SEQ ID NO: 21229 - RNA, 22 nt, Human
uagagagcuguuugaaagcagg

SEQ ID NO: 21230 - RNA, 22 nt, Human
uagagagguuugaauuggcugc

SEQ ID NO: 21231 - RNA, 22 nt, Human
uagagaugugauauagcagagu

SEQ ID NO: 21232 - RNA, 23 nt, Human
uagagcagggaaaucugucagag

SEQ ID NO: 21233 - RNA, 23 nt, Human
uagagcaguagaucaccauggga

SEQ ID NO: 21234 - RNA, 22 nt, Human
uagagcaguuggcagcuguauu

SEQ ID NO: 21235 - RNA, 22 nt, Human
uagagcauuuagaggggcagga

SEQ ID NO: 21236 - RNA, 22 nt, Human
uagagcucuccuuccucugugg

SEQ ID NO: 21237 - RNA, 22 nt, Human
uagagcugauaaugaggccaag

SEQ ID NO: 21238 - RNA, 19 nt, Human
uagagcugcuuccuggcag

SEQ ID NO: 21239 - RNA, 22 nt, Human
uagagcuggccgggacagcugg

SEQ ID NO: 21240 - RNA, 22 nt, Human
uagagcuugauuggauucaggg

SEQ ID NO: 21241 - RNA, 22 nt, Human
uagagcuuggacugcauuuucg

SEQ ID NO: 21242 - RNA, 22 nt, Human
uagaggaaccaggcaggcugag

SEQ ID NO: 21243 - RNA, 22 nt, Human
uagaggcugggaauuauuuuca

SEQ ID NO: 21244 - RNA, 22 nt, Human
uagagggaaggaagaauggauu

SEQ ID NO: 21245 - RNA, 22 nt, Human
uagagguauaccaaaaaggcau

SEQ ID NO: 21246 - RNA, 22 nt, Human
uagaggugagauauuuuauuuu

SEQ ID NO: 21247 - RNA, 22 nt, Human
uagaggugagccaucaaggggc

SEQ ID NO: 21248 - RNA, 22 nt, Human
uagagguuggccuuagaaagau

SEQ ID NO: 21249 - RNA, 22 nt, Human
uagaguauagcuaacuguauua

SEQ ID NO: 21250 - RNA, 22 nt, Human
uagaguccauuaaugcaaguuu

SEQ ID NO: 21251 - RNA, 22 nt, Human
uagauaaaagggcaaagggcau

SEQ ID NO: 21252 - RNA, 19 nt, Human
uagauaaggcauuuaaucu

SEQ ID NO: 21253 - RNA, 22 nt, Human
uagauacaggcaagauuaugaa

SEQ ID NO: 21254 - RNA, 22 nt, Human
uagauacaggcucucugagccu

SEQ ID NO: 21255 - RNA, 22 nt, Human
uagauacaguguuaagugugga

SEQ ID NO: 21256 - RNA, 22 nt, Human
uagauacaugaaauggcagaua

SEQ ID NO: 21257 - RNA, 22 nt, Human
uagauacucagaaaugcuuuca

SEQ ID NO: 21258 - RNA, 22 nt, Human
uagauacuuauaaucuuccaag

SEQ ID NO: 21259 - RNA, 23 nt, Human
uagauagcacacugacaucugac

SEQ ID NO: 21260 - RNA, 22 nt, Human
ugcuggaggaguuuacuguggc

SEQ ID NO: 21261 - RNA, 22 nt, Human
ugcuggaggauuaaacaaguca

SEQ ID NO: 21262 - RNA, 22 nt, Human
ugcuggaggcaguggaggugcc

SEQ ID NO: 21263 - RNA, 22 nt, Human
ugcuggaggccugacuguguuu

SEQ ID NO: 21264 - RNA, 20 nt, Human
ugcuggaggcgccggcgcuc

SEQ ID NO: 21265 - RNA, 17 nt, Human
ugcuggaggcgggguau

SEQ ID NO: 21266 - RNA, 22 nt, Human
ugcuggaggggccugaccagga

SEQ ID NO: 21267 - RNA, 19 nt, Human
ugcuggagguugacagggu

SEQ ID NO: 21268 - RNA, 22 nt, Human
ugcuggaguaacaagacacuca

SEQ ID NO: 21269 - RNA, 22 nt, Human
ugcuggcaccagaaugacugca

SEQ ID NO: 21270 - RNA, 22 nt, Human
ugcuggcagccaugccuuggaa

SEQ ID NO: 21271 - RNA, 20 nt, Human
ugcuggcaugcaagagggaa

SEQ ID NO: 21272 - RNA, 22 nt, Human
ugcuggccaacaaggcuccaag

SEQ ID NO: 21273 - RNA, 22 nt, Human
ugcuggccaauggcagaggcgg

SEQ ID NO: 21274 - RNA, 22 nt, Human
ugcuggcccaugaagacgcagu

SEQ ID NO: 21275 - RNA, 23 nt, Human
ugcuggcuaagaaucugcauuuu

SEQ ID NO: 21276 - RNA, 22 nt, Human
ugcuggcucaguuugcagacuc

SEQ ID NO: 21277 - RNA, 22 nt, Human
ugcuggcucccaggagccgcug

SEQ ID NO: 21278 - RNA, 22 nt, Human
ugcuggcucuaggcugagacag

SEQ ID NO: 21279 - RNA, 22 nt, Human
ugcuggcugcagugcugucaaa

SEQ ID NO: 21280 - RNA, 22 nt, Human
ugcuggcuggaucagagauugg

SEQ ID NO: 21281 - RNA, 22 nt, Human
ugcuggcuggccuggccuggac

SEQ ID NO: 21282 - RNA, 22 nt, Human
ugcuggcuguauaugugagagu

SEQ ID NO: 21283 - RNA, 22 nt, Human
ugcuggcuguguaccaucucaa

SEQ ID NO: 21284 - RNA, 23 nt, Human
ugcuggcuguguuauugccaaca

SEQ ID NO: 21285 - RNA, 22 nt, Human
ugcuggcuuccugugcacagca

SEQ ID NO: 21286 - RNA, 22 nt, Human
ugcugggcacacaguaggugcu

SEQ ID NO: 21287 - RNA, 22 nt, Human
ugcugggcaccagugccugcag

SEQ ID NO: 21288 - RNA, 22 nt, Human
ugcugggcccccagugaccuuc

SEQ ID NO: 21289 - RNA, 22 nt, Human
ugcugggcggugggcucauccc

SEQ ID NO: 21290 - RNA, 22 nt, Human
ugcugggcuagaagcugaggcc

SEQ ID NO: 21291 - RNA, 22 nt, Human
ugcugggcuucacccccacagu

SEQ ID NO: 21292 - RNA, 22 nt, Human
ugcuggggcagaagagccaaga

SEQ ID NO: 21293 - RNA, 22 nt, Human
ugcuggggguagcucugcguag

SEQ ID NO: 21294 - RNA, 22 nt, Human
ugcuggggucauggggcgcccg

SEQ ID NO: 21295 - RNA, 22 nt, Human
ugcuggguagaaguauuagucu

SEQ ID NO: 21296 - RNA, 22 nt, Human
ugcugggucccuugagagcuca

SEQ ID NO: 21297 - RNA, 22 nt, Human
ugcuggguguuccgcacuugac

SEQ ID NO: 21298 - RNA, 22 nt, Human
ugcugguaccgcgccuccgcca

SEQ ID NO: 21299 - RNA, 22 nt, Human
ugcugguggagaaaguggaggu

SEQ ID NO: 21300 - RNA, 22 nt, Human
ugcuguccugcugagggaugug

SEQ ID NO: 21301 - RNA, 22 nt, Human
ugcugucugauucagggugauu

SEQ ID NO: 21302 - RNA, 22 nt, Human
ugcugucugcaacaguacuaca

SEQ ID NO: 21303 - RNA, 22 nt, Human
uagugauucgauguggguaagu

SEQ ID NO: 21304 - RNA, 23 nt, Human
uagugauuggaaaaacuaguuuu

SEQ ID NO: 21305 - RNA, 22 nt, Human
uagugauuuagaauucaaaugu

SEQ ID NO: 21306 - RNA, 22 nt, Human
uagugauuuucauauuacauua

SEQ ID NO: 21307 - RNA, 22 nt, Human
uagugcaaaggcccugagaugg

SEQ ID NO: 21308 - RNA, 22 nt, Human
uagugcacacgcauguagcagu

SEQ ID NO: 21309 - RNA, 22 nt, Human
uagugcagaggaggagccucug

SEQ ID NO: 21310 - RNA, 22 nt, Human
uagugccaugcgagggguggga

SEQ ID NO: 21311 - RNA, 22 nt, Human
uagugcuuaaaaguggaagaga

SEQ ID NO: 21312 - RNA, 22 nt, Human
uagugcuuaacacaaagugauu

SEQ ID NO: 21313 - RNA, 22 nt, Human
uagugcuugguggagauggaga

SEQ ID NO: 21314 - RNA, 22 nt, Human
uagugcuuuauuguuccugaaa

SEQ ID NO: 21315 - RNA, 22 nt, Human
uaguggaacugugucauacaaa

SEQ ID NO: 21316 - RNA, 22 nt, Human
uaguggaggggaugcaaagcuu

SEQ ID NO: 21317 - RNA, 22 nt, Human
uaguggggccugggaggguucc

SEQ ID NO: 21318 - RNA, 22 nt, Human
uaguguaaauaacugccuagac

SEQ ID NO: 21319 - RNA, 19 nt, Human
uagugucaaggaggagggu

SEQ ID NO: 21320 - RNA, 22 nt, Human
uagugucagcaucucauugagc

SEQ ID NO: 21321 - RNA, 22 nt, Human
uagugucaggagggaaaugcaa

SEQ ID NO: 21322 - RNA, 22 nt, Human
uagugucaucguugcagcugag

SEQ ID NO: 21323 - RNA, 22 nt, Human
uagugucugauccguaguuaca

SEQ ID NO: 21324 - RNA, 22 nt, Human
uagugucuguccaucaguaacu

SEQ ID NO: 21325 - RNA, 22 nt, Human
uaguguggccccaagaggaucu

SEQ ID NO: 21326 - RNA, 22 nt, Human
uaguguuaauucaguuuauaau

SEQ ID NO: 21327 - RNA, 22 nt, Human
uaguguucuaagaacauccaug

SEQ ID NO: 21328 - RNA, 22 nt, Human
uaguguucugggcugagagggg

SEQ ID NO: 21329 - RNA, 22 nt, Human
uaguguuuucuagaaugguuuu

SEQ ID NO: 21330 - RNA, 22 nt, Human
uaguuaaagagauccacauucc

SEQ ID NO: 21331 - RNA, 22 nt, Human
uaguuaaugcuaauuaacaaau

SEQ ID NO: 21332 - RNA, 22 nt, Human
uaguuaaugugaggcaccuagu

SEQ ID NO: 21333 - RNA, 22 nt, Human
uaguuacaaaccaacaggcagc

SEQ ID NO: 21334 - RNA, 22 nt, Human
uaguuaggaauagcagcgacuc

SEQ ID NO: 21335 - RNA, 22 nt, Human
uaguuaggguucugcagagaca

SEQ ID NO: 21336 - RNA, 22 nt, Human
uaguuaugucugcaugcauauu

SEQ ID NO: 21337 - RNA, 22 nt, Human
uaguucuacagaugguuuguaa

SEQ ID NO: 21338 - RNA, 22 nt, Human
uaguucuagaccaguuaauagu

SEQ ID NO: 21339 - RNA, 22 nt, Human
uaguucuagccagugaaaugua

SEQ ID NO: 21340 - RNA, 22 nt, Human
uaguuuagccccacgugugcuu

SEQ ID NO: 21341 - RNA, 22 nt, Human
uaguuuaggaauuaugagggug

SEQ ID NO: 21342 - RNA, 22 nt, Human
uaguuuaguaagaggagagcug

SEQ ID NO: 21343 - RNA, 22 nt, Human
uaguuuauaguuagcgagcacg

SEQ ID NO: 21344 - RNA, 22 nt, Human
uaguuucagcuccuucauccug

SEQ ID NO: 21345 - RNA, 22 nt, Human
uaguuucauaugcaaaauagua

SEQ ID NO: 21346 - RNA, 22 nt, Human
uaguuucuaaagcuuccuaggu

SEQ ID NO: 21347 - RNA, 22 nt, Human
uaguuucuagucaaucuucuuu

SEQ ID NO: 21348 - RNA, 22 nt, Human
uaguuucucagggaggaaagaa

SEQ ID NO: 21349 - RNA, 22 nt, Human
uaguuuguaaugaggagaagua

SEQ ID NO: 21350 - RNA, 22 nt, Human
uaguuuuauaauguuaacaucu

SEQ ID NO: 21351 - RNA, 22 nt, Human
uaguuuuuaaguguacaauuuc

SEQ ID NO: 21352 - RNA, 22 nt, Human
uaguuuuuacugcgaguuauaa

SEQ ID NO: 21353 - RNA, 22 nt, Human
uauaaaauucucaguuuggggu

SEQ ID NO: 21354 - RNA, 18 nt, Human
uauaaacacacuuagguu

SEQ ID NO: 21355 - RNA, 22 nt, Human
uauaaagaaaugauuuccagaa

SEQ ID NO: 21356 - RNA, 22 nt, Human
uauaaagaaguguaaacaggaa

SEQ ID NO: 21357 - RNA, 22 nt, Human
uauaaagaauccagaagagaca

SEQ ID NO: 21358 - RNA, 22 nt, Human
uauaaagugugaacugugagua

SEQ ID NO: 21359 - RNA, 22 nt, Human
uauaaauuauuaggcugcuaaa

SEQ ID NO: 21360 - RNA, 21 nt, Human
uauaacacacuucagcuucuc

SEQ ID NO: 21361 - RNA, 22 nt, Human
uauaacaguuuaggugguguca

SEQ ID NO: 21362 - RNA, 18 nt, Human
uauaaccucuguuacuca

SEQ ID NO: 21363 - RNA, 22 nt, Human
uauaacuaauacuggccaugag

SEQ ID NO: 21364 - RNA, 22 nt, Human
uauaagaagugaagaagaguua

SEQ ID NO: 21365 - RNA, 22 nt, Human
uauaagaaugcuuguuuggggu

SEQ ID NO: 21366 - RNA, 22 nt, Human
uauaagauacuuggcauagugc

SEQ ID NO: 21367 - RNA, 22 nt, Human
uauaauuuuaagugguaaauua

SEQ ID NO: 21368 - RNA, 22 nt, Human
uauacacaaggugugcauuugu

SEQ ID NO: 21369 - RNA, 22 nt, Human
uauguucauagaaaucaugacc

SEQ ID NO: 21370 - RNA, 22 nt, Human
uauguucuuagaagaggcagca

SEQ ID NO: 21371 - RNA, 22 nt, Human
uauguugagugaaagaagcuag

SEQ ID NO: 21372 - RNA, 22 nt, Human
uauguuuauacuuugauguacu

SEQ ID NO: 21373 - RNA, 22 nt, Human
uauguuuuaggaauuaauuguu

SEQ ID NO: 21374 - RNA, 22 nt, Human
uauguuuuucagacguccuaca

SEQ ID NO: 21375 - RNA, 22 nt, Human
uauuaaauuauggauuuaggag

SEQ ID NO: 21376 - RNA, 22 nt, Human
uauuaauaagugacuacuagcu

SEQ ID NO: 21377 - RNA, 21 nt, Human
uauuaauaugucuaagcugau

SEQ ID NO: 21378 - RNA, 21 nt, Human
uauuaauuuuucuucccacua

SEQ ID NO: 21379 - RNA, 22 nt, Human
uauuacaagaaagggcaugaau

SEQ ID NO: 21380 - RNA, 22 nt, Human
uauuacagggcuaguuaugagu

SEQ ID NO: 21381 - RNA, 22 nt, Human
uauuacguaacuacuuaaauug

SEQ ID NO: 21382 - RNA, 22 nt, Human
uauuagaaagcuuaauaucgug

SEQ ID NO: 21383 - RNA, 22 nt, Human
uauuagcaacagagcucuuguu

SEQ ID NO: 21384 - RNA, 22 nt, Human
uauuagcagccaacuuagcugu

SEQ ID NO: 21385 - RNA, 22 nt, Human
uauuagcauauaugauucaguu

SEQ ID NO: 21386 - RNA, 22 nt, Human
uauuagcgcuuacugaguugcc

SEQ ID NO: 21387 - RNA, 22 nt, Human
uauuagcuccaguacuguugcc

SEQ ID NO: 21388 - RNA, 22 nt, Human
uauuagcuucugguuuuguucu

SEQ ID NO: 21389 - RNA, 22 nt, Human
uauuaggcauuugaggauaaac

SEQ ID NO: 21390 - RNA, 22 nt, Human
uauuaguaauaccugucucaua

SEQ ID NO: 21391 - RNA, 22 nt, Human
uauuaguagcuugaaauuggug

SEQ ID NO: 21392 - RNA, 22 nt, Human
uauuaguugcaaaacauugacu

SEQ ID NO: 21393 - RNA, 22 nt, Human
uauuauaaaauuacuggcaggg

SEQ ID NO: 21394 - RNA, 22 nt, Human
uauuauaauuuagggcuuggau

SEQ ID NO: 21395 - RNA, 22 nt, Human
uauuaucauugguaauaugguc

SEQ ID NO: 21396 - RNA, 22 nt, Human
uauuaugaucccagcccuggag

SEQ ID NO: 21397 - RNA, 22 nt, Human
uauuaugaucgugacucaagga

SEQ ID NO: 21398 - RNA, 22 nt, Human
uauuaugguuguagguuaacaa

SEQ ID NO: 21399 - RNA, 22 nt, Human
uauuauuauaguuauugggaag

SEQ ID NO: 21400 - RNA, 22 nt, Human
uauuauugcaaguauauaaagu

SEQ ID NO: 21401 - RNA, 22 nt, Human
uauucacagcugccgcacucag

SEQ ID NO: 21402 - RNA, 22 nt, Human
uauucacagguucuggggauca

SEQ ID NO: 21403 - RNA, 22 nt, Human
uauucacauucucaggccuggu

SEQ ID NO: 21404 - RNA, 22 nt, Human
uauucacuuugggagagccauu

SEQ ID NO: 21405 - RNA, 22 nt, Human
uauucagaaaacugagcgauga

SEQ ID NO: 21406 - RNA, 22 nt, Human
uauucagaaaauaaauuggauu

SEQ ID NO: 21407 - RNA, 22 nt, Human
uauucagaguguagcaaauaga

SEQ ID NO: 21408 - RNA, 22 nt, Human
uauucagugacaggguauuaug

SEQ ID NO: 21409 - RNA, 22 nt, Human
uauucauguguuggaaaggaac

SEQ ID NO: 21410 - RNA, 22 nt, Human
uauuccaacuucacuauugucu

SEQ ID NO: 21411 - RNA, 20 nt, Human
uauuccaaggguagagaaaa

SEQ ID NO: 21412 - RNA, 22 nt, Human
uauuccaagucacuguguccug

SEQ ID NO: 21413 - RNA, 22 nt, Human
uauuccaauugguuguaaagaa

SEQ ID NO: 21414 - RNA, 22 nt, Human
uauuccagguuucuuguuguau

SEQ ID NO: 21415 - RNA, 22 nt, Human
uauuccagugugaucuuuguag

SEQ ID NO: 21416 - RNA, 22 nt, Human
uauucccacccuaaguaguagg

SEQ ID NO: 21417 - RNA, 22 nt, Human
uauucccacuccucagcaauuu

SEQ ID NO: 21418 - RNA, 22 nt, Human
uauucccugauguacacuggca

SEQ ID NO: 21419 - RNA, 22 nt, Human
uauuccuaagucccaacuacau

SEQ ID NO: 21420 - RNA, 22 nt, Human
uauauuaaccauaggguucuag

SEQ ID NO: 21421 - RNA, 22 nt, Human
uauauucaacaggcuaauguca

SEQ ID NO: 21422 - RNA, 22 nt, Human
uauauucauauuguugucucuc

SEQ ID NO: 21423 - RNA, 22 nt, Human
uauauuccaguucaucucuuga

SEQ ID NO: 21424 - RNA, 22 nt, Human
uauauucugauuccaucugugu

SEQ ID NO: 21425 - RNA, 18 nt, Human
uauauucugugcccuggu

SEQ ID NO: 21426 - RNA, 22 nt, Human
uauauucuuucaccuucuuccu

SEQ ID NO: 21427 - RNA, 22 nt, Human
uauauuguaggugcuauuugaa

SEQ ID NO: 21428 - RNA, 19 nt, Human
uauauuugagugugcaugc

SEQ ID NO: 21429 - RNA, 22 nt, Human
uaucaacaaaggccuuguguuu

SEQ ID NO: 21430 - RNA, 22 nt, Human
uaucaacauuaauauuuucugg

SEQ ID NO: 21431 - RNA, 22 nt, Human
uaucaaccaacuacucguguug

SEQ ID NO: 21432 - RNA, 22 nt, Human
uaucaagugacuaucacagaac

SEQ ID NO: 21433 - RNA, 22 nt, Human
uaucaauacauguuaucagugu

SEQ ID NO: 21434 - RNA, 22 nt, Human
uaucacacgccuugcuucauuu

SEQ ID NO: 21435 - RNA, 22 nt, Human
uaucacacuguuuuaauuacuu

SEQ ID NO: 21436 - RNA, 22 nt, Human
uaucacaucaauguuuuaaaau

SEQ ID NO: 21437 - RNA, 22 nt, Human
uaucacuacacuaagauacaga

SEQ ID NO: 21438 - RNA, 19 nt, Human
uaucacugggcacugagga

SEQ ID NO: 21439 - RNA, 22 nt, Human
uaucagaaagauauuacugggg

SEQ ID NO: 21440 - RNA, 22 nt, Human
uaucagaaaucaacacacagug

SEQ ID NO: 21441 - RNA, 22 nt, Human
uaucagaaugcagccaugugca

SEQ ID NO: 21442 - RNA, 17 nt, Human
uaucagaauguguuuac

SEQ ID NO: 21443 - RNA, 22 nt, Human
uaucagaugacaucuucuaugg

SEQ ID NO: 21444 - RNA, 22 nt, Human
uaucagcaacucagagcagucu

SEQ ID NO: 21445 - RNA, 22 nt, Human
uaucagcaccgcggacagcauc

SEQ ID NO: 21446 - RNA, 22 nt, Human
uaucagcaucuccucaaagaua

SEQ ID NO: 21447 - RNA, 22 nt, Human
uaucagcgugcaaaucuuugga

SEQ ID NO: 21448 - RNA, 23 nt, Human
uaucaguaagcaucccugaaccc

SEQ ID NO: 21449 - RNA, 20 nt, Human
uaucaguaggauauucugcc

SEQ ID NO: 21450 - RNA, 23 nt, Human
uaucagugugaugaggcugcugc

SEQ ID NO: 21451 - RNA, 22 nt, Human
uaucaguuuauucuauaaauag

SEQ ID NO: 21452 - RNA, 22 nt, Human
uaucaucauuggcaggugagaa

SEQ ID NO: 21453 - RNA, 22 nt, Human
uaucaucuuguugucaugcagc

SEQ ID NO: 21454 - RNA, 22 nt, Human
uaucaugaucagcaacuaauca

SEQ ID NO: 21455 - RNA, 22 nt, Human
uaucauucuucucaccuuugaa

SEQ ID NO: 21456 - RNA, 22 nt, Human
uaucauuguguuauuucuucca

SEQ ID NO: 21457 - RNA, 22 nt, Human
uauccaaagagauucauguucu

SEQ ID NO: 21458 - RNA, 23 nt, Human
uauccaguagggcccagagcuga

SEQ ID NO: 21459 - RNA, 22 nt, Human
uauccauuauguuggcuagucu

SEQ ID NO: 21460 - RNA, 22 nt, Human
uauccauuuauuuucuaggcaa

SEQ ID NO: 21461 - RNA, 23 nt, Human
uauccuaaaggcaacaggaaguc

SEQ ID NO: 21462 - RNA, 22 nt, Human
uauccugcuuuguuccucuuga

SEQ ID NO: 21463 - RNA, 22 nt, Human
uauccuuguacuauaguauuua

SEQ ID NO: 21464 - RNA, 22 nt, Human
uaucuaaaggauuuaauuuagu

SEQ ID NO: 21465 - RNA, 20 nt, Human
uaucuaaaugcuuacauuac

SEQ ID NO: 21466 - RNA, 22 nt, Human
uaucuaagguauaugaggaauc

SEQ ID NO: 21467 - RNA, 22 nt, Human
uaucuaauaaaucugauaagua

SEQ ID NO: 21468 - RNA, 22 nt, Human
uaucuagauaccaagaagcaca

SEQ ID NO: 21469 - RNA, 22 nt, Human
uaucuagauuucuuucucugug

SEQ ID NO: 21470 - RNA, 23 nt, Human
uaucucagaggaauguaguuacu

SEQ ID NO: 21471 - RNA, 22 nt, Human
uaucucagcuggaucaguggaa

SEQ ID NO: 21472 - RNA, 17 nt, Human
uaucucuucaaguuuca

SEQ ID NO: 21473 - RNA, 22 nt, Human
uaucugagaaagaagcaccaga

SEQ ID NO: 21474 - RNA, 22 nt, Human
uaucuguagucagaauaauuuu

SEQ ID NO: 21475 - RNA, 22 nt, Human
uaucuguagucucaugguuccu

SEQ ID NO: 21476 - RNA, 22 nt, Human
uaucuguauccccaucuagcua

SEQ ID NO: 21477 - RNA, 22 nt, Human
uaucugucgggagucuuccgga

SEQ ID NO: 21478 - RNA, 22 nt, Human
ucagaauucugaccuuggguca

SEQ ID NO: 21479 - RNA, 19 nt, Human
ucagaauucugucucuuga

SEQ ID NO: 21480 - RNA, 22 nt, Human
ucagaauugauuuucaaaacag

SEQ ID NO: 21481 - RNA, 22 nt, Human
ucagaauugcagggagggcagg

SEQ ID NO: 21482 - RNA, 22 nt, Human
ucagaauuuuaaaccaaggaaa

SEQ ID NO: 21483 - RNA, 22 nt, Human
ucagaauuuuuguuacccuuga

SEQ ID NO: 21484 - RNA, 18 nt, Human
ucagacaaguuagacagg

SEQ ID NO: 21485 - RNA, 22 nt, Human
ucagacaccgucuauuuugccu

SEQ ID NO: 21486 - RNA, 22 nt, Human
ucagacaggcuggacagcuugc

SEQ ID NO: 21487 - RNA, 22 nt, Human
ucagacagucaucagagcuugu

SEQ ID NO: 21488 - RNA, 20 nt, Human
ucagacagucgcaguucugg

SEQ ID NO: 21489 - RNA, 22 nt, Human
ucagacaucucauaauguauua

SEQ ID NO: 21490 - RNA, 22 nt, Human
ucagacauggggagagagaccu

SEQ ID NO: 21491 - RNA, 22 nt, Human
ucagaccccagaaugaagccag

SEQ ID NO: 21492 - RNA, 22 nt, Human
ucagaccuggccgccuccaucc

SEQ ID NO: 21493 - RNA, 22 nt, Human
ucagaccuugucgucacuuaga

SEQ ID NO: 21494 - RNA, 22 nt, Human
ucagacugcugucccugccugg

SEQ ID NO: 21495 - RNA, 21 nt, Human
ucagacuugagcucuucuaca

SEQ ID NO: 21496 - RNA, 22 nt, Human
ucagacuugccuuuuuauaaaa

SEQ ID NO: 21497 - RNA, 22 nt, Human
ucagagaaaauggaaacuuuua

SEQ ID NO: 21498 - RNA, 22 nt, Human
ucagagaaaugaaguagggauu

SEQ ID NO: 21499 - RNA, 22 nt, Human
ucagagaagacaucauugugaa

SEQ ID NO: 21500 - RNA, 20 nt, Human
ucagagaagggacugagauu

SEQ ID NO: 21501 - RNA, 22 nt, Human
ucagagaaguaagguggggugc

SEQ ID NO: 21502 - RNA, 22 nt, Human
ucagagaauguccuucuucauu

SEQ ID NO: 21503 - RNA, 22 nt, Human
ucagagaaugugaauauuaaac

SEQ ID NO: 21504 - RNA, 22 nt, Human
ucagagaauucgauuaaaugca

SEQ ID NO: 21505 - RNA, 22 nt, Human
ucagagagccucaggcacugcc

SEQ ID NO: 21506 - RNA, 23 nt, Human
ucagagagcuguugagagcugcc

SEQ ID NO: 21507 - RNA, 22 nt, Human
ucagagaggcaauacuguuuaa

SEQ ID NO: 21508 - RNA, 23 nt, Human
ucagagaggcccccugcagagau

SEQ ID NO: 21509 - RNA, 22 nt, Human
ucagagaucuggaguacaacug

SEQ ID NO: 21510 - RNA, 22 nt, Human
ucagagcagacuuugaaggagg

SEQ ID NO: 21511 - RNA, 22 nt, Human
ucagagcagcauuuuacaggau

SEQ ID NO: 21512 - RNA, 22 nt, Human
ucagagcuaaggggagagcaaa

SEQ ID NO: 21513 - RNA, 22 nt, Human
ucagagcuccuaagggcugauu

SEQ ID NO: 21514 - RNA, 22 nt, Human
ucagagcugcccaugcaagggg

SEQ ID NO: 21515 - RNA, 22 nt, Human
ucagagcugugcuucaggaaag

SEQ ID NO: 21516 - RNA, 22 nt, Human
ucagagcuuuggagaccaggaa

SEQ ID NO: 21517 - RNA, 22 nt, Human
ucagaggaacacuguuucaugc

SEQ ID NO: 21518 - RNA, 22 nt, Human
ucagaggaaucuguacuugaaa

SEQ ID NO: 21519 - RNA, 22 nt, Human
ucagaggacagcagcuaaauaa

SEQ ID NO: 21520 - RNA, 22 nt, Human
ucagaggagaaguugggaaaau

SEQ ID NO: 21521 - RNA, 18 nt, Human
ucagaggagauaccuaaa

SEQ ID NO: 21522 - RNA, 22 nt, Human
ucagaggagaugguuaccaggg

SEQ ID NO: 21523 - RNA, 22 nt, Human
ucagaggaggcauuuaaacaga

SEQ ID NO: 21524 - RNA, 22 nt, Human
ucagaggagggacucagaccca

SEQ ID NO: 21525 - RNA, 22 nt, Human
ucagaggauugccucagcgagc

SEQ ID NO: 21526 - RNA, 19 nt, Human
ucagaggauuuggcuauga

SEQ ID NO: 21527 - RNA, 22 nt, Human
ucagaggcagcugauguucugu

SEQ ID NO: 21528 - RNA, 22 nt, Human
ucagaggccuaugucuacaacu

SEQ ID NO: 21529 - RNA, 22 nt, Human
ucagaggccugaaagaauuugg

SEQ ID NO: 21530 - RNA, 20 nt, Human
ucagaggcugccagcugggg

SEQ ID NO: 21531 - RNA, 22 nt, Human
ucagaggcuggaagagccuccu

SEQ ID NO: 21532 - RNA, 22 nt, Human
ucagaggcuucugcucaccuca

SEQ ID NO: 21533 - RNA, 22 nt, Human
ucagaggcuugaagcccaagcc

SEQ ID NO: 21534 - RNA, 17 nt, Human
ucagagggaugagcagg

SEQ ID NO: 21535 - RNA, 22 nt, Human
ucagagguaaaaacucacugua

SEQ ID NO: 21536 - RNA, 22 nt, Human
ucagagguaagggcugagagga

SEQ ID NO: 21537 - RNA, 22 nt, Human
ucagagguaguagcagaguuga

SEQ ID NO: 21538 - RNA, 22 nt, Human
ucagaggucccuagcaggagug

SEQ ID NO: 21539 - RNA, 22 nt, Human
ucagaggugagcaugugaccaa

SEQ ID NO: 21540 - RNA, 22 nt, Human
ucagagguggagauaguuggga

SEQ ID NO: 21541 - RNA, 22 nt, Human
ucagagucaacuguugccuguu

SEQ ID NO: 21542 - RNA, 22 nt, Human
ucagagucaggaaugcuugauu

SEQ ID NO: 21543 - RNA, 21 nt, Human
ucagagucucaggagcaaggg

SEQ ID NO: 21544 - RNA, 22 nt, Human
ucagagugggagaaugugccaa

SEQ ID NO: 21545 - RNA, 22 nt, Human
ucagaguguggugagaugugca

SEQ ID NO: 21546 - RNA, 21 nt, Human
ucagaguguguuacagcaagc

SEQ ID NO: 21547 - RNA, 22 nt, Human
ucagaguuggccuuucuguauu

SEQ ID NO: 21548 - RNA, 22 nt, Human
ucagaguuugaaauaauuuuua

SEQ ID NO: 21549 - RNA, 22 nt, Human
ucagauaaaggagagcuuagca

SEQ ID NO: 21550 - RNA, 22 nt, Human
ucagauaccauugaauuuguug

SEQ ID NO: 21551 - RNA, 22 nt, Human
ucagauacuagcucucagccuc

SEQ ID NO: 21552 - RNA, 22 nt, Human
ucagauauagucauuuaaauaa

SEQ ID NO: 21553 - RNA, 22 nt, Human
ucagauaugaauucauaucucu

SEQ ID NO: 21554 - RNA, 22 nt, Human
ucagaugccaacugaacaacag

SEQ ID NO: 21555 - RNA, 22 nt, Human
ucagaugccuguggggucuagg

SEQ ID NO: 21556 - RNA, 22 nt, Human
ucagaugcuagggcugagcuau

SEQ ID NO: 21557 - RNA, 22 nt, Human
ucagaugcuuagagauuagacu

SEQ ID NO: 21558 - RNA, 22 nt, Human
ucagauggaaugaugccacugc

SEQ ID NO: 21559 - RNA, 20 nt, Human
ucagauuaaauguucugucu

SEQ ID NO: 21560 - RNA, 22 nt, Human
ucagauuuaugaauauacuaug

SEQ ID NO: 21561 - RNA, 22 nt, Human
ucagauuuccuguugaagaagu

SEQ ID NO: 21562 - RNA, 22 nt, Human
ucagauuuccuugcaguuugga

SEQ ID NO: 21563 - RNA, 22 nt, Human
ucagauuucuagcguuuggcca

SEQ ID NO: 21564 - RNA, 22 nt, Human
ucagauuugaauauuccuuucg

SEQ ID NO: 21565 - RNA, 22 nt, Human
ucagauuugaugugguuuucua

SEQ ID NO: 21566 - RNA, 22 nt, Human
ucagauuuggacacaggaacuu

SEQ ID NO: 21567 - RNA, 22 nt, Human
ucagauuuugcacgagguuuug

SEQ ID NO: 21568 - RNA, 21 nt, Human
ucagcaaaauaagcaaaugga

SEQ ID NO: 21569 - RNA, 17 nt, Human
uccauuccuaaggcccu

SEQ ID NO: 21570 - RNA, 22 nt, Human
uccauucuuuugcugucuuccu

SEQ ID NO: 21571 - RNA, 22 nt, Human
uccauucuuuuuaccucucaga

SEQ ID NO: 21572 - RNA, 22 nt, Human
uccauugcucaauauagaguuu

SEQ ID NO: 21573 - RNA, 22 nt, Human
uccauuggucucugugcccagg

SEQ ID NO: 21574 - RNA, 22 nt, Human
uccauuugaaaugaaagugaua

SEQ ID NO: 21575 - RNA, 22 nt, Human
uccauuuucuugcucuagguaa

SEQ ID NO: 21576 - RNA, 22 nt, Human
uccauuuuucaugacuccucaa

SEQ ID NO: 21577 - RNA, 20 nt, Human
ucccaaaauucuacuuuauc

SEQ ID NO: 21578 - RNA, 22 nt, Human
ucccaaagaacugaauaguaau

SEQ ID NO: 21579 - RNA, 22 nt, Human
ucccaaagcuacucuucugacu

SEQ ID NO: 21580 - RNA, 22 nt, Human
ucccaagagacagaaugguauc

SEQ ID NO: 21581 - RNA, 22 nt, Human
ucccaagagcuacucaauggaa

SEQ ID NO: 21582 - RNA, 22 nt, Human
ucccaagagcucugggauaagg

SEQ ID NO: 21583 - RNA, 22 nt, Human
ucccaaggcacagggcagggac

SEQ ID NO: 21584 - RNA, 20 nt, Human
ucccaagggcugagaggauc

SEQ ID NO: 21585 - RNA, 22 nt, Human
ucccaaguagaugggaauacag

SEQ ID NO: 21586 - RNA, 22 nt, Human
ucccaagugucuuggaccaggg

SEQ ID NO: 21587 - RNA, 22 nt, Human
ucagggcaucaucaugaauaua

SEQ ID NO: 21588 - RNA, 22 nt, Human
ucagggcaucucuuaaguggug

SEQ ID NO: 21589 - RNA, 22 nt, Human
ucagggcauguauguuucuuua

SEQ ID NO: 21590 - RNA, 22 nt, Human
ucagggcccagagcucaggcaa

SEQ ID NO: 21591 - RNA, 22 nt, Human
ucagggcccagucugugcaucu

SEQ ID NO: 21592 - RNA, 22 nt, Human
ucagggcucagugggauagguc

SEQ ID NO: 21593 - RNA, 22 nt, Human
ucagggcuccggaaguggccuc

SEQ ID NO: 21594 - RNA, 22 nt, Human
ucagggcugccgggcagaccgu

SEQ ID NO: 21595 - RNA, 22 nt, Human
ucaggggcagccggggaagcca

SEQ ID NO: 21596 - RNA, 22 nt, Human
ucagggugaaccaggcaggaau

SEQ ID NO: 21597 - RNA, 22 nt, Human
ucaggguucuuucaguuaaguu

SEQ ID NO: 21598 - RNA, 22 nt, Human
ucaggguugugaaggaaagggg

SEQ ID NO: 21599 - RNA, 22 nt, Human
ucagguaaguguaauauauaga

SEQ ID NO: 21600 - RNA, 20 nt, Human
ucagguagaucuuugagguc

SEQ ID NO: 21601 - RNA, 22 nt, Human
ucagguagugguuaaguucugu

SEQ ID NO: 21602 - RNA, 22 nt, Human
ucagguccccaacucuucucac

SEQ ID NO: 21603 - RNA, 22 nt, Human
ucaggucuauagaagaggaggg

SEQ ID NO: 21604 - RNA, 22 nt, Human
ucaggucuuuugucuccuagaa

SEQ ID NO: 21605 - RNA, 22 nt, Human
ucagguggcugguugcuggcua

SEQ ID NO: 21606 - RNA, 22 nt, Human
ucagguguagguuguucaguuu

SEQ ID NO: 21607 - RNA, 22 nt, Human
ucagguguguggcucuggacca

SEQ ID NO: 21608 - RNA, 22 nt, Human
ucagguguuagaagaaauuuca

SEQ ID NO: 21609 - RNA, 22 nt, Human
ucagguucagacuagucccagu

SEQ ID NO: 21610 - RNA, 22 nt, Human
ucagguucuggugagggcccuu

SEQ ID NO: 21611 - RNA, 22 nt, Human
ucaguaaaugcuugcaggccga

SEQ ID NO: 21612 - RNA, 22 nt, Human
ucaguaauuaccuaugacucga

SEQ ID NO: 21613 - RNA, 22 nt, Human
ucaguacuugcauccucuccuu

SEQ ID NO: 21614 - RNA, 23 nt, Human
ucaguagugcauugaauaagugc

SEQ ID NO: 21615 - RNA, 22 nt, Human
ucaguaguucagcaaauauuuu

SEQ ID NO: 21616 - RNA, 22 nt, Human
ucaguaguuuuaagucuguuaa

SEQ ID NO: 21617 - RNA, 22 nt, Human
ucaguauagcuaaaaguuuguc

SEQ ID NO: 21618 - RNA, 19 nt, Human
ucaguauauaauuacacca

SEQ ID NO: 21619 - RNA, 22 nt, Human
ucaguauccacaaaugcucaaa

SEQ ID NO: 21620 - RNA, 22 nt, Human
ucaguauuucuaaacauuggcu

SEQ ID NO: 21621 - RNA, 22 nt, Human
ucagucacacucacugagguag

SEQ ID NO: 21622 - RNA, 22 nt, Human
ucagucaggagaugccagagau

SEQ ID NO: 21623 - RNA, 22 nt, Human
ucagucauaguuuggagagaau

SEQ ID NO: 21624 - RNA, 23 nt, Human
ucagucccaacagcuucuccugg

SEQ ID NO: 21625 - RNA, 22 nt, Human
ucaguccuacacgcucagggac

SEQ ID NO: 21626 - RNA, 22 nt, Human
ucaguccuccucucauagagag

SEQ ID NO: 21627 - RNA, 22 nt, Human
ucaguccuuggcauuuaggagc

SEQ ID NO: 21628 - RNA, 19 nt, Human
ucagucuaggaaugagcua

SEQ ID NO: 21629 - RNA, 18 nt, Human
ucagucuauuguauaaga

SEQ ID NO: 21630 - RNA, 23 nt, Human
ucagucuuggcuucugauuuucc

SEQ ID NO: 21631 - RNA, 22 nt, Human
ucagugacaacuaugaauauuu

SEQ ID NO: 21632 - RNA, 21 nt, Human
ucagugacaggugcugaccuc

SEQ ID NO: 21633 - RNA, 22 nt, Human
ucagugaucuaaggguauggcc

SEQ ID NO: 21634 - RNA, 22 nt, Human
ucagugauuucuggggugaggg

SEQ ID NO: 21635 - RNA, 20 nt, Human
ucagugauuuugaagaggaa

SEQ ID NO: 21636 - RNA, 21 nt, Human
ucagugcaauucuauggggaa

SEQ ID NO: 21637 - RNA, 22 nt, Human
ucagugcagacuguaaguugga

SEQ ID NO: 21638 - RNA, 20 nt, Human
ucagugcagauuguccaagu

SEQ ID NO: 21639 - RNA, 22 nt, Human
ucagugcagcggcagcagcucu

SEQ ID NO: 21640 - RNA, 22 nt, Human
ucagugccuacuuugaucaauu

SEQ ID NO: 21641 - RNA, 22 nt, Human
ucagugcucugagguccagggu

SEQ ID NO: 21642 - RNA, 22 nt, Human
ucagugcuguaaacaaaaggaa

SEQ ID NO: 21643 - RNA, 22 nt, Human
ucagugcuguguaaauguauua

SEQ ID NO: 21644 - RNA, 22 nt, Human
ucagugcuucggcgagcaccua

SEQ ID NO: 21645 - RNA, 22 nt, Human
ucagugcuugccucuggaggag

SEQ ID NO: 21646 - RNA, 23 nt, Human
ucagugcuugggggugacgcgcc

SEQ ID NO: 21647 - RNA, 22 nt, Human
ucagugcuuuugucacaugguc

SEQ ID NO: 21648 - RNA, 19 nt, Human
ucaguggagaaaggggaag

SEQ ID NO: 21649 - RNA, 22 nt, Human
ucaguggauauuucuguggcug

SEQ ID NO: 21650 - RNA, 22 nt, Human
ucagugguggaagcagcaaacc

SEQ ID NO: 21651 - RNA, 22 nt, Human
ucagugguuaaguucuguccac

SEQ ID NO: 21652 - RNA, 22 nt, Human
ucaguguauggagugcuggauu

SEQ ID NO: 21653 - RNA, 22 nt, Human
ucagugucagucuuuuagauau

SEQ ID NO: 21654 - RNA, 22 nt, Human
ucaguguccaaaaagaggcaag

SEQ ID NO: 21655 - RNA, 22 nt, Human
ucagugucccgucucuuaacuc

SEQ ID NO: 21656 - RNA, 22 nt, Human
ucagugucuagggacaguaauc

SEQ ID NO: 21657 - RNA, 23 nt, Human
ucagugucuaguuguggaauuga

SEQ ID NO: 21658 - RNA, 22 nt, Human
ucagugugaauucauuuuagau

SEQ ID NO: 21659 - RNA, 22 nt, Human
ucaguguggaaaauccuuuggc

SEQ ID NO: 21660 - RNA, 22 nt, Human
ucaguguguaguaaauuguagg

SEQ ID NO: 21661 - RNA, 22 nt, Human
ucagugugucucugcauuuggg

SEQ ID NO: 21662 - RNA, 22 nt, Human
ucaguguguucaauuggauagg

SEQ ID NO: 21663 - RNA, 22 nt, Human
ucaguguucagggaccaggucc

SEQ ID NO: 21664 - RNA, 16 nt, Human
ucaguguuccagaaua

SEQ ID NO: 21665 - RNA, 22 nt, Human
ucaguguugaauuuuuugcaaa

SEQ ID NO: 21666 - RNA, 22 nt, Human
ucaguguuuauucaauguuauu

SEQ ID NO: 21667 - RNA, 22 nt, Human
ucaguguuuauugcggugugua

SEQ ID NO: 21668 - RNA, 22 nt, Human
ucaguguuucaguuuggaaaug

SEQ ID NO: 21669 - RNA, 22 nt, Human
ucaguguuuguggcaaauguua

SEQ ID NO: 21670 - RNA, 22 nt, Human
ucaguguuuuaacugucuuuua

SEQ ID NO: 21671 - RNA, 22 nt, Human
ucaguguuuuuaaagcaauaua

SEQ ID NO: 21672 - RNA, 22 nt, Human
ucaguuaauggauucugucaga

SEQ ID NO: 21673 - RNA, 22 nt, Human
ucaguuagauugccuccuuaga

SEQ ID NO: 21674 - RNA, 22 nt, Human
ucaguucuaacaguuuagaaca

SEQ ID NO: 21675 - RNA, 22 nt, Human
ucaguucugaaguucugccucc

SEQ ID NO: 21676 - RNA, 22 nt, Human
ucaguucuggcugcugcuguca

SEQ ID NO: 21677 - RNA, 22 nt, Human
ucaguucuuaguaaugcagucu

SEQ ID NO: 21678 - RNA, 22 nt, Human
ucaguucuuuauuucacaguga

SEQ ID NO: 21679 - RNA, 22 nt, Human
ucaguugcauauuuuguguucu

SEQ ID NO: 21680 - RNA, 22 nt, Human
ucaguugccaguauuuuauaua

SEQ ID NO: 21681 - RNA, 22 nt, Human
ucaguugccuccauagucaucc

SEQ ID NO: 21682 - RNA, 22 nt, Human
ucaguugcuaugagaaauaaau

SEQ ID NO: 21683 - RNA, 20 nt, Human
ucaguuuaaauccuggcuuu

SEQ ID NO: 21684 - RNA, 22 nt, Human
ucaguuuaagaugacuaacaau

SEQ ID NO: 21685 - RNA, 22 nt, Human
ucaguuuauaaauuguauuuag

SEQ ID NO: 21686 - RNA, 22 nt, Human
ucaguuuauggucuaguucaug

SEQ ID NO: 21687 - RNA, 22 nt, Human
uggcccugcuggccaaaggcua

SEQ ID NO: 21688 - RNA, 22 nt, Human
uggcccugcuguaucaucugcu

SEQ ID NO: 21689 - RNA, 22 nt, Human
uggcccugggcagaggcaacau

SEQ ID NO: 21690 - RNA, 22 nt, Human
uggcccugucccuggagccugg

SEQ ID NO: 21691 - RNA, 22 nt, Human
uggcccuguguccugcugccag

SEQ ID NO: 21692 - RNA, 22 nt, Human
uggcccugugugcaggcugcac

SEQ ID NO: 21693 - RNA, 20 nt, Human
uggcccuguuuucuccaggc

SEQ ID NO: 21694 - RNA, 22 nt, Human
uggcccuucaaauucccuaguc

SEQ ID NO: 21695 - RNA, 22 nt, Human
uggcccuucugagcacagggcc

SEQ ID NO: 21696 - RNA, 22 nt, Human
ucccaagagggguuauuaugcc

SEQ ID NO: 21697 - RNA, 22 nt, Human
ucccaagauacgcuguaagaag

SEQ ID NO: 21698 - RNA, 22 nt, Human
ucccaagaugacacaguggacg

SEQ ID NO: 21699 - RNA, 19 nt, Human
ucccaagauuucuguauca

SEQ ID NO: 21700 - RNA, 22 nt, Human
ucccaagcaaugagucagggcc

SEQ ID NO: 21701 - RNA, 22 nt, Human
ucccaaggauaagagagucuga

SEQ ID NO: 21702 - RNA, 20 nt, Human
ucccaaggaugccugggugu

SEQ ID NO: 21703 - RNA, 22 nt, Human
ucccaaggccaggcaucuagaa

SEQ ID NO: 21704 - RNA, 22 nt, Human
ucccaauuaacagguaucaggc

SEQ ID NO: 21705 - RNA, 22 nt, Human
ucccacacuacacgguuguugg

SEQ ID NO: 21706 - RNA, 22 nt, Human
ucccacacuugaaacaaggcug

SEQ ID NO: 21707 - RNA, 22 nt, Human
ucccacagaccaugaguggaag

SEQ ID NO: 21708 - RNA, 22 nt, Human
ucccacagaguggcucaccuag

SEQ ID NO: 21709 - RNA, 21 nt, Human
ucccacagcgccagcuccugu

SEQ ID NO: 21710 - RNA, 22 nt, Human
ucccacaggaaaguagacauug

SEQ ID NO: 21711 - RNA, 22 nt, Human
ucccacaggaggaguuggaaau

SEQ ID NO: 21712 - RNA, 22 nt, Human
ucccacaggcccagggcggaaa

SEQ ID NO: 21713 - RNA, 22 nt, Human
ucccacagugguacagcccuga

SEQ ID NO: 21714 - RNA, 22 nt, Human
ucccacaugugaauccucaggu

SEQ ID NO: 21715 - RNA, 22 nt, Human
ucccacuauuauccuauguggg

SEQ ID NO: 21716 - RNA, 22 nt, Human
ucccacucacugucucugacac

SEQ ID NO: 21717 - RNA, 21 nt, Human
ucccacugccacagcuucagg

SEQ ID NO: 21718 - RNA, 22 nt, Human
ucccacugucuucucgugcucg

SEQ ID NO: 21719 - RNA, 22 nt, Human
ucccacuuaacugugacuucuc

SEQ ID NO: 21720 - RNA, 22 nt, Human
ucccagaacccugccagguccu

SEQ ID NO: 21721 - RNA, 22 nt, Human
ucccagaaucuccagugcuaca

SEQ ID NO: 21722 - RNA, 22 nt, Human
ucccagagaagagcuggaugga

SEQ ID NO: 21723 - RNA, 22 nt, Human
ucccagagccucugccacucug

SEQ ID NO: 21724 - RNA, 22 nt, Human
ucccagagcucugacaccagcu

SEQ ID NO: 21725 - RNA, 22 nt, Human
ucccagagguugagucacuuau

SEQ ID NO: 21726 - RNA, 22 nt, Human
uggucugaaugacuuguuaguu

SEQ ID NO: 21727 - RNA, 22 nt, Human
uggucugagcggggccauucag

SEQ ID NO: 21728 - RNA, 22 nt, Human
uggucugaggaacaccagcacu

SEQ ID NO: 21729 - RNA, 22 nt, Human
uggucugauuuuucaucuguug

SEQ ID NO: 21730 - RNA, 22 nt, Human
uggugaauaguagcuucagacu

SEQ ID NO: 21731 - RNA, 22 nt, Human
uggugacagcauggaagaagug

SEQ ID NO: 21732 - RNA, 22 nt, Human
uggugagaauugguuggauuua

SEQ ID NO: 21733 - RNA, 22 nt, Human
uggugagacaggaucaaccccu

SEQ ID NO: 21734 - RNA, 22 nt, Human
uggugagauaacuuucggcaag

SEQ ID NO: 21735 - RNA, 22 nt, Human
uggugagauguauggaggguug

SEQ ID NO: 21736 - RNA, 22 nt, Human
uggugagcucuuuagacuggga

SEQ ID NO: 21737 - RNA, 22 nt, Human
uggugcaauauuaugaaaggua

SEQ ID NO: 21738 - RNA, 22 nt, Human
uggugcaguagaaggccgacuu

SEQ ID NO: 21739 - RNA, 22 nt, Human
uggugcaguagagcugucuggg

SEQ ID NO: 21740 - RNA, 22 nt, Human
uggugccacaagaauacaaagc

SEQ ID NO: 21741 - RNA, 22 nt, Human
uggugcugacaguucugagugc

SEQ ID NO: 21742 - RNA, 22 nt, Human
uggugcugcaggugggcacagu

SEQ ID NO: 21743 - RNA, 22 nt, Human
uggugcugugauacgaggcacu

SEQ ID NO: 21744 - RNA, 22 nt, Human
ugguggaaggcagagcuacacc

SEQ ID NO: 21745 - RNA, 22 nt, Human
ugguggacaccgcagccaugaa

SEQ ID NO: 21746 - RNA, 22 nt, Human
ugguggacauucuggaugugcu

SEQ ID NO: 21747 - RNA, 20 nt, Human
ugguggacuuuggcauggcu

SEQ ID NO: 21748 - RNA, 22 nt, Human
ugguggagaccucgcuaacccc

SEQ ID NO: 21749 - RNA, 22 nt, Human
ugguggagagacaguguauugg

SEQ ID NO: 21750 - RNA, 22 nt, Human
ugguggagccuaggcuaagucu

SEQ ID NO: 21751 - RNA, 22 nt, Human
ugguggagcuguggccacgacc

SEQ ID NO: 21752 - RNA, 19 nt, Human
ugguggaggccccauguuc

SEQ ID NO: 21753 - RNA, 19 nt, Human
ugguggaggugcaccugac

SEQ ID NO: 21754 - RNA, 21 nt, Human
ugguggagugugcugagcaug

SEQ ID NO: 21755 - RNA, 22 nt, Human
ugguggaguuucucuuucaaac

SEQ ID NO: 21756 - RNA, 19 nt, Human
ugguggcaaugucagcuaa

SEQ ID NO: 21757 - RNA, 22 nt, Human
ugguggcacaagggagagaauc

SEQ ID NO: 21758 - RNA, 23 nt, Human
ugguggcagaaguagcagaugac

SEQ ID NO: 21759 - RNA, 22 nt, Human
ugguggcagcugagugucaggu

SEQ ID NO: 21760 - RNA, 22 nt, Human
ugguggcagucuccuggcugug

SEQ ID NO: 21761 - RNA, 22 nt, Human
ugguggcaucagugaaguacac

SEQ ID NO: 21762 - RNA, 17 nt, Human
ugguggcuggagucagg

SEQ ID NO: 21763 - RNA, 22 nt, Human
ugguggcuguaagggagagaag

SEQ ID NO: 21764 - RNA, 23 nt, Human
ugguggcuugugguggccaccag

SEQ ID NO: 21765 - RNA, 22 nt, Human
uggugggagugacguugccuuc

SEQ ID NO: 21766 - RNA, 22 nt, Human
ugguggggcuuuccuucugcuu

SEQ ID NO: 21767 - RNA, 22 nt, Human
uggugggggaggcugucuagca

SEQ ID NO: 21768 - RNA, 23 nt, Human
ugguggggucuuggagacagcac

SEQ ID NO: 21769 - RNA, 22 nt, Human
uggugggucggcugggagagcu

SEQ ID NO: 21770 - RNA, 22 nt, Human
ugguggucauagcagaggccgu

SEQ ID NO: 21771 - RNA, 22 nt, Human
uggugucugcacucccuggcgu

SEQ ID NO: 21772 - RNA, 22 nt, Human
ugguguugaaccucagcagggg

SEQ ID NO: 21773 - RNA, 22 nt, Human
ugguguuggagaugguugcauu

SEQ ID NO: 21774 - RNA, 22 nt, Human
ugguuagaugaggcugguuuca

SEQ ID NO: 21775 - RNA, 22 nt, Human
ugguuagucaguaccugagugu

SEQ ID NO: 21776 - RNA, 22 nt, Human
ugguuauaaauugcuaugcaga

SEQ ID NO: 21777 - RNA, 23 nt, Human
ugguucaagugagaaguaauguu

SEQ ID NO: 21778 - RNA, 22 nt, Human
ugguucagagaguugcugacca

SEQ ID NO: 21779 - RNA, 22 nt, Human
ugguucauaauuugcacuacug

SEQ ID NO: 21780 - RNA, 17 nt, Human
ugguuccaaccauacgc

SEQ ID NO: 21781 - RNA, 19 nt, Human
ugguucuccuuccacaguc

SEQ ID NO: 21782 - RNA, 22 nt, Human
ugguugaaaaacauuggcuuuu

SEQ ID NO: 21783 - RNA, 22 nt, Human
ugguugaacaaguuggguauau

SEQ ID NO: 21784 - RNA, 20 nt, Human
ugguugaauuuuuagugacc

SEQ ID NO: 21785 - RNA, 22 nt, Human
ugguugccucucagagauuccg

SEQ ID NO: 21786 - RNA, 22 nt, Human
ugguuggauggcucuuguggcu

SEQ ID NO: 21787 - RNA, 22 nt, Human
ugguugugcugaguuuagugca

SEQ ID NO: 21788 - RNA, 22 nt, Human
ugguugugucacuuagauuaga

SEQ ID NO: 21789 - RNA, 22 nt, Human
ugguuuaugcuguugcagcucu

SEQ ID NO: 21790 - RNA, 21 nt, Human
ugguuuauuucacucagcaua

SEQ ID NO: 21791 - RNA, 22 nt, Human
ugguuuauuucucugaaagguu

SEQ ID NO: 21792 - RNA, 22 nt, Human
ugguuucacacugcauggugua

SEQ ID NO: 21793 - RNA, 21 nt, Human
ugguuucuaagcugucagucu

SEQ ID NO: 21794 - RNA, 22 nt, Human
ugguuucucagacucuuugcag

SEQ ID NO: 21795 - RNA, 22 nt, Human
ugguuucugcccucagagcuca

SEQ ID NO: 21796 - RNA, 22 nt, Human
ugguuucuuuccacucuccacc

SEQ ID NO: 21797 - RNA, 22 nt, Human
ugguuugcccacucgagugauu

SEQ ID NO: 21798 - RNA, 21 nt, Human
ugguuugcggccaaaguuaaa

SEQ ID NO: 21799 - RNA, 22 nt, Human
ugguuuggguaguuauuauuau

SEQ ID NO: 21800 - RNA, 18 nt, Human
ugguuugucaugagaauu

SEQ ID NO: 21801 - RNA, 22 nt, Human
ugguuuguuuguucauguaaaa

SEQ ID NO: 21802 - RNA, 22 nt, Human
ugguuuuugguuuaacacuaug

SEQ ID NO: 21803 - RNA, 22 nt, Human
uguaaaaagcccagccgcugag

SEQ ID NO: 21804 - RNA, 22 nt, Human
uguaaaacaaaauuuguggaga

SEQ ID NO: 21805 - RNA, 22 nt, Human
ucccugcaggugggguggccag

SEQ ID NO: 21806 - RNA, 22 nt, Human
ucccugcauuugggagaguguc

SEQ ID NO: 21807 - RNA, 22 nt, Human
ucccugcugcacucacaccuac

SEQ ID NO: 21808 - RNA, 22 nt, Human
ucccugcuugcucucagcccuu

SEQ ID NO: 21809 - RNA, 22 nt, Human
ucccugcuuucuugugagggga

SEQ ID NO: 21810 - RNA, 22 nt, Human
ucccuggagauaacuucuggga

SEQ ID NO: 21811 - RNA, 22 nt, Human
ucccuggcacaagaaggcuguc

SEQ ID NO: 21812 - RNA, 22 nt, Human
ucccuggcacugcugugauuag

SEQ ID NO: 21813 - RNA, 22 nt, Human
ucccuggcagcuguccuuucag

SEQ ID NO: 21814 - RNA, 22 nt, Human
ucccuggcugguguagagggau

SEQ ID NO: 21815 - RNA, 22 nt, Human
ucccugggaauuaauauuugga

SEQ ID NO: 21816 - RNA, 22 nt, Human
ucccugggcaaguuuacucuuc

SEQ ID NO: 21817 - RNA, 22 nt, Human
ucccugggcaucacguugcuuc

SEQ ID NO: 21818 - RNA, 22 nt, Human
ucccugggcggacauucuccca

SEQ ID NO: 21819 - RNA, 22 nt, Human
ucccuggggaagggcaagcaag

SEQ ID NO: 21820 - RNA, 22 nt, Human
ucccugggguaucgcugaggca

SEQ ID NO: 21821 - RNA, 22 nt, Human
ucccuggguccugcuugcucuc

SEQ ID NO: 21822 - RNA, 22 nt, Human
ucccuggguuaccuuucaaggu

SEQ ID NO: 21823 - RNA, 22 nt, Human
ucccuguacacuaacuugagac

SEQ ID NO: 21824 - RNA, 22 nt, Human
ucccuguacuuacacagcgucc

SEQ ID NO: 21825 - RNA, 22 nt, Human
ucccuguccugggcaaucccag

SEQ ID NO: 21826 - RNA, 22 nt, Human
ucccuguggaagacugccagag

SEQ ID NO: 21827 - RNA, 22 nt, Human
ucccugugggcagaggcugccu

SEQ ID NO: 21828 - RNA, 23 nt, Human
ucccuguguacagccugcaugag

SEQ ID NO: 21829 - RNA, 22 nt, Human
ucccuguguccaugccaggagg

SEQ ID NO: 21830 - RNA, 22 nt, Human
ucccugugucuuccucuugccc

SEQ ID NO: 21831 - RNA, 22 nt, Human
ucccuguguguauauaaacggu

SEQ ID NO: 21832 - RNA, 22 nt, Human
ucccuguuuuauauccuaacaa

SEQ ID NO: 21833 - RNA, 22 nt, Human
ucccuuaaaacucauguguugu

SEQ ID NO: 21834 - RNA, 22 nt, Human
ucccuuagggcugggugggugu

SEQ ID NO: 21835 - RNA, 19 nt, Human
ucccuucuauaguaauaaa

SEQ ID NO: 21836 - RNA, 21 nt, Human
ucccuugggaaacuuucuuga

SEQ ID NO: 21837 - RNA, 22 nt, Human
ucccuugguaauucuguuccuu

SEQ ID NO: 21838 - RNA, 22 nt, Human
ucccuuucacuuaacuagccca

SEQ ID NO: 21839 - RNA, 18 nt, Human
uccgaggcaccauaaaaa

SEQ ID NO: 21840 - RNA, 22 nt, Human
uccgaguugaaguaggauagcg

SEQ ID NO: 21841 - RNA, 22 nt, Human
uccggcagcagcucugaaggag

SEQ ID NO: 21842 - RNA, 22 nt, Human
uccgggcaacugaagggagguu

SEQ ID NO: 21843 - RNA, 22 nt, Human
uguaaguuuugugaaacaaaca

SEQ ID NO: 21844 - RNA, 21 nt, Human
uguaaucuaaagaagcucuuu

SEQ ID NO: 21845 - RNA, 22 nt, Human
uguaauggaaaaacauuagcau

SEQ ID NO: 21846 - RNA, 22 nt, Human
uguaauggagcuuagaguuauc

SEQ ID NO: 21847 - RNA, 22 nt, Human
uguaauucauucaacugaagaa

SEQ ID NO: 21848 - RNA, 22 nt, Human
uguacaaaacaagaugggggua

SEQ ID NO: 21849 - RNA, 22 nt, Human
uguacaagaauaauuuuauaua

SEQ ID NO: 21850 - RNA, 22 nt, Human
uguacaagcaaauagaccuuca

SEQ ID NO: 21851 - RNA, 19 nt, Human
uguacaaggauuaugcagg

SEQ ID NO: 21852 - RNA, 23 nt, Human
uguacaaguacgaccucucccuc

SEQ ID NO: 21853 - RNA, 22 nt, Human
uguacaauagcuauuaucucca

SEQ ID NO: 21854 - RNA, 22 nt, Human
uguacaaucuuggucccuuuau

SEQ ID NO: 21855 - RNA, 22 nt, Human
uguacaaugcugagguuugggg

SEQ ID NO: 21856 - RNA, 22 nt, Human
uguacaauguggccaguguuaa

SEQ ID NO: 21857 - RNA, 22 nt, Human
uguacacaugcccacuugaagc

SEQ ID NO: 21858 - RNA, 22 nt, Human
uguacacguggccaucuuuaca

SEQ ID NO: 21859 - RNA, 22 nt, Human
uguacagaaggcacuaagguca

SEQ ID NO: 21860 - RNA, 22 nt, Human
uguacagagguguacauaugau

SEQ ID NO: 21861 - RNA, 22 nt, Human
uguacagauaaagacuguaaau

SEQ ID NO: 21862 - RNA, 22 nt, Human
uguacagcugccuuuuuuacuu

SEQ ID NO: 21863 - RNA, 22 nt, Human
uguacaguaggaacuuguuauu

SEQ ID NO: 21864 - RNA, 22 nt, Human
uguacaguauauuucaaagcca

SEQ ID NO: 21865 - RNA, 22 nt, Human
uguacaguauugguguuaguag

SEQ ID NO: 21866 - RNA, 22 nt, Human
uguacagucugcagcuugcugu

SEQ ID NO: 21867 - RNA, 22 nt, Human
uguacaguguagucaugagguu

SEQ ID NO: 21868 - RNA, 18 nt, Human
uguacaguuaugagcauu

SEQ ID NO: 21869 - RNA, 23 nt, Human
uguacaguuguuugacucagcuc

SEQ ID NO: 21870 - RNA, 22 nt, Human
uguacauacauagauauacaca

SEQ ID NO: 21871 - RNA, 22 nt, Human
uguacauagaaaggauacagcu

SEQ ID NO: 21872 - RNA, 19 nt, Human
uguacauauagagcucagu

SEQ ID NO: 21873 - RNA, 22 nt, Human
uguacaugacagagagagccaa

SEQ ID NO: 21874 - RNA, 22 nt, Human
uguacauuuagagcucaauaga

SEQ ID NO: 21875 - RNA, 22 nt, Human
uguaccaggaggaggacaaauu

SEQ ID NO: 21876 - RNA, 22 nt, Human
uguaccaguguugagaaugaga

SEQ ID NO: 21877 - RNA, 20 nt, Human
uguaccauaaugacuggcuc

SEQ ID NO: 21878 - RNA, 22 nt, Human
uguaccaucucagcauucagga

SEQ ID NO: 21879 - RNA, 22 nt, Human
uguaccaugcgacgccucucac

SEQ ID NO: 21880 - RNA, 19 nt, Human
uguacguguggguguuuaa

SEQ ID NO: 21881 - RNA, 22 nt, Human
uguacuauuaagaggccuaaau

SEQ ID NO: 21882 - RNA, 22 nt, Human
uguacuguaugccaggcacuau

SEQ ID NO: 21883 - RNA, 22 nt, Human
uguagaaaauuggagcauucau

SEQ ID NO: 21884 - RNA, 22 nt, Human
uguagaaauuaguaagaucaac

SEQ ID NO: 21885 - RNA, 22 nt, Human
uguagaacugacauuuuggacu

SEQ ID NO: 21886 - RNA, 22 nt, Human
uguagaaguaggagucaucuca

SEQ ID NO: 21887 - RNA, 18 nt, Human
uguagagccagguuugcc

SEQ ID NO: 21888 - RNA, 22 nt, Human
uguagauguagacacaggucua

SEQ ID NO: 21889 - RNA, 22 nt, Human
uguagcaccagucaccagccca

SEQ ID NO: 21890 - RNA, 22 nt, Human
uguagcagucugggggaauuac

SEQ ID NO: 21891 - RNA, 19 nt, Human
uguagcaguuuaaaacaac

SEQ ID NO: 21892 - RNA, 22 nt, Human
uguagcauguaaauugguuauu

SEQ ID NO: 21893 - RNA, 20 nt, Human
uguagccagccucucaaugc

SEQ ID NO: 21894 - RNA, 22 nt, Human
uguagcucuccagccagcaagg

SEQ ID NO: 21895 - RNA, 23 nt, Human
uguaggcuguaguuuguaggucc

SEQ ID NO: 21896 - RNA, 22 nt, Human
uguagggacugaggcuggagag

SEQ ID NO: 21897 - RNA, 22 nt, Human
uguagggagaagagaggcaccu

SEQ ID NO: 21898 - RNA, 22 nt, Human
uguagggaggaaagggcucuug

SEQ ID NO: 21899 - RNA, 22 nt, Human
uguagggaggaaggguuggaaa

SEQ ID NO: 21900 - RNA, 23 nt, Human
uguaggucugccuuaucugcugc

SEQ ID NO: 21901 - RNA, 22 nt, Human
uguagugaggaaagacugguug

SEQ ID NO: 21902 - RNA, 22 nt, Human
uguauaaacuuaagcaggaacc

SEQ ID NO: 21903 - RNA, 22 nt, Human
uguauaaguguguagaguaaga

SEQ ID NO: 21904 - RNA, 22 nt, Human
uguauacaauucacacuuccca

SEQ ID NO: 21905 - RNA, 21 nt, Human
uguauacacguguugaaaaca

SEQ ID NO: 21906 - RNA, 22 nt, Human
uguauacaugucugugugcaca

SEQ ID NO: 21907 - RNA, 22 nt, Human
uguauacauucucuuggguuug

SEQ ID NO: 21908 - RNA, 22 nt, Human
uguauagaguuggaagaugacu

SEQ ID NO: 21909 - RNA, 22 nt, Human
uguauagaugaggaagcuguua

SEQ ID NO: 21910 - RNA, 22 nt, Human
uguauaguguggaaagaacagu

SEQ ID NO: 21911 - RNA, 22 nt, Human
uguauaguugagucaaguuuca

SEQ ID NO: 21912 - RNA, 22 nt, Human
uguauauguuuguauguacaca

SEQ ID NO: 21913 - RNA, 22 nt, Human
uguaucaaggguuuauguaagc

SEQ ID NO: 21914 - RNA, 22 nt, Human
cacauggguggauggaugcaug

SEQ ID NO: 21915 - RNA, 22 nt, Human
cacaugugcaguuacaugaauu

SEQ ID NO: 21916 - RNA, 22 nt, Human
cacauguguauaugugaggggg

SEQ ID NO: 21917 - RNA, 22 nt, Human
cacaugugugcugaggacugug

SEQ ID NO: 21918 - RNA, 22 nt, Human
cacauguuucaggccauauuug

SEQ ID NO: 21919 - RNA, 20 nt, Human
cacauuaaggaaaacaacug

SEQ ID NO: 21920 - RNA, 22 nt, Human
cacauucaauuacacagauagg

SEQ ID NO: 21921 - RNA, 22 nt, Human
cacauucagcucauuaaugguc

SEQ ID NO: 21922 - RNA, 22 nt, Human
cacauucagggcagaccacuca

SEQ ID NO: 21923 - RNA, 22 nt, Human
cacauuccugagcuucgaccug

SEQ ID NO: 21924 - RNA, 22 nt, Human
cacauuccuuacauucauagag

SEQ ID NO: 21925 - RNA, 22 nt, Human
cacauugaaccauauauuagug

SEQ ID NO: 21926 - RNA, 22 nt, Human
cacauugauaauuaaggccucc

SEQ ID NO: 21927 - RNA, 22 nt, Human
cacauugcagacguauauuauu

SEQ ID NO: 21928 - RNA, 22 nt, Human
cacauugcagguugagaaggug

SEQ ID NO: 21929 - RNA, 22 nt, Human
cacauuggcaaacgggguugca

SEQ ID NO: 21930 - RNA, 22 nt, Human
cacauugggcuugcaugcacgg

SEQ ID NO: 21931 - RNA, 22 nt, Human
cacauuguauuguggaaaguua

SEQ ID NO: 21932 - RNA, 22 nt, Human
cacauuuaauugguuuagggug

SEQ ID NO: 21933 - RNA, 22 nt, Human
cacauuuacuuuuaucccuugg

SEQ ID NO: 21934 - RNA, 22 nt, Human
cacauuuagagguuagcauggu

SEQ ID NO: 21935 - RNA, 22 nt, Human
cacauuuaggagguggggaagc

SEQ ID NO: 21936 - RNA, 22 nt, Human
cacauuuauuugaggcuaauug

SEQ ID NO: 21937 - RNA, 22 nt, Human
cacauuucucuaccucacacaa

SEQ ID NO: 21938 - RNA, 22 nt, Human
cacauuucuguacuuagguaga

SEQ ID NO: 21939 - RNA, 22 nt, Human
cacauuucugugagucaauauu

SEQ ID NO: 21940 - RNA, 22 nt, Human
caccaaagucgcuucugucguc

SEQ ID NO: 21941 - RNA, 22 nt, Human
caccaccaggcaggacaccgaa

SEQ ID NO: 21942 - RNA, 22 nt, Human
caccacugcuuccugccaucug

SEQ ID NO: 21943 - RNA, 22 nt, Human
caccagagugggugagggugau

SEQ ID NO: 21944 - RNA, 20 nt, Human
caccagcagcagcugccacc

SEQ ID NO: 21945 - RNA, 22 nt, Human
caccagccagagugacagcucc

SEQ ID NO: 21946 - RNA, 22 nt, Human
caccagcuaauuaaaacagcag

SEQ ID NO: 21947 - RNA, 22 nt, Human
caccagcuuacagucucacccc

SEQ ID NO: 21948 - RNA, 22 nt, Human
caccagcuucccaucgcggguc

SEQ ID NO: 21949 - RNA, 22 nt, Human
caccagcuucucauugcggguc

SEQ ID NO: 21950 - RNA, 22 nt, Human
caccagcuugggcuguggaaau

SEQ ID NO: 21951 - RNA, 22 nt, Human
caccaggaccccacgguggguu

SEQ ID NO: 21952 - RNA, 22 nt, Human
caccaggagcaucuaggaggcg

SEQ ID NO: 21953 - RNA, 22 nt, Human
caccaggagccaucaggagucc

SEQ ID NO: 21954 - RNA, 22 nt, Human
caccaggauaaaaccucuagau

SEQ ID NO: 21955 - RNA, 22 nt, Human
caccaggaugggcagguagguc

SEQ ID NO: 21956 - RNA, 22 nt, Human
caccaggggcagagaccaaagu

SEQ ID NO: 21957 - RNA, 22 nt, Human
caccaggguacaauuucgcaga

SEQ ID NO: 21958 - RNA, 22 nt, Human
caccagguuccgggcagagcug

SEQ ID NO: 21959 - RNA, 22 nt, Human
caccagucuuuauuuuguuauu

SEQ ID NO: 21960 - RNA, 22 nt, Human
caccaucuagcauuuauuugga

SEQ ID NO: 21961 - RNA, 22 nt, Human
caccaucugguaggcauuagug

SEQ ID NO: 21962 - RNA, 22 nt, Human
caccaugcuugauuuguaaugu

SEQ ID NO: 21963 - RNA, 22 nt, Human
caccauuuaagaaagccaaauu

SEQ ID NO: 21964 - RNA, 22 nt, Human
caccauuuaguagcaagagcuc

SEQ ID NO: 21965 - RNA, 22 nt, Human
cacccacauggaaauucacagu

SEQ ID NO: 21966 - RNA, 22 nt, Human
cacccagacauguggucccaga

SEQ ID NO: 21967 - RNA, 22 nt, Human
cacccagcuuuugcauccuccg

SEQ ID NO: 21968 - RNA, 22 nt, Human
cacccaggacaaaauauggaau

SEQ ID NO: 21969 - RNA, 22 nt, Human
ccaggagcgcgugaacaggcug

SEQ ID NO: 21970 - RNA, 22 nt, Human
ccaggagcgggaaaaggaagaa

SEQ ID NO: 21971 - RNA, 22 nt, Human
ccaggaggaugauuuuaagagg

SEQ ID NO: 21972 - RNA, 22 nt, Human
ccaggaggcaauaucaagucca

SEQ ID NO: 21973 - RNA, 22 nt, Human
ccaggaggcggaagguacagug

SEQ ID NO: 21974 - RNA, 22 nt, Human
ccaggaggggucucugucuccc

SEQ ID NO: 21975 - RNA, 22 nt, Human
ccaggagucaauaaaggaagcu

SEQ ID NO: 21976 - RNA, 22 nt, Human
ccaggagucuggaugagguguc

SEQ ID NO: 21977 - RNA, 22 nt, Human
ccaggagugcagggaugguauc

SEQ ID NO: 21978 - RNA, 22 nt, Human
ccaggaguggcuggugaccuuc

SEQ ID NO: 21979 - RNA, 19 nt, Human
ccaggagugguggggugag

SEQ ID NO: 21980 - RNA, 22 nt, Human
ccaggaguuggaagcugccaug

SEQ ID NO: 21981 - RNA, 22 nt, Human
ccaggaguuggagguugcagug

SEQ ID NO: 21982 - RNA, 22 nt, Human
ccaggaucuguacaccucugag

SEQ ID NO: 21983 - RNA, 22 nt, Human
ccaggauggggagcagauagaa

SEQ ID NO: 21984 - RNA, 20 nt, Human
ccaggcaacuauccugucuc

SEQ ID NO: 21985 - RNA, 15 nt, Human
ccaggcaagcaggaa

SEQ ID NO: 21986 - RNA, 22 nt, Human
ccaggcaagcucugcugugccc

SEQ ID NO: 21987 - RNA, 22 nt, Human
ccaggcacucagagacugggac

SEQ ID NO: 21988 - RNA, 22 nt, Human
ccaggcagagugcuccagaaag

SEQ ID NO: 21989 - RNA, 22 nt, Human
ccaggcagccugcuccauucug

SEQ ID NO: 21990 - RNA, 22 nt, Human
ccaggcagggagcuguuuggcc

SEQ ID NO: 21991 - RNA, 23 nt, Human
ccaggcaguagcuauugaaguga

SEQ ID NO: 21992 - RNA, 22 nt, Human
ccaggcagucaggguugugugu

SEQ ID NO: 21993 - RNA, 22 nt, Human
ccaggcaucacgggcauguggc

SEQ ID NO: 21994 - RNA, 22 nt, Human
ccaggcauccauugcuuccucu

SEQ ID NO: 21995 - RNA, 22 nt, Human
ccaggcauugugagugggcagg

SEQ ID NO: 21996 - RNA, 22 nt, Human
ccaggccaggagagcgagguuu

SEQ ID NO: 21997 - RNA, 19 nt, Human
ccaggccuccugggagguc

SEQ ID NO: 21998 - RNA, 22 nt, Human
ccaggccugauugggaaucuug

SEQ ID NO: 21999 - RNA, 22 nt, Human
ccaggccugcaucugcugcgca

SEQ ID NO: 22000 - RNA, 22 nt, Human
ccaggccuggacggguggccug

SEQ ID NO: 22001 - RNA, 19 nt, Human
ccaggccuggcgucuccgc

SEQ ID NO: 22002 - RNA, 20 nt, Human
ccaggccugggccugcucua

SEQ ID NO: 22003 - RNA, 22 nt, Human
ccaggccuguguuguguggagg

SEQ ID NO: 22004 - RNA, 22 nt, Human
ccaggcguggcuucagcagccc

SEQ ID NO: 22005 - RNA, 18 nt, Human
ccaggcuacuucuuggcc

SEQ ID NO: 22006 - RNA, 22 nt, Human
ccaggcuagagugcaguggcgu

SEQ ID NO: 22007 - RNA, 22 nt, Human
ccaggcuagcccagaccacagg

SEQ ID NO: 22008 - RNA, 22 nt, Human
ccaggcuccgcauagaccccac

SEQ ID NO: 22009 - RNA, 22 nt, Human
ccaggcucuaucccuccuucuu

SEQ ID NO: 22010 - RNA, 22 nt, Human
ccaggcucugagaggaauguga

SEQ ID NO: 22011 - RNA, 15 nt, Human
ccaggcucugcacuc

SEQ ID NO: 22012 - RNA, 22 nt, Human
ccaggcucuguuccccgaggag

SEQ ID NO: 22013 - RNA, 22 nt, Human
ccaggcugagcaugauuggagc

SEQ ID NO: 22014 - RNA, 22 nt, Human
ccaggcugcagucaaggggcau

SEQ ID NO: 22015 - RNA, 22 nt, Human
ccaggcugccgaggaaagaaag

SEQ ID NO: 22016 - RNA, 22 nt, Human
ccaggcuggauuuugcaguuca

SEQ ID NO: 22017 - RNA, 15 nt, Human
ccaggcugggugagc

SEQ ID NO: 22018 - RNA, 22 nt, Human
ccaggcuggucugaauuucuag

SEQ ID NO: 22019 - RNA, 22 nt, Human
ccaggcuguaagagugauguug

SEQ ID NO: 22020 - RNA, 22 nt, Human
ccaggcugugguuuagauagag

SEQ ID NO: 22021 - RNA, 22 nt, Human
ccaggcuguuuucaaacuuggg

SEQ ID NO: 22022 - RNA, 22 nt, Human
ccaggcuucaggagugguuucc

SEQ ID NO: 22023 - RNA, 22 nt, Human
cacucugcgcugggcgccagcg

SEQ ID NO: 22024 - RNA, 22 nt, Human
cacugaaccugaaccaauacuc

SEQ ID NO: 22025 - RNA, 22 nt, Human
cacugaacuggucuuaggaggu

SEQ ID NO: 22026 - RNA, 22 nt, Human
cacugaagaugcgacuagugcu

SEQ ID NO: 22027 - RNA, 22 nt, Human
cacugaagcuuucauucucuug

SEQ ID NO: 22028 - RNA, 22 nt, Human
cacugaaggaaggacuacugca

SEQ ID NO: 22029 - RNA, 22 nt, Human
cacugaaggacaguaggaaggg

SEQ ID NO: 22030 - RNA, 22 nt, Human
cacugaaggcugcagcucagcc

SEQ ID NO: 22031 - RNA, 22 nt, Human
cacugaagguaggaccaaggcu

SEQ ID NO: 22032 - RNA, 22 nt, Human
cacugagaggucucauuuccaa

SEQ ID NO: 22033 - RNA, 22 nt, Human
cacugagcugauagaauuccag

SEQ ID NO: 22034 - RNA, 22 nt, Human
cacugaggcuuccuuaggcaau

SEQ ID NO: 22035 - RNA, 21 nt, Human
cacugaggucagggguagggu

SEQ ID NO: 22036 - RNA, 22 nt, Human
cacugaguucccugacauuuca

SEQ ID NO: 22037 - RNA, 22 nt, Human
cacugcaaugucuaccuccugg

SEQ ID NO: 22038 - RNA, 22 nt, Human
cacugcagccacauagaugacg

SEQ ID NO: 22039 - RNA, 21 nt, Human
cacugcagccuugaccugggc

SEQ ID NO: 22040 - RNA, 22 nt, Human
cacugcauggaugauggcugua

SEQ ID NO: 22041 - RNA, 22 nt, Human
cacugcauggcugugaggcagc

SEQ ID NO: 22042 - RNA, 21 nt, Human
cacugcauuaagucuguaggu

SEQ ID NO: 22043 - RNA, 20 nt, Human
cacugcauugauggaaacag

SEQ ID NO: 22044 - RNA, 22 nt, Human
cacugccaccugcaugcccuga

SEQ ID NO: 22045 - RNA, 22 nt, Human
cacugcuugauugacaugcacg

SEQ ID NO: 22046 - RNA, 22 nt, Human
cacuggaaccaagacccagggc

SEQ ID NO: 22047 - RNA, 22 nt, Human
cacuggaaguucauucucagaa

SEQ ID NO: 22048 - RNA, 22 nt, Human
cacuggaauggauagagcagag

SEQ ID NO: 22049 - RNA, 22 nt, Human
cacuggaauguugaggagacaa

SEQ ID NO: 22050 - RNA, 22 nt, Human
cacuggaggucaguggagcacu

SEQ ID NO: 22051 - RNA, 22 nt, Human
cacuggcaaagccuguuccuua

SEQ ID NO: 22052 - RNA, 22 nt, Human
cacuggcagauuugggaucugg

SEQ ID NO: 22053 - RNA, 22 nt, Human
cacuggcaucuaguggguugag

SEQ ID NO: 22054 - RNA, 22 nt, Human
cacuggcccagccaggccuguu

SEQ ID NO: 22055 - RNA, 22 nt, Human
cacuggcuaugagggagauggg

SEQ ID NO: 22056 - RNA, 22 nt, Human
cacuggcugagcuucucuaggg

SEQ ID NO: 22057 - RNA, 22 nt, Human
cacuggcuugauggguaaugcc

SEQ ID NO: 22058 - RNA, 22 nt, Human
cacugggaccuaggacugagcu

SEQ ID NO: 22059 - RNA, 22 nt, Human
cacugggagcagcuccaacauu

SEQ ID NO: 22060 - RNA, 22 nt, Human
cacugggcaauucugagccuaa

SEQ ID NO: 22061 - RNA, 22 nt, Human
cacugggcgccagcugcugagc

SEQ ID NO: 22062 - RNA, 22 nt, Human
cacugggcugauaccaggcuuc

SEQ ID NO: 22063 - RNA, 23 nt, Human
cacugggggcugcuacagagagg

SEQ ID NO: 22064 - RNA, 22 nt, Human
cacugguacacugaauggcguu

SEQ ID NO: 22065 - RNA, 22 nt, Human
cacuggucagcaugguagacca

SEQ ID NO: 22066 - RNA, 23 nt, Human
cacuggugggguuuaaaagaagc

SEQ ID NO: 22067 - RNA, 22 nt, Human
cacuguaaccuccaccuccugg

SEQ ID NO: 22068 - RNA, 22 nt, Human
cacuguaagaugagcuuuuuua

SEQ ID NO: 22069 - RNA, 22 nt, Human
cacuguaauagcauuauaagug

SEQ ID NO: 22070 - RNA, 22 nt, Human
cacugucacguucugaaacugu

SEQ ID NO: 22071 - RNA, 22 nt, Human
cacuguccaugcuugcuaaccc

SEQ ID NO: 22072 - RNA, 19 nt, Human
cacuguccuagucgaggcc

SEQ ID NO: 22073 - RNA, 22 nt, Human
cacugucuccuagggggacuuc

SEQ ID NO: 22074 - RNA, 22 nt, Human
cacugucugagcuggugauuag

SEQ ID NO: 22075 - RNA, 22 nt, Human
cacugucuguguguccuugggg

SEQ ID NO: 22076 - RNA, 22 nt, Human
cacugugcuccuuccuuagcac

SEQ ID NO: 22077 - RNA, 19 nt, Human
cacugugguccuucacugc

SEQ ID NO: 22078 - RNA, 22 nt, Human
cacuguggugugagggcugaug

SEQ ID NO: 22079 - RNA, 22 nt, Human
cacuguguaagaagaugggcuu

SEQ ID NO: 22080 - RNA, 22 nt, Human
cacugugucaguuugguuagac

SEQ ID NO: 22081 - RNA, 23 nt, Human
cacuguguuacauguugaagaug

SEQ ID NO: 22082 - RNA, 22 nt, Human
cacuguucacauuuuagucuau

SEQ ID NO: 22083 - RNA, 22 nt, Human
ccagguguucuuugucccuguu

SEQ ID NO: 22084 - RNA, 22 nt, Human
ccaguaaaaagcgacaggaagu

SEQ ID NO: 22085 - RNA, 22 nt, Human
ccaguaaaccaaguguuuacua

SEQ ID NO: 22086 - RNA, 23 nt, Human
ccaguaaacccuuccucaguguc

SEQ ID NO: 22087 - RNA, 22 nt, Human
ccaguacaccucacuucccuuu

SEQ ID NO: 22088 - RNA, 18 nt, Human
ccaguaccuccuccucuc

SEQ ID NO: 22089 - RNA, 22 nt, Human
ccaguacuugcuaccucaauug

SEQ ID NO: 22090 - RNA, 22 nt, Human
ccaguaguuggacaaauagauu

SEQ ID NO: 22091 - RNA, 22 nt, Human
ccaguauucgaucuggccaguu

SEQ ID NO: 22092 - RNA, 22 nt, Human
ccagucaaguugacacaccaag

SEQ ID NO: 22093 - RNA, 22 nt, Human
ccagucacuggaaaaugggaau

SEQ ID NO: 22094 - RNA, 22 nt, Human
ccagucagagaaaauguccacu

SEQ ID NO: 22095 - RNA, 22 nt, Human
ccagucagccaagcugcagcgg

SEQ ID NO: 22096 - RNA, 22 nt, Human
ccagucagggcaggagccuggu

SEQ ID NO: 22097 - RNA, 22 nt, Human
ccaguccacgucaagaagaggu

SEQ ID NO: 22098 - RNA, 22 nt, Human
ccaguccauggauucccaaggu

SEQ ID NO: 22099 - RNA, 22 nt, Human
ccagucccagcucugccaugcu

SEQ ID NO: 22100 - RNA, 22 nt, Human
ccagucccaggcagaaauccag

SEQ ID NO: 22101 - RNA, 19 nt, Human
ccagucccauacaggagau

SEQ ID NO: 22102 - RNA, 22 nt, Human
ccaguccuggccaguaacauga

SEQ ID NO: 22103 - RNA, 22 nt, Human
ccagucuccuaagagccccuga

SEQ ID NO: 22104 - RNA, 22 nt, Human
ccagucugaggccuggugaggg

SEQ ID NO: 22105 - RNA, 22 nt, Human
ccagucugugugccagccugcg

SEQ ID NO: 22106 - RNA, 22 nt, Human
ccagugcaccaagaggccuaga

SEQ ID NO: 22107 - RNA, 22 nt, Human
ccagugcagucccccugaacug

SEQ ID NO: 22108 - RNA, 19 nt, Human
ccagugccggcgcugggga

SEQ ID NO: 22109 - RNA, 22 nt, Human
ccagugccuaucuccucuggga

SEQ ID NO: 22110 - RNA, 22 nt, Human
ccagugccugugggcauggugc

SEQ ID NO: 22111 - RNA, 22 nt, Human
ccagugcucuuaaaggucauaa

SEQ ID NO: 22112 - RNA, 22 nt, Human
ccagugcugaaugaggaggucu

SEQ ID NO: 22113 - RNA, 22 nt, Human
ccagugcuuccaggaauacggu

SEQ ID NO: 22114 - RNA, 22 nt, Human
ccaguggaauuaaaaauaagug

SEQ ID NO: 22115 - RNA, 22 nt, Human
ccaguggaguuuuuauacccag

SEQ ID NO: 22116 - RNA, 23 nt, Human
ccaguggcguaaacuagaggaua

SEQ ID NO: 22117 - RNA, 22 nt, Human
ccaguggcuacagggggguuga

SEQ ID NO: 22118 - RNA, 22 nt, Human
ccagugggaacacuggcauugc

SEQ ID NO: 22119 - RNA, 22 nt, Human
ccagugggagggagcuaggcca

SEQ ID NO: 22120 - RNA, 22 nt, Human
ccagugggugcugggcucugcc

SEQ ID NO: 22121 - RNA, 22 nt, Human
ccagugugaaaggucauuuauc

SEQ ID NO: 22122 - RNA, 22 nt, Human
ccagugugcaaucucuggcuua

SEQ ID NO: 22123 - RNA, 22 nt, Human
ccaguguggccaggugcuggua

SEQ ID NO: 22124 - RNA, 23 nt, Human
ccagugugguagguccacaggug

SEQ ID NO: 22125 - RNA, 22 nt, Human
ccaguguguuaguggauuuccc

SEQ ID NO: 22126 - RNA, 22 nt, Human
ccaguguuccauggagugauua

SEQ ID NO: 22127 - RNA, 22 nt, Human
ccaguguugaacaguauuugga

SEQ ID NO: 22128 - RNA, 22 nt, Human
ccaguguugcauaggaugggga

SEQ ID NO: 22129 - RNA, 22 nt, Human
ccaguuaaucacugaguccugu

SEQ ID NO: 22130 - RNA, 22 nt, Human
ccauaagguuuggggccaugca

SEQ ID NO: 22131 - RNA, 22 nt, Human
ccauaaucguguguuaaauaau

SEQ ID NO: 22132 - RNA, 22 nt, Human
cacccagcacagagggaggcga

SEQ ID NO: 22133 - RNA, 22 nt, Human
cacccagcagcacuuaagacua

SEQ ID NO: 22134 - RNA, 22 nt, Human
cacccaggacaggccagaugug

SEQ ID NO: 22135 - RNA, 22 nt, Human
cacccaggcagguggcugagaa

SEQ ID NO: 22136 - RNA, 22 nt, Human
cacccaggcuggagugcauugg

SEQ ID NO: 22137 - RNA, 22 nt, Human
cacccaguaagcaugaggcccu

SEQ ID NO: 22138 - RNA, 22 nt, Human
caccccaaguucuguccacugc

SEQ ID NO: 22139 - RNA, 22 nt, Human
cacccccaggagcuccagggac

SEQ ID NO: 22140 - RNA, 22 nt, Human
caccccuugucuuuggggucgu

SEQ ID NO: 22141 - RNA, 20 nt, Human
cacccucccagcaccuaugc

SEQ ID NO: 22142 - RNA, 22 nt, Human
cacccuggcuggaggugcagug

SEQ ID NO: 22143 - RNA, 22 nt, Human
cacccuuugcugcucuuccucc

SEQ ID NO: 22144 - RNA, 22 nt, Human
caccuagcagaacagaggugcu

SEQ ID NO: 22145 - RNA, 22 nt, Human
caccuagggcaucccugcccca

SEQ ID NO: 22146 - RNA, 22 nt, Human
caccuaggguuucgccuuucuu

SEQ ID NO: 22147 - RNA, 22 nt, Human
caccugaagauuuagagauuga

SEQ ID NO: 22148 - RNA, 22 nt, Human
caccugcagggggagucaagag

SEQ ID NO: 22149 - RNA, 20 nt, Human
caccuggauaugacccagcu

SEQ ID NO: 22150 - RNA, 22 nt, Human
caccuggcuggaagugcuccgg

SEQ ID NO: 22151 - RNA, 22 nt, Human
caccugguucuagugaaagucu

SEQ ID NO: 22152 - RNA, 22 nt, Human
caccuguuguuuauucaucucu

SEQ ID NO: 22153 - RNA, 22 nt, Human
caccuuguggcccagucagguu

SEQ ID NO: 22154 - RNA, 22 nt, Human
caccuuugaccuugcagcgcac

SEQ ID NO: 22155 - RNA, 22 nt, Human
caccuuuugugucugcguuugu

SEQ ID NO: 22156 - RNA, 22 nt, Human
cacgacuuguggaggagcgcgg

SEQ ID NO: 22157 - RNA, 22 nt, Human
cacggaaacacagguuauaaga

SEQ ID NO: 22158 - RNA, 23 nt, Human
cacggcagccuccgagggugcug

SEQ ID NO: 22159 - RNA, 22 nt, Human
cacggccacugcagcaccccag

SEQ ID NO: 22160 - RNA, 22 nt, Human
cacgggcuguuuccaugcaaaa

SEQ ID NO: 22161 - RNA, 22 nt, Human
cacgguggcccacaggugcaag

SEQ ID NO: 22162 - RNA, 22 nt, Human
cacguccacccaggcugcccag

SEQ ID NO: 22163 - RNA, 22 nt, Human
cacgugagaccuugcagaggug

SEQ ID NO: 22164 - RNA, 22 nt, Human
cacguuuuaugacagaagaagc

SEQ ID NO: 22165 - RNA, 22 nt, Human
cacuaaaacuacauuggaaaca

SEQ ID NO: 22166 - RNA, 22 nt, Human
cacuagaaagguacagauuaug

SEQ ID NO: 22167 - RNA, 22 nt, Human
cacuagagguugaugagaggug

SEQ ID NO: 22168 - RNA, 22 nt, Human
cacuaguggccccaugugguug

SEQ ID NO: 22169 - RNA, 22 nt, Human
cacuaguucacaaaauaggaaa

SEQ ID NO: 22170 - RNA, 22 nt, Human
cacuauaauccuguuuuagaac

SEQ ID NO: 22171 - RNA, 22 nt, Human
cacuauuuauacuuccugaucc

SEQ ID NO: 22172 - RNA, 21 nt, Human
cacuauuuauauaugccagcu

SEQ ID NO: 22173 - RNA, 22 nt, Human
cacuauuuccuggauuuugacg

SEQ ID NO: 22174 - RNA, 22 nt, Human
cacuauuuuucacuuaggcuua

SEQ ID NO: 22175 - RNA, 22 nt, Human
cacucacuuauuucuaacagaa

SEQ ID NO: 22176 - RNA, 22 nt, Human
cacucaggcugugucaggagga

SEQ ID NO: 22177 - RNA, 21 nt, Human
cacucaggguaugugccaggc

SEQ ID NO: 22178 - RNA, 22 nt, Human
cacuccagccucagugacagag

SEQ ID NO: 22179 - RNA, 23 nt, Human
cacuccuguuucuaagccagcau

SEQ ID NO: 22180 - RNA, 20 nt, Human
cacucuaaccauauuuccuc

SEQ ID NO: 22181 - RNA, 22 nt, Human
cacucuaagaacacaaaggccc

SEQ ID NO: 22182 - RNA, 22 nt, Human
cacucucagcauaaugaaugug

SEQ ID NO: 22183 - RNA, 22 nt, Human
cacucucucaggcuuuccuugu

SEQ ID NO: 22184 - RNA, 22 nt, Human
cacucugagaaacacuaaacca

SEQ ID NO: 22185 - RNA, 22 nt, Human
cacucugagccaaaacuaauuc

SEQ ID NO: 22186 - RNA, 20 nt, Human
cacucugagggaguccaugu

SEQ ID NO: 22187 - RNA, 22 nt, Human
cacucugauuccacaaggcucc

SEQ ID NO: 22188 - RNA, 22 nt, Human
cacucugggcucuuguuucaga

SEQ ID NO: 22189 - RNA, 22 nt, Human
cacucugggggcugccgcugcc

SEQ ID NO: 22190 - RNA, 22 nt, Human
cacucugguucugaacaggauc

SEQ ID NO: 22191 - RNA, 22 nt, Human
cacugaaacagguauugcuggu

SEQ ID NO: 22192 - RNA, 22 nt, Human
cacugaccauggccaauuggca

SEQ ID NO: 22193 - RNA, 22 nt, Human
cacugacuaaguuugugaaggu

SEQ ID NO: 22194 - RNA, 22 nt, Human
cacugagcaagucaguacagca

SEQ ID NO: 22195 - RNA, 22 nt, Human
cacugagccaggagcaauauca

SEQ ID NO: 22196 - RNA, 22 nt, Human
cacugaggcugggggagaaggu

SEQ ID NO: 22197 - RNA, 22 nt, Human
cacugagguaucugucucuccu

SEQ ID NO: 22198 - RNA, 22 nt, Human
cacugcaaccuccgccucuugg

SEQ ID NO: 22199 - RNA, 22 nt, Human
cacugcaaccucugccaccugg

SEQ ID NO: 22200 - RNA, 22 nt, Human
cacuacagggguccacagcuga

SEQ ID NO: 22201 - RNA, 22 nt, Human
cacuacuugaaagaauuacaga

SEQ ID NO: 22202 - RNA, 22 nt, Human
cacuagaaccaaugacauuucu

SEQ ID NO: 22203 - RNA, 22 nt, Human
cacuagagaaacgcccaggcuc

SEQ ID NO: 22204 - RNA, 22 nt, Human
cacuagaugauaaucagcugga

SEQ ID NO: 22205 - RNA, 22 nt, Human
cacuaggcgccggguggcugug

SEQ ID NO: 22206 - RNA, 22 nt, Human
cacuaguccugguuucaugcua

SEQ ID NO: 22207 - RNA, 22 nt, Human
cacuauaucucuuucaucuuuu

SEQ ID NO: 22208 - RNA, 22 nt, Human
cacuauaugccuuugaaauaca

SEQ ID NO: 22209 - RNA, 22 nt, Human
cacuauuugcuuugggcuagag

SEQ ID NO: 22210 - RNA, 22 nt, Human
cacucaggguacaauggagggc

SEQ ID NO: 22211 - RNA, 22 nt, Human
cacucauauuggaacaagcuug

SEQ ID NO: 22212 - RNA, 22 nt, Human
cacuccaggucccaguuccugg

SEQ ID NO: 22213 - RNA, 22 nt, Human
cacucuaaccuccaucuuccau

SEQ ID NO: 22214 - RNA, 22 nt, Human
cacucucacaugcccugucagu

SEQ ID NO: 22215 - RNA, 22 nt, Human
cacucucacugagcucaugcca

SEQ ID NO: 22216 - RNA, 22 nt, Human
cacucuccagcacaccccauuu

SEQ ID NO: 22217 - RNA, 21 nt, Human
cacucucccaauccuugcuga

SEQ ID NO: 22218 - RNA, 22 nt, Human
cacucugaugguuucuguucaa

SEQ ID NO: 22219 - RNA, 22 nt, Human
cacucugcugaaaucgccuugu

SEQ ID NO: 22220 - RNA, 22 nt, Human
cacugaaauauuaauaucuuau

SEQ ID NO: 22221 - RNA, 22 nt, Human
cacugaaaucgaaaaauguagg

SEQ ID NO: 22222 - RNA, 22 nt, Human
cacugaaccguaaaugauuuag

SEQ ID NO: 22223 - RNA, 22 nt, Human
cacugaacuccuuguuuguccu

SEQ ID NO: 22224 - RNA, 20 nt, Human
cacugaagacuucuugcuca

SEQ ID NO: 22225 - RNA, 22 nt, Human
cacugaagccugggaguaagac

SEQ ID NO: 22226 - RNA, 22 nt, Human
cacugaaggcuaggauuagaug

SEQ ID NO: 22227 - RNA, 22 nt, Human
cacugagaaagugaccugccaa

SEQ ID NO: 22228 - RNA, 22 nt, Human
cacugagaccagagucccugac

SEQ ID NO: 22229 - RNA, 22 nt, Human
cacugagagaugugucacagca

SEQ ID NO: 22230 - RNA, 22 nt, Human
cacugagcaugagugggcugug

SEQ ID NO: 22231 - RNA, 22 nt, Human
cacugagcugauuucaggugcc

SEQ ID NO: 22232 - RNA, 22 nt, Human
cacugagggcggagcccaggga

SEQ ID NO: 22233 - RNA, 22 nt, Human
cacugauuaagucugcuagagg

SEQ ID NO: 22234 - RNA, 22 nt, Human
cacugcaaccucagacuccugg

SEQ ID NO: 22235 - RNA, 22 nt, Human
cacugcaaccuccagcucucag

SEQ ID NO: 22236 - RNA, 22 nt, Human
cacugcaaccuccgccuaccgg

SEQ ID NO: 22237 - RNA, 22 nt, Human
cacugcacaggugagauguggg

SEQ ID NO: 22238 - RNA, 22 nt, Human
cacugcagaucagaggcugaga

SEQ ID NO: 22239 - RNA, 22 nt, Human
cacugcaguaacucuaggacug

SEQ ID NO: 22240 - RNA, 22 nt, Human
cacugcagucuucaucaaccaa

SEQ ID NO: 22241 - RNA, 22 nt, Human
cagauugagucugggaaaaggc

SEQ ID NO: 22242 - RNA, 22 nt, Human
cagauuuaagauauuuguauug

SEQ ID NO: 22243 - RNA, 22 nt, Human
cagauuucaugcgaaauggggu

SEQ ID NO: 22244 - RNA, 22 nt, Human
cagauuucuuuagcaagcuaag

SEQ ID NO: 22245 - RNA, 22 nt, Human
cagauuuugaugaauguggaaa

SEQ ID NO: 22246 - RNA, 20 nt, Human
cagcaaaaugaaaauggauu

SEQ ID NO: 22247 - RNA, 22 nt, Human
cagcaaaauuugaggauugccu

SEQ ID NO: 22248 - RNA, 19 nt, Human
cagcaaacacuguaaaugg

SEQ ID NO: 22249 - RNA, 22 nt, Human
cagcaacaugugguaguguagg

SEQ ID NO: 22250 - RNA, 22 nt, Human
cagcaacuccuguagcuuaugc

SEQ ID NO: 22251 - RNA, 20 nt, Human
cagcaacuuuggacugaguu

SEQ ID NO: 22252 - RNA, 22 nt, Human
cagcaagaaucagacaaccuca

SEQ ID NO: 22253 - RNA, 22 nt, Human
cagcaagacaaggaacaaacug

SEQ ID NO: 22254 - RNA, 22 nt, Human
cagcaagagacuguucucuaag

SEQ ID NO: 22255 - RNA, 22 nt, Human
cagcaagaggguaagguugaag

SEQ ID NO: 22256 - RNA, 22 nt, Human
cagcaagaguugggguuguugg

SEQ ID NO: 22257 - RNA, 22 nt, Human
cagcaagauuaagggcagaaaa

SEQ ID NO: 22258 - RNA, 22 nt, Human
cagcaaggucugucaauagugg

SEQ ID NO: 22259 - RNA, 22 nt, Human
cagcaagucagugaguagaaga

SEQ ID NO: 22260 - RNA, 22 nt, Human
cagcaauaagguaagcuucucc

SEQ ID NO: 22261 - RNA, 22 nt, Human
cagcaauaaugucuacaaaucu

SEQ ID NO: 22262 - RNA, 22 nt, Human
cagcaaucgggugauaugcaau

SEQ ID NO: 22263 - RNA, 22 nt, Human
cagcacagaguauuuuauugau

SEQ ID NO: 22264 - RNA, 22 nt, Human
cagcacaggccugucuuugucu

SEQ ID NO: 22265 - RNA, 22 nt, Human
cagcacagggacaauagcagau

SEQ ID NO: 22266 - RNA, 22 nt, Human
cagcacaguuucuggcccgccg

SEQ ID NO: 22267 - RNA, 22 nt, Human
cagcacauaaucagugauugug

SEQ ID NO: 22268 - RNA, 22 nt, Human
cagcacauagcaugcuugucag

SEQ ID NO: 22269 - RNA, 22 nt, Human
cagcacauaguagguauucacu

SEQ ID NO: 22270 - RNA, 22 nt, Human
cagcacaucugauuauaugacu

SEQ ID NO: 22271 - RNA, 22 nt, Human
cagcacaucuucugaucuuuug

SEQ ID NO: 22272 - RNA, 22 nt, Human
cagcaccauuuuccuggucagc

SEQ ID NO: 22273 - RNA, 22 nt, Human
cagcacccucggaggcugccgu

SEQ ID NO: 22274 - RNA, 22 nt, Human
cagcaccucugggucuugucuu

SEQ ID NO: 22275 - RNA, 22 nt, Human
cagcaccuuccuauccaggaga

SEQ ID NO: 22276 - RNA, 22 nt, Human
cagcaccuuccuuaacuccagg

SEQ ID NO: 22277 - RNA, 22 nt, Human
cagcacuaggauauacauuucc

SEQ ID NO: 22278 - RNA, 22 nt, Human
cagcacucuggcuucguuaagu

SEQ ID NO: 22279 - RNA, 22 nt, Human
cagcacuggggggauucggagc

SEQ ID NO: 22280 - RNA, 22 nt, Human
cagcacuugagcuuucauguaa

SEQ ID NO: 22281 - RNA, 22 nt, Human
cagcacuuggugccauugagug

SEQ ID NO: 22282 - RNA, 22 nt, Human
cagcagacuggaguaggcagug

SEQ ID NO: 22283 - RNA, 22 nt, Human
cagcagacuuacuagaauguaa

SEQ ID NO: 22284 - RNA, 22 nt, Human
cagcagagaugagauuccuaua

SEQ ID NO: 22285 - RNA, 22 nt, Human
cagcagagcauuugguaggagg

SEQ ID NO: 22286 - RNA, 22 nt, Human
cagcagagcugggaauaaaauu

SEQ ID NO: 22287 - RNA, 22 nt, Human
cagcagagcugugugggaaggg

SEQ ID NO: 22288 - RNA, 22 nt, Human
cagcagaggaaagcaaaucuaa

SEQ ID NO: 22289 - RNA, 22 nt, Human
cagcagcccacgcgugcugucc

SEQ ID NO: 22290 - RNA, 22 nt, Human
cagcagccuacaaugcacagaa

SEQ ID NO: 22291 - RNA, 22 nt, Human
cagcagccuagaagcucuacca

SEQ ID NO: 22292 - RNA, 22 nt, Human
cagcagccuggagggggccacg

SEQ ID NO: 22293 - RNA, 22 nt, Human
cagcagcucacucagguggcuc

SEQ ID NO: 22294 - RNA, 22 nt, Human
cagcagcucaggcuccuuccca

SEQ ID NO: 22295 - RNA, 22 nt, Human
cagcagcuccaaagaauagcca

SEQ ID NO: 22296 - RNA, 22 nt, Human
cagcagcuccucugcggcuaug

SEQ ID NO: 22297 - RNA, 22 nt, Human
cagcagcugccucagcugggga

SEQ ID NO: 22298 - RNA, 22 nt, Human
cagcagcugcgugcccaggccg

SEQ ID NO: 22299 - RNA, 22 nt, Human
cagcagcugguugaauccuucu

SEQ ID NO: 22300 - RNA, 22 nt, Human
cagcagcuuuugcauucucauu

SEQ ID NO: 22301 - RNA, 22 nt, Human
cagcaggaaaaucaauucugug

SEQ ID NO: 22302 - RNA, 22 nt, Human
cagcaggacauggaggaguaaa

SEQ ID NO: 22303 - RNA, 22 nt, Human
cagcaggaccauugaggcauca

SEQ ID NO: 22304 - RNA, 22 nt, Human
cagcaggagcagucagacuccu

SEQ ID NO: 22305 - RNA, 22 nt, Human
cagcaggaggugaguagcaggu

SEQ ID NO: 22306 - RNA, 22 nt, Human
cagcaggcagccauuucacugu

SEQ ID NO: 22307 - RNA, 22 nt, Human
cagcaggccaugcugcuuuuca

SEQ ID NO: 22308 - RNA, 22 nt, Human
cagcaggcguugggagaaagac

SEQ ID NO: 22309 - RNA, 22 nt, Human
cagcaggcuggacuucaguccc

SEQ ID NO: 22310 - RNA, 22 nt, Human
cagcaggcuguggaaauccugg

SEQ ID NO: 22311 - RNA, 22 nt, Human
cagcaggggaacugugggccag

SEQ ID NO: 22312 - RNA, 22 nt, Human
cagcaggguauacagggaauuu

SEQ ID NO: 22313 - RNA, 18 nt, Human
cagcagguagaguuuggu

SEQ ID NO: 22314 - RNA, 22 nt, Human
cagcagguauguuuguucagca

SEQ ID NO: 22315 - RNA, 21 nt, Human
cagcagguggagccucuuguc

SEQ ID NO: 22316 - RNA, 22 nt, Human
cagcagguuaacagaggcuggu

SEQ ID NO: 22317 - RNA, 22 nt, Human
cagcaguaauuagugcugcaug

SEQ ID NO: 22318 - RNA, 22 nt, Human
cagcagugugcaggugugcugg

SEQ ID NO: 22319 - RNA, 22 nt, Human
cagcaguucuguacuuuagagu

SEQ ID NO: 22320 - RNA, 22 nt, Human
cagcaucaacauucucagcucu

SEQ ID NO: 22321 - RNA, 20 nt, Human
cagcaucuagugagauuugc

SEQ ID NO: 22322 - RNA, 22 nt, Human
cagcaucucauuugacuucugc

SEQ ID NO: 22323 - RNA, 22 nt, Human
cagcaucugaccaauaucuaca

SEQ ID NO: 22324 - RNA, 19 nt, Human
cagcaucugagccgugucc

SEQ ID NO: 22325 - RNA, 22 nt, Human
cagcaucuugaaggguaaacca

SEQ ID NO: 22326 - RNA, 22 nt, Human
cagcaugaucccaguugauugc

SEQ ID NO: 22327 - RNA, 22 nt, Human
cagcaugauuggugucugguga

SEQ ID NO: 22328 - RNA, 22 nt, Human
cagcaugccugggcugccugcc

SEQ ID NO: 22329 - RNA, 22 nt, Human
cagcauggagacaaagugggca

SEQ ID NO: 22330 - RNA, 22 nt, Human
cagcaugguuggguucugggga

SEQ ID NO: 22331 - RNA, 22 nt, Human
cagcauguaagccacugcccug

SEQ ID NO: 22332 - RNA, 22 nt, Human
cagcauuggguuaccuuuguuu

SEQ ID NO: 22333 - RNA, 22 nt, Human
cagcauuuaaugcagugcuucc

SEQ ID NO: 22334 - RNA, 22 nt, Human
cagcauuucaggaggcugaggu

SEQ ID NO: 22335 - RNA, 22 nt, Human
cagcacaguguuagguaauuug

SEQ ID NO: 22336 - RNA, 22 nt, Human
cagcacauaagccgaagacugu

SEQ ID NO: 22337 - RNA, 22 nt, Human
cagcacaugcucaucagggaag

SEQ ID NO: 22338 - RNA, 22 nt, Human
cagcaccagcauauuccagggc

SEQ ID NO: 22339 - RNA, 22 nt, Human
cagcaccaggcagaccuggagc

SEQ ID NO: 22340 - RNA, 22 nt, Human
cagcacccuuuccacugccuug

SEQ ID NO: 22341 - RNA, 22 nt, Human
cagcaccuaggacaguagucag

SEQ ID NO: 22342 - RNA, 22 nt, Human
cagcaccuccgcaguucaccug

SEQ ID NO: 22343 - RNA, 22 nt, Human
cagcacuaauccugcaauuucu

SEQ ID NO: 22344 - RNA, 22 nt, Human
cagcacugcugcuguacacaca

SEQ ID NO: 22345 - RNA, 22 nt, Human
cagcacuggggccacuggaguu

SEQ ID NO: 22346 - RNA, 22 nt, Human
cagcacugugauaacugagcca

SEQ ID NO: 22347 - RNA, 22 nt, Human
cagcacuguucccagaccacug

SEQ ID NO: 22348 - RNA, 22 nt, Human
cagcacuucagcauucagauuu

SEQ ID NO: 22349 - RNA, 22 nt, Human
cagcacuuugagggcucuuaau

SEQ ID NO: 22350 - RNA, 22 nt, Human
cagccaggacucccauuuagga

SEQ ID NO: 22351 - RNA, 22 nt, Human
cagccaggauggagaacuguug

SEQ ID NO: 22352 - RNA, 22 nt, Human
cagccaggcccagaucaugcug

SEQ ID NO: 22353 - RNA, 22 nt, Human
cagccaggccuggugaccaaag

SEQ ID NO: 22354 - RNA, 22 nt, Human
cagccagguuagugcuaauugu

SEQ ID NO: 22355 - RNA, 22 nt, Human
cagcccaaagccccaggcuaga

SEQ ID NO: 22356 - RNA, 22 nt, Human
cagcccaccuggcacguguguu

SEQ ID NO: 22357 - RNA, 22 nt, Human
cagcccagaacucacgucucca

SEQ ID NO: 22358 - RNA, 22 nt, Human
cagcccagacaccaucauucua

SEQ ID NO: 22359 - RNA, 22 nt, Human
cagcccagagaaggggcccgug

SEQ ID NO: 22360 - RNA, 22 nt, Human
cagcccagcgcaaacaacuggc

SEQ ID NO: 22361 - RNA, 22 nt, Human
cagcccaggccgacaguuccuc

SEQ ID NO: 22362 - RNA, 22 nt, Human
cagcccaggucucucuuccagu

SEQ ID NO: 22363 - RNA, 22 nt, Human
cagcccagguggcggagguugc

SEQ ID NO: 22364 - RNA, 22 nt, Human
cagccccauggugugcuccagc

SEQ ID NO: 22365 - RNA, 22 nt, Human
cagcccccauggggaggucaag

SEQ ID NO: 22366 - RNA, 22 nt, Human
cagccccuggcgcacgccgagc

SEQ ID NO: 22367 - RNA, 22 nt, Human
cagcccgucacacgcuagcauc

SEQ ID NO: 22368 - RNA, 22 nt, Human
cagcccucaucccgccugcguu

SEQ ID NO: 22369 - RNA, 20 nt, Human
cagcccuccaguggaggcag

SEQ ID NO: 22370 - RNA, 22 nt, Human
cagcccugagaaggaggaucuc

SEQ ID NO: 22371 - RNA, 22 nt, Human
cagcccugcagagggcgcuccu

SEQ ID NO: 22372 - RNA, 22 nt, Human
cagcccugcagcuggaucucac

SEQ ID NO: 22373 - RNA, 22 nt, Human
cagcccugccauggagccuccu

SEQ ID NO: 22374 - RNA, 22 nt, Human
cagcccugcugccuuagugccu

SEQ ID NO: 22375 - RNA, 22 nt, Human
cagcccuggugccaagguuccc

SEQ ID NO: 22376 - RNA, 20 nt, Human
cagcccugugaccuggcccu

SEQ ID NO: 22377 - RNA, 22 nt, Human
cagcccugugcggagggcccug

SEQ ID NO: 22378 - RNA, 22 nt, Human
cagcccuguugcgcuuccggcg

SEQ ID NO: 22379 - RNA, 23 nt, Human
cagcccuuccugcauguuuuugu

SEQ ID NO: 22380 - RNA, 22 nt, Human
cagcccuuggcuggcuccuugc

SEQ ID NO: 22381 - RNA, 22 nt, Human
cagcccuuguuucuaaagcugc

SEQ ID NO: 22382 - RNA, 20 nt, Human
cagcccuuuauccuccuaug

SEQ ID NO: 22383 - RNA, 22 nt, Human
cagcccuuuccuucucagcuuu

SEQ ID NO: 22384 - RNA, 22 nt, Human
cagcccuuuuuugguacaaccg

SEQ ID NO: 22385 - RNA, 22 nt, Human
cagccggaccugagggauuccu

SEQ ID NO: 22386 - RNA, 20 nt, Human
cagccuccacucacucagcu

SEQ ID NO: 22387 - RNA, 22 nt, Human
cagccucugacaccacagucgu

SEQ ID NO: 22388 - RNA, 22 nt, Human
cagccugccgucagccagguag

SEQ ID NO: 22389 - RNA, 22 nt, Human
cagccuggacagcgaccagagu

SEQ ID NO: 22390 - RNA, 22 nt, Human
cagccuggagccacagcccagg

SEQ ID NO: 22391 - RNA, 22 nt, Human
cagccuggauugcagaaugcua

SEQ ID NO: 22392 - RNA, 22 nt, Human
cagccugggcuccagagucccu

SEQ ID NO: 22393 - RNA, 22 nt, Human
cagccuguagaauacaguaaau

SEQ ID NO: 22394 - RNA, 22 nt, Human
cagccuucaaggcuuagcucag

SEQ ID NO: 22395 - RNA, 22 nt, Human
cagccuucugaaugaacguacu

SEQ ID NO: 22396 - RNA, 22 nt, Human
cagccuuugaacuucagagguu

SEQ ID NO: 22397 - RNA, 22 nt, Human
cagccuuuuaggacuauuugug

SEQ ID NO: 22398 - RNA, 22 nt, Human
cagcgcaguguagguggggggc

SEQ ID NO: 22399 - RNA, 22 nt, Human
cagcuacagaggccacauggcu

SEQ ID NO: 22400 - RNA, 22 nt, Human
cagcuagaaaugggauugguau

SEQ ID NO: 22401 - RNA, 22 nt, Human
cagcuagcuucccugcagugcu

SEQ ID NO: 22402 - RNA, 22 nt, Human
cagcuaggaaaccagagggcag

SEQ ID NO: 22403 - RNA, 22 nt, Human
cagcuaggaaguccuuggcgaa

SEQ ID NO: 22404 - RNA, 22 nt, Human
cagcuaggagaaaagguguuuu

SEQ ID NO: 22405 - RNA, 20 nt, Human
cagcuagugguaggagucgg

SEQ ID NO: 22406 - RNA, 22 nt, Human
cagcuauauuguuuucuacugu

SEQ ID NO: 22407 - RNA, 22 nt, Human
cagcuauuccaggaguagaauc

SEQ ID NO: 22408 - RNA, 22 nt, Human
cagcuauuuucucauuaaggau

SEQ ID NO: 22409 - RNA, 22 nt, Human
cagcucacagccacgccauucc

SEQ ID NO: 22410 - RNA, 22 nt, Human
cagcucagucuugaagcacugg

SEQ ID NO: 22411 - RNA, 22 nt, Human
cagcuccagccaccggggggug

SEQ ID NO: 22412 - RNA, 22 nt, Human
cagcucccaguggcagcuccuu

SEQ ID NO: 22413 - RNA, 22 nt, Human
cagcuccccucuguggggcagu

SEQ ID NO: 22414 - RNA, 22 nt, Human
cagcucccgccaucgggaggca

SEQ ID NO: 22415 - RNA, 22 nt, Human
cagcucccuauggugaggcgac

SEQ ID NO: 22416 - RNA, 22 nt, Human
cagcuccuauuagacacugaau

SEQ ID NO: 22417 - RNA, 22 nt, Human
cagcuccucagcccugccuugg

SEQ ID NO: 22418 - RNA, 22 nt, Human
cagcuccucuggccagcccugc

SEQ ID NO: 22419 - RNA, 22 nt, Human
cagcucuacugggcaccauucg

SEQ ID NO: 22420 - RNA, 22 nt, Human
cagcucugaggaacacuccuuu

SEQ ID NO: 22421 - RNA, 17 nt, Human
cagcucugcagacuucc

SEQ ID NO: 22422 - RNA, 22 nt, Human
cagcucugccaucaucugccuu

SEQ ID NO: 22423 - RNA, 22 nt, Human
cagcucugcugggaggaugcag

SEQ ID NO: 22424 - RNA, 22 nt, Human
cagcucuggccagaucuauccu

SEQ ID NO: 22425 - RNA, 22 nt, Human
cagcucuggcuuuggggagcuu

SEQ ID NO: 22426 - RNA, 20 nt, Human
cagcucugggaaagaggcca

SEQ ID NO: 22427 - RNA, 22 nt, Human
cagcucuggguaggaggaaucu

SEQ ID NO: 22428 - RNA, 22 nt, Human
cagcucuguaaauuccuucauc

SEQ ID NO: 22429 - RNA, 22 nt, Human
cagcucuucagagugagcaaug

SEQ ID NO: 22430 - RNA, 22 nt, Human
cagcucuuccauuuccuucagc

SEQ ID NO: 22431 - RNA, 22 nt, Human
cagcugaacauguagagcaucu

SEQ ID NO: 22432 - RNA, 22 nt, Human
cagcugaagaaagagugguuag

SEQ ID NO: 22433 - RNA, 22 nt, Human
cagcugacagugaggugggggc

SEQ ID NO: 22434 - RNA, 22 nt, Human
cagcugacgccagaguggaauu

SEQ ID NO: 22435 - RNA, 22 nt, Human
cagcugagaagugauagcugca

SEQ ID NO: 22436 - RNA, 22 nt, Human
cagcugagaccagaaugcaggu

SEQ ID NO: 22437 - RNA, 22 nt, Human
cagcugagcucccaggccauca

SEQ ID NO: 22438 - RNA, 22 nt, Human
cagcugagucugagguucuuug

SEQ ID NO: 22439 - RNA, 22 nt, Human
cagcugaguggacccuagaggc

SEQ ID NO: 22440 - RNA, 22 nt, Human
cagcugcaaucagaagcuaagg

SEQ ID NO: 22441 - RNA, 22 nt, Human
cagcugcacugaagcagguuug

SEQ ID NO: 22442 - RNA, 22 nt, Human
cagcugcagucaucuucuagaa

SEQ ID NO: 22443 - RNA, 22 nt, Human
cagcugccaagaaucuuuucua

SEQ ID NO: 22444 - RNA, 22 nt, Human
cagcugccacaggacuuucuga

SEQ ID NO: 22445 - RNA, 22 nt, Human
cagcugcccaagccccagaugu

SEQ ID NO: 22446 - RNA, 22 nt, Human
cagcugccugcaacacaagcuu

SEQ ID NO: 22447 - RNA, 22 nt, Human
cagcugccugucuggaggcaau

SEQ ID NO: 22448 - RNA, 21 nt, Human
cagcugcguguccucccaccc

SEQ ID NO: 22449 - RNA, 22 nt, Human
cagcugcucugguggucucucc

SEQ ID NO: 22450 - RNA, 22 nt, Human
cagcugcugaggaagggguugg

SEQ ID NO: 22451 - RNA, 22 nt, Human
cagcugcugauggccugacaga

SEQ ID NO: 22452 - RNA, 22 nt, Human
cagccccucacagagcuguccu

SEQ ID NO: 22453 - RNA, 22 nt, Human
cagccccuuguccgguagccac

SEQ ID NO: 22454 - RNA, 22 nt, Human
cagcccucaaaccacuuccagg

SEQ ID NO: 22455 - RNA, 22 nt, Human
cagcccucagguccucagcagc

SEQ ID NO: 22456 - RNA, 22 nt, Human
cagcccucaucucagcuucuuu

SEQ ID NO: 22457 - RNA, 22 nt, Human
cagcccuccuuucacucccagg

SEQ ID NO: 22458 - RNA, 22 nt, Human
cagcccucugaagaggcgcuug

SEQ ID NO: 22459 - RNA, 18 nt, Human
ccuggaccugucuccuuu

SEQ ID NO: 22460 - RNA, 22 nt, Human
ccuggacuaaaaucuuuucuua

SEQ ID NO: 22461 - RNA, 22 nt, Human
ccuggagaccugauggcagcgg

SEQ ID NO: 22462 - RNA, 22 nt, Human
ccuggagagagaggccaacugc

SEQ ID NO: 22463 - RNA, 22 nt, Human
ccuggagagcucgggccaggca

SEQ ID NO: 22464 - RNA, 22 nt, Human
ccuggagaggagaaagggccca

SEQ ID NO: 22465 - RNA, 22 nt, Human
ccuggagaggcgcugcagagga

SEQ ID NO: 22466 - RNA, 22 nt, Human
ccuggagauuauuugguccaau

SEQ ID NO: 22467 - RNA, 22 nt, Human
ccuggagcccaaggcagugaga

SEQ ID NO: 22468 - RNA, 22 nt, Human
ccuggagccccucuggccagcc

SEQ ID NO: 22469 - RNA, 22 nt, Human
ccuggagcuuuuccaguugaca

SEQ ID NO: 22470 - RNA, 22 nt, Human
ccuggaggagcgcugaccagcu

SEQ ID NO: 22471 - RNA, 22 nt, Human
ccuggaggcagaaauaggacuu

SEQ ID NO: 22472 - RNA, 22 nt, Human
ccuggaggcucugggagggcag

SEQ ID NO: 22473 - RNA, 16 nt, Human
ccuggaggucacuuca

SEQ ID NO: 22474 - RNA, 23 nt, Human
ccuggaguacuaaggggauggaa

SEQ ID NO: 22475 - RNA, 22 nt, Human
ccuggaguuuuuugguugacuc

SEQ ID NO: 22476 - RNA, 22 nt, Human
ccuggaucuuuguuguaaauau

SEQ ID NO: 22477 - RNA, 23 nt, Human
ccuggcacacaguugacauggaa

SEQ ID NO: 22478 - RNA, 22 nt, Human
ccuggcacauaguaaguacuag

SEQ ID NO: 22479 - RNA, 22 nt, Human
ccuggcacaugauagaugcuca

SEQ ID NO: 22480 - RNA, 22 nt, Human
ccuggcagaauauuaaagugca

SEQ ID NO: 22481 - RNA, 22 nt, Human
ccuggcagacagcacugaagcu

SEQ ID NO: 22482 - RNA, 22 nt, Human
ccuggcagcaggugggcccgug

SEQ ID NO: 22483 - RNA, 22 nt, Human
ccuggcagcuaagugcuuugag

SEQ ID NO: 22484 - RNA, 22 nt, Human
ccuggcaggccccuccuggauu

SEQ ID NO: 22485 - RNA, 22 nt, Human
ccuggcagguggagguugcagu

SEQ ID NO: 22486 - RNA, 22 nt, Human
ccuggcaugaggagcaugaggu

SEQ ID NO: 22487 - RNA, 22 nt, Human
ccuggcauucucuccagagaga

SEQ ID NO: 22488 - RNA, 22 nt, Human
ccuggccaaucuagggcuguua

SEQ ID NO: 22489 - RNA, 22 nt, Human
ccuggccacccagccuuggcca

SEQ ID NO: 22490 - RNA, 22 nt, Human
ccuggccacucagguguggggc

SEQ ID NO: 22491 - RNA, 19 nt, Human
ccuggccagacuucugccc

SEQ ID NO: 22492 - RNA, 22 nt, Human
ccuggccaggcauggagucaca

SEQ ID NO: 22493 - RNA, 22 nt, Human
ccuggccaggcucucagcacug

SEQ ID NO: 22494 - RNA, 22 nt, Human
ccuggccaguuuccaggcccug

SEQ ID NO: 22495 - RNA, 16 nt, Human
ccuggcccggcuuccu

SEQ ID NO: 22496 - RNA, 22 nt, Human
ccuggccgacauggugaaacgc

SEQ ID NO: 22497 - RNA, 22 nt, Human
ccuggccucagccuagggcuga

SEQ ID NO: 22498 - RNA, 22 nt, Human
ccuggccugcucggcucuuaag

SEQ ID NO: 22499 - RNA, 22 nt, Human
ccuggcucagcagcucuuucuc

SEQ ID NO: 22500 - RNA, 22 nt, Human
ccuggcuccagcugccuguccu

SEQ ID NO: 22501 - RNA, 22 nt, Human
ccuggcucccuggaccucauua

SEQ ID NO: 22502 - RNA, 22 nt, Human
ccuggcucuggggcggacagcu

SEQ ID NO: 22503 - RNA, 22 nt, Human
ccuggcucuggugaggagaagu

SEQ ID NO: 22504 - RNA, 22 nt, Human
ccuggcucuucugugucagccc

SEQ ID NO: 22505 - RNA, 22 nt, Human
ccuggcugaacaaagucccucc

SEQ ID NO: 22506 - RNA, 22 nt, Human
ccuggcugcucugaugagcgcc

SEQ ID NO: 22507 - RNA, 22 nt, Human
ccuggcugcugucacugaccau

SEQ ID NO: 22508 - RNA, 22 nt, Human
ccuggcugcuuccucugccaug

SEQ ID NO: 22509 - RNA, 22 nt, Human
ccuggcugcuuucacuauggag

SEQ ID NO: 22510 - RNA, 22 nt, Human
ccuggcuggauggagccccugg

SEQ ID NO: 22511 - RNA, 22 nt, Human
ccuggcugguggcagcgacaag

SEQ ID NO: 22512 - RNA, 22 nt, Human
ccuggcuuagagguugccuuuc

SEQ ID NO: 22513 - RNA, 22 nt, Human
ccuggcuuauuuuuauagcagu

SEQ ID NO: 22514 - RNA, 18 nt, Human
ccuggcuuccaucuuggu

SEQ ID NO: 22515 - RNA, 22 nt, Human
ccuggcuuccuggagcucacaa

SEQ ID NO: 22516 - RNA, 22 nt, Human
ccuggcuucuauaccaccaggu

SEQ ID NO: 22517 - RNA, 22 nt, Human
ccugggaacagcagaguccugg

SEQ ID NO: 22518 - RNA, 22 nt, Human
ccugggaacaguggguuggcuc

SEQ ID NO: 22519 - RNA, 22 nt, Human
ccugggaagagcugacaggagg

SEQ ID NO: 22520 - RNA, 22 nt, Human
ccugggaagcccauagcagcuu

SEQ ID NO: 22521 - RNA, 22 nt, Human
ccugggaaggugaggcccugga

SEQ ID NO: 22522 - RNA, 22 nt, Human
ccugggacuuggucugggguuu

SEQ ID NO: 22523 - RNA, 22 nt, Human
ccugggagagucuguggucucc

SEQ ID NO: 22524 - RNA, 21 nt, Human
ccugggagaucagcugccuuc

SEQ ID NO: 22525 - RNA, 22 nt, Human
ccugggagccgacugacugugc

SEQ ID NO: 22526 - RNA, 22 nt, Human
ccugggaggcagagguugcagu

SEQ ID NO: 22527 - RNA, 22 nt, Human
ccugggaggcggagguugcagu

SEQ ID NO: 22528 - RNA, 22 nt, Human
ccugggaggcuguuuccagccu

SEQ ID NO: 22529 - RNA, 22 nt, Human
ccugggaugaaagcagcccacu

SEQ ID NO: 22530 - RNA, 22 nt, Human
ccugggauuuccugagcacucu

SEQ ID NO: 22531 - RNA, 22 nt, Human
ccugggcaauauagugaggccc

SEQ ID NO: 22532 - RNA, 22 nt, Human
ccugggcagggagaccaggcuc

SEQ ID NO: 22533 - RNA, 22 nt, Human
ccugggcagggcuggacucuca

SEQ ID NO: 22534 - RNA, 22 nt, Human
ccugggcagguguggcuucccc

SEQ ID NO: 22535 - RNA, 22 nt, Human
ccugggcauaaaucacuccaag

SEQ ID NO: 22536 - RNA, 22 nt, Human
ccugggcaucaacaagcagaga

SEQ ID NO: 22537 - RNA, 22 nt, Human
ccugggcaucucaugcaccugc

SEQ ID NO: 22538 - RNA, 23 nt, Human
ccugggcauuggcugcagcuucu

SEQ ID NO: 22539 - RNA, 21 nt, Human
ccugggccaaauucccuggac

SEQ ID NO: 22540 - RNA, 19 nt, Human
ccugggccuccaucacccc

SEQ ID NO: 22541 - RNA, 22 nt, Human
ccugggccugaaaacauuucuc

SEQ ID NO: 22542 - RNA, 22 nt, Human
ccugggccuggcgggucggcuc

SEQ ID NO: 22543 - RNA, 22 nt, Human
ccugggcucacagccaaggcuc

SEQ ID NO: 22544 - RNA, 22 nt, Human
ccugggcucaggcuugggcagc

SEQ ID NO: 22545 - RNA, 22 nt, Human
ccugggcucuauccugacccag

SEQ ID NO: 22546 - RNA, 16 nt, Human
ccugggcucuguugga

SEQ ID NO: 22547 - RNA, 22 nt, Human
ccugggcugaagucaagugugg

SEQ ID NO: 22548 - RNA, 22 nt, Human
ccugggcuuacgaccucugacu

SEQ ID NO: 22549 - RNA, 22 nt, Human
ccugggcuuccacgagcagagg

SEQ ID NO: 22550 - RNA, 22 nt, Human
ccugggcuucugucuagauguu

SEQ ID NO: 22551 - RNA, 22 nt, Human
ccugggcuuuggaacaguacuu

SEQ ID NO: 22552 - RNA, 22 nt, Human
ccuggggaagucacuucucuuu

SEQ ID NO: 22553 - RNA, 22 nt, Human
ccuggggaauagagucaagggg

SEQ ID NO: 22554 - RNA, 22 nt, Human
ccuggggagccgccugagcccc

SEQ ID NO: 22555 - RNA, 22 nt, Human
ccuggggauucugacacggagu

SEQ ID NO: 22556 - RNA, 22 nt, Human
ccuggggcuccagagcagcgga

SEQ ID NO: 22557 - RNA, 22 nt, Human
ccugggguauauaggugaauau

SEQ ID NO: 22558 - RNA, 22 nt, Human
ccuggggucagggacgcugugc

SEQ ID NO: 22559 - RNA, 22 nt, Human
ccugggucccaucccagaguga

SEQ ID NO: 22560 - RNA, 22 nt, Human
ccuggguccuggcagccuccug

SEQ ID NO: 22561 - RNA, 22 nt, Human
ccugggucuauagacuucaaga

SEQ ID NO: 22562 - RNA, 22 nt, Human
ccugggucuggucacuaaguca

SEQ ID NO: 22563 - RNA, 22 nt, Human
ccugggucuucagucugcuggu

SEQ ID NO: 22564 - RNA, 22 nt, Human
ccugggugaaugauauucuaaa

SEQ ID NO: 22565 - RNA, 22 nt, Human
ccugggugacccgugagcgucc

SEQ ID NO: 22566 - RNA, 22 nt, Human
ccugggugaugugcugcccucg

SEQ ID NO: 22567 - RNA, 22 nt, Human
ccugggugcccggcccuucucu

SEQ ID NO: 22568 - RNA, 22 nt, Human
caggagcuggauaggaccacaa

SEQ ID NO: 22569 - RNA, 22 nt, Human
caggaggaaaguuccacucaac

SEQ ID NO: 22570 - RNA, 22 nt, Human
caggaggaacaagagguucugg

SEQ ID NO: 22571 - RNA, 22 nt, Human
ccuggugccacuagagaauguc

SEQ ID NO: 22572 - RNA, 22 nt, Human
ccuggugcccccaagccagcug

SEQ ID NO: 22573 - RNA, 22 nt, Human
ccugguuuaugccagauccugu

SEQ ID NO: 22574 - RNA, 22 nt, Human
ccugguuuguauuuuuaacacc

SEQ ID NO: 22575 - RNA, 22 nt, Human
ccugguuuuucaaacauacaag

SEQ ID NO: 22576 - RNA, 22 nt, Human
ccuguaacuccuuggcucaagu

SEQ ID NO: 22577 - RNA, 22 nt, Human
ccuguaccgcgaucugcugcgc

SEQ ID NO: 22578 - RNA, 22 nt, Human
ccuguacuagggucucauugcc

SEQ ID NO: 22579 - RNA, 22 nt, Human
ccuguagaaucuguagacccau

SEQ ID NO: 22580 - RNA, 22 nt, Human
ccuguaggaacgccuucauuug

SEQ ID NO: 22581 - RNA, 22 nt, Human
ccuguaggauauuguagaauac

SEQ ID NO: 22582 - RNA, 22 nt, Human
ccuguauuugcaacuuuucuua

SEQ ID NO: 22583 - RNA, 22 nt, Human
ccuguccagggacugagggaga

SEQ ID NO: 22584 - RNA, 22 nt, Human
ccugucccccaggccuguacca

SEQ ID NO: 22585 - RNA, 22 nt, Human
ccuguccccucacaaugccacu

SEQ ID NO: 22586 - RNA, 22 nt, Human
ccugucucccuggcauggcuca

SEQ ID NO: 22587 - RNA, 22 nt, Human
ccugucugcaugaucccugcca

SEQ ID NO: 22588 - RNA, 22 nt, Human
ccugucuggaacauggccuguu

SEQ ID NO: 22589 - RNA, 22 nt, Human
ccugucuggccuuccacggggg

SEQ ID NO: 22590 - RNA, 22 nt, Human
ccugucuguauugguuugcuau

SEQ ID NO: 22591 - RNA, 19 nt, Human
ccugucugucuucagcuag

SEQ ID NO: 22592 - RNA, 22 nt, Human
ccugucuguuugcccauucuug

SEQ ID NO: 22593 - RNA, 21 nt, Human
ccugucuuggacugaggcacc

SEQ ID NO: 22594 - RNA, 22 nt, Human
ccugugacaaacccgccuauuc

SEQ ID NO: 22595 - RNA, 18 nt, Human
ccugugacagaggcauca

SEQ ID NO: 22596 - RNA, 22 nt, Human
ccugugaccacucugguucugc

SEQ ID NO: 22597 - RNA, 22 nt, Human
ccugugacccuuccagucuacu

SEQ ID NO: 22598 - RNA, 22 nt, Human
ccugugaggucuugcaugugaa

SEQ ID NO: 22599 - RNA, 22 nt, Human
ccugugaugguguuacacuguu

SEQ ID NO: 22600 - RNA, 19 nt, Human
ccugugcacauguguccuu

SEQ ID NO: 22601 - RNA, 22 nt, Human
ccugugcauugcaggguguuca

SEQ ID NO: 22602 - RNA, 22 nt, Human
ccugugccaaaaucuaggcagu

SEQ ID NO: 22603 - RNA, 22 nt, Human
ccugugccuuaacccuuuaggc

SEQ ID NO: 22604 - RNA, 18 nt, Human
ccugugcuccagcaucug

SEQ ID NO: 22605 - RNA, 22 nt, Human
ccugugcucccuauguaucugg

SEQ ID NO: 22606 - RNA, 22 nt, Human
ccugugcuggcuuuauucucag

SEQ ID NO: 22607 - RNA, 22 nt, Human
ccuguggacauucuguguggaa

SEQ ID NO: 22608 - RNA, 21 nt, Human
ccuguggauuuuaaaauugga

SEQ ID NO: 22609 - RNA, 18 nt, Human
ccuguggcucagcccaca

SEQ ID NO: 22610 - RNA, 22 nt, Human
ccuguggcucucuuuggagguc

SEQ ID NO: 22611 - RNA, 22 nt, Human
ccugugggcccuggacagagac

SEQ ID NO: 22612 - RNA, 22 nt, Human
ccuguggggcugaaagaggcuu

SEQ ID NO: 22613 - RNA, 22 nt, Human
ccuguguccaguuccagguugu

SEQ ID NO: 22614 - RNA, 22 nt, Human
ccuguguggaaggcaggaggcc

SEQ ID NO: 22615 - RNA, 22 nt, Human
ccuguguggccgcacugcuccc

SEQ ID NO: 22616 - RNA, 22 nt, Human
ccugugugguagccagcggugc

SEQ ID NO: 22617 - RNA, 22 nt, Human
ccuguguguaggccaggggagu

SEQ ID NO: 22618 - RNA, 22 nt, Human
ccugugugucugucacugcaca

SEQ ID NO: 22619 - RNA, 21 nt, Human
ccugugugugucccuuuaaga

SEQ ID NO: 22620 - RNA, 17 nt, Human
ccuguguuugcuccuuc

SEQ ID NO: 22621 - RNA, 18 nt, Human
ccuguuacacacuggggu

SEQ ID NO: 22622 - RNA, 22 nt, Human
ccuguucaagggaugauugacc

SEQ ID NO: 22623 - RNA, 22 nt, Human
ccuguucaauauucuuccuugu

SEQ ID NO: 22624 - RNA, 22 nt, Human
ccuguucaaugcccuggcuuca

SEQ ID NO: 22625 - RNA, 21 nt, Human
ccuguucacagaucuguaacu

SEQ ID NO: 22626 - RNA, 22 nt, Human
ccuguucaccauggucacgugc

SEQ ID NO: 22627 - RNA, 22 nt, Human
ccuguucacgguguguuguuag

SEQ ID NO: 22628 - RNA, 19 nt, Human
ccuguucaugacucugucc

SEQ ID NO: 22629 - RNA, 22 nt, Human
ccuguuccauucauauccuauu

SEQ ID NO: 22630 - RNA, 22 nt, Human
ccuguucuaaucuuggggcaga

SEQ ID NO: 22631 - RNA, 22 nt, Human
ccuguucuugucucauuggcua

SEQ ID NO: 22632 - RNA, 22 nt, Human
ccuguugcucugcaugaguuua

SEQ ID NO: 22633 - RNA, 17 nt, Human
ccuguuguugccuuugc

SEQ ID NO: 22634 - RNA, 22 nt, Human
ccuguuguuuacugcagugagu

SEQ ID NO: 22635 - RNA, 22 nt, Human
ccuguuuagugaggugaggagu

SEQ ID NO: 22636 - RNA, 22 nt, Human
ccuuaaaagaacuaucucuucu

SEQ ID NO: 22637 - RNA, 22 nt, Human
ccuuaaacucugauaugauauu

SEQ ID NO: 22638 - RNA, 22 nt, Human
ccuuaaacuuuaucuugugaga

SEQ ID NO: 22639 - RNA, 22 nt, Human
ccuuaaagaauaagucuuaucu

SEQ ID NO: 22640 - RNA, 22 nt, Human
ccuuaaucugauauggcuggug

SEQ ID NO: 22641 - RNA, 22 nt, Human
ccuuaauuucuguccuucagau

SEQ ID NO: 22642 - RNA, 22 nt, Human
ccuuacaaugcaguuuacuuag

SEQ ID NO: 22643 - RNA, 22 nt, Human
ccuuagaaauguaccaaaggaa

SEQ ID NO: 22644 - RNA, 22 nt, Human
ccuuagcagggagucuguccag

SEQ ID NO: 22645 - RNA, 22 nt, Human
ccuuagcagggccgggccuggg

SEQ ID NO: 22646 - RNA, 22 nt, Human
ccuuagcuggagugguggaaug

SEQ ID NO: 22647 - RNA, 20 nt, Human
ccuucagaacuuacauagua

SEQ ID NO: 22648 - RNA, 22 nt, Human
ccuucagcguccccuuuacccg

SEQ ID NO: 22649 - RNA, 22 nt, Human
ccuucaggucauauaugucaga

SEQ ID NO: 22650 - RNA, 22 nt, Human
ccuucaugauggaaaggguuca

SEQ ID NO: 22651 - RNA, 22 nt, Human
ccuuccagaguucagucugccc

SEQ ID NO: 22652 - RNA, 22 nt, Human
ccuuccaggagucucugcaggu

SEQ ID NO: 22653 - RNA, 22 nt, Human
ccuuccaggcuggaggcuuggg

SEQ ID NO: 22654 - RNA, 22 nt, Human
ccuuccagugacuaaggaggaa

SEQ ID NO: 22655 - RNA, 22 nt, Human
ccuucccaggcuagaccaacau

SEQ ID NO: 22656 - RNA, 20 nt, Human
ccuuccccacccgcugaggu

SEQ ID NO: 22657 - RNA, 22 nt, Human
ccuuccccaggugcucacuguc

SEQ ID NO: 22658 - RNA, 22 nt, Human
ccuuccuuugcaggucagguca

SEQ ID NO: 22659 - RNA, 22 nt, Human
ccuuccuuugcaucauuucuag

SEQ ID NO: 22660 - RNA, 22 nt, Human
ccuuccuuuuacugucuccgga

SEQ ID NO: 22661 - RNA, 22 nt, Human
ccuucuccugccuuggguucau

SEQ ID NO: 22662 - RNA, 20 nt, Human
ccuucucuggaauugccucc

SEQ ID NO: 22663 - RNA, 18 nt, Human
ccuucugacgcuugagaa

SEQ ID NO: 22664 - RNA, 22 nt, Human
ccuucuucaccaguuuaccuga

SEQ ID NO: 22665 - RNA, 22 nt, Human
ccuucuucuguguggcccaaga

SEQ ID NO: 22666 - RNA, 22 nt, Human
ccuugacugccuucaggcuggg

SEQ ID NO: 22667 - RNA, 22 nt, Human
ccuugacuguaauggaguaggg

SEQ ID NO: 22668 - RNA, 22 nt, Human
ccuugagacacagccaaagaug

SEQ ID NO: 22669 - RNA, 22 nt, Human
ccuugagaugagcuaauuuuuu

SEQ ID NO: 22670 - RNA, 22 nt, Human
ccuugcagcauauagagucccu

SEQ ID NO: 22671 - RNA, 22 nt, Human
ccuugcaguuguuacuguagcc

SEQ ID NO: 22672 - RNA, 22 nt, Human
ccuugcccgcugccucugaguu

SEQ ID NO: 22673 - RNA, 19 nt, Human
ccuugccugucccugcagc

SEQ ID NO: 22674 - RNA, 22 nt, Human
ccuugcugaccaucaccuuuga

SEQ ID NO: 22675 - RNA, 22 nt, Human
ccuuggagacagguuugcuuuc

SEQ ID NO: 22676 - RNA, 22 nt, Human
ccuuggagcggucagcacuggu

SEQ ID NO: 22677 - RNA, 22 nt, Human
ccuuggauuuugugcccacgcc

SEQ ID NO: 22678 - RNA, 22 nt, Human
caggguuucaccauguuagcag

SEQ ID NO: 22679 - RNA, 22 nt, Human
cagguaacuuuagugaaagagc

SEQ ID NO: 22680 - RNA, 22 nt, Human
cagguagaggcugccaucagcu

SEQ ID NO: 22681 - RNA, 22 nt, Human
cagguagggauaugauggugau

SEQ ID NO: 22682 - RNA, 22 nt, Human
cagguagguauggugcagucuu

SEQ ID NO: 22683 - RNA, 22 nt, Human
cagguauaugugcauccauaga

SEQ ID NO: 22684 - RNA, 22 nt, Human
cagguccaauugcgcuaaaauc

SEQ ID NO: 22685 - RNA, 22 nt, Human
cagguccaguaaaaagaguccu

SEQ ID NO: 22686 - RNA, 17 nt, Human
caggucccagggucucu

SEQ ID NO: 22687 - RNA, 22 nt, Human
cagguccccaggguaccuaccu

SEQ ID NO: 22688 - RNA, 22 nt, Human
caggucccguuccccagagauu

SEQ ID NO: 22689 - RNA, 22 nt, Human
cagguccucgggggaggccggc

SEQ ID NO: 22690 - RNA, 22 nt, Human
cagguccugccuugguuacccu

SEQ ID NO: 22691 - RNA, 22 nt, Human
cagguccuuguuuguaaagcag

SEQ ID NO: 22692 - RNA, 22 nt, Human
caggucucggguucagcaguga

SEQ ID NO: 22693 - RNA, 22 nt, Human
caggucucuuuugucacaccac

SEQ ID NO: 22694 - RNA, 22 nt, Human
caggucugaagagucacaugcc

SEQ ID NO: 22695 - RNA, 22 nt, Human
caggucugcaggcuggagucca

SEQ ID NO: 22696 - RNA, 22 nt, Human
caggucuggguugauggccugg

SEQ ID NO: 22697 - RNA, 21 nt, Human
caggucuggugaacacucuca

SEQ ID NO: 22698 - RNA, 22 nt, Human
caggucuguauuaacagagggu

SEQ ID NO: 22699 - RNA, 18 nt, Human
caggucugucugccuccc

SEQ ID NO: 22700 - RNA, 22 nt, Human
caggugaaaaagcaaccauauu

SEQ ID NO: 22701 - RNA, 22 nt, Human
caggugaacucaguuuuguauu

SEQ ID NO: 22702 - RNA, 22 nt, Human
caggugacccucaguguggacu

SEQ ID NO: 22703 - RNA, 17 nt, Human
caggugaccuggugaug

SEQ ID NO: 22704 - RNA, 22 nt, Human
caggugccgggaaugcagcaau

SEQ ID NO: 22705 - RNA, 22 nt, Human
cagggucugaaacugaucacag

SEQ ID NO: 22706 - RNA, 22 nt, Human
cagggugacugcccuggccacu

SEQ ID NO: 22707 - RNA, 22 nt, Human
cagggugagugggaagcagcgu

SEQ ID NO: 22708 - RNA, 22 nt, Human
cagggugcagugucgcugcuag

SEQ ID NO: 22709 - RNA, 22 nt, Human
cagggugccuguccucagcaaa

SEQ ID NO: 22710 - RNA, 22 nt, Human
cagggugcgggagaugugcacc

SEQ ID NO: 22711 - RNA, 22 nt, Human
cagggugcuuagaaauggaccu

SEQ ID NO: 22712 - RNA, 22 nt, Human
cagggugggcacccagccucca

SEQ ID NO: 22713 - RNA, 22 nt, Human
caggguggggcuggcuaucaaa

SEQ ID NO: 22714 - RNA, 22 nt, Human
caggguguauaguguagaaguu

SEQ ID NO: 22715 - RNA, 22 nt, Human
caggguucagugggcccucuug

SEQ ID NO: 22716 - RNA, 22 nt, Human
caggguugauuccuucugaggg

SEQ ID NO: 22717 - RNA, 22 nt, Human
caggguugguuucuccucaggc

SEQ ID NO: 22718 - RNA, 22 nt, Human
cagguaagagacggauuggccc

SEQ ID NO: 22719 - RNA, 22 nt, Human
cagguacacaggacaaaguacu

SEQ ID NO: 22720 - RNA, 17 nt, Human
cagguacauugcuacug

SEQ ID NO: 22721 - RNA, 22 nt, Human
cagguagcugcagagacuauuu

SEQ ID NO: 22722 - RNA, 22 nt, Human
cagguagcugcuggccauguac

SEQ ID NO: 22723 - RNA, 22 nt, Human
cagguagcuuuugauauuaggg

SEQ ID NO: 22724 - RNA, 22 nt, Human
cagguagguuuuaggcuaaaca

SEQ ID NO: 22725 - RNA, 22 nt, Human
cagguaguccacagugagggag

SEQ ID NO: 22726 - RNA, 22 nt, Human
cagguauaacgugcauguugua

SEQ ID NO: 22727 - RNA, 23 nt, Human
cagguauugauuuuucuucuagg

SEQ ID NO: 22728 - RNA, 22 nt, Human
caggucaaagguuaguuauguu

SEQ ID NO: 22729 - RNA, 22 nt, Human
caggucagcuggugccccaggu

SEQ ID NO: 22730 - RNA, 22 nt, Human
cagguccaagagauccuccuac

SEQ ID NO: 22731 - RNA, 22 nt, Human
cagguccaagguuccugaauag

SEQ ID NO: 22732 - RNA, 22 nt, Human
caggucccgccccgggcugacc

SEQ ID NO: 22733 - RNA, 22 nt, Human
caggucccugcgccccggccuc

SEQ ID NO: 22734 - RNA, 22 nt, Human
cagguccucacgccucacccuu

SEQ ID NO: 22735 - RNA, 22 nt, Human
cagguccucugagaugggaggu

SEQ ID NO: 22736 - RNA, 22 nt, Human
cagguccuggcaucaggcaggu

SEQ ID NO: 22737 - RNA, 22 nt, Human
caggucuccagcucagggucca

SEQ ID NO: 22738 - RNA, 22 nt, Human
caggucuccauuuugaugaguu

SEQ ID NO: 22739 - RNA, 22 nt, Human
caggucucccauccccucuguu

SEQ ID NO: 22740 - RNA, 22 nt, Human
caggucucugcagccccucugu

SEQ ID NO: 22741 - RNA, 17 nt, Human
caggucugaggccaggc

SEQ ID NO: 22742 - RNA, 22 nt, Human
caggucugugugccauuuccaa

SEQ ID NO: 22743 - RNA, 22 nt, Human
caggucuguuuccaucagugcu

SEQ ID NO: 22744 - RNA, 22 nt, Human
caggucuguuuucaaggucagu

SEQ ID NO: 22745 - RNA, 22 nt, Human
caggucuuuucuacugguggag

SEQ ID NO: 22746 - RNA, 22 nt, Human
caggugaaucacuugaguccag

SEQ ID NO: 22747 - RNA, 22 nt, Human
caggugacccucucaccugcuu

SEQ ID NO: 22748 - RNA, 22 nt, Human
caggugacuucugaggccuuca

SEQ ID NO: 22749 - RNA, 22 nt, Human
caggugagaggcgguccugcau

SEQ ID NO: 22750 - RNA, 22 nt, Human
caggugaguuugcuauuguaca

SEQ ID NO: 22751 - RNA, 22 nt, Human
caggugcaaugagacagcucug

SEQ ID NO: 22752 - RNA, 22 nt, Human
caggugcucugcugcagguaag

SEQ ID NO: 22753 - RNA, 22 nt, Human
caggugcugcagggcuggcguc

SEQ ID NO: 22754 - RNA, 22 nt, Human
caggugcugcguggcggagcug

SEQ ID NO: 22755 - RNA, 22 nt, Human
cagguggccuugccaucuccug

SEQ ID NO: 22756 - RNA, 22 nt, Human
cagguggcuuagucccauuuua

SEQ ID NO: 22757 - RNA, 22 nt, Human
caggugggagccacagcguaca

SEQ ID NO: 22758 - RNA, 22 nt, Human
caggugggccaugaaaaaugac

SEQ ID NO: 22759 - RNA, 22 nt, Human
caggugggcuugggagaacacu

SEQ ID NO: 22760 - RNA, 18 nt, Human
caggugggucuccugccc

SEQ ID NO: 22761 - RNA, 22 nt, Human
caggugguacuuaaagucagaa

SEQ ID NO: 22762 - RNA, 22 nt, Human
caggugguuccauguuucauga

SEQ ID NO: 22763 - RNA, 22 nt, Human
caggugucggucaggcgguuuu

SEQ ID NO: 22764 - RNA, 22 nt, Human
cagguuagcaacaugguuagag

SEQ ID NO: 22765 - RNA, 22 nt, Human
cagguuaguaaggucuacauaa

SEQ ID NO: 22766 - RNA, 22 nt, Human
cagguuaguuaaucuuuguuuc

SEQ ID NO: 22767 - RNA, 22 nt, Human
cagguucagcaggaggcauccc

SEQ ID NO: 22768 - RNA, 22 nt, Human
cagguucccuagcagcaaagcc

SEQ ID NO: 22769 - RNA, 22 nt, Human
cagguucugccauuuacuugua

SEQ ID NO: 22770 - RNA, 22 nt, Human
cagguugaaaguggaggagcua

SEQ ID NO: 22771 - RNA, 22 nt, Human
cagguugggcugcgaggaggag

SEQ ID NO: 22772 - RNA, 22 nt, Human
cagguuggggacuuaggaugac

SEQ ID NO: 22773 - RNA, 22 nt, Human
caguaaaagauggaaauagaau

SEQ ID NO: 22774 - RNA, 22 nt, Human
caguaaacaguuacuaagaaga

SEQ ID NO: 22775 - RNA, 22 nt, Human
caguaaauccuagagcccucau

SEQ ID NO: 22776 - RNA, 22 nt, Human
caguaaaugguacguauauuuu

SEQ ID NO: 22777 - RNA, 22 nt, Human
caguaaauguccucgcagggaa

SEQ ID NO: 22778 - RNA, 22 nt, Human
caguaaauuaucucaucucugu

SEQ ID NO: 22779 - RNA, 22 nt, Human
caguaacaggcucugugguaua

SEQ ID NO: 22780 - RNA, 22 nt, Human
caguaacauuucaagguagagg

SEQ ID NO: 22781 - RNA, 22 nt, Human
caguaacugaugugaucaaacg

SEQ ID NO: 22782 - RNA, 22 nt, Human
caguaagaauaugaaucaggau

SEQ ID NO: 22783 - RNA, 22 nt, Human
caguaaggaugcacauaacuag

SEQ ID NO: 22784 - RNA, 22 nt, Human
caguaagucaacaaacaugggg

SEQ ID NO: 22785 - RNA, 22 nt, Human
caguaauaaagcuaaguauuuc

SEQ ID NO: 22786 - RNA, 22 nt, Human
caguaauaagcuggagggugug

SEQ ID NO: 22787 - RNA, 22 nt, Human
caguggaugguuugucuugccu

SEQ ID NO: 22788 - RNA, 22 nt, Human
caguggauuagccagagcugga

SEQ ID NO: 22789 - RNA, 22 nt, Human
caguggcaaggacaguaauaau

SEQ ID NO: 22790 - RNA, 22 nt, Human
caguggcaaugggacagagcac

SEQ ID NO: 22791 - RNA, 22 nt, Human
caguggcacccacgggcugggc

SEQ ID NO: 22792 - RNA, 22 nt, Human
caguggcacuugucauuucuga

SEQ ID NO: 22793 - RNA, 22 nt, Human
caguggcagagaacagagaccu

SEQ ID NO: 22794 - RNA, 22 nt, Human
caguggcaggauuucagcucag

SEQ ID NO: 22795 - RNA, 22 nt, Human
caguggcauacuuggcugauau

SEQ ID NO: 22796 - RNA, 22 nt, Human
caguggcaugguugacugcagu

SEQ ID NO: 22797 - RNA, 17 nt, Human
caguggccuauggcuuu

SEQ ID NO: 22798 - RNA, 22 nt, Human
caguggccucuggcuuugcugu

SEQ ID NO: 22799 - RNA, 22 nt, Human
caguggcugagaguggacacug

SEQ ID NO: 22800 - RNA, 20 nt, Human
caguggcugauaacaaauua

SEQ ID NO: 22801 - RNA, 22 nt, Human
caguggcuucucaugucauuca

SEQ ID NO: 22802 - RNA, 20 nt, Human
caguggcuucuguggaauau

SEQ ID NO: 22803 - RNA, 23 nt, Human
cagugggaggacugagauaaaac

SEQ ID NO: 22804 - RNA, 22 nt, Human
cagugggguuucugugggugcu

SEQ ID NO: 22805 - RNA, 22 nt, Human
caguggguggcuaaguggcuga

SEQ ID NO: 22806 - RNA, 22 nt, Human
cagugguacucucagauguuua

SEQ ID NO: 22807 - RNA, 22 nt, Human
cagugguagaagccaaguagau

SEQ ID NO: 22808 - RNA, 17 nt, Human
caguggucugagguaug

SEQ ID NO: 22809 - RNA, 22 nt, Human
cagugguggaaugaggaauugu

SEQ ID NO: 22810 - RNA, 22 nt, Human
cagugguugucagcaacaauau

SEQ ID NO: 22811 - RNA, 22 nt, Human
cagugguuuaggucaaggggag

SEQ ID NO: 22812 - RNA, 22 nt, Human
cagugguuuccaaacuuguucc

SEQ ID NO: 22813 - RNA, 22 nt, Human
caguguaagaauucaaagccua

SEQ ID NO: 22814 - RNA, 22 nt, Human
caguguacuuggaauguaacag

SEQ ID NO: 22815 - RNA, 22 nt, Human
caguguccucagccagcagcua

SEQ ID NO: 22816 - RNA, 22 nt, Human
cagugucucccccagguucugu

SEQ ID NO: 22817 - RNA, 22 nt, Human
cagugucuuauuuguagcucag

SEQ ID NO: 22818 - RNA, 22 nt, Human
cagugucuuucagacucagaaa

SEQ ID NO: 22819 - RNA, 22 nt, Human
cagugugacuucugagcugcca

SEQ ID NO: 22820 - RNA, 22 nt, Human
cagugugaggaauuagugucca

SEQ ID NO: 22821 - RNA, 22 nt, Human
cagugugcugcagagaacauuu

SEQ ID NO: 22822 - RNA, 19 nt, Human
cuccuggcucugucauuuu

SEQ ID NO: 22823 - RNA, 18 nt, Human
cuccuggcugauggugag

SEQ ID NO: 22824 - RNA, 22 nt, Human
cuccugggaaaugaaggggcag

SEQ ID NO: 22825 - RNA, 22 nt, Human
cuccugggaggaugcggacccg

SEQ ID NO: 22826 - RNA, 22 nt, Human
cuccugggaugacucuuucuuu

SEQ ID NO: 22827 - RNA, 22 nt, Human
cuccugggcucauaucauucag

SEQ ID NO: 22828 - RNA, 22 nt, Human
cuccugggcugucggcgcucug

SEQ ID NO: 22829 - RNA, 22 nt, Human
cuccuggggccauggaaggaac

SEQ ID NO: 22830 - RNA, 22 nt, Human
cuccugggucauugccagcaaa

SEQ ID NO: 22831 - RNA, 20 nt, Human
cuccugguccaggagccuga

SEQ ID NO: 22832 - RNA, 22 nt, Human
cuccuguggcuuucugauuuca

SEQ ID NO: 22833 - RNA, 22 nt, Human
cuccugugguacucccagggcc

SEQ ID NO: 22834 - RNA, 22 nt, Human
cuccuguggucaagggugggac

SEQ ID NO: 22835 - RNA, 22 nt, Human
cuccuuagugccucugcacgag

SEQ ID NO: 22836 - RNA, 22 nt, Human
cuccuucagucugcguggcugu

SEQ ID NO: 22837 - RNA, 22 nt, Human
cuccuucaugucauguguccgg

SEQ ID NO: 22838 - RNA, 19 nt, Human
cuccuucccugguuucugu

SEQ ID NO: 22839 - RNA, 22 nt, Human
cuccuucccuucaaguguuccu

SEQ ID NO: 22840 - RNA, 22 nt, Human
cuccuuccugguuagcaccuua

SEQ ID NO: 22841 - RNA, 22 nt, Human
cuccuugguguaguacugagca

SEQ ID NO: 22842 - RNA, 22 nt, Human
cucgagagauccucuugccacc

SEQ ID NO: 22843 - RNA, 22 nt, Human
cucgcaggacagugcuaggacu

SEQ ID NO: 22844 - RNA, 22 nt, Human
cucgccugccugugucucuccc

SEQ ID NO: 22845 - RNA, 22 nt, Human
cucgcggcgcccgaagcccuug

SEQ ID NO: 22846 - RNA, 22 nt, Human
cucggagaugcuggcugagauc

SEQ ID NO: 22847 - RNA, 22 nt, Human
cucgggcaggagggcccucucc

SEQ ID NO: 22848 - RNA, 22 nt, Human
cucguugcugaagccaaaguca

SEQ ID NO: 22849 - RNA, 22 nt, Human
cucuaaauccacgguauaguug

SEQ ID NO: 22850 - RNA, 22 nt, Human
cucuaaggaacucccccaaacu

SEQ ID NO: 22851 - RNA, 22 nt, Human
cucuacuccaaaaggcuacaau

SEQ ID NO: 22852 - RNA, 21 nt, Human
cucuagaaaucgaauaaccuu

SEQ ID NO: 22853 - RNA, 22 nt, Human
cucuagaacugauugggaagaa

SEQ ID NO: 22854 - RNA, 22 nt, Human
cucuagaagcugaggggcccaa

SEQ ID NO: 22855 - RNA, 22 nt, Human
cucuagaaugaauuagcgcagg

SEQ ID NO: 22856 - RNA, 22 nt, Human
cucuagaggcuugaaugggcga

SEQ ID NO: 22857 - RNA, 22 nt, Human
cucuagcuuuugauaccagugu

SEQ ID NO: 22858 - RNA, 22 nt, Human
cucuagggcucugugagguugg

SEQ ID NO: 22859 - RNA, 22 nt, Human
cucuagggugcaggccccagga

SEQ ID NO: 22860 - RNA, 22 nt, Human
cucuauuuauggcaucuuuaug

SEQ ID NO: 22861 - RNA, 20 nt, Human
cucucacagcucccucagcc

SEQ ID NO: 22862 - RNA, 22 nt, Human
cucucagauggagugugaaugg

SEQ ID NO: 22863 - RNA, 22 nt, Human
cucucagguagagcccaagaau

SEQ ID NO: 22864 - RNA, 22 nt, Human
cucucaguccugcgcgccucug

SEQ ID NO: 22865 - RNA, 22 nt, Human
cucucagugccacacagccauu

SEQ ID NO: 22866 - RNA, 22 nt, Human
cucucagugccugcccuaggcu

SEQ ID NO: 22867 - RNA, 23 nt, Human
cucuccaccuucccacccaggga

SEQ ID NO: 22868 - RNA, 22 nt, Human
cucuccagaauuauuacuauua

SEQ ID NO: 22869 - RNA, 22 nt, Human
cucuccagagcccuuccggccc

SEQ ID NO: 22870 - RNA, 22 nt, Human
cucuccagcagauguagucugu

SEQ ID NO: 22871 - RNA, 22 nt, Human
cucuccagccaggggcuuccug

SEQ ID NO: 22872 - RNA, 22 nt, Human
cucuccagccuuuagcccacgc

SEQ ID NO: 22873 - RNA, 19 nt, Human
cucuccagcuccaguagcu

SEQ ID NO: 22874 - RNA, 22 nt, Human
cucuccaggagcucagagucua

SEQ ID NO: 22875 - RNA, 22 nt, Human
cucuccagggcaugaguuccac

SEQ ID NO: 22876 - RNA, 21 nt, Human
cucuccagguaggauaaaugu

SEQ ID NO: 22877 - RNA, 22 nt, Human
cucuccagucaggaacucugac

SEQ ID NO: 22878 - RNA, 22 nt, Human
cucuccagucauauucucaguc

SEQ ID NO: 22879 - RNA, 22 nt, Human
cucuccaguuaccuaggucuga

SEQ ID NO: 22880 - RNA, 22 nt, Human
cucuccaguuauagcugauuug

SEQ ID NO: 22881 - RNA, 22 nt, Human
cucucccccacagcagccuucu

SEQ ID NO: 22882 - RNA, 23 nt, Human
cucucccccuuugauguuagcuc

SEQ ID NO: 22883 - RNA, 22 nt, Human
cucucccuggccagcugugcag

SEQ ID NO: 22884 - RNA, 22 nt, Human
cucucccuugggugggcuuugg

SEQ ID NO: 22885 - RNA, 22 nt, Human
cucuccuauugugugguaagga

SEQ ID NO: 22886 - RNA, 20 nt, Human
cucuccucacccgugucagg

SEQ ID NO: 22887 - RNA, 22 nt, Human
cucuccugguguggaggacagg

SEQ ID NO: 22888 - RNA, 22 nt, Human
cucuccuugaggcuuggacuuc

SEQ ID NO: 22889 - RNA, 22 nt, Human
cucucgcgugugccuuuccgcu

SEQ ID NO: 22890 - RNA, 22 nt, Human
cucucugaggaaggagcaucug

SEQ ID NO: 22891 - RNA, 22 nt, Human
cucucugaggcaggccuguggg

SEQ ID NO: 22892 - RNA, 22 nt, Human
cucucugagugagggacaagcu

SEQ ID NO: 22893 - RNA, 22 nt, Human
cucucugcuguauccuuaggcu

SEQ ID NO: 22894 - RNA, 21 nt, Human
cucucugcuuaugaauaguga

SEQ ID NO: 22895 - RNA, 20 nt, Human
cucucuggaaggugggagcc

SEQ ID NO: 22896 - RNA, 22 nt, Human
ucugaaauagaagugucuuucu

SEQ ID NO: 22897 - RNA, 22 nt, Human
ucugaaauauauuuugaguguu

SEQ ID NO: 22898 - RNA, 22 nt, Human
ucugaaauccuuuaucuuggcu

SEQ ID NO: 22899 - RNA, 22 nt, Human
ucugaaaucuaaugcucugugg

SEQ ID NO: 22900 - RNA, 22 nt, Human
ucugaaauggcagcgggaauga

SEQ ID NO: 22901 - RNA, 22 nt, Human
ucugaaauggcgauggccguug

SEQ ID NO: 22902 - RNA, 22 nt, Human
ucugaacagaaaagaugcacaa

SEQ ID NO: 22903 - RNA, 19 nt, Human
ucugaagaauuagagagca

SEQ ID NO: 22904 - RNA, 22 nt, Human
ucugaagagaaugcugcugaac

SEQ ID NO: 22905 - RNA, 22 nt, Human
ucugaagagucaucuuugggug

SEQ ID NO: 22906 - RNA, 22 nt, Human
ucugaagcacugcaaugcuuua

SEQ ID NO: 22907 - RNA, 22 nt, Human
ucugaagccuuuguacaggccu

SEQ ID NO: 22908 - RNA, 22 nt, Human
ucugaagcuggaggaagcuuug

SEQ ID NO: 22909 - RNA, 22 nt, Human
ucugaaggaaaaggguagauau

SEQ ID NO: 22910 - RNA, 22 nt, Human
ucugaagggcugaguggaggag

SEQ ID NO: 22911 - RNA, 19 nt, Human
ucugaaguccagggcauac

SEQ ID NO: 22912 - RNA, 22 nt, Human
ucugaauagagagagguccuuu

SEQ ID NO: 22913 - RNA, 22 nt, Human
ucugaauaguauauugaaagca

SEQ ID NO: 22914 - RNA, 22 nt, Human
ucugaauauguuuaucaucucu

SEQ ID NO: 22915 - RNA, 18 nt, Human
ucugaauauuaugcagug

SEQ ID NO: 22916 - RNA, 22 nt, Human
ucugaauucuuagaauuaaagg

SEQ ID NO: 22917 - RNA, 22 nt, Human
ucugaauuuuaacuacacaaag

SEQ ID NO: 22918 - RNA, 22 nt, Human
ucugaauuuugaugugcauuga

SEQ ID NO: 22919 - RNA, 22 nt, Human
ucugacaagucaagucuugacu

SEQ ID NO: 22920 - RNA, 22 nt, Human
ucugacaauaacugaguuuaac

SEQ ID NO: 22921 - RNA, 22 nt, Human
ucugacaaugaacaaucuauag

SEQ ID NO: 22922 - RNA, 22 nt, Human
ucugacaauuagccuaguccug

SEQ ID NO: 22923 - RNA, 22 nt, Human
ucugacaggauuuuuucaggca

SEQ ID NO: 22924 - RNA, 22 nt, Human
ucugacagguugggauauggaa

SEQ ID NO: 22925 - RNA, 22 nt, Human
ucugacaugagggcuguggaga

SEQ ID NO: 22926 - RNA, 20 nt, Human
ucugacccagagcccaggcu

SEQ ID NO: 22927 - RNA, 22 nt, Human
ucugacccagauggcaccgugg

SEQ ID NO: 22928 - RNA, 23 nt, Human
ucugaccucguuugcuguguucu

SEQ ID NO: 22929 - RNA, 22 nt, Human
ucugacuucuucauccuugcca

SEQ ID NO: 22930 - RNA, 22 nt, Human
ucugacuugcaucuuaaaggag

SEQ ID NO: 22931 - RNA, 22 nt, Human
ucugagaacauaaauugacuuc

SEQ ID NO: 22932 - RNA, 22 nt, Human
ucugagaacaugcuuugaucau

SEQ ID NO: 22933 - RNA, 22 nt, Human
ucugagaagcgugucucuguuu

SEQ ID NO: 22934 - RNA, 22 nt, Human
ucugagaaggguaggcuccauu

SEQ ID NO: 22935 - RNA, 22 nt, Human
ucugagaauagugccacugugg

SEQ ID NO: 22936 - RNA, 22 nt, Human
ucugagaauggagcuaaaaauc

SEQ ID NO: 22937 - RNA, 22 nt, Human
ucugagacacucuugugauggg

SEQ ID NO: 22938 - RNA, 22 nt, Human
ucugagacccauacaggcccac

SEQ ID NO: 22939 - RNA, 22 nt, Human
ucugagacuucugaagcuagaa

SEQ ID NO: 22940 - RNA, 20 nt, Human
ucugagacuuguagugugga

SEQ ID NO: 22941 - RNA, 22 nt, Human
ucugagacuuuaaccuggggcc

SEQ ID NO: 22942 - RNA, 23 nt, Human
ucugagagaacaaugccuccuau

SEQ ID NO: 22943 - RNA, 22 nt, Human
ucugagagagcaccuauccacu

SEQ ID NO: 22944 - RNA, 22 nt, Human
ucugagaggauuccugucccga

SEQ ID NO: 22945 - RNA, 22 nt, Human
ucugagaguacgggcugcgcgc

SEQ ID NO: 22946 - RNA, 20 nt, Human
ucugagagucugagugauga

SEQ ID NO: 22947 - RNA, 22 nt, Human
ucugagauuuguauggugagac

SEQ ID NO: 22948 - RNA, 22 nt, Human
ucugagcagagcaucauuucag

SEQ ID NO: 22949 - RNA, 22 nt, Human
ucugagcauugaauuuucuucc

SEQ ID NO: 22950 - RNA, 22 nt, Human
ucugagccagccaccuccuuca

SEQ ID NO: 22951 - RNA, 22 nt, Human
ucugagccccuagaacugagcg

SEQ ID NO: 22952 - RNA, 22 nt, Human
ucugagcuagaaaguaugcccu

SEQ ID NO: 22953 - RNA, 22 nt, Human
ucugagcugccccuuuacuuug

SEQ ID NO: 22954 - RNA, 22 nt, Human
ucugagcuggagcccaucaccu

SEQ ID NO: 22955 - RNA, 22 nt, Human
ucugagcugggggccuggcaug

SEQ ID NO: 22956 - RNA, 22 nt, Human
ucugagcugggucuugacagcu

SEQ ID NO: 22957 - RNA, 22 nt, Human
ucugagcuguaaguagacaagg

SEQ ID NO: 22958 - RNA, 22 nt, Human
ucugagcugugaguugcuuagg

SEQ ID NO: 22959 - RNA, 22 nt, Human
ucugagcuguggccauucuucc

SEQ ID NO: 22960 - RNA, 22 nt, Human
ucugagcuuacucagggauaca

SEQ ID NO: 22961 - RNA, 22 nt, Human
ucugaggaaucuugacacauuu

SEQ ID NO: 22962 - RNA, 22 nt, Human
ucugaggacagugcugugccug

SEQ ID NO: 22963 - RNA, 22 nt, Human
ucugaggaucugaagggaacag

SEQ ID NO: 22964 - RNA, 23 nt, Human
ucugaggaugaaggauagcaagu

SEQ ID NO: 22965 - RNA, 22 nt, Human
ucugaggcauaaccuguucugc

SEQ ID NO: 22966 - RNA, 22 nt, Human
ucugaggcauuuaauuaugacc

SEQ ID NO: 22967 - RNA, 22 nt, Human
ucugaggcccaguucaacucuu

SEQ ID NO: 22968 - RNA, 22 nt, Human
ucugaggcuaagagacagaggc

SEQ ID NO: 22969 - RNA, 22 nt, Human
ucugaggcugucucugggcucc

SEQ ID NO: 22970 - RNA, 22 nt, Human
ucugagggaauagcuauuguag

SEQ ID NO: 22971 - RNA, 22 nt, Human
ucugaggggcuggaagggcugc

SEQ ID NO: 22972 - RNA, 22 nt, Human
ucugagggugggagaaggagcu

SEQ ID NO: 22973 - RNA, 22 nt, Human
ucugaggguuguagagagggac

SEQ ID NO: 22974 - RNA, 22 nt, Human
ucugagguccuacuauaagugg

SEQ ID NO: 22975 - RNA, 18 nt, Human
ucugagguggacgaggag

SEQ ID NO: 22976 - RNA, 22 nt, Human
ucugagguuaauccugcugcau

SEQ ID NO: 22977 - RNA, 22 nt, Human
ucugagugagggugugagauau

SEQ ID NO: 22978 - RNA, 22 nt, Human
ucugagugaguguaggccugac

SEQ ID NO: 22979 - RNA, 22 nt, Human
ucuuugaacuuuuuguaaguua

SEQ ID NO: 22980 - RNA, 22 nt, Human
ucuuugaaguuccccuggaaga

SEQ ID NO: 22981 - RNA, 22 nt, Human
ucuuugaaguugaaguaguugg

SEQ ID NO: 22982 - RNA, 22 nt, Human
ucuuugaauuucugacugucuu

SEQ ID NO: 22983 - RNA, 22 nt, Human
ucuuugaccaaauuauccuguu

SEQ ID NO: 22984 - RNA, 22 nt, Human
ucuuugcaacucccauuuccau

SEQ ID NO: 22985 - RNA, 22 nt, Human
ucuuugcaggccaaauuguuaa

SEQ ID NO: 22986 - RNA, 22 nt, Human
ucuuugcauuuuaugccguuau

SEQ ID NO: 22987 - RNA, 22 nt, Human
ucuuugcucuuacacaguuagu

SEQ ID NO: 22988 - RNA, 22 nt, Human
ucuuuggaauuugcuggaaaua

SEQ ID NO: 22989 - RNA, 22 nt, Human
ucuuuggaucucaagguggcag

SEQ ID NO: 22990 - RNA, 22 nt, Human
ucuuuggauuaaaauauuugua

SEQ ID NO: 22991 - RNA, 22 nt, Human
ucuuuggcaucagggccagcua

SEQ ID NO: 22992 - RNA, 22 nt, Human
ucuuuggcuaugauuuacuguu

SEQ ID NO: 22993 - RNA, 19 nt, Human
ucuuuggcuucuggaucag

SEQ ID NO: 22994 - RNA, 22 nt, Human
ucuuuggucagaaagauuacac

SEQ ID NO: 22995 - RNA, 22 nt, Human
ucuuuguaagaaauucuuccgu

SEQ ID NO: 22996 - RNA, 19 nt, Human
ucuuuguacaagucucugc

SEQ ID NO: 22997 - RNA, 20 nt, Human
ucuuuguuaauuuuaucucc

SEQ ID NO: 22998 - RNA, 22 nt, Human
ucuuuguuauugcuuuaucuau

SEQ ID NO: 22999 - RNA, 22 nt, Human
ucuuuguuggaguccaaggaua

SEQ ID NO: 23000 - RNA, 22 nt, Human
ucuuuguuuguacuguuagaau

SEQ ID NO: 23001 - RNA, 22 nt, Human
ucuuuuauagugaauuuucuug

SEQ ID NO: 23002 - RNA, 22 nt, Human
ucuuuucacaaaggagcuggag

SEQ ID NO: 23003 - RNA, 19 nt, Human
ucuuuucacgcauuuugaa

SEQ ID NO: 23004 - RNA, 22 nt, Human
ucuuuucaucauuuaauaggua

SEQ ID NO: 23005 - RNA, 22 nt, Human
ucucacaggugcacguggcugu

SEQ ID NO: 23006 - RNA, 22 nt, Human
ucucacaguaugaauuguucac

SEQ ID NO: 23007 - RNA, 22 nt, Human
ucucacaguuguccacugaaaa

SEQ ID NO: 23008 - RNA, 19 nt, Human
ucucacaguuuccuugccu

SEQ ID NO: 23009 - RNA, 19 nt, Human
ucucacaucagcuccuagc

SEQ ID NO: 23010 - RNA, 22 nt, Human
ucucacauuucauugacagcug

SEQ ID NO: 23011 - RNA, 22 nt, Human
ucucacuggguauaaaugagua

SEQ ID NO: 23012 - RNA, 22 nt, Human
ucucagaaaaacuuugagggua

SEQ ID NO: 23013 - RNA, 22 nt, Human
ucucagaaaaaggagaaacugg

SEQ ID NO: 23014 - RNA, 23 nt, Human
ucucagaaaggagaaguaauuug

SEQ ID NO: 23015 - RNA, 22 nt, Human
ucucagaaaugacaggagguac

SEQ ID NO: 23016 - RNA, 22 nt, Human
ucucagaacacccuucuauggu

SEQ ID NO: 23017 - RNA, 22 nt, Human
ucucagaaggcaagggcugggg

SEQ ID NO: 23018 - RNA, 22 nt, Human
ucucagaaggguggugcuggag

SEQ ID NO: 23019 - RNA, 22 nt, Human
ucucagaagugaucaggauguu

SEQ ID NO: 23020 - RNA, 22 nt, Human
ucucagaaucaggaccuacuuc

SEQ ID NO: 23021 - RNA, 19 nt, Human
ucucagaauuaagagugcu

SEQ ID NO: 23022 - RNA, 23 nt, Human
ucucagacccgaagccagaggaa

SEQ ID NO: 23023 - RNA, 22 nt, Human
ucucagagaaaugugucaccau

SEQ ID NO: 23024 - RNA, 22 nt, Human
ucucagagauuuuguuucccuu

SEQ ID NO: 23025 - RNA, 22 nt, Human
ucucagagcuucagaaagcacc

SEQ ID NO: 23026 - RNA, 19 nt, Human
ucucagaggaaaaauugcu

SEQ ID NO: 23027 - RNA, 23 nt, Human
ucucagaggauuccugggccuug

SEQ ID NO: 23028 - RNA, 22 nt, Human
ucucagagggaaaggccaauuu

SEQ ID NO: 23029 - RNA, 22 nt, Human
ucucagaggucuucagccucug

SEQ ID NO: 23030 - RNA, 22 nt, Human
ucucagagugacaaugagaauu

SEQ ID NO: 23031 - RNA, 22 nt, Human
ucucagaguuccucuggagucc

SEQ ID NO: 23032 - RNA, 22 nt, Human
ucucagauggcaucagcuagag

SEQ ID NO: 23033 - RNA, 22 nt, Human
ucucagcaaggaaagaggcagg

SEQ ID NO: 23034 - RNA, 22 nt, Human
ucucagcagccagauccagagc

SEQ ID NO: 23035 - RNA, 22 nt, Human
ucucagcucagcuuccacagag

SEQ ID NO: 23036 - RNA, 22 nt, Human
ucucagcucauggcagccuuga

SEQ ID NO: 23037 - RNA, 22 nt, Human
ucucagcugccugcccugcucc

SEQ ID NO: 23038 - RNA, 22 nt, Human
ucucagcuugaguggaugagcu

SEQ ID NO: 23039 - RNA, 22 nt, Human
ucucaggaaauaggauuugagu

SEQ ID NO: 23040 - RNA, 22 nt, Human
ucucaggaagauuagggcuaag

SEQ ID NO: 23041 - RNA, 22 nt, Human
ucucaggaucuaauacauggua

SEQ ID NO: 23042 - RNA, 22 nt, Human
ucucaggcaucuguguggcaca

SEQ ID NO: 23043 - RNA, 22 nt, Human
ucucaggcauucccacauagaa

SEQ ID NO: 23044 - RNA, 20 nt, Human
ucucaggcccccuccuugcu

SEQ ID NO: 23045 - RNA, 22 nt, Human
ucucaggccccugaguuucucu

SEQ ID NO: 23046 - RNA, 21 nt, Human
ucucaggcgagaauucuuuua

SEQ ID NO: 23047 - RNA, 19 nt, Human
ucucaggcugggcggcugc

SEQ ID NO: 23048 - RNA, 22 nt, Human
ucucagggagagcugcuggcau

SEQ ID NO: 23049 - RNA, 22 nt, Human
ucucagggaguugaggcugccu

SEQ ID NO: 23050 - RNA, 22 nt, Human
ucucagggaugggaggccccag

SEQ ID NO: 23051 - RNA, 22 nt, Human
ucucagggcgcagugaggcagu

SEQ ID NO: 23052 - RNA, 17 nt, Human
ucucaggggcuagcccu

SEQ ID NO: 23053 - RNA, 22 nt, Human
ucucaggguuuguacaagugua

SEQ ID NO: 23054 - RNA, 22 nt, Human
ucucaguggaucucagaauuuu

SEQ ID NO: 23055 - RNA, 22 nt, Human
ucucaguggcuuccucacuuuu

SEQ ID NO: 23056 - RNA, 22 nt, Human
ucucagugggaagggcacaguu

SEQ ID NO: 23057 - RNA, 22 nt, Human
ucucaguguuaucuaucugccu

SEQ ID NO: 23058 - RNA, 20 nt, Human
ucucaguuucuagagucagg

SEQ ID NO: 23059 - RNA, 22 nt, Human
ucucauaaacucaguuuucuca

SEQ ID NO: 23060 - RNA, 18 nt, Human
ucucauaaaggggugugu

SEQ ID NO: 23061 - RNA, 22 nt, Human
ucucauaaggucagauuucaca

SEQ ID NO: 23062 - RNA, 22 nt, Human
ucucauaauuguuucccagcua

SEQ ID NO: 23063 - RNA, 22 nt, Human
ucucaucuucauaucugaaaga

SEQ ID NO: 23064 - RNA, 22 nt, Human
ucucaucuuuaaaugaaaauuu

SEQ ID NO: 23065 - RNA, 22 nt, Human
ucucaugaugccuaugcagggu

SEQ ID NO: 23066 - RNA, 22 nt, Human
ucucaugccuggaauuaucauu

SEQ ID NO: 23067 - RNA, 22 nt, Human
ucucaugcuguagugcacuaac

SEQ ID NO: 23068 - RNA, 22 nt, Human
ucucauggcuuguaggagguga

SEQ ID NO: 23069 - RNA, 22 nt, Human
ucucauugccuucacucuucag

SEQ ID NO: 23070 - RNA, 22 nt, Human
ucucauugguauauacaugugu

SEQ ID NO: 23071 - RNA, 22 nt, Human
ucucauuguagaaagacugauu

SEQ ID NO: 23072 - RNA, 22 nt, Human
ucucauuugccucaucuauaaa

SEQ ID NO: 23073 - RNA, 22 nt, Human
ucucauuuggcuuuguuuuaaa

SEQ ID NO: 23074 - RNA, 22 nt, Human
ucucauuugugugcaauucaga

SEQ ID NO: 23075 - RNA, 22 nt, Human
ucucauuuugagucagacacua

SEQ ID NO: 23076 - RNA, 19 nt, Human
ucuccaaaaccaaucacua

SEQ ID NO: 23077 - RNA, 22 nt, Human
ucuccaaacucagacuaaguau

SEQ ID NO: 23078 - RNA, 22 nt, Human
ucuccacaagcugaugcuagga

SEQ ID NO: 23079 - RNA, 22 nt, Human
ucuccacaaguguugagaguac

SEQ ID NO: 23080 - RNA, 22 nt, Human
ucuccacacuuucucucccagg

SEQ ID NO: 23081 - RNA, 22 nt, Human
ucuccacagaagguuccaggcc

SEQ ID NO: 23082 - RNA, 22 nt, Human
ucuccacauucuauuggcuaua

SEQ ID NO: 23083 - RNA, 21 nt, Human
ucuccagagugggaggaaauc

SEQ ID NO: 23084 - RNA, 22 nt, Human
ucuccaggaagcccucccugac

SEQ ID NO: 23085 - RNA, 22 nt, Human
ucuccaggacugagcuccagcc

SEQ ID NO: 23086 - RNA, 22 nt, Human
ucuccaggcacuuggcugcuac

SEQ ID NO: 23087 - RNA, 23 nt, Human
ucuccaggccuuacuccaggccu

SEQ ID NO: 23088 - RNA, 22 nt, Human
ucuccaggccuuucccaucuua

SEQ ID NO: 23089 - RNA, 22 nt, Human
ucuccaggcuuuuugugaauug

SEQ ID NO: 23090 - RNA, 22 nt, Human
ucuccaggggcugcugugccac

SEQ ID NO: 23091 - RNA, 22 nt, Human
ucuccagguaaauggcauccug

SEQ ID NO: 23092 - RNA, 19 nt, Human
ucuccaggugccccaaaca

SEQ ID NO: 23093 - RNA, 22 nt, Human
ucuccagucucaagacauugag

SEQ ID NO: 23094 - RNA, 22 nt, Human
ucuccagugaaucuccuccugg

SEQ ID NO: 23095 - RNA, 21 nt, Human
ucuccagugcuucugccucuu

SEQ ID NO: 23096 - RNA, 22 nt, Human
ugaacaguuucaagaaaacuuu

SEQ ID NO: 23097 - RNA, 22 nt, Human
ugaacauauucaccucuaaaua

SEQ ID NO: 23098 - RNA, 22 nt, Human
ugaacauuccugaaugaagcau

SEQ ID NO: 23099 - RNA, 22 nt, Human
ugaaccuucauaaaauuaagug

SEQ ID NO: 23100 - RNA, 22 nt, Human
ugaacuacaaaaaucaacauuu

SEQ ID NO: 23101 - RNA, 22 nt, Human
ugaacucgggaggaggcugcag

SEQ ID NO: 23102 - RNA, 22 nt, Human
ugaacucuaauggugcuuuucu

SEQ ID NO: 23103 - RNA, 22 nt, Human
ugaacucucccccauugcccuc

SEQ ID NO: 23104 - RNA, 22 nt, Human
ugaacugcaggaaucucagugg

SEQ ID NO: 23105 - RNA, 22 nt, Human
ugaacuucagugcauaauuauc

SEQ ID NO: 23106 - RNA, 22 nt, Human
ugaacuuucacaagaauaugcu

SEQ ID NO: 23107 - RNA, 22 nt, Human
ugaagaaccugaugagcugugu

SEQ ID NO: 23108 - RNA, 22 nt, Human
ugaagaauaagauagauggagc

SEQ ID NO: 23109 - RNA, 22 nt, Human
ugaagacaagaaaacacugggg

SEQ ID NO: 23110 - RNA, 22 nt, Human
ugaagacacauacaagggaaug

SEQ ID NO: 23111 - RNA, 22 nt, Human
ugaagacagaccaaggagaaug

SEQ ID NO: 23112 - RNA, 22 nt, Human
ugaagacagggucuuuaacgag

SEQ ID NO: 23113 - RNA, 18 nt, Human
ugaagacaugagguuagu

SEQ ID NO: 23114 - RNA, 22 nt, Human
ucuuuuggaaaugaugugcagg

SEQ ID NO: 23115 - RNA, 22 nt, Human
ucuuuuggguucuuaugauuua

SEQ ID NO: 23116 - RNA, 22 nt, Human
ucuuuugucaucccuuguacau

SEQ ID NO: 23117 - RNA, 22 nt, Human
ucuuuugugaggacaagguacg

SEQ ID NO: 23118 - RNA, 22 nt, Human
ucuuuugugauucuuuaguuac

SEQ ID NO: 23119 - RNA, 22 nt, Human
ugaaaaacacuaauuggaaagc

SEQ ID NO: 23120 - RNA, 22 nt, Human
ugaaaaacugaauaguugagua

SEQ ID NO: 23121 - RNA, 22 nt, Human
ugaaaaacuuuaauccauaaag

SEQ ID NO: 23122 - RNA, 22 nt, Human
ugaaaacagaauccuuguuuuc

SEQ ID NO: 23123 - RNA, 22 nt, Human
ugaaaagacugcaagagagcau

SEQ ID NO: 23124 - RNA, 22 nt, Human
ugaaaaggagccuuagguaggu

SEQ ID NO: 23125 - RNA, 20 nt, Human
ugaaaaggucaggagacaug

SEQ ID NO: 23126 - RNA, 22 nt, Human
ugaaaaugcccucuaugucuca

SEQ ID NO: 23127 - RNA, 22 nt, Human
ugaaaauucaucucauagcaga

SEQ ID NO: 23128 - RNA, 22 nt, Human
ugaaaauuuccaucaguuauau

SEQ ID NO: 23129 - RNA, 22 nt, Human
ugaaacaaaaguauguagcuug

SEQ ID NO: 23130 - RNA, 22 nt, Human
ugaaacaaugugaaguugcuga

SEQ ID NO: 23131 - RNA, 22 nt, Human
ugaaacagucuccagacuugga

SEQ ID NO: 23132 - RNA, 23 nt, Human
ugaaacauuuaggguagaauuuc

SEQ ID NO: 23133 - RNA, 22 nt, Human
ugaaaccuuggcuagagauuga

SEQ ID NO: 23134 - RNA, 22 nt, Human
ugaaacugaaagguauuuauag

SEQ ID NO: 23135 - RNA, 22 nt, Human
ugaaacuugcuaauugcacgua

SEQ ID NO: 23136 - RNA, 22 nt, Human
ugaaagaaacagguauauuggg

SEQ ID NO: 23137 - RNA, 22 nt, Human
ugaaagaaggguggaaaaugua

SEQ ID NO: 23138 - RNA, 22 nt, Human
ucuguaggggccggcggagccc

SEQ ID NO: 23139 - RNA, 22 nt, Human
ucuguaguaugguacuuauuua

SEQ ID NO: 23140 - RNA, 20 nt, Human
ucuguagucuaugaggcuua

SEQ ID NO: 23141 - RNA, 22 nt, Human
ucuguagucucugauauaucug

SEQ ID NO: 23142 - RNA, 22 nt, Human
ucuguauaaggacaaacauuua

SEQ ID NO: 23143 - RNA, 22 nt, Human
ucuguauugauucuguuaggca

SEQ ID NO: 23144 - RNA, 22 nt, Human
ucugucaauauaugugcugcag

SEQ ID NO: 23145 - RNA, 22 nt, Human
ucugucaauuauucacauaggc

SEQ ID NO: 23146 - RNA, 22 nt, Human
ucugucacaaguaauccuuuuc

SEQ ID NO: 23147 - RNA, 22 nt, Human
ucugucaccccuguuucuggcu

SEQ ID NO: 23148 - RNA, 23 nt, Human
ucugucaccuauggcugcucuuc

SEQ ID NO: 23149 - RNA, 22 nt, Human
ucugucacucccugaugaugaa

SEQ ID NO: 23150 - RNA, 22 nt, Human
ucugucacugagcucaggauuc

SEQ ID NO: 23151 - RNA, 22 nt, Human
ucugucacuuaagaauugccua

SEQ ID NO: 23152 - RNA, 23 nt, Human
ucugucacuuucugcuguggagu

SEQ ID NO: 23153 - RNA, 22 nt, Human
ucugucaggagauuggcagcug

SEQ ID NO: 23154 - RNA, 22 nt, Human
ucugucaucucuaaaauagaaa

SEQ ID NO: 23155 - RNA, 22 nt, Human
ucugucaugccacaggacuugg

SEQ ID NO: 23156 - RNA, 18 nt, Human
ucuguccacccugugcug

SEQ ID NO: 23157 - RNA, 17 nt, Human
ucuguccagggagugug

SEQ ID NO: 23158 - RNA, 22 nt, Human
ucuguccaguggcucucaggga

SEQ ID NO: 23159 - RNA, 22 nt, Human
ucugucccugagagcucaggag

SEQ ID NO: 23160 - RNA, 22 nt, Human
ucuguccucuuugaagcugcuc

SEQ ID NO: 23161 - RNA, 22 nt, Human
ucuguccuguuuccuccugaca

SEQ ID NO: 23162 - RNA, 22 nt, Human
ucugucuacagggagaaugaua

SEQ ID NO: 23163 - RNA, 22 nt, Human
ucugucuccucagaugacucca

SEQ ID NO: 23164 - RNA, 22 nt, Human
ucugucuccugccagugccucu

SEQ ID NO: 23165 - RNA, 22 nt, Human
ucugucugagugguguuagagu

SEQ ID NO: 23166 - RNA, 22 nt, Human
ucugucugccuguguccccacc

SEQ ID NO: 23167 - RNA, 22 nt, Human
ucugucuuagccaucucaggcu

SEQ ID NO: 23168 - RNA, 22 nt, Human
ucugucuucuguagcuaauaau

SEQ ID NO: 23169 - RNA, 22 nt, Human
ucugucuuggccagccaucugg

SEQ ID NO: 23170 - RNA, 23 nt, Human
ucugucuuguuuaggccacuguu

SEQ ID NO: 23171 - RNA, 22 nt, Human
ucugucuuugucaggaccagag

SEQ ID NO: 23172 - RNA, 22 nt, Human
ucugugaaaggaaagaacugac

SEQ ID NO: 23173 - RNA, 22 nt, Human
ucugugaaugugaccuuauuug

SEQ ID NO: 23174 - RNA, 22 nt, Human
ucugugacuugcgggaggagaa

SEQ ID NO: 23175 - RNA, 22 nt, Human
ucugugcagucagggcucaguc

SEQ ID NO: 23176 - RNA, 22 nt, Human
ucugugccagcagccuccugga

SEQ ID NO: 23177 - RNA, 21 nt, Human
ucugugccucaacccucaucu

SEQ ID NO: 23178 - RNA, 22 nt, Human
ucugugccuccguaacacacca

SEQ ID NO: 23179 - RNA, 22 nt, Human
ucugugcggucuguguuaugaa

SEQ ID NO: 23180 - RNA, 23 nt, Human
ucugugcuacaaaucgcgucugu

SEQ ID NO: 23181 - RNA, 22 nt, Human
ucugugcuagaggaguuggcca

SEQ ID NO: 23182 - RNA, 23 nt, Human
ucugugcucgggggagcucucug

SEQ ID NO: 23183 - RNA, 22 nt, Human
ucugugcugcccaacuucucaa

SEQ ID NO: 23184 - RNA, 22 nt, Human
ucugugcugucucagagaaagc

SEQ ID NO: 23185 - RNA, 22 nt, Human
ucugugcugucucagauaagca

SEQ ID NO: 23186 - RNA, 22 nt, Human
ucuguggaaauuuccugaggca

SEQ ID NO: 23187 - RNA, 22 nt, Human
ucuguggaccaggguauaagga

SEQ ID NO: 23188 - RNA, 18 nt, Human
ucuguggagagggcaguu

SEQ ID NO: 23189 - RNA, 22 nt, Human
ucuguggcaaacacagugacca

SEQ ID NO: 23190 - RNA, 22 nt, Human
ucuguggcaguucugguucauc

SEQ ID NO: 23191 - RNA, 22 nt, Human
ucuguggcaugguaucuggagg

SEQ ID NO: 23192 - RNA, 22 nt, Human
ucuguggcauguugcacuugua

SEQ ID NO: 23193 - RNA, 22 nt, Human
ucuguggccugccuccucauuu

SEQ ID NO: 23194 - RNA, 22 nt, Human
ucuguggcgcauaguugucucu

SEQ ID NO: 23195 - RNA, 21 nt, Human
ucuguggcggacucuaggccc

SEQ ID NO: 23196 - RNA, 23 nt, Human
ucuguggcuccuucaggcugcug

SEQ ID NO: 23197 - RNA, 22 nt, Human
ucuguggcuggagaacuugucu

SEQ ID NO: 23198 - RNA, 22 nt, Human
ucugugguggagugggcaugag

SEQ ID NO: 23199 - RNA, 22 nt, Human
ucuguguauuugugaccuguau

SEQ ID NO: 23200 - RNA, 22 nt, Human
ucugugucacugaggccugugu

SEQ ID NO: 23201 - RNA, 22 nt, Human
ucugugugcccaccugacaccu

SEQ ID NO: 23202 - RNA, 22 nt, Human
ucugugugguaguuucagugaa

SEQ ID NO: 23203 - RNA, 20 nt, Human
ucuguguuucagcugcuuga

SEQ ID NO: 23204 - RNA, 22 nt, Human
ucuguguuugccauccuugcuc

SEQ ID NO: 23205 - RNA, 22 nt, Human
ucuguguuuuaaacaguagaaa

SEQ ID NO: 23206 - RNA, 22 nt, Human
ucuguuauaaaucacacugcau

SEQ ID NO: 23207 - RNA, 22 nt, Human
ucuguuauacagucuguggcac

SEQ ID NO: 23208 - RNA, 22 nt, Human
ucuguuauauguuuuuucuaaa

SEQ ID NO: 23209 - RNA, 20 nt, Human
ucuguucaaaucuuaguucc

SEQ ID NO: 23210 - RNA, 21 nt, Human
ucuguucaaggaacuacggau

SEQ ID NO: 23211 - RNA, 22 nt, Human
ucuguucagaaauggaagugcc

SEQ ID NO: 23212 - RNA, 22 nt, Human
ucuguucaucaucuggacacau

SEQ ID NO: 23213 - RNA, 17 nt, Human
ucuguucaugcauaccu

SEQ ID NO: 23214 - RNA, 22 nt, Human
ucuguuccauguuuuguuccau

SEQ ID NO: 23215 - RNA, 22 nt, Human
ucuguuccucaaggucugugug

SEQ ID NO: 23216 - RNA, 22 nt, Human
ucuguuccuguccuaagggcca

SEQ ID NO: 23217 - RNA, 22 nt, Human
ucuguucuauuggucuaugugu

SEQ ID NO: 23218 - RNA, 22 nt, Human
ucuguucuuaaagcauucuugc

SEQ ID NO: 23219 - RNA, 22 nt, Human
ucuguucuuggugcagcuggga

SEQ ID NO: 23220 - RNA, 22 nt, Human
ucuguucuuguccccacuucag

SEQ ID NO: 23221 - RNA, 23 nt, Human
ucuguucuuuuagcugaucauuu

SEQ ID NO: 23222 - RNA, 22 nt, Human
ucuguugacuccuagcagccau

SEQ ID NO: 23223 - RNA, 21 nt, Human
ugacagguuuaggauuaaaau

SEQ ID NO: 23224 - RNA, 22 nt, Human
ugacaguaguguuagaacugau

SEQ ID NO: 23225 - RNA, 22 nt, Human
ugacagugaacagguuaccacu

SEQ ID NO: 23226 - RNA, 22 nt, Human
ugacagugaaugacaagguucu

SEQ ID NO: 23227 - RNA, 22 nt, Human
ugacagugcaugugacaaagga

SEQ ID NO: 23228 - RNA, 23 nt, Human
ugacaguguauuugacuauaugg

SEQ ID NO: 23229 - RNA, 22 nt, Human
ugacaguuaagguauacauuca

SEQ ID NO: 23230 - RNA, 22 nt, Human
ugacauaaaucuaaaggaaagg

SEQ ID NO: 23231 - RNA, 22 nt, Human
ugacauaaguugguagaaagga

SEQ ID NO: 23232 - RNA, 22 nt, Human
ugacauacuuuuagauagaugg

SEQ ID NO: 23233 - RNA, 20 nt, Human
ugacauagcucuuggggugc

SEQ ID NO: 23234 - RNA, 22 nt, Human
ugacaucagaauggcauagaaa

SEQ ID NO: 23235 - RNA, 22 nt, Human
ugacauccugaguacauaagag

SEQ ID NO: 23236 - RNA, 22 nt, Human
ugacaucuaguagguagagacc

SEQ ID NO: 23237 - RNA, 22 nt, Human
ugacaucugggcccucagcuaa

SEQ ID NO: 23238 - RNA, 22 nt, Human
ugacaugcuuguuuuccuugaa

SEQ ID NO: 23239 - RNA, 22 nt, Human
ugacauguccugagaagauggc

SEQ ID NO: 23240 - RNA, 22 nt, Human
ugacauguggcuuugacccagg

SEQ ID NO: 23241 - RNA, 22 nt, Human
ugacauugugugcauuuaaagu

SEQ ID NO: 23242 - RNA, 22 nt, Human
ugacauuuaaucccuaaauauu

SEQ ID NO: 23243 - RNA, 22 nt, Human
ugaccaaaggugguuuauuugg

SEQ ID NO: 23244 - RNA, 22 nt, Human
ugaccacacuugaucacucuga

SEQ ID NO: 23245 - RNA, 22 nt, Human
ugaccacugaauaugacugccu

SEQ ID NO: 23246 - RNA, 22 nt, Human
ugaccagugaucuacugggauu

SEQ ID NO: 23247 - RNA, 22 nt, Human
ugacccauggucugaucauagg

SEQ ID NO: 23248 - RNA, 22 nt, Human
ugacccauuggucccuagaucc

SEQ ID NO: 23249 - RNA, 22 nt, Human
ugacccugcuucuuggugcagg

SEQ ID NO: 23250 - RNA, 17 nt, Human
ugacccuguuggguguu

SEQ ID NO: 23251 - RNA, 22 nt, Human
ugacccuuccccucuggguucu

SEQ ID NO: 23252 - RNA, 22 nt, Human
ugacccuucccuucaguuggcu

SEQ ID NO: 23253 - RNA, 23 nt, Human
ugacccuugaugguugacgugca

SEQ ID NO: 23254 - RNA, 22 nt, Human
ugacccuuggaguaggauguau

SEQ ID NO: 23255 - RNA, 22 nt, Human
ugacccuuguuuaucauuucug

SEQ ID NO: 23256 - RNA, 22 nt, Human
ugacccuuucauuauucucauu

SEQ ID NO: 23257 - RNA, 22 nt, Human
uuccuggggcuccagcuaccag

SEQ ID NO: 23258 - RNA, 22 nt, Human
uuccugggugguccugguagag

SEQ ID NO: 23259 - RNA, 22 nt, Human
uuccugguaacaaucucaaagu

SEQ ID NO: 23260 - RNA, 22 nt, Human
uuccugguaguaagacaucugg

SEQ ID NO: 23261 - RNA, 22 nt, Human
uuccuggucccguucuucacug

SEQ ID NO: 23262 - RNA, 22 nt, Human
uuccugguccuauuauauacac

SEQ ID NO: 23263 - RNA, 22 nt, Human
uuccugguggcuuugccaacug

SEQ ID NO: 23264 - RNA, 22 nt, Human
uuccugguuuauggaaagcaug

SEQ ID NO: 23265 - RNA, 20 nt, Human
uuccuguauacaaagaguuc

SEQ ID NO: 23266 - RNA, 22 nt, Human
uuccuguauucuaaagggaaag

SEQ ID NO: 23267 - RNA, 20 nt, Human
uuccuguccucucuuucagg

SEQ ID NO: 23268 - RNA, 22 nt, Human
uuccugugaagccgguggucuc

SEQ ID NO: 23269 - RNA, 19 nt, Human
uuccugugcugcugugucc

SEQ ID NO: 23270 - RNA, 22 nt, Human
uuccuguguguugguggcagaa

SEQ ID NO: 23271 - RNA, 22 nt, Human
uuccuguuguguuagagucaau

SEQ ID NO: 23272 - RNA, 23 nt, Human
uuccuuaacuguuaagauugucu

SEQ ID NO: 23273 - RNA, 22 nt, Human
uuccuuaaugaaucaggccauu

SEQ ID NO: 23274 - RNA, 19 nt, Human
uuccuuagaggaggcggug

SEQ ID NO: 23275 - RNA, 22 nt, Human
uuccuuagaguuuccagaaagc

SEQ ID NO: 23276 - RNA, 22 nt, Human
uuccuuagggaaagggauaagg

SEQ ID NO: 23277 - RNA, 22 nt, Human
uuccuuaguguuagauucugug

SEQ ID NO: 23278 - RNA, 22 nt, Human
uuccuuaguugacugucuuagu

SEQ ID NO: 23279 - RNA, 22 nt, Human
uuccuuccuccuccaguucugg

SEQ ID NO: 23280 - RNA, 22 nt, Human
uuccuuccugucuuccuuacug

SEQ ID NO: 23281 - RNA, 22 nt, Human
uuccuucuccagaacuucuagg

SEQ ID NO: 23282 - RNA, 22 nt, Human
uuccuucucuguggggaaggca

SEQ ID NO: 23283 - RNA, 22 nt, Human
uuccuucugaagccuuuguguu

SEQ ID NO: 23284 - RNA, 22 nt, Human
uuccuucuggaagcuucagggg

SEQ ID NO: 23285 - RNA, 22 nt, Human
uuccuucuggaggcuccagggg

SEQ ID NO: 23286 - RNA, 22 nt, Human
uuccuucuuugugguagaaagu

SEQ ID NO: 23287 - RNA, 22 nt, Human
uuccuucuuuuacaccauaaau

SEQ ID NO: 23288 - RNA, 22 nt, Human
uuccuugaaaguuugaacugac

SEQ ID NO: 23289 - RNA, 22 nt, Human
uuccuugaccacugcauaauga

SEQ ID NO: 23290 - RNA, 22 nt, Human
uuccuugagaugacugucuugu

SEQ ID NO: 23291 - RNA, 22 nt, Human
uuccuugagguauucaguuuua

SEQ ID NO: 23292 - RNA, 22 nt, Human
uuccuugcccucugggaucuug

SEQ ID NO: 23293 - RNA, 22 nt, Human
uuccuuggaaauucugacuuca

SEQ ID NO: 23294 - RNA, 22 nt, Human
uuccuuggagcgcuaaagcucu

SEQ ID NO: 23295 - RNA, 22 nt, Human
uuccuuggaguuaagacccugg

SEQ ID NO: 23296 - RNA, 22 nt, Human
uuccuuggccacacuggugcuu

SEQ ID NO: 23297 - RNA, 22 nt, Human
uuccuugggagaaaaaauauau

SEQ ID NO: 23298 - RNA, 17 nt, Human
uuccuugggugcugggu

SEQ ID NO: 23299 - RNA, 22 nt, Human
uuccuugguacagaguagcuuu

SEQ ID NO: 23300 - RNA, 22 nt, Human
uuccuuguucuacaucccugcc

SEQ ID NO: 23301 - RNA, 22 nt, Human
uuccuuguuuguagcucuggga

SEQ ID NO: 23302 - RNA, 22 nt, Human
uuccuuuagugucauauacuuu

SEQ ID NO: 23303 - RNA, 22 nt, Human
uuccuuucccucacagccucgg

SEQ ID NO: 23304 - RNA, 22 nt, Human
uuccuuuucauaugccccgcgu

SEQ ID NO: 23305 - RNA, 22 nt, Human
uuccuuuucuucuaccacaugu

SEQ ID NO: 23306 - RNA, 22 nt, Human
uuccuuuugcaagguccucuag

SEQ ID NO: 23307 - RNA, 21 nt, Human
uuccuuuuuauggcuuagugg

SEQ ID NO: 23308 - RNA, 22 nt, Human
uucggaguauugacaugugaag

SEQ ID NO: 23309 - RNA, 18 nt, Human
uucggcagauacgcuugg

SEQ ID NO: 23310 - RNA, 22 nt, Human
uucggcuucuuagaggcgcucc

SEQ ID NO: 23311 - RNA, 22 nt, Human
uucggucuuguguaaacacugu

SEQ ID NO: 23312 - RNA, 22 nt, Human
uucguugcuuuaagccacuacg

SEQ ID NO: 23313 - RNA, 22 nt, Human
uucguuuucuaggaccaacaga

SEQ ID NO: 23314 - RNA, 22 nt, Human
uucuaaagacucauggaagugg

SEQ ID NO: 23315 - RNA, 22 nt, Human
uucuaaagagaaugcguuucug

SEQ ID NO: 23316 - RNA, 22 nt, Human
uucuaaagccuguccuaucaga

SEQ ID NO: 23317 - RNA, 22 nt, Human
uucuaacuuuugaggcaaugug

SEQ ID NO: 23318 - RNA, 22 nt, Human
uucuaagaggcuaaugaagaau

SEQ ID NO: 23319 - RNA, 22 nt, Human
uucuaagagucauuaauggccu

SEQ ID NO: 23320 - RNA, 22 nt, Human
uucuaaguuacuguuauggucu

SEQ ID NO: 23321 - RNA, 22 nt, Human
uucuaauagcugccuauguauu

SEQ ID NO: 23322 - RNA, 22 nt, Human
uucuaaugauuucauucaaagc

SEQ ID NO: 23323 - RNA, 22 nt, Human
uucuaauuauucccuuguccca

SEQ ID NO: 23324 - RNA, 20 nt, Human
uucuaauuugauggaguagc

SEQ ID NO: 23325 - RNA, 20 nt, Human
uucuacaaaacugauucuga

SEQ ID NO: 23326 - RNA, 22 nt, Human
uucuacacaccucugaggacau

SEQ ID NO: 23327 - RNA, 22 nt, Human
uucuacauauauuuuucucacu

SEQ ID NO: 23328 - RNA, 22 nt, Human
uucuacauucauguauuaccuc

SEQ ID NO: 23329 - RNA, 22 nt, Human
uucuaccagaccccagacuugu

SEQ ID NO: 23330 - RNA, 22 nt, Human
uucuaccagcuacucacugaua

SEQ ID NO: 23331 - RNA, 22 nt, Human
uucuaccauugggaaaacagcc

SEQ ID NO: 23332 - RNA, 22 nt, Human
ugcagaaaggaggggugggaau

SEQ ID NO: 23333 - RNA, 22 nt, Human
ugcagaaauaaagauauuauca

SEQ ID NO: 23334 - RNA, 22 nt, Human
ugcagaacagggccaugucacc

SEQ ID NO: 23335 - RNA, 22 nt, Human
ugcagaagaccuuccagggcug

SEQ ID NO: 23336 - RNA, 22 nt, Human
ugcagaagauggucugagcacc

SEQ ID NO: 23337 - RNA, 22 nt, Human
ugcagaauuauggugcuggcuu

SEQ ID NO: 23338 - RNA, 22 nt, Human
ugcagacagagaaaugaggccc

SEQ ID NO: 23339 - RNA, 22 nt, Human
ugcagagaaaccaguggaggac

SEQ ID NO: 23340 - RNA, 22 nt, Human
ugcagagagauauggcaagagg

SEQ ID NO: 23341 - RNA, 22 nt, Human
ugcagagauagaacuacuuucu

SEQ ID NO: 23342 - RNA, 22 nt, Human
ugcagaggaccauuguccugga

SEQ ID NO: 23343 - RNA, 22 nt, Human
ugcagaggagucagccugggca

SEQ ID NO: 23344 - RNA, 23 nt, Human
ugcagaggcaugaucacugcuca

SEQ ID NO: 23345 - RNA, 22 nt, Human
ugcagagggaaaaggugcuccu

SEQ ID NO: 23346 - RNA, 15 nt, Human
ugcagagguaccugg

SEQ ID NO: 23347 - RNA, 22 nt, Human
ugcagagucccaggacccagag

SEQ ID NO: 23348 - RNA, 22 nt, Human
ugcagaguccucuggagggacu

SEQ ID NO: 23349 - RNA, 23 nt, Human
ugcagagugucacuugaaaacca

SEQ ID NO: 23350 - RNA, 22 nt, Human
ugcagaugaaugcugagacacu

SEQ ID NO: 23351 - RNA, 22 nt, Human
ugcagaugccugggcugcacca

SEQ ID NO: 23352 - RNA, 17 nt, Human
ugcagcaaaugggggac

SEQ ID NO: 23353 - RNA, 22 nt, Human
ugcagcaagaaggcacugucug

SEQ ID NO: 23354 - RNA, 22 nt, Human
ugcagcaauuugcaguaauuua

SEQ ID NO: 23355 - RNA, 22 nt, Human
ugcagcaccgucccacuggcua

SEQ ID NO: 23356 - RNA, 22 nt, Human
ugcagcaccuauggacacuugu

SEQ ID NO: 23357 - RNA, 20 nt, Human
ugcagcacgggcccuuucca

SEQ ID NO: 23358 - RNA, 19 nt, Human
ugcagcacuaaaaacuuuc

SEQ ID NO: 23359 - RNA, 21 nt, Human
ugcagcagaagucucuguguc

SEQ ID NO: 23360 - RNA, 22 nt, Human
ugcagcagaaguguucuucucu

SEQ ID NO: 23361 - RNA, 22 nt, Human
ugcagcagggcccaggcacaga

SEQ ID NO: 23362 - RNA, 23 nt, Human
ugcagcaggguggucuacuucuc

SEQ ID NO: 23363 - RNA, 22 nt, Human
ugcagcaggugacaacgagugg

SEQ ID NO: 23364 - RNA, 22 nt, Human
ugcagcagguuccaaaggguua

SEQ ID NO: 23365 - RNA, 22 nt, Human
ugcagcauccauauauuauuag

SEQ ID NO: 23366 - RNA, 22 nt, Human
ugcagcaucuccuuaaaucuug

SEQ ID NO: 23367 - RNA, 22 nt, Human
ugcagcaugccaaacgaggagg

SEQ ID NO: 23368 - RNA, 22 nt, Human
ugcagcauuauguagcuguuuu

SEQ ID NO: 23369 - RNA, 22 nt, Human
ugcagcauucugguaaaaggca

SEQ ID NO: 23370 - RNA, 22 nt, Human
ugcagcauucuuggccacuacu

SEQ ID NO: 23371 - RNA, 22 nt, Human
ugcagcauugcaaagcagucuu

SEQ ID NO: 23372 - RNA, 22 nt, Human
ugcagccaucuuucuuggagga

SEQ ID NO: 23373 - RNA, 21 nt, Human
ugcagccauucagcccuaugc

SEQ ID NO: 23374 - RNA, 22 nt, Human
ugcagcccaggcgucagguggu

SEQ ID NO: 23375 - RNA, 22 nt, Human
ugcagccccccagauggccgua

SEQ ID NO: 23376 - RNA, 19 nt, Human
ugcagccccuaccacauuc

SEQ ID NO: 23377 - RNA, 22 nt, Human
ugcagccccuaucgcggacagg

SEQ ID NO: 23378 - RNA, 22 nt, Human
ugcagccccugaaaauggcagc

SEQ ID NO: 23379 - RNA, 22 nt, Human
ugcagcccugugcacauccccu

SEQ ID NO: 23380 - RNA, 22 nt, Human
ugcagcccuuccuuccucuggg

SEQ ID NO: 23381 - RNA, 22 nt, Human
ugcagccuuggcaaccagggac

SEQ ID NO: 23382 - RNA, 22 nt, Human
ugcagccuuuagaaguucagau

SEQ ID NO: 23383 - RNA, 22 nt, Human
ugcagcuccucuggcugccuga

SEQ ID NO: 23384 - RNA, 22 nt, Human
ugcagcuccugugcugagugug

SEQ ID NO: 23385 - RNA, 22 nt, Human
ugcagcucugggcaagugccuu

SEQ ID NO: 23386 - RNA, 22 nt, Human
ugcagcugagucacccagccau

SEQ ID NO: 23387 - RNA, 22 nt, Human
ugcagcugccuccuucccuugu

SEQ ID NO: 23388 - RNA, 22 nt, Human
ugcagcugcuugauucaucuug

SEQ ID NO: 23389 - RNA, 19 nt, Human
ugcagcuguaugagcuuaa

SEQ ID NO: 23390 - RNA, 22 nt, Human
ugcagcuguuacggacccuguc

SEQ ID NO: 23391 - RNA, 22 nt, Human
ugcagcuuaucucuuuggcagu

SEQ ID NO: 23392 - RNA, 20 nt, Human
ugcagcuucaccugugucau

SEQ ID NO: 23393 - RNA, 22 nt, Human
ugcagcuucuuguccugugauu

SEQ ID NO: 23394 - RNA, 22 nt, Human
ugcagcuugcuguaggcuaagu

SEQ ID NO: 23395 - RNA, 22 nt, Human
ugcagcuuuaagcuuucaucag

SEQ ID NO: 23396 - RNA, 22 nt, Human
ugcaggaaaacaccuaucaccc

SEQ ID NO: 23397 - RNA, 22 nt, Human
ugcaggaaauuccaggguggcc

SEQ ID NO: 23398 - RNA, 22 nt, Human
ugcaggaacucgaaaacuauag

SEQ ID NO: 23399 - RNA, 22 nt, Human
ugcaggaauauugaugaacuua

SEQ ID NO: 23400 - RNA, 20 nt, Human
ugcaggaauuugcauuccuu

SEQ ID NO: 23401 - RNA, 22 nt, Human
ugcaggaccggaaccaugggau

SEQ ID NO: 23402 - RNA, 22 nt, Human
ugcaggagagugagucaguagg

SEQ ID NO: 23403 - RNA, 22 nt, Human
ugcaggagauaauggugcuuag

SEQ ID NO: 23404 - RNA, 22 nt, Human
ugcaggagccuuggacuugaaa

SEQ ID NO: 23405 - RNA, 22 nt, Human
ugcaggagcugugcggugaggg

SEQ ID NO: 23406 - RNA, 22 nt, Human
ugcaggaggcuuuauucaggau

SEQ ID NO: 23407 - RNA, 22 nt, Human
ugcaggaguccaaucaggagac

SEQ ID NO: 23408 - RNA, 22 nt, Human
ugcaggaguuccccucugccug

SEQ ID NO: 23409 - RNA, 22 nt, Human
ugcaggcagcuaaaccauguaa

SEQ ID NO: 23410 - RNA, 22 nt, Human
ugcaggcagggccagcgugagg

SEQ ID NO: 23411 - RNA, 22 nt, Human
ugagcagagacgggggccucca

SEQ ID NO: 23412 - RNA, 22 nt, Human
ugagcagagcaggcugcgcccu

SEQ ID NO: 23413 - RNA, 22 nt, Human
ugagcagagcaguaacaggagc

SEQ ID NO: 23414 - RNA, 22 nt, Human
ugagcagaggccagcaccuggg

SEQ ID NO: 23415 - RNA, 22 nt, Human
ugagcagagucgcuccagagug

SEQ ID NO: 23416 - RNA, 22 nt, Human
ugagcagaguuguuucuccuga

SEQ ID NO: 23417 - RNA, 22 nt, Human
ugagcagaugugccaaacugua

SEQ ID NO: 23418 - RNA, 22 nt, Human
ugagcagcccuuccuccggcca

SEQ ID NO: 23419 - RNA, 22 nt, Human
ugagcagcuucugucugaaggc

SEQ ID NO: 23420 - RNA, 21 nt, Human
ugagcaggagucaugggaaug

SEQ ID NO: 23421 - RNA, 22 nt, Human
ugagcaggauucgccucuugca

SEQ ID NO: 23422 - RNA, 22 nt, Human
ugagcaggggagagcgaaugug

SEQ ID NO: 23423 - RNA, 18 nt, Human
ugagcaggggcugaccuu

SEQ ID NO: 23424 - RNA, 22 nt, Human
ugagcaggugagucuagggcag

SEQ ID NO: 23425 - RNA, 17 nt, Human
ugagcaguagaagaugc

SEQ ID NO: 23426 - RNA, 22 nt, Human
ugagcaguaggucugaauagug

SEQ ID NO: 23427 - RNA, 22 nt, Human
ugagcaucaaauugaugggacu

SEQ ID NO: 23428 - RNA, 23 nt, Human
ugagcaucacaggagaaccaggc

SEQ ID NO: 23429 - RNA, 22 nt, Human
ugagcaucuuuuuacagguuua

SEQ ID NO: 23430 - RNA, 22 nt, Human
ugagcauggugggugcagagca

SEQ ID NO: 23431 - RNA, 22 nt, Human
ugagccaaacuucuccuugguc

SEQ ID NO: 23432 - RNA, 22 nt, Human
ugagccagagagguugaggcua

SEQ ID NO: 23433 - RNA, 22 nt, Human
ugagccagauaagggcucacgc

SEQ ID NO: 23434 - RNA, 22 nt, Human
ugagccaggaguuugaggcugu

SEQ ID NO: 23435 - RNA, 22 nt, Human
ugagccaggcuccaugccaccu

SEQ ID NO: 23436 - RNA, 22 nt, Human
ugagccagguuuuccaucauuc

SEQ ID NO: 23437 - RNA, 22 nt, Human
ugagccagucucucagaacccu

SEQ ID NO: 23438 - RNA, 22 nt, Human
ugagccaugggacuccaaggga

SEQ ID NO: 23439 - RNA, 22 nt, Human
ugagcccaggaguuggagaccg

SEQ ID NO: 23440 - RNA, 22 nt, Human
ugagcccaggaguuggaggcug

SEQ ID NO: 23441 - RNA, 22 nt, Human
ugagguaugcugaacucuguuu

SEQ ID NO: 23442 - RNA, 22 nt, Human
ugagguaugguaagguaaaauc

SEQ ID NO: 23443 - RNA, 22 nt, Human
ugagguccugcauguugagguc

SEQ ID NO: 23444 - RNA, 22 nt, Human
ugaggucugcucaagucccugg

SEQ ID NO: 23445 - RNA, 22 nt, Human
ugaggucuguccugucuuugga

SEQ ID NO: 23446 - RNA, 22 nt, Human
ugaggugaccgcagaugggaag

SEQ ID NO: 23447 - RNA, 22 nt, Human
ugaggugagucaugcauuggag

SEQ ID NO: 23448 - RNA, 22 nt, Human
ugaggugguucaagagccuugu

SEQ ID NO: 23449 - RNA, 22 nt, Human
ugaguaauaaacugucuugcuc

SEQ ID NO: 23450 - RNA, 22 nt, Human
ugaguacucuucucacuacacc

SEQ ID NO: 23451 - RNA, 22 nt, Human
ugaguagaccucacgugucaga

SEQ ID NO: 23452 - RNA, 22 nt, Human
ugaguaggauaggguggggcuu

SEQ ID NO: 23453 - RNA, 22 nt, Human
ugaguagggguagaaaguuuag

SEQ ID NO: 23454 - RNA, 22 nt, Human
ugaguauauacccagaagugga

SEQ ID NO: 23455 - RNA, 22 nt, Human
ugaguauugaccagaaaauuua

SEQ ID NO: 23456 - RNA, 19 nt, Human
ugagucacucuuacaguca

SEQ ID NO: 23457 - RNA, 22 nt, Human
ugagucauguaauaaugcugcu

SEQ ID NO: 23458 - RNA, 22 nt, Human
ugaguccaauaggggccuggaa

SEQ ID NO: 23459 - RNA, 22 nt, Human
ugaguccugcucugggcagggu

SEQ ID NO: 23460 - RNA, 22 nt, Human
ugaguccugcugagcagagagg

SEQ ID NO: 23461 - RNA, 22 nt, Human
ugagucuccagcgaaguaggau

SEQ ID NO: 23462 - RNA, 22 nt, Human
ugagucucgguuuccccuccaa

SEQ ID NO: 23463 - RNA, 21 nt, Human
ugagucucucagcuucaggua

SEQ ID NO: 23464 - RNA, 23 nt, Human
ugagucuugagcuuuggauucug

SEQ ID NO: 23465 - RNA, 22 nt, Human
ugagucuuuagaauucuaacuu

SEQ ID NO: 23466 - RNA, 22 nt, Human
ugagucuuuuauccugggaaug

SEQ ID NO: 23467 - RNA, 22 nt, Human
ugagucuuuucauuguguggau

SEQ ID NO: 23468 - RNA, 21 nt, Human
ugagucuuuugcacaaggaau

SEQ ID NO: 23469 - RNA, 19 nt, Human
ugagugaaggccguggugg

SEQ ID NO: 23470 - RNA, 22 nt, Human
ugagugagacaccaaaggcugu

SEQ ID NO: 23471 - RNA, 22 nt, Human
ugagugaggaagcgguggagga

SEQ ID NO: 23472 - RNA, 20 nt, Human
ugagugaguuuguggcagga

SEQ ID NO: 23473 - RNA, 22 nt, Human
ugagugcuggcuaaauagaaaa

SEQ ID NO: 23474 - RNA, 22 nt, Human
ugaguggagaacagaggcucuc

SEQ ID NO: 23475 - RNA, 19 nt, Human
ugaguggagugcaaugaag

SEQ ID NO: 23476 - RNA, 19 nt, Human
ugagugucacgucagugcc

SEQ ID NO: 23477 - RNA, 19 nt, Human
ugaguguguguuucucuaa

SEQ ID NO: 23478 - RNA, 23 nt, Human
ugaguguguucccugugagauuu

SEQ ID NO: 23479 - RNA, 22 nt, Human
ugaguuaaaugagaacaugaaa

SEQ ID NO: 23480 - RNA, 22 nt, Human
ugaguuauugcagcuuccuccu

SEQ ID NO: 23481 - RNA, 22 nt, Human
ugaguucaaagacagguauagg

SEQ ID NO: 23482 - RNA, 22 nt, Human
ugaguucuaguggcugcagauu

SEQ ID NO: 23483 - RNA, 22 nt, Human
ugaguucucaugaaaucuaguu

SEQ ID NO: 23484 - RNA, 22 nt, Human
ugaguucuccaagagaagguaa

SEQ ID NO: 23485 - RNA, 22 nt, Human
ugaguucuccaggaagcagacu

SEQ ID NO: 23486 - RNA, 22 nt, Human
ugaguucuuuccguuagguaug

SEQ ID NO: 23487 - RNA, 22 nt, Human
ugaguucuuugcaaauaacaag

SEQ ID NO: 23488 - RNA, 22 nt, Human
ugaguugcuaucuagauccaga

SEQ ID NO: 23489 - RNA, 22 nt, Human
ugaguuuaauuggagccugaau

SEQ ID NO: 23490 - RNA, 22 nt, Human
ugauaacucucaguuucucaug

SEQ ID NO: 23491 - RNA, 22 nt, Human
ugauacagagaaagcaucuuuu

SEQ ID NO: 23492 - RNA, 21 nt, Human
ugauacaggaaugguucuaug

SEQ ID NO: 23493 - RNA, 22 nt, Human
ugauacagucagcucacaauug

SEQ ID NO: 23494 - RNA, 22 nt, Human
ugauacauaaaccaucauuuug

SEQ ID NO: 23495 - RNA, 22 nt, Human
ugauacuuuggagacuugagua

SEQ ID NO: 23496 - RNA, 22 nt, Human
ugauagaaaggaaauuaauugg

SEQ ID NO: 23497 - RNA, 22 nt, Human
ugauagaaucagauaaaaggau

SEQ ID NO: 23498 - RNA, 22 nt, Human
ugauaguaucugauuauuucac

SEQ ID NO: 23499 - RNA, 22 nt, Human
ugauauaagaaguaguauggau

SEQ ID NO: 23500 - RNA, 22 nt, Human
ugauauccuuuaaccuggaccg

SEQ ID NO: 23501 - RNA, 22 nt, Human
ugauaucuaccauaaccauucg

SEQ ID NO: 23502 - RNA, 22 nt, Human
ugauaucugaaguguauaaaca

SEQ ID NO: 23503 - RNA, 22 nt, Human
ugauauggcuaaagaaaguuuc

SEQ ID NO: 23504 - RNA, 22 nt, Human
ugauauuuuaugagcuuucaua

SEQ ID NO: 23505 - RNA, 22 nt, Human
ugaucaggucugaacagggagg

SEQ ID NO: 23506 - RNA, 22 nt, Human
ugaucuagguuggcuucaacug

SEQ ID NO: 23507 - RNA, 22 nt, Human
ugaucuccugaccuuguaaucc

SEQ ID NO: 23508 - RNA, 22 nt, Human
ugaucuucaccuuguucuuugg

SEQ ID NO: 23509 - RNA, 22 nt, Human
ugaucuuuccucuuguuugucu

SEQ ID NO: 23510 - RNA, 18 nt, Human
ugaucuuugaguauaaug

SEQ ID NO: 23511 - RNA, 22 nt, Human
ugaucuuugguaaucuggcaca

SEQ ID NO: 23512 - RNA, 22 nt, Human
ugaugaaaaccagaacucucau

SEQ ID NO: 23513 - RNA, 22 nt, Human
ugaugaaaauguucagcaauua

SEQ ID NO: 23514 - RNA, 22 nt, Human
ugaugaaaguguuuacucaccu

SEQ ID NO: 23515 - RNA, 22 nt, Human
ugaugacaauguugcugcaaua

SEQ ID NO: 23516 - RNA, 22 nt, Human
ugaugacagcaaaaaaugcuag

SEQ ID NO: 23517 - RNA, 22 nt, Human
ugaugacaguguuacagcucca

SEQ ID NO: 23518 - RNA, 22 nt, Human
ugaugacaugugggcuguggcu

SEQ ID NO: 23519 - RNA, 22 nt, Human
ugaugagagaggucauugaaau

SEQ ID NO: 23520 - RNA, 22 nt, Human
ugaugaggggcucagaggucag

SEQ ID NO: 23521 - RNA, 22 nt, Human
ugaugauaugaaagaaucuuua

SEQ ID NO: 23522 - RNA, 17 nt, Human
ugaugcaaagucagcug

SEQ ID NO: 23523 - RNA, 23 nt, Human
ugaugcaguaaauuggucucuaa

SEQ ID NO: 23524 - RNA, 22 nt, Human
ugaugcuguguaccucauggga

SEQ ID NO: 23525 - RNA, 22 nt, Human
ugauggaaacuuggguaaguca

SEQ ID NO: 23526 - RNA, 21 nt, Human
ugauggaaaggauuuuggguc

SEQ ID NO: 23527 - RNA, 22 nt, Human
uugggggcagagggagcaucug

SEQ ID NO: 23528 - RNA, 22 nt, Human
uugggguguucaggguacuucu

SEQ ID NO: 23529 - RNA, 22 nt, Human
uugggguguuggauggagcaag

SEQ ID NO: 23530 - RNA, 22 nt, Human
uuggguccuaaccccagagucu

SEQ ID NO: 23531 - RNA, 22 nt, Human
uugggucuguuuagcugagaag

SEQ ID NO: 23532 - RNA, 22 nt, Human
uugguaaauacuauaaucaaau

SEQ ID NO: 23533 - RNA, 22 nt, Human
uugguacaaaaccaugaaagaa

SEQ ID NO: 23534 - RNA, 22 nt, Human
uugguacaaaaguaacuguggu

SEQ ID NO: 23535 - RNA, 22 nt, Human
uugguacaaugugcuagguagg

SEQ ID NO: 23536 - RNA, 22 nt, Human
uugguacagaugagguauucuc

SEQ ID NO: 23537 - RNA, 22 nt, Human
uugguacauguuaaggaagagu

SEQ ID NO: 23538 - RNA, 22 nt, Human
uugguagaaugaacauucauug

SEQ ID NO: 23539 - RNA, 22 nt, Human
uugguaggggacuagaguccag

SEQ ID NO: 23540 - RNA, 22 nt, Human
uuggucaaggacauuacaguuu

SEQ ID NO: 23541 - RNA, 22 nt, Human
uuggucacuugcuaugugccaa

SEQ ID NO: 23542 - RNA, 22 nt, Human
uuggucagcacugauguuucag

SEQ ID NO: 23543 - RNA, 22 nt, Human
uuggucagcuaauaaggacagg

SEQ ID NO: 23544 - RNA, 22 nt, Human
uuggucagcucaauggagaggg

SEQ ID NO: 23545 - RNA, 22 nt, Human
uuggucuuguggcaucuuucca

SEQ ID NO: 23546 - RNA, 22 nt, Human
uuggugagugcuauguaccaca

SEQ ID NO: 23547 - RNA, 22 nt, Human
uugguuaaaaucaaauuaauca

SEQ ID NO: 23548 - RNA, 23 nt, Human
uugguuacuggauuugaggggcc

SEQ ID NO: 23549 - RNA, 22 nt, Human
uugguucacauuagauuuccuu

SEQ ID NO: 23550 - RNA, 22 nt, Human
ugccucagucuaaagucucuca

SEQ ID NO: 23551 - RNA, 22 nt, Human
ugccucauuaacuguccuuaau

SEQ ID NO: 23552 - RNA, 22 nt, Human
ugccuccaccauugcucacuuu

SEQ ID NO: 23553 - RNA, 22 nt, Human
ugccucucuaacccaugcccaa

SEQ ID NO: 23554 - RNA, 22 nt, Human
ugccucugaggaagauuguguu

SEQ ID NO: 23555 - RNA, 22 nt, Human
ugccucugccuccauuguuagu

SEQ ID NO: 23556 - RNA, 23 nt, Human
ugccucugccucccuagucugca

SEQ ID NO: 23557 - RNA, 22 nt, Human
ugccucugguuaucugguaccu

SEQ ID NO: 23558 - RNA, 22 nt, Human
ugccucuguggaaauggugguc

SEQ ID NO: 23559 - RNA, 22 nt, Human
ugccugaagaaaacuugcagca

SEQ ID NO: 23560 - RNA, 22 nt, Human
ugccugaagcugcauuccuagu

SEQ ID NO: 23561 - RNA, 22 nt, Human
ugccugagguggucugcaaaug

SEQ ID NO: 23562 - RNA, 22 nt, Human
ugccugagugauguggcagcca

SEQ ID NO: 23563 - RNA, 22 nt, Human
ugcuuuaacauaagauaucuuu

SEQ ID NO: 23564 - RNA, 22 nt, Human
ugcuuuauggauuuguguccug

SEQ ID NO: 23565 - RNA, 22 nt, Human
ugcuuuauucagucucugccau

SEQ ID NO: 23566 - RNA, 22 nt, Human
ugcuuuauuuauaaaauagcaa

SEQ ID NO: 23567 - RNA, 22 nt, Human
ugcuuucacauguaugcacaaa

SEQ ID NO: 23568 - RNA, 22 nt, Human
ugcuuucacugauguaucauuu

SEQ ID NO: 23569 - RNA, 21 nt, Human
ugcuuucagacucuuacagaa

SEQ ID NO: 23570 - RNA, 22 nt, Human
ugcuuucauauugccuaugacu

SEQ ID NO: 23571 - RNA, 22 nt, Human
ugcuuucauugugauaggaagc

SEQ ID NO: 23572 - RNA, 19 nt, Human
ugcuuucuaaacacaugca

SEQ ID NO: 23573 - RNA, 22 nt, Human
ugcuuucuccugucugaaagau

SEQ ID NO: 23574 - RNA, 22 nt, Human
ugcuuucucucuaccccacuuu

SEQ ID NO: 23575 - RNA, 22 nt, Human
ugcuuucugcucuuguccacac

SEQ ID NO: 23576 - RNA, 17 nt, Human
ugcuuucuuccugcccu

SEQ ID NO: 23577 - RNA, 22 nt, Human
ugcuuugccugcuuugacucau

SEQ ID NO: 23578 - RNA, 22 nt, Human
ugcuuuggaucuauuugcugag

SEQ ID NO: 23579 - RNA, 22 nt, Human
ugcuuugugauaugcugugucu

SEQ ID NO: 23580 - RNA, 22 nt, Human
ugcuuuguguuugaauagauaa

SEQ ID NO: 23581 - RNA, 22 nt, Human
ugcuuuuagcuaguaacuagua

SEQ ID NO: 23582 - RNA, 22 nt, Human
ugcuuuuuccccuucuggcgag

SEQ ID NO: 23583 - RNA, 22 nt, Human
ugcuuuuugcacccuuugccgu

SEQ ID NO: 23584 - RNA, 21 nt, Human
uggaaaaauguggccuaguga

SEQ ID NO: 23585 - RNA, 22 nt, Human
uggaaaacaugcacauuggauu

SEQ ID NO: 23586 - RNA, 22 nt, Human
uggaaaacauugagauaccaag

SEQ ID NO: 23587 - RNA, 22 nt, Human
uggaaaacuuugguggugaggg

SEQ ID NO: 23588 - RNA, 22 nt, Human
uggaaacuaacaacagagcaga

SEQ ID NO: 23589 - RNA, 22 nt, Human
uggaaacuagagaguuuguauu

SEQ ID NO: 23590 - RNA, 22 nt, Human
uggaaacuagccuuuuagguug

SEQ ID NO: 23591 - RNA, 21 nt, Human
uggaaacuucuagcuuacgua

SEQ ID NO: 23592 - RNA, 22 nt, Human
uggaaacuuggaacgucuucag

SEQ ID NO: 23593 - RNA, 22 nt, Human
uggaaagaggaagugcccagca

SEQ ID NO: 23594 - RNA, 22 nt, Human
uggaaagguaggauuucaagac

SEQ ID NO: 23595 - RNA, 22 nt, Human
uggaaagugagacauauuuaua

SEQ ID NO: 23596 - RNA, 22 nt, Human
uggaaauagauaguaucauuca

SEQ ID NO: 23597 - RNA, 22 nt, Human
uggaaauagcuccaguuaagca

SEQ ID NO: 23598 - RNA, 22 nt, Human
uggaaauagcuccaguuucauu

SEQ ID NO: 23599 - RNA, 22 nt, Human
uggaaauaguugugagucaggc

SEQ ID NO: 23600 - RNA, 22 nt, Human
uggaaauguuucuugagcucag

SEQ ID NO: 23601 - RNA, 22 nt, Human
uggaaauuaacuugguacauau

SEQ ID NO: 23602 - RNA, 18 nt, Human
uggaaauugaaacagaaa

SEQ ID NO: 23603 - RNA, 22 nt, Human
uggaaauuuauucaucauucau

SEQ ID NO: 23604 - RNA, 22 nt, Human
uggaaauuuugaacaguuucua

SEQ ID NO: 23605 - RNA, 19 nt, Human
uggaacaaacugcaaugac

SEQ ID NO: 23606 - RNA, 22 nt, Human
uggaacacauuaaccacaggga

SEQ ID NO: 23607 - RNA, 19 nt, Human
uggaacacucaaacugggu

SEQ ID NO: 23608 - RNA, 22 nt, Human
uggaacacugaucauugccuuu

SEQ ID NO: 23609 - RNA, 22 nt, Human
uggaacacuguggaugagaaga

SEQ ID NO: 23610 - RNA, 22 nt, Human
uggaacacuuuguugaaaugca

SEQ ID NO: 23611 - RNA, 22 nt, Human
uggaaccaucaaagagauccug

SEQ ID NO: 23612 - RNA, 20 nt, Human
uggaaccuaggcagagcugg

SEQ ID NO: 23613 - RNA, 22 nt, Human
uggaaccuggugauguacaagu

SEQ ID NO: 23614 - RNA, 22 nt, Human
uggaacugcuccaaaaccucca

SEQ ID NO: 23615 - RNA, 21 nt, Human
uggaacuggugaaaaccuccu

SEQ ID NO: 23616 - RNA, 22 nt, Human
uggaacuucaugagauuaugga

SEQ ID NO: 23617 - RNA, 23 nt, Human
uggaagaaaaugguuuggcugug

SEQ ID NO: 23618 - RNA, 22 nt, Human
uggaagaaggcagagaggcauu

SEQ ID NO: 23619 - RNA, 22 nt, Human
uggaagaauagaagaugguuga

SEQ ID NO: 23620 - RNA, 22 nt, Human
uggaagaauuuggggauaaauu

SEQ ID NO: 23621 - RNA, 22 nt, Human
uggaagacacuauuuaccaggu

SEQ ID NO: 23622 - RNA, 22 nt, Human
uggaagacaguugaugggaguu

SEQ ID NO: 23623 - RNA, 22 nt, Human
uggaagaccacaagcccuuaac

SEQ ID NO: 23624 - RNA, 22 nt, Human
uggaagacggaaaucuguagau

SEQ ID NO: 23625 - RNA, 22 nt, Human
uggaagagaaaggaguggaucu

SEQ ID NO: 23626 - RNA, 22 nt, Human
uggaagagcaggcagacaaugc

SEQ ID NO: 23627 - RNA, 20 nt, Human
uggaagaggagaugccucug

SEQ ID NO: 23628 - RNA, 22 nt, Human
uggaagaucaaccaggauugac

SEQ ID NO: 23629 - RNA, 22 nt, Human
uggaagcaaaauauccuuuaau

SEQ ID NO: 23630 - RNA, 22 nt, Human
uggaagcaacaacuauggacca

SEQ ID NO: 23631 - RNA, 22 nt, Human
uggaagcacugaagagacaacc

SEQ ID NO: 23632 - RNA, 23 nt, Human
uggaagcagaaguuucaauaucc

SEQ ID NO: 23633 - RNA, 22 nt, Human
uggaagcagagagcuaucacca

SEQ ID NO: 23634 - RNA, 22 nt, Human
uggaagcagcauuaaugaguua

SEQ ID NO: 23635 - RNA, 22 nt, Human
uggaagcaucacuucuugccug

SEQ ID NO: 23636 - RNA, 22 nt, Human
uggaaggaacagaguuugaaac

SEQ ID NO: 23637 - RNA, 22 nt, Human
uggaaggcaggaccugccuugg

SEQ ID NO: 23638 - RNA, 22 nt, Human
uggaaggcauuucacacaggau

SEQ ID NO: 23639 - RNA, 22 nt, Human
uggaaggcgcagugaugaugcu

SEQ ID NO: 23640 - RNA, 22 nt, Human
uggaaggcgucucgaaggccua

SEQ ID NO: 23641 - RNA, 19 nt, Human
uggaaggcuaagacacuug

SEQ ID NO: 23642 - RNA, 22 nt, Human
uggaaggcugagaguccugggg

SEQ ID NO: 23643 - RNA, 22 nt, Human
uggaaggcuuggaauacuucca

SEQ ID NO: 23644 - RNA, 22 nt, Human
uggaagggagugacagucagag

SEQ ID NO: 23645 - RNA, 22 nt, Human
uggaagggggaagacagcucug

SEQ ID NO: 23646 - RNA, 16 nt, Human
uggaaggggucuccgg

SEQ ID NO: 23647 - RNA, 22 nt, Human
uggaagguggauauccuaguca

SEQ ID NO: 23648 - RNA, 22 nt, Human
uggaagguguggcaggucuagu

SEQ ID NO: 23649 - RNA, 22 nt, Human
uggaagucccuguguguggccu

SEQ ID NO: 23650 - RNA, 22 nt, Human
uggaaguggcagaaaaugaaca

SEQ ID NO: 23651 - RNA, 22 nt, Human
uggaagugucuacauguggagu

SEQ ID NO: 23652 - RNA, 20 nt, Human
uggaaguucuguugcauugg

SEQ ID NO: 23653 - RNA, 23 nt, Human
uggaauaauaagguacauuaaca

SEQ ID NO: 23654 - RNA, 22 nt, Human
uggaauauacucagaacaggcu

SEQ ID NO: 23655 - RNA, 22 nt, Human
uggaauaugcaauugcauuuca

SEQ ID NO: 23656 - RNA, 22 nt, Human
uggaaucuugcgggcacauggc

SEQ ID NO: 23657 - RNA, 22 nt, Human
uggaaugaauauguuuuaagga

SEQ ID NO: 23658 - RNA, 22 nt, Human
uggaaugagcuggcuaauaacc

SEQ ID NO: 23659 - RNA, 22 nt, Human
uggaggaguagauuuucagagg

SEQ ID NO: 23660 - RNA, 22 nt, Human
uggaggauuccacuuacaugag

SEQ ID NO: 23661 - RNA, 20 nt, Human
uggaggcaccuguggagauc

SEQ ID NO: 23662 - RNA, 22 nt, Human
uggaggcaggggauacagguca

SEQ ID NO: 23663 - RNA, 22 nt, Human
uggaggcagguggaggagugaa

SEQ ID NO: 23664 - RNA, 22 nt, Human
uggaggcaguaacugagcaaca

SEQ ID NO: 23665 - RNA, 22 nt, Human
uggaggcagucaaaugacugac

SEQ ID NO: 23666 - RNA, 22 nt, Human
uggaggccagugaaaguagauu

SEQ ID NO: 23667 - RNA, 22 nt, Human
uggaggccaugccagagcccua

SEQ ID NO: 23668 - RNA, 22 nt, Human
uggaggccgcguagucugagca

SEQ ID NO: 23669 - RNA, 22 nt, Human
uggaggccuagguugaugugug

SEQ ID NO: 23670 - RNA, 20 nt, Human
uggaggccugcagguuuggg

SEQ ID NO: 23671 - RNA, 22 nt, Human
uggaggcugugugcaugagacc

SEQ ID NO: 23672 - RNA, 22 nt, Human
uggagggauacaaagaugaaaa

SEQ ID NO: 23673 - RNA, 20 nt, Human
uggagggauuguuggcaaau

SEQ ID NO: 23674 - RNA, 22 nt, Human
uggagggcaugcuguccauggg

SEQ ID NO: 23675 - RNA, 22 nt, Human
uggagggcgcuuagauggaggg

SEQ ID NO: 23676 - RNA, 18 nt, Human
uggagggcuugcugcagc

SEQ ID NO: 23677 - RNA, 19 nt, Human
uggagguccaggaguaggg

SEQ ID NO: 23678 - RNA, 22 nt, Human
uggaggugaaaugagauuuugu

SEQ ID NO: 23679 - RNA, 22 nt, Human
uggaggugagugugguacagca

SEQ ID NO: 23680 - RNA, 22 nt, Human
uggagguggcaucugacagcug

SEQ ID NO: 23681 - RNA, 22 nt, Human
uggaggugggagggacuguccu

SEQ ID NO: 23682 - RNA, 22 nt, Human
ugcucugaaggggaagggaugg

SEQ ID NO: 23683 - RNA, 22 nt, Human
ugcucugaugggguggacauag

SEQ ID NO: 23684 - RNA, 22 nt, Human
ugcucugcaagcaggagcaaga

SEQ ID NO: 23685 - RNA, 23 nt, Human
ugcucugggaggcccuggagagc

SEQ ID NO: 23686 - RNA, 22 nt, Human
ugcucugggcaacagccucccu

SEQ ID NO: 23687 - RNA, 22 nt, Human
ugcucugggcuaucugagaaag

SEQ ID NO: 23688 - RNA, 22 nt, Human
ugcucuggggagcuccucugcg

SEQ ID NO: 23689 - RNA, 22 nt, Human
ugcucuggguccugggccuccu

SEQ ID NO: 23690 - RNA, 18 nt, Human
ugcucuggucucacuugg

SEQ ID NO: 23691 - RNA, 22 nt, Human
ugcucuguaggggaaagagagc

SEQ ID NO: 23692 - RNA, 22 nt, Human
ugcucuguauucuauggcaguu

SEQ ID NO: 23693 - RNA, 22 nt, Human
ugcucuguugugcaugugggau

SEQ ID NO: 23694 - RNA, 18 nt, Human
ugcucuguuuaaugauuu

SEQ ID NO: 23695 - RNA, 22 nt, Human
ugcucuucaccauuacaucaug

SEQ ID NO: 23696 - RNA, 22 nt, Human
ugcugaaaaugcguaucuucca

SEQ ID NO: 23697 - RNA, 20 nt, Human
ugcugaagaaucacagaugg

SEQ ID NO: 23698 - RNA, 19 nt, Human
ugcugaaguugucagucug

SEQ ID NO: 23699 - RNA, 22 nt, Human
ugcugaauaauaagauuacuca

SEQ ID NO: 23700 - RNA, 22 nt, Human
ugcugaaugaauggaugguugc

SEQ ID NO: 23701 - RNA, 22 nt, Human
ugcugaauuaaacucuaugugg

SEQ ID NO: 23702 - RNA, 22 nt, Human
ugcugaauucucauucccugga

SEQ ID NO: 23703 - RNA, 22 nt, Human
ugcugacacuauucuaaaaagc

SEQ ID NO: 23704 - RNA, 21 nt, Human
ugcugacaucaggucugcuau

SEQ ID NO: 23705 - RNA, 19 nt, Human
ugcugacugggccucaccg

SEQ ID NO: 23706 - RNA, 22 nt, Human
ugcugagacaacaggaaacaag

SEQ ID NO: 23707 - RNA, 22 nt, Human
ugcugagacaccuaagguaaau

SEQ ID NO: 23708 - RNA, 22 nt, Human
ugcugagaggaaagaaugcaca

SEQ ID NO: 23709 - RNA, 22 nt, Human
ugcugagaggaaggugcacugg

SEQ ID NO: 23710 - RNA, 22 nt, Human
ugcugagauaagcuaugaccag

SEQ ID NO: 23711 - RNA, 22 nt, Human
ugcugaggaaaaaugugacucu

SEQ ID NO: 23712 - RNA, 22 nt, Human
ugcugaggacaccuagccuucu

SEQ ID NO: 23713 - RNA, 22 nt, Human
ugcugaggagguggcugugcuu

SEQ ID NO: 23714 - RNA, 22 nt, Human
ugcugaggcaguccuaacagga

SEQ ID NO: 23715 - RNA, 20 nt, Human
ugcugaggccugaggccugg

SEQ ID NO: 23716 - RNA, 22 nt, Human
ugcugagggagggguuuuccag

SEQ ID NO: 23717 - RNA, 22 nt, Human
ugcugaggucaccuugcugcua

SEQ ID NO: 23718 - RNA, 22 nt, Human
ugcugaggucauuuccaaguga

SEQ ID NO: 23719 - RNA, 20 nt, Human
ugcugagguugacaugccca

SEQ ID NO: 23720 - RNA, 22 nt, Human
ugcugagguuguggagugcauu

SEQ ID NO: 23721 - RNA, 22 nt, Human
ugcugagguuucgucugcuugc

SEQ ID NO: 23722 - RNA, 22 nt, Human
ugcugaguacucuccuguguag

SEQ ID NO: 23723 - RNA, 22 nt, Human
ugcugagucguauuauuuuuua

SEQ ID NO: 23724 - RNA, 22 nt, Human
ugcugauauauucuaguuuucu

SEQ ID NO: 23725 - RNA, 22 nt, Human
ugcugaugaguccuucuaucgc

SEQ ID NO: 23726 - RNA, 17 nt, Human
ugcugcagacccacccc

SEQ ID NO: 23727 - RNA, 22 nt, Human
ugcugcagacgaagcccaugcc

SEQ ID NO: 23728 - RNA, 22 nt, Human
ugcugcagagaauguuuuggcc

SEQ ID NO: 23729 - RNA, 22 nt, Human
ugcugcagcuaaggugaggugc

SEQ ID NO: 23730 - RNA, 19 nt, Human
ugcugcaggaugcugcugg

SEQ ID NO: 23731 - RNA, 22 nt, Human
ugcugcagguguguucagugag

SEQ ID NO: 23732 - RNA, 22 nt, Human
ugcugcagucacacggcuaucu

SEQ ID NO: 23733 - RNA, 22 nt, Human
ugcugcaguguuugcugaaguu

SEQ ID NO: 23734 - RNA, 22 nt, Human
ugcugccaaaugcgagcucugu

SEQ ID NO: 23735 - RNA, 17 nt, Human
ugcugccaagucccaac

SEQ ID NO: 23736 - RNA, 22 nt, Human
ugcugccagccaggccauggag

SEQ ID NO: 23737 - RNA, 21 nt, Human
ugcugccaucaugcagagaug

SEQ ID NO: 23738 - RNA, 22 nt, Human
ugcugccaucucaacugcccuu

SEQ ID NO: 23739 - RNA, 23 nt, Human
ugcugcccacucuuccagcccuc

SEQ ID NO: 23740 - RNA, 22 nt, Human
ugcugccuaauaagucgagggu

SEQ ID NO: 23741 - RNA, 22 nt, Human
ugcugccuccuuccugccagga

SEQ ID NO: 23742 - RNA, 22 nt, Human
ugcugccucugcugauauggcc

SEQ ID NO: 23743 - RNA, 22 nt, Human
ugcugccuuagaaauggcuaua

SEQ ID NO: 23744 - RNA, 22 nt, Human
ugcugccuuugggaccuggccu

SEQ ID NO: 23745 - RNA, 22 nt, Human
ugcugcuccugccuggcuccca

SEQ ID NO: 23746 - RNA, 22 nt, Human
ugcugcucgccacggcccaggg

SEQ ID NO: 23747 - RNA, 22 nt, Human
ugcugcucuucaccauggccuc

SEQ ID NO: 23748 - RNA, 22 nt, Human
ugcugcugaucauuuauagucu

SEQ ID NO: 23749 - RNA, 22 nt, Human
ugcugcugauggaugccuggac

SEQ ID NO: 23750 - RNA, 20 nt, Human
ugcugcugcuucacccccau

SEQ ID NO: 23751 - RNA, 22 nt, Human
ugcugcuguauccuuaguguca

SEQ ID NO: 23752 - RNA, 20 nt, Human
ugcugcugugagcgucccug

SEQ ID NO: 23753 - RNA, 22 nt, Human
ugcugcuucaccuguuguacag

SEQ ID NO: 23754 - RNA, 22 nt, Human
ugcugcuuugauguguaaauca

SEQ ID NO: 23755 - RNA, 22 nt, Human
ugcugcuuuggaacuccacagg

SEQ ID NO: 23756 - RNA, 21 nt, Human
ugcuggaaaaagugguucuag

SEQ ID NO: 23757 - RNA, 22 nt, Human
ugcuggaaaaaucauuugcuuu

SEQ ID NO: 23758 - RNA, 22 nt, Human
ugcuggaaagagaguuucaaug

SEQ ID NO: 23759 - RNA, 22 nt, Human
ugcuggaaaguuaaauuuugga

SEQ ID NO: 23760 - RNA, 22 nt, Human
ugcuggaaauauauuuguuuau

SEQ ID NO: 23761 - RNA, 22 nt, Human
ugcuggaaauuccuaggaggua

SEQ ID NO: 23762 - RNA, 22 nt, Human
ugcuggaagcuccugcaugucu

SEQ ID NO: 23763 - RNA, 22 nt, Human
ugcuggaagggucggcgugggc

SEQ ID NO: 23764 - RNA, 22 nt, Human
ugcuggaaugagucggggaggg

SEQ ID NO: 23765 - RNA, 22 nt, Human
ugcuggaauuauagaaaaauag

SEQ ID NO: 23766 - RNA, 22 nt, Human
ugcuggaauuuugcucuugcaa

SEQ ID NO: 23767 - RNA, 22 nt, Human
ugcuggagaagcuccugggacu

SEQ ID NO: 23768 - RNA, 22 nt, Human
ugcuggagacucacucaggugc

SEQ ID NO: 23769 - RNA, 22 nt, Human
cauagaaacuugcagcaagcac

SEQ ID NO: 23770 - RNA, 22 nt, Human
cauagaauggauugacaagauu

SEQ ID NO: 23771 - RNA, 22 nt, Human
cauagacauucagcacucacua

SEQ ID NO: 23772 - RNA, 22 nt, Human
cauagccaucuuuagcuuccag

SEQ ID NO: 23773 - RNA, 22 nt, Human
cauaggaagccaucucagucac

SEQ ID NO: 23774 - RNA, 22 nt, Human
cauaggccacggucagcccaca

SEQ ID NO: 23775 - RNA, 22 nt, Human
cauauaauguuugaagaugugg

SEQ ID NO: 23776 - RNA, 22 nt, Human
cauaucaaagagaaggauagga

SEQ ID NO: 23777 - RNA, 22 nt, Human
cauaucuccuccagcacaggcc

SEQ ID NO: 23778 - RNA, 22 nt, Human
cauaucuucugacaugaucagg

SEQ ID NO: 23779 - RNA, 22 nt, Human
cauaugaaauaugaguugaaca

SEQ ID NO: 23780 - RNA, 22 nt, Human
cauauggacaagaacauuuaug

SEQ ID NO: 23781 - RNA, 22 nt, Human
cauauuagacacuuauguccac

SEQ ID NO: 23782 - RNA, 22 nt, Human
cauauucaagggguaaggcaaa

SEQ ID NO: 23783 - RNA, 22 nt, Human
cauauucuguuggucacauaga

SEQ ID NO: 23784 - RNA, 22 nt, Human
cauauuuaguguuuggagaucg

SEQ ID NO: 23785 - RNA, 22 nt, Human
cauauuuauucuucugccagug

SEQ ID NO: 23786 - RNA, 22 nt, Human
cauauuucagucuaagaugugu

SEQ ID NO: 23787 - RNA, 22 nt, Human
cauauuugguauaacuuaagca

SEQ ID NO: 23788 - RNA, 22 nt, Human
caucaaauaaagaaauuccuug

SEQ ID NO: 23789 - RNA, 22 nt, Human
caucaaauaggaauauuuggca

SEQ ID NO: 23790 - RNA, 22 nt, Human
caucaaaucugacuuuucuucc

SEQ ID NO: 23791 - RNA, 22 nt, Human
caucaaauuaugugucaaagca

SEQ ID NO: 23792 - RNA, 22 nt, Human
caucaagagucuuacuaucagu

SEQ ID NO: 23793 - RNA, 23 nt, Human
caucaaguacuuuugacaagugu

SEQ ID NO: 23794 - RNA, 22 nt, Human
caucaagucaucaaagaauuca

SEQ ID NO: 23795 - RNA, 22 nt, Human
caucaagugguucuccagguug

SEQ ID NO: 23796 - RNA, 22 nt, Human
caucacaaaaugauuauucccu

SEQ ID NO: 23797 - RNA, 22 nt, Human
caucacagggggcuagaagucu

SEQ ID NO: 23798 - RNA, 22 nt, Human
caucacagguccugaugacauu

SEQ ID NO: 23799 - RNA, 22 nt, Human
caucacaguuugucagaaauca

SEQ ID NO: 23800 - RNA, 22 nt, Human
caucacaucagugugaacaguu

SEQ ID NO: 23801 - RNA, 22 nt, Human
caucacccggaacugugucugc

SEQ ID NO: 23802 - RNA, 22 nt, Human
caucacuacaaauuuaagaaau

SEQ ID NO: 23803 - RNA, 22 nt, Human
caucacugaaccccaacuuucu

SEQ ID NO: 23804 - RNA, 22 nt, Human
caucagaaaccuugaggaaacu

SEQ ID NO: 23805 - RNA, 22 nt, Human
caucagaaugaauguucuggag

SEQ ID NO: 23806 - RNA, 22 nt, Human
caucagaauguuagagaaggga

SEQ ID NO: 23807 - RNA, 22 nt, Human
caucagagguacuuaaugaaug

SEQ ID NO: 23808 - RNA, 23 nt, Human
caucagagguugccacucccugg

SEQ ID NO: 23809 - RNA, 22 nt, Human
caucagcacuaugauuaaagua

SEQ ID NO: 23810 - RNA, 22 nt, Human
caucagcugagggugagcagaa

SEQ ID NO: 23811 - RNA, 22 nt, Human
caucaggaauuauccuaauuau

SEQ ID NO: 23812 - RNA, 22 nt, Human
caucagucccacggagcagccc

SEQ ID NO: 23813 - RNA, 22 nt, Human
caucagucuagauucuaguacc

SEQ ID NO: 23814 - RNA, 22 nt, Human
caucagugucucucugguacuu

SEQ ID NO: 23815 - RNA, 22 nt, Human
caguuuuugccauuaagaguaa

SEQ ID NO: 23816 - RNA, 22 nt, Human
cauaaaagccaccuauuuaaag

SEQ ID NO: 23817 - RNA, 22 nt, Human
cauaaagucucauaauucacuu

SEQ ID NO: 23818 - RNA, 22 nt, Human
cauaaaguguauaagugaagaa

SEQ ID NO: 23819 - RNA, 22 nt, Human
cauaaauucaguucugccucuu

SEQ ID NO: 23820 - RNA, 22 nt, Human
cauaacaucugugaagcaggaa

SEQ ID NO: 23821 - RNA, 22 nt, Human
cauaacauuauuuucugaagau

SEQ ID NO: 23822 - RNA, 22 nt, Human
cauaacuguuaagauaauuuuu

SEQ ID NO: 23823 - RNA, 22 nt, Human
cauaagaagguaacauccuuaa

SEQ ID NO: 23824 - RNA, 22 nt, Human
cauaauaucuccgauuacuugc

SEQ ID NO: 23825 - RNA, 22 nt, Human
cauaauccugguguagcccucu

SEQ ID NO: 23826 - RNA, 22 nt, Human
cauaauccuugauucaaauaau

SEQ ID NO: 23827 - RNA, 22 nt, Human
cauaaugaacauuagcuacugu

SEQ ID NO: 23828 - RNA, 22 nt, Human
cauaaugucugacacaguaaga

SEQ ID NO: 23829 - RNA, 22 nt, Human
cauaauuauaaacgcaaguuca

SEQ ID NO: 23830 - RNA, 22 nt, Human
cauaauuucccaagagauugaa

SEQ ID NO: 23831 - RNA, 22 nt, Human
cauacaaauguguccaggcucu

SEQ ID NO: 23832 - RNA, 22 nt, Human
cauacagaaaauauauuuugau

SEQ ID NO: 23833 - RNA, 22 nt, Human
cauacagagaaggauaauaaag

SEQ ID NO: 23834 - RNA, 22 nt, Human
cauacauuaccuaacuuaaugc

SEQ ID NO: 23835 - RNA, 22 nt, Human
cauacauuuauacacaucuaug

SEQ ID NO: 23836 - RNA, 21 nt, Human
cauacucaguguauaacuucu

SEQ ID NO: 23837 - RNA, 22 nt, Human
cauacuguaagugcaaaagugu

SEQ ID NO: 23838 - RNA, 22 nt, Human
cauacugucagagccugaaggg

SEQ ID NO: 23839 - RNA, 22 nt, Human
cauacuuucuuuuucacgcaua

SEQ ID NO: 23840 - RNA, 22 nt, Human
cauacuuuuuagaucugccuuc

SEQ ID NO: 23841 - RNA, 22 nt, Human
cauagaaaucaggugagaaucu

SEQ ID NO: 23842 - RNA, 22 nt, Human
cauagauucuuauuuccaucuu

SEQ ID NO: 23843 - RNA, 22 nt, Human
cauagcaacagcaucaagucaa

SEQ ID NO: 23844 - RNA, 22 nt, Human
cauagcaaggugcuuuccacau

SEQ ID NO: 23845 - RNA, 22 nt, Human
cauagcgguauuccacgugguu

SEQ ID NO: 23846 - RNA, 22 nt, Human
cauaggaaaagcauucuucuug

SEQ ID NO: 23847 - RNA, 22 nt, Human
cauaggaaugaggacaauuagc

SEQ ID NO: 23848 - RNA, 22 nt, Human
cauaggucacuguacagguuaa

SEQ ID NO: 23849 - RNA, 22 nt, Human
cauagugacucaugccuauaau

SEQ ID NO: 23850 - RNA, 22 nt, Human
cauagugucugguaacauagua

SEQ ID NO: 23851 - RNA, 22 nt, Human
cauauauuauggacugcagaau

SEQ ID NO: 23852 - RNA, 22 nt, Human
cauauccaauaugacuaguguu

SEQ ID NO: 23853 - RNA, 21 nt, Human
cauaugaaagaaguaucugac

SEQ ID NO: 23854 - RNA, 21 nt, Human
cauauuaaaucggugccuuua

SEQ ID NO: 23855 - RNA, 22 nt, Human
cauauuaaggucuguaaggggu

SEQ ID NO: 23856 - RNA, 22 nt, Human
cauauuagccuccacugggaca

SEQ ID NO: 23857 - RNA, 22 nt, Human
cauauuguaaaagguugaaucc

SEQ ID NO: 23858 - RNA, 22 nt, Human
cauauugucuauugcuguuuuu

SEQ ID NO: 23859 - RNA, 19 nt, Human
cauauuuuugggcuggcau

SEQ ID NO: 23860 - RNA, 22 nt, Human
caucaaaauuagacauuguuga

SEQ ID NO: 23861 - RNA, 22 nt, Human
caucaaacaaaugcuuuuagau

SEQ ID NO: 23862 - RNA, 22 nt, Human
caucaaagggccuguggugcag

SEQ ID NO: 23863 - RNA, 22 nt, Human
caucaaaguugauauccaauua

SEQ ID NO: 23864 - RNA, 22 nt, Human
caucaacagugucagaugaugc

SEQ ID NO: 23865 - RNA, 21 nt, Human
caucaacucuugugcucacac

SEQ ID NO: 23866 - RNA, 22 nt, Human
caucaagauggaagagcaaaua

SEQ ID NO: 23867 - RNA, 22 nt, Human
caucaagugccuuucaccucua

SEQ ID NO: 23868 - RNA, 22 nt, Human
caucacaccacaggcauuuucu

SEQ ID NO: 23869 - RNA, 22 nt, Human
caucacaggcauuuugaguguc

SEQ ID NO: 23870 - RNA, 22 nt, Human
caucacaucuacuauaagugau

SEQ ID NO: 23871 - RNA, 22 nt, Human
caucacauguaggcagcaucac

SEQ ID NO: 23872 - RNA, 22 nt, Human
caucacauuuaaggggaaggac

SEQ ID NO: 23873 - RNA, 22 nt, Human
caucacauuuaauuaaaauguc

SEQ ID NO: 23874 - RNA, 22 nt, Human
caucagaaccaguggggacauu

SEQ ID NO: 23875 - RNA, 22 nt, Human
caucagaagauggcucuggaaa

SEQ ID NO: 23876 - RNA, 22 nt, Human
caucagaaucugagucucugcc

SEQ ID NO: 23877 - RNA, 22 nt, Human
caucagaauuacuuggggagcu

SEQ ID NO: 23878 - RNA, 22 nt, Human
caugaaauguuagaauuagaca

SEQ ID NO: 23879 - RNA, 22 nt, Human
caugaaauuugaaguacagcaa

SEQ ID NO: 23880 - RNA, 22 nt, Human
caugaacagcuaacauuuuggg

SEQ ID NO: 23881 - RNA, 22 nt, Human
caugaacauucagaaauacagc

SEQ ID NO: 23882 - RNA, 22 nt, Human
caugaaccaaaccaaagugucc

SEQ ID NO: 23883 - RNA, 22 nt, Human
caugaagcccucaucagucuga

SEQ ID NO: 23884 - RNA, 22 nt, Human
caugaagcuugaagcaguccac

SEQ ID NO: 23885 - RNA, 22 nt, Human
caugaaggaauaauuguuuaga

SEQ ID NO: 23886 - RNA, 23 nt, Human
caugaagguagcacaaagccucu

SEQ ID NO: 23887 - RNA, 22 nt, Human
caugaagucacuggagcuuuca

SEQ ID NO: 23888 - RNA, 22 nt, Human
caugaauauacauccugauggc

SEQ ID NO: 23889 - RNA, 22 nt, Human
caugaauuuauauuauuaguga

SEQ ID NO: 23890 - RNA, 22 nt, Human
caugaauuuuucuguggguuaa

SEQ ID NO: 23891 - RNA, 22 nt, Human
caugacaaauaaaccuuugcca

SEQ ID NO: 23892 - RNA, 22 nt, Human
caugacaauaagccagcagaaa

SEQ ID NO: 23893 - RNA, 20 nt, Human
caugagaagggcagugugag

SEQ ID NO: 23894 - RNA, 22 nt, Human
caugagagauccuucaugagag

SEQ ID NO: 23895 - RNA, 22 nt, Human
caugaggauccaggugacaggc

SEQ ID NO: 23896 - RNA, 22 nt, Human
caugaguaugauuauacccagu

SEQ ID NO: 23897 - RNA, 16 nt, Human
caugagucaguaagca

SEQ ID NO: 23898 - RNA, 22 nt, Human
caugagucauagugaagcagga

SEQ ID NO: 23899 - RNA, 22 nt, Human
caugagugaguaucucaagaua

SEQ ID NO: 23900 - RNA, 22 nt, Human
caugagugucaucucagcagcu

SEQ ID NO: 23901 - RNA, 22 nt, Human
caugaguuuuuuaguucaugca

SEQ ID NO: 23902 - RNA, 22 nt, Human
caugauacuugaauuuggaagg

SEQ ID NO: 23903 - RNA, 22 nt, Human
caugauacuugacauuugcgau

SEQ ID NO: 23904 - RNA, 22 nt, Human
caugaugucacagagaagcaca

SEQ ID NO: 23905 - RNA, 22 nt, Human
caugauuuacuaaaauuuguuu

SEQ ID NO: 23906 - RNA, 22 nt, Human
caugcaaacacguaaacauuca

SEQ ID NO: 23907 - RNA, 22 nt, Human
caugcaaaugguggcuaaaugg

SEQ ID NO: 23908 - RNA, 20 nt, Human
caugcaacagauuauuuccc

SEQ ID NO: 23909 - RNA, 22 nt, Human
caugcacacugcaacaaggacu

SEQ ID NO: 23910 - RNA, 22 nt, Human
caugcacagagcuuggucauug

SEQ ID NO: 23911 - RNA, 22 nt, Human
caugcacaugcaauagugcuuu

SEQ ID NO: 23912 - RNA, 22 nt, Human
caugcagaggugccacgaggcu

SEQ ID NO: 23913 - RNA, 21 nt, Human
caugcagauucuggagccaga

SEQ ID NO: 23914 - RNA, 21 nt, Human
caugcaggauuuaaccuagaa

SEQ ID NO: 23915 - RNA, 22 nt, Human
caugcaggcacccagagcccac

SEQ ID NO: 23916 - RNA, 22 nt, Human
caugcagggagcagaggagaca

SEQ ID NO: 23917 - RNA, 22 nt, Human
caugcagguuauaugugcuucu

SEQ ID NO: 23918 - RNA, 22 nt, Human
caugcaguauucaggacaguuc

SEQ ID NO: 23919 - RNA, 22 nt, Human
caugcagugaugcacugcauca

SEQ ID NO: 23920 - RNA, 22 nt, Human
caugcauacacaggucaggcag

SEQ ID NO: 23921 - RNA, 22 nt, Human
caugcauagcuuuggagcuagg

SEQ ID NO: 23922 - RNA, 22 nt, Human
caugcauauaugcuacaugcaa

SEQ ID NO: 23923 - RNA, 22 nt, Human
caugcaugccuggcucacagag

SEQ ID NO: 23924 - RNA, 22 nt, Human
caugcaugucagggauccugga

SEQ ID NO: 23925 - RNA, 22 nt, Human
caugcauuccuccucugccuua

SEQ ID NO: 23926 - RNA, 22 nt, Human
caugccaacaacaagcaaugag

SEQ ID NO: 23927 - RNA, 20 nt, Human
caugccagaaugugagguag

SEQ ID NO: 23928 - RNA, 22 nt, Human
caugccagggcuugcugccugg

SEQ ID NO: 23929 - RNA, 23 nt, Human
caugccaguuugugcaggcagau

SEQ ID NO: 23930 - RNA, 20 nt, Human
caugccaugucuacugaggc

SEQ ID NO: 23931 - RNA, 22 nt, Human
cugaacaggcucugauggauuc

SEQ ID NO: 23932 - RNA, 22 nt, Human
cugaaccacuaauauuuugauu

SEQ ID NO: 23933 - RNA, 22 nt, Human
cugaacucuuuaugacagcuug

SEQ ID NO: 23934 - RNA, 22 nt, Human
cugaacugacagacugccugcu

SEQ ID NO: 23935 - RNA, 22 nt, Human
cugaagaaauaugauugcuuaa

SEQ ID NO: 23936 - RNA, 22 nt, Human
cugaagaagcugcagccuggag

SEQ ID NO: 23937 - RNA, 20 nt, Human
cugaagagacuggaggggca

SEQ ID NO: 23938 - RNA, 23 nt, Human
cugaagagccaacaaaaagcuug

SEQ ID NO: 23939 - RNA, 22 nt, Human
cugaagaggacgcagcagcaag

SEQ ID NO: 23940 - RNA, 17 nt, Human
cugaagaguccuggcua

SEQ ID NO: 23941 - RNA, 22 nt, Human
cugaagauagugucugaucaug

SEQ ID NO: 23942 - RNA, 22 nt, Human
cugaagauucgccuuuguuuau

SEQ ID NO: 23943 - RNA, 22 nt, Human
cugaagcaauugagagauguuu

SEQ ID NO: 23944 - RNA, 22 nt, Human
cugaagcagauguggcugagau

SEQ ID NO: 23945 - RNA, 22 nt, Human
cugaagccacgauagcuuccua

SEQ ID NO: 23946 - RNA, 22 nt, Human
cugaagcugaaaacuuccagca

SEQ ID NO: 23947 - RNA, 22 nt, Human
cugaagcugcauaccaaagacu

SEQ ID NO: 23948 - RNA, 22 nt, Human
cugaagcugggcacuuccuuuu

SEQ ID NO: 23949 - RNA, 22 nt, Human
cugaaggauuagagagcacuua

SEQ ID NO: 23950 - RNA, 22 nt, Human
cugaaggcuaaaauggacugaa

SEQ ID NO: 23951 - RNA, 22 nt, Human
cugaaggcugaggcuguguugu

SEQ ID NO: 23952 - RNA, 22 nt, Human
cugaaguuaacaucuugauguc

SEQ ID NO: 23953 - RNA, 22 nt, Human
cugaaguuaaucagagguacaa

SEQ ID NO: 23954 - RNA, 22 nt, Human
cugaaguucauacaauggccau

SEQ ID NO: 23955 - RNA, 22 nt, Human
cugaaguuuuucaauuuauguu

SEQ ID NO: 23956 - RNA, 22 nt, Human
cugaauaaagcccucgcgcgcu

SEQ ID NO: 23957 - RNA, 22 nt, Human
cugaauaauuuuauaguugcug

SEQ ID NO: 23958 - RNA, 22 nt, Human
cugaauaauuuucuguuguaug

SEQ ID NO: 23959 - RNA, 22 nt, Human
cugaauaucauuuaucauuggc

SEQ ID NO: 23960 - RNA, 22 nt, Human
cugaauauuagucaugucugau

SEQ ID NO: 23961 - RNA, 22 nt, Human
cugaaucaugccauuuugcuua

SEQ ID NO: 23962 - RNA, 22 nt, Human
cugaaugccugcagagccagag

SEQ ID NO: 23963 - RNA, 22 nt, Human
cugaauuaagcauuacauacau

SEQ ID NO: 23964 - RNA, 22 nt, Human
cugaauuacugaaggucaacuu

SEQ ID NO: 23965 - RNA, 18 nt, Human
cugaauuaucucaucauu

SEQ ID NO: 23966 - RNA, 21 nt, Human
cugaauuaugugcuuaccuuu

SEQ ID NO: 23967 - RNA, 22 nt, Human
cugaauuauuuaaggugaaggg

SEQ ID NO: 23968 - RNA, 22 nt, Human
cugaauucugccuugaggccuu

SEQ ID NO: 23969 - RNA, 22 nt, Human
cugacaaaccacugcuccagcu

SEQ ID NO: 23970 - RNA, 22 nt, Human
cugacaaacuuaauuuucugaa

SEQ ID NO: 23971 - RNA, 22 nt, Human
cugacaagguugaauuguccca

SEQ ID NO: 23972 - RNA, 22 nt, Human
cugacacacugagcauuugaua

SEQ ID NO: 23973 - RNA, 22 nt, Human
cugacacccagcagaacuggga

SEQ ID NO: 23974 - RNA, 20 nt, Human
cugacagaaaauauuucauc

SEQ ID NO: 23975 - RNA, 22 nt, Human
cugacagaaucauuaagaccau

SEQ ID NO: 23976 - RNA, 22 nt, Human
cugacagaugcugcuggcagua

SEQ ID NO: 23977 - RNA, 22 nt, Human
cugacagauuagaugugcauau

SEQ ID NO: 23978 - RNA, 22 nt, Human
cugacagcagcaaauggagaua

SEQ ID NO: 23979 - RNA, 22 nt, Human
cugacagcuauuuuuguagaua

SEQ ID NO: 23980 - RNA, 22 nt, Human
cugacagcuguugcagugaaug

SEQ ID NO: 23981 - RNA, 22 nt, Human
cugacaguaacuaauguggaga

SEQ ID NO: 23982 - RNA, 22 nt, Human
cugacagucucauugauuugcu

SEQ ID NO: 23983 - RNA, 22 nt, Human
cugacagucuugccaaguuucu

SEQ ID NO: 23984 - RNA, 22 nt, Human
cugacauguauaagcuuuaagu

SEQ ID NO: 23985 - RNA, 22 nt, Human
cugacauuuacugagcacuuac

SEQ ID NO: 23986 - RNA, 20 nt, Human
cugaccagcagccugucucc

SEQ ID NO: 23987 - RNA, 22 nt, Human
cugcugagcaucagggcugccc

SEQ ID NO: 23988 - RNA, 22 nt, Human
cugcugagcccuggcacaggug

SEQ ID NO: 23989 - RNA, 22 nt, Human
cugcugaggccuucccuguccu

SEQ ID NO: 23990 - RNA, 22 nt, Human
cugcugagguauacuaugugac

SEQ ID NO: 23991 - RNA, 22 nt, Human
cugcugcaacucuuuagagggu

SEQ ID NO: 23992 - RNA, 22 nt, Human
cugcugcuuagcauagcagagg

SEQ ID NO: 23993 - RNA, 22 nt, Human
cugcuggacuacaggaagaguu

SEQ ID NO: 23994 - RNA, 22 nt, Human
cugcuggcaccgaugaaagaca

SEQ ID NO: 23995 - RNA, 22 nt, Human
cugcuggcccccauuucagggu

SEQ ID NO: 23996 - RNA, 22 nt, Human
cugcuggcuucuagucauucaa

SEQ ID NO: 23997 - RNA, 22 nt, Human
cugcugggcagaggcugcauga

SEQ ID NO: 23998 - RNA, 22 nt, Human
cugcugguaccaguggccguca

SEQ ID NO: 23999 - RNA, 22 nt, Human
cugcugguuagucuuaguggga

SEQ ID NO: 24000 - RNA, 22 nt, Human
cugcugucauagccaucccucc

SEQ ID NO: 24001 - RNA, 22 nt, Human
cugcugucaucuggcgcugugc

SEQ ID NO: 24002 - RNA, 22 nt, Human
cugcuguccaaccugcacucgc

SEQ ID NO: 24003 - RNA, 20 nt, Human
cugcugugauucccuccucc

SEQ ID NO: 24004 - RNA, 22 nt, Human
cugcugugcagacagacucucu

SEQ ID NO: 24005 - RNA, 22 nt, Human
cugcugugccucuuuucacgug

SEQ ID NO: 24006 - RNA, 22 nt, Human
cugcugugcuuguggccacccg

SEQ ID NO: 24007 - RNA, 22 nt, Human
cugcugugugaccauggacagg

SEQ ID NO: 24008 - RNA, 22 nt, Human
cugcugugugcuuacuuggguu

SEQ ID NO: 24009 - RNA, 20 nt, Human
cugcugugugugccucagcc

SEQ ID NO: 24010 - RNA, 22 nt, Human
cugcuguguuagcagguuuagu

SEQ ID NO: 24011 - RNA, 22 nt, Human
cugcuguguugccagugucacc

SEQ ID NO: 24012 - RNA, 22 nt, Human
cugcuguguuggcauuggauag

SEQ ID NO: 24013 - RNA, 23 nt, Human
cugcuguguuggucucgauggga

SEQ ID NO: 24014 - RNA, 22 nt, Human
cugcuguguuucacaccucugg

SEQ ID NO: 24015 - RNA, 22 nt, Human
cugcuguuuggugagugagaaa

SEQ ID NO: 24016 - RNA, 22 nt, Human
cugcuuauggagaugaguaaga

SEQ ID NO: 24017 - RNA, 22 nt, Human
cugcuuggcauugguaaagaau

SEQ ID NO: 24018 - RNA, 20 nt, Human
cugcuugggccccucuggcc

SEQ ID NO: 24019 - RNA, 22 nt, Human
cugcuuuaacaaggcugaucag

SEQ ID NO: 24020 - RNA, 22 nt, Human
cugcuuuaacagaugauggugu

SEQ ID NO: 24021 - RNA, 22 nt, Human
cugcuuuaauggaaaguguuuu

SEQ ID NO: 24022 - RNA, 22 nt, Human
cugcuuuagacaacugcuggga

SEQ ID NO: 24023 - RNA, 22 nt, Human
cugcuuuagagcugagccucag

SEQ ID NO: 24024 - RNA, 22 nt, Human
cugcuuuagcuagugcucuuag

SEQ ID NO: 24025 - RNA, 19 nt, Human
cugcuuuaggccuuaaaag

SEQ ID NO: 24026 - RNA, 22 nt, Human
cugcuuuauagggcuuccaugu

SEQ ID NO: 24027 - RNA, 23 nt, Human
cugcuuucccacuccaugcucuu

SEQ ID NO: 24028 - RNA, 22 nt, Human
cugcuuugauuagaagaguaca

SEQ ID NO: 24029 - RNA, 22 nt, Human
cugcuuuggcagaagucagcua

SEQ ID NO: 24030 - RNA, 22 nt, Human
cugcuuugggcagcuuuguggc

SEQ ID NO: 24031 - RNA, 22 nt, Human
cuggaaaaugaagaagcagagg

SEQ ID NO: 24032 - RNA, 22 nt, Human
cuggaaagacagagggcauggg

SEQ ID NO: 24033 - RNA, 22 nt, Human
cuggaaagagauggcaggguuu

SEQ ID NO: 24034 - RNA, 22 nt, Human
cuggaaagauuucuuuggaguc

SEQ ID NO: 24035 - RNA, 22 nt, Human
cuggaaaguagauguacuaagg

SEQ ID NO: 24036 - RNA, 23 nt, Human
cuggaacauaguagauggucaga

SEQ ID NO: 24037 - RNA, 22 nt, Human
cuggaacucaggaugguuagga

SEQ ID NO: 24038 - RNA, 21 nt, Human
cuggaagaagcagcaggauuc

SEQ ID NO: 24039 - RNA, 22 nt, Human
cuggaagacguuugaagccaug

SEQ ID NO: 24040 - RNA, 22 nt, Human
cuggaagcuuguuugccagucu

SEQ ID NO: 24041 - RNA, 22 nt, Human
cuggaaggagcccgggcggauc

SEQ ID NO: 24042 - RNA, 19 nt, Human
cuggaaggagggacuguuc

SEQ ID NO: 24043 - RNA, 22 nt, Human
cuggaaggcggagguuguagug

SEQ ID NO: 24044 - RNA, 22 nt, Human
cuggaaggcucugcugccuguc

SEQ ID NO: 24045 - RNA, 22 nt, Human
cuggaagggagcacuguagaga

SEQ ID NO: 24046 - RNA, 22 nt, Human
cuggaagguaacaaggccauua

SEQ ID NO: 24047 - RNA, 22 nt, Human
cuggaagguggauggcgaggcc

SEQ ID NO: 24048 - RNA, 22 nt, Human
cuggaagguuccucccagcucc

SEQ ID NO: 24049 - RNA, 22 nt, Human
cuggaauauuuguaggaugaaa

SEQ ID NO: 24050 - RNA, 22 nt, Human
cuggaaugagagcccggggauc

SEQ ID NO: 24051 - RNA, 22 nt, Human
cuggaaugcggagaguuggaga

SEQ ID NO: 24052 - RNA, 22 nt, Human
cuggaauggcaaugggaagucc

SEQ ID NO: 24053 - RNA, 22 nt, Human
cuggaaugggccauuugaggcc

SEQ ID NO: 24054 - RNA, 22 nt, Human
cuggaauggguuucaggcacug

SEQ ID NO: 24055 - RNA, 22 nt, Human
cuggaauguucuccagcauggc

SEQ ID NO: 24056 - RNA, 22 nt, Human
cuggaauugcauaauauguccu

SEQ ID NO: 24057 - RNA, 22 nt, Human
cuggacagaucccuuguagcuu

SEQ ID NO: 24058 - RNA, 22 nt, Human
cuggacucagggugcuccagcg

SEQ ID NO: 24059 - RNA, 22 nt, Human
cuggacuuuggcccaucugcca

SEQ ID NO: 24060 - RNA, 22 nt, Human
cuggagaaacaucaggcauagg

SEQ ID NO: 24061 - RNA, 22 nt, Human
cuggagaacagagcuguuuaga

SEQ ID NO: 24062 - RNA, 22 nt, Human
cuggagaagcauucaaauaauu

SEQ ID NO: 24063 - RNA, 22 nt, Human
cuggagagaauguggaaugauu

SEQ ID NO: 24064 - RNA, 22 nt, Human
cuggagaguuggaagauggacu

SEQ ID NO: 24065 - RNA, 22 nt, Human
ccaaggcaacguuggugucagg

SEQ ID NO: 24066 - RNA, 22 nt, Human
ccaaggcacacucugcaagguu

SEQ ID NO: 24067 - RNA, 22 nt, Human
ccaaggcagaagauggcucuug

SEQ ID NO: 24068 - RNA, 22 nt, Human
ccaaggcaggggaucaaaguuu

SEQ ID NO: 24069 - RNA, 22 nt, Human
ccaaggccacaaacagccuggc

SEQ ID NO: 24070 - RNA, 22 nt, Human
ccaaggcuccucagcuggucuu

SEQ ID NO: 24071 - RNA, 22 nt, Human
ccaaggcugagguuuccaguug

SEQ ID NO: 24072 - RNA, 22 nt, Human
ccaagggagacugugagaccuc

SEQ ID NO: 24073 - RNA, 22 nt, Human
ccaaggucuuggacagcuaaug

SEQ ID NO: 24074 - RNA, 22 nt, Human
ccaaguaguugagacuacaggu

SEQ ID NO: 24075 - RNA, 20 nt, Human
ccaauaaagcucuauaggga

SEQ ID NO: 24076 - RNA, 22 nt, Human
ccaauauuaugaaagugugaca

SEQ ID NO: 24077 - RNA, 22 nt, Human
ccaauccucauguucaacaacc

SEQ ID NO: 24078 - RNA, 22 nt, Human
ccaaugagacagaaagagccuc

SEQ ID NO: 24079 - RNA, 22 nt, Human
ccaaugcauugaauuagguuuu

SEQ ID NO: 24080 - RNA, 22 nt, Human
ccaauguuaggcucugguuuua

SEQ ID NO: 24081 - RNA, 18 nt, Human
ccaauguuggccccaagg

SEQ ID NO: 24082 - RNA, 20 nt, Human
ccaauguuuacagauuacuu

SEQ ID NO: 24083 - RNA, 22 nt, Human
ccaauguuuauuuuccugcugc

SEQ ID NO: 24084 - RNA, 22 nt, Human
ccaauguuuuauacagaaguac

SEQ ID NO: 24085 - RNA, 22 nt, Human
ccaauucauccucuggggcuuc

SEQ ID NO: 24086 - RNA, 22 nt, Human
ccacaaggaggacagcaguugg

SEQ ID NO: 24087 - RNA, 17 nt, Human
ccacacccuuuccuucc

SEQ ID NO: 24088 - RNA, 22 nt, Human
ccacacuggcaugggauggagg

SEQ ID NO: 24089 - RNA, 22 nt, Human
ccacacuuugagaugacuagga

SEQ ID NO: 24090 - RNA, 22 nt, Human
ccacagaaaauaaagcacgauu

SEQ ID NO: 24091 - RNA, 22 nt, Human
ccacagaccuuggcuuccaccu

SEQ ID NO: 24092 - RNA, 22 nt, Human
ccacagaguuacaaaacaguca

SEQ ID NO: 24093 - RNA, 22 nt, Human
ccacagaguugaugcaauaaga

SEQ ID NO: 24094 - RNA, 22 nt, Human
ccacagcaggacuggagccgcc

SEQ ID NO: 24095 - RNA, 23 nt, Human
ccacagcuauaggguagugcagu

SEQ ID NO: 24096 - RNA, 22 nt, Human
ccagagaaagugaagcaaaugu

SEQ ID NO: 24097 - RNA, 22 nt, Human
ccagagaagguggagcuugugu

SEQ ID NO: 24098 - RNA, 19 nt, Human
ccagagacauuggcaucuu

SEQ ID NO: 24099 - RNA, 22 nt, Human
ccagagagaaauggauuugagu

SEQ ID NO: 24100 - RNA, 22 nt, Human
ccagagagaguacugggcucug

SEQ ID NO: 24101 - RNA, 22 nt, Human
ccagagcccagcacacggugcu

SEQ ID NO: 24102 - RNA, 19 nt, Human
ccagagcccgccagauggg

SEQ ID NO: 24103 - RNA, 22 nt, Human
ccagagcccgggaccuggacuu

SEQ ID NO: 24104 - RNA, 22 nt, Human
ccagagccggcucccucagcuu

SEQ ID NO: 24105 - RNA, 22 nt, Human
ccagagccucaacacagguccu

SEQ ID NO: 24106 - RNA, 22 nt, Human
ccagagccucgcccggagccuc

SEQ ID NO: 24107 - RNA, 22 nt, Human
ccagagccucuuaugaagaucg

SEQ ID NO: 24108 - RNA, 22 nt, Human
ccagagccugcugagccccauu

SEQ ID NO: 24109 - RNA, 22 nt, Human
ccagagcuccagggcuacagaa

SEQ ID NO: 24110 - RNA, 22 nt, Human
ccagagcugaggagaugggcuu

SEQ ID NO: 24111 - RNA, 22 nt, Human
ccagagcugauuccugggacuu

SEQ ID NO: 24112 - RNA, 22 nt, Human
ccagagcugcauccagcagguu

SEQ ID NO: 24113 - RNA, 22 nt, Human
ccagaggaauugggaaacaugu

SEQ ID NO: 24114 - RNA, 22 nt, Human
ccagaggagaugccuccucugu

SEQ ID NO: 24115 - RNA, 22 nt, Human
ccagaggagcauggccuugaga

SEQ ID NO: 24116 - RNA, 22 nt, Human
ccagaggagggcucugaugagg

SEQ ID NO: 24117 - RNA, 22 nt, Human
ccagaggaguugaggcuuuggg

SEQ ID NO: 24118 - RNA, 22 nt, Human
ccagaggaucaguacuggcugg

SEQ ID NO: 24119 - RNA, 19 nt, Human
ccagaggcagcuucuguaa

SEQ ID NO: 24120 - RNA, 22 nt, Human
ccagaggcuggcagccagcuga

SEQ ID NO: 24121 - RNA, 22 nt, Human
ccagagggaagaggaagcgcug

SEQ ID NO: 24122 - RNA, 22 nt, Human
ccagagggcuugguuugggcca

SEQ ID NO: 24123 - RNA, 22 nt, Human
ccagaggucuccugcacgggau

SEQ ID NO: 24124 - RNA, 22 nt, Human
ccagaggugccacagaaagagc

SEQ ID NO: 24125 - RNA, 22 nt, Human
ccagaggugcucuuuggaagug

SEQ ID NO: 24126 - RNA, 22 nt, Human
ccagagguggaagauuguuuug

SEQ ID NO: 24127 - RNA, 22 nt, Human
ccagaggugggagugaucuggu

SEQ ID NO: 24128 - RNA, 22 nt, Human
ccagagguggucauagaaagca

SEQ ID NO: 24129 - RNA, 22 nt, Human
ccagagguuacacccucagccc

SEQ ID NO: 24130 - RNA, 22 nt, Human
ccagagguuccaggcuagggag

SEQ ID NO: 24131 - RNA, 22 nt, Human
ccagagucauuuugagucauaa

SEQ ID NO: 24132 - RNA, 22 nt, Human
ccagagucuuuauauuccugaa

SEQ ID NO: 24133 - RNA, 22 nt, Human
ccagauaaggcuuuuuaaaagc

SEQ ID NO: 24134 - RNA, 22 nt, Human
ccagauauucacuuuuacaugc

SEQ ID NO: 24135 - RNA, 22 nt, Human
ccagaucacucaaccagagcuc

SEQ ID NO: 24136 - RNA, 16 nt, Human
ccagaugaaugggagu

SEQ ID NO: 24137 - RNA, 18 nt, Human
ccagauggccagucugcu

SEQ ID NO: 24138 - RNA, 22 nt, Human
ccagaugggccagggguuuguu

SEQ ID NO: 24139 - RNA, 22 nt, Human
ccagaugggcuuuagcaaauga

SEQ ID NO: 24140 - RNA, 22 nt, Human
ccagauucauagaaacucauag

SEQ ID NO: 24141 - RNA, 23 nt, Human
ccagauuugccacgagagaggcu

SEQ ID NO: 24142 - RNA, 22 nt, Human
ccagcacucgcugauuuuagga

SEQ ID NO: 24143 - RNA, 22 nt, Human
ccagcacucugucccagcuucc

SEQ ID NO: 24144 - RNA, 22 nt, Human
ccagcagaagcucccgcugggu

SEQ ID NO: 24145 - RNA, 22 nt, Human
ccagcagagcuggaagugugcu

SEQ ID NO: 24146 - RNA, 22 nt, Human
ccagcagagggcgcuucacacc

SEQ ID NO: 24147 - RNA, 22 nt, Human
ccagcagagucuaggaaggagg

SEQ ID NO: 24148 - RNA, 22 nt, Human
ccagcagagugggguuuagagu

SEQ ID NO: 24149 - RNA, 22 nt, Human
ccagcagcagcguccaaggaga

SEQ ID NO: 24150 - RNA, 22 nt, Human
ccagcagcauccugcagcacuu

SEQ ID NO: 24151 - RNA, 22 nt, Human
ccagcagcccucuuccaagacu

SEQ ID NO: 24152 - RNA, 22 nt, Human
ccagcagcgauagggugagugc

SEQ ID NO: 24153 - RNA, 22 nt, Human
ccagcagcucccucaggguccg

SEQ ID NO: 24154 - RNA, 22 nt, Human
ccagcagcuuugcauacacuaa

SEQ ID NO: 24155 - RNA, 22 nt, Human
ccagcaggagaugccugugucu

SEQ ID NO: 24156 - RNA, 22 nt, Human
ccagcaucagcacccaaggagc

SEQ ID NO: 24157 - RNA, 22 nt, Human
ccagcauccaugcucccucggg

SEQ ID NO: 24158 - RNA, 22 nt, Human
ccagcaugagacgaugaugaag

SEQ ID NO: 24159 - RNA, 20 nt, Human
ccagcauguacacaugugga

SEQ ID NO: 24160 - RNA, 22 nt, Human
ccagccacagcuuccagcuccu

SEQ ID NO: 24161 - RNA, 22 nt, Human
ccagccaccgcuuguuugcacu

SEQ ID NO: 24162 - RNA, 22 nt, Human
ccagccagccuugaucugagua

SEQ ID NO: 24163 - RNA, 22 nt, Human
ccagccagcugguuggacgccu

SEQ ID NO: 24164 - RNA, 22 nt, Human
ccagccaguccagcauuggugu

SEQ ID NO: 24165 - RNA, 19 nt, Human
ccagcccauaguccaucac

SEQ ID NO: 24166 - RNA, 22 nt, Human
ccagccccgggccuuaccgugc

SEQ ID NO: 24167 - RNA, 22 nt, Human
ccagcccugauuagagaauguc

SEQ ID NO: 24168 - RNA, 18 nt, Human
ccagcccugcagcaccug

SEQ ID NO: 24169 - RNA, 22 nt, Human
ccagcccuguuuaugugucacu

SEQ ID NO: 24170 - RNA, 22 nt, Human
ccagcccuugcugaaggguggc

SEQ ID NO: 24171 - RNA, 22 nt, Human
ccagcccuuugugguucacuga

SEQ ID NO: 24172 - RNA, 19 nt, Human
ccagccucucuuccacccc

SEQ ID NO: 24173 - RNA, 22 nt, Human
ccagccuucaccugcucugguc

SEQ ID NO: 24174 - RNA, 22 nt, Human
ccagcgcuucccaucagggagg

SEQ ID NO: 24175 - RNA, 22 nt, Human
ccagcuaguaagcaccugcauc

SEQ ID NO: 24176 - RNA, 22 nt, Human
ccagcuauugcuguguaacagu

SEQ ID NO: 24177 - RNA, 23 nt, Human
ccagcucccaggucugaggacug

SEQ ID NO: 24178 - RNA, 22 nt, Human
ccagcuccggugugcuuauuuc

SEQ ID NO: 24179 - RNA, 22 nt, Human
ccagcuccucuucccaguguca

SEQ ID NO: 24180 - RNA, 22 nt, Human
ccagcuccucuugucucuagca

SEQ ID NO: 24181 - RNA, 22 nt, Human
caugucuuauuuaugcuucuua

SEQ ID NO: 24182 - RNA, 22 nt, Human
caugucuuucucaucacaucua

SEQ ID NO: 24183 - RNA, 22 nt, Human
caugugauuacacuaagaaggu

SEQ ID NO: 24184 - RNA, 19 nt, Human
caugugcaugagcacagga

SEQ ID NO: 24185 - RNA, 22 nt, Human
cauguggagaauuaaaaaauac

SEQ ID NO: 24186 - RNA, 22 nt, Human
caugugguauugugagauccac

SEQ ID NO: 24187 - RNA, 22 nt, Human
cauguguaaggcucacaggcag

SEQ ID NO: 24188 - RNA, 22 nt, Human
cauguguaccagcuguucuuug

SEQ ID NO: 24189 - RNA, 22 nt, Human
cauguguauuauucuuguggaa

SEQ ID NO: 24190 - RNA, 21 nt, Human
caugugucuuguguuacugcu

SEQ ID NO: 24191 - RNA, 22 nt, Human
caugugugaagacugcgggcca

SEQ ID NO: 24192 - RNA, 22 nt, Human
caugugugaaucuugugaucau

SEQ ID NO: 24193 - RNA, 22 nt, Human
caugugugagugagcagucuuc

SEQ ID NO: 24194 - RNA, 22 nt, Human
caugugugcaccaacccuaugu

SEQ ID NO: 24195 - RNA, 22 nt, Human
caugugugguuaccuacuugac

SEQ ID NO: 24196 - RNA, 22 nt, Human
cauguguguccaugugacuaag

SEQ ID NO: 24197 - RNA, 22 nt, Human
caugugugucuccaccagcugc

SEQ ID NO: 24198 - RNA, 22 nt, Human
cauguguguggcugacaauuuu

SEQ ID NO: 24199 - RNA, 18 nt, Human
cauguguucuacaucagu

SEQ ID NO: 24200 - RNA, 22 nt, Human
cauguucaucagaucaauugua

SEQ ID NO: 24201 - RNA, 22 nt, Human
cauguucuaauauugugacaua

SEQ ID NO: 24202 - RNA, 22 nt, Human
cauguuggcacugucucugccu

SEQ ID NO: 24203 - RNA, 22 nt, Human
cauguuguaucauucuguuccu

SEQ ID NO: 24204 - RNA, 22 nt, Human
cauguuuaauugcgauguuuga

SEQ ID NO: 24205 - RNA, 22 nt, Human
ccagggugaggaggcucccacg

SEQ ID NO: 24206 - RNA, 22 nt, Human
ccagggugcucuguggcgucgc

SEQ ID NO: 24207 - RNA, 22 nt, Human
ccaggguuggaugagucacuua

SEQ ID NO: 24208 - RNA, 22 nt, Human
ccaggguuggcaagcaaggcuu

SEQ ID NO: 24209 - RNA, 22 nt, Human
ccaggguugguauucaccugga

SEQ ID NO: 24210 - RNA, 22 nt, Human
ccagguaacuugagaacaugag

SEQ ID NO: 24211 - RNA, 21 nt, Human
ccagguacauggagaaugugg

SEQ ID NO: 24212 - RNA, 22 nt, Human
ccaggucuaucaaguugggcuc

SEQ ID NO: 24213 - RNA, 22 nt, Human
ccaggucuuguuugacaucaau

SEQ ID NO: 24214 - RNA, 22 nt, Human
ccaggugcacucaagaccugcu

SEQ ID NO: 24215 - RNA, 22 nt, Human
ccaggugcucuugccagggcug

SEQ ID NO: 24216 - RNA, 22 nt, Human
ccagguggaaggucugugcucu

SEQ ID NO: 24217 - RNA, 22 nt, Human
ccagguggacuugauuugaaua

SEQ ID NO: 24218 - RNA, 22 nt, Human
ccagguggcccugcccuacucu

SEQ ID NO: 24219 - RNA, 22 nt, Human
ccaggugggcgugucuucaccu

SEQ ID NO: 24220 - RNA, 20 nt, Human
ccagguggugccuggagagg

SEQ ID NO: 24221 - RNA, 22 nt, Human
ccagguguaagacaugguccua

SEQ ID NO: 24222 - RNA, 22 nt, Human
ccaggugucauggauaaugggu

SEQ ID NO: 24223 - RNA, 22 nt, Human
ccaggugucuguggccagcccu

SEQ ID NO: 24224 - RNA, 22 nt, Human
ccagguguuacacgaguguuaa

SEQ ID NO: 24225 - RNA, 22 nt, Human
ccaguaaauuacuugaugucau

SEQ ID NO: 24226 - RNA, 22 nt, Human
ccaguaacaccucgcagacucc

SEQ ID NO: 24227 - RNA, 22 nt, Human
ccaguaauggaaauagcaguuc

SEQ ID NO: 24228 - RNA, 21 nt, Human
ccaguauuauuucucuaugua

SEQ ID NO: 24229 - RNA, 22 nt, Human
ccagucacagguguguuuauau

SEQ ID NO: 24230 - RNA, 22 nt, Human
ccagucaguucugauuaugugg

SEQ ID NO: 24231 - RNA, 22 nt, Human
ccaguccagugccaugcauggc

SEQ ID NO: 24232 - RNA, 22 nt, Human
ccaguccauauuuauacugccg

SEQ ID NO: 24233 - RNA, 22 nt, Human
ccaguccuaguucuaccuuaca

SEQ ID NO: 24234 - RNA, 19 nt, Human
ccaguccucuuugggccug

SEQ ID NO: 24235 - RNA, 22 nt, Human
ccagucgugacaaccaaaaaua

SEQ ID NO: 24236 - RNA, 20 nt, Human
ccagucucuaucagaaauaa

SEQ ID NO: 24237 - RNA, 22 nt, Human
ccagucugcagccccuggggac

SEQ ID NO: 24238 - RNA, 22 nt, Human
ccagucugcugugguaggaaga

SEQ ID NO: 24239 - RNA, 21 nt, Human
ccagucuguaaaauggggaca

SEQ ID NO: 24240 - RNA, 19 nt, Human
ccagugcaagguaagauag

SEQ ID NO: 24241 - RNA, 22 nt, Human
ccagugcccagcugcccaggca

SEQ ID NO: 24242 - RNA, 22 nt, Human
ccagugccuauccuucuccugu

SEQ ID NO: 24243 - RNA, 22 nt, Human
ccaguggacuucucccuguggu

SEQ ID NO: 24244 - RNA, 20 nt, Human
ccagugggaagugauuaggu

SEQ ID NO: 24245 - RNA, 22 nt, Human
ccaguggguaggccauggugag

SEQ ID NO: 24246 - RNA, 22 nt, Human
ccaguguauuuuugggaccugc

SEQ ID NO: 24247 - RNA, 22 nt, Human
ccaguguccuuccuuuccaugg

SEQ ID NO: 24248 - RNA, 22 nt, Human
ccagugucuacuguggcauauc

SEQ ID NO: 24249 - RNA, 22 nt, Human
ccagugucuagcagaugacagg

SEQ ID NO: 24250 - RNA, 19 nt, Human
ccagugucuagcgcacagc

SEQ ID NO: 24251 - RNA, 22 nt, Human
ccagugucuagucacagguacu

SEQ ID NO: 24252 - RNA, 22 nt, Human
ccagugugaaccucaccacccu

SEQ ID NO: 24253 - RNA, 22 nt, Human
ccagugugauuguugcaagaau

SEQ ID NO: 24254 - RNA, 22 nt, Human
ccagugugccaauuuacagcug

SEQ ID NO: 24255 - RNA, 22 nt, Human
ccaguguggacucucuccuuug

SEQ ID NO: 24256 - RNA, 22 nt, Human
ccagugugguuuaggauaggga

SEQ ID NO: 24257 - RNA, 22 nt, Human
ccaguguguuuuucucugacuc

SEQ ID NO: 24258 - RNA, 22 nt, Human
ccaguguucccucggguucaug

SEQ ID NO: 24259 - RNA, 22 nt, Human
ccaguguuggaggauggcuugc

SEQ ID NO: 24260 - RNA, 22 nt, Human
ccaguguuuccccagaagagag

SEQ ID NO: 24261 - RNA, 22 nt, Human
ccaguuaguuaaaggcgcagua

SEQ ID NO: 24262 - RNA, 22 nt, Human
ccaguucuucuugacacgaaag

SEQ ID NO: 24263 - RNA, 22 nt, Human
ccaguucuuucugugugcaaca

SEQ ID NO: 24264 - RNA, 22 nt, Human
ccaguugguuucaaugggacag

SEQ ID NO: 24265 - RNA, 22 nt, Human
ccaguuuaagacuuaucucaau

SEQ ID NO: 24266 - RNA, 22 nt, Human
ccaguuugagguuucaagaugu

SEQ ID NO: 24267 - RNA, 22 nt, Human
ccaguuuuuccagugcuuucug

SEQ ID NO: 24268 - RNA, 23 nt, Human
ccauaaucaggguuguggggucc

SEQ ID NO: 24269 - RNA, 22 nt, Human
ccauaaucauguaaguaaauuc

SEQ ID NO: 24270 - RNA, 22 nt, Human
ccauaggagcccuggucccuga

SEQ ID NO: 24271 - RNA, 22 nt, Human
ccaucaaugacuaauaaaauag

SEQ ID NO: 24272 - RNA, 22 nt, Human
ccaucaguuuuaucugacaaaa

SEQ ID NO: 24273 - RNA, 22 nt, Human
ccauccauauggugacaaggug

SEQ ID NO: 24274 - RNA, 22 nt, Human
ccauccaugaacgaggaagugg

SEQ ID NO: 24275 - RNA, 22 nt, Human
ccauccaugcgccagacagauu

SEQ ID NO: 24276 - RNA, 22 nt, Human
ccaucccuucucuggccagcag

SEQ ID NO: 24277 - RNA, 22 nt, Human
ccauccugcaggaccuccauau

SEQ ID NO: 24278 - RNA, 22 nt, Human
ccauccugcauugcuauucaga

SEQ ID NO: 24279 - RNA, 22 nt, Human
ccaugcaauuucuguaaaacca

SEQ ID NO: 24280 - RNA, 22 nt, Human
ccaugcagugcuggagcugauu

SEQ ID NO: 24281 - RNA, 22 nt, Human
ccaugccauacuggccacccgg

SEQ ID NO: 24282 - RNA, 19 nt, Human
ccaugccaucauuuuaaag

SEQ ID NO: 24283 - RNA, 22 nt, Human
ccaugcccuaaaggacuggcag

SEQ ID NO: 24284 - RNA, 22 nt, Human
ccaugcccuugucaucuccagg

SEQ ID NO: 24285 - RNA, 22 nt, Human
ccaugccuuccuuucccuggaa

SEQ ID NO: 24286 - RNA, 22 nt, Human
ccaugccuuucacugaaccagu

SEQ ID NO: 24287 - RNA, 22 nt, Human
ccaugcuccuuaccacucacuu

SEQ ID NO: 24288 - RNA, 22 nt, Human
ccaugcugacccugugcaggca

SEQ ID NO: 24289 - RNA, 22 nt, Human
ccauggagcgggugagugagug

SEQ ID NO: 24290 - RNA, 22 nt, Human
ccauggcagccaugggagccac

SEQ ID NO: 24291 - RNA, 22 nt, Human
ccauggcagccuggccuggcuu

SEQ ID NO: 24292 - RNA, 22 nt, Human
ccauggccaauugcaccuugcu

SEQ ID NO: 24293 - RNA, 22 nt, Human
ccauggccucgcucuacguggg

SEQ ID NO: 24294 - RNA, 22 nt, Human
ccauggcucuagagauugaaaa

SEQ ID NO: 24295 - RNA, 22 nt, Human
ccauggcuucuuucucugccag

SEQ ID NO: 24296 - RNA, 22 nt, Human
ccaugggaccuaccuccugugc

SEQ ID NO: 24297 - RNA, 22 nt, Human
ccaugggcgcacaggccuggag

SEQ ID NO: 24298 - RNA, 22 nt, Human
ccauguacaugaacacggcggc

SEQ ID NO: 24299 - RNA, 22 nt, Human
ccaugugcuugcucuggcaccu

SEQ ID NO: 24300 - RNA, 22 nt, Human
ccauguggcuagcgugccugca

SEQ ID NO: 24301 - RNA, 22 nt, Human
ccaugugggauuuuggugucug

SEQ ID NO: 24302 - RNA, 20 nt, Human
cugggcugcccagcuauggg

SEQ ID NO: 24303 - RNA, 22 nt, Human
cugggcugcgggcgccccucca

SEQ ID NO: 24304 - RNA, 22 nt, Human
cugggcugcggugguagguugu

SEQ ID NO: 24305 - RNA, 22 nt, Human
cugggcugcucagcccccucgc

SEQ ID NO: 24306 - RNA, 22 nt, Human
cugggcuggagugcaauggcgc

SEQ ID NO: 24307 - RNA, 22 nt, Human
cugggcuggauaauucuuugcu

SEQ ID NO: 24308 - RNA, 22 nt, Human
cugggcuggcgcauccgacacg

SEQ ID NO: 24309 - RNA, 20 nt, Human
cugggcugggcuacaggguc

SEQ ID NO: 24310 - RNA, 22 nt, Human
cugggcuguaauguggcacuga

SEQ ID NO: 24311 - RNA, 22 nt, Human
cugggcugugguguggcccaaa

SEQ ID NO: 24312 - RNA, 22 nt, Human
cugggcuuagcagcuccugguc

SEQ ID NO: 24313 - RNA, 22 nt, Human
cugggcuuugguacugugauua

SEQ ID NO: 24314 - RNA, 22 nt, Human
cuggggaaggcggugacugcgc

SEQ ID NO: 24315 - RNA, 22 nt, Human
cuggggaauagagcuggagacc

SEQ ID NO: 24316 - RNA, 22 nt, Human
cuggggacugaaggauguugcu

SEQ ID NO: 24317 - RNA, 22 nt, Human
cuggggacuugcagacacaauu

SEQ ID NO: 24318 - RNA, 20 nt, Human
cuggggagccucgcgguggc

SEQ ID NO: 24319 - RNA, 20 nt, Human
cuggggaggaggauguguuc

SEQ ID NO: 24320 - RNA, 22 nt, Human
cuggggauccuuuuugcaucua

SEQ ID NO: 24321 - RNA, 22 nt, Human
cuggggcagagcccagcaauuu

SEQ ID NO: 24322 - RNA, 22 nt, Human
cuggggcaucauccauucuuuc

SEQ ID NO: 24323 - RNA, 22 nt, Human
cuggggcauugggagaggccug

SEQ ID NO: 24324 - RNA, 22 nt, Human
cuggggcccugggucugcccuc

SEQ ID NO: 24325 - RNA, 22 nt, Human
cuggggcucacuuuggucaggc

SEQ ID NO: 24326 - RNA, 23 nt, Human
cuggggcucauugcaguagccau

SEQ ID NO: 24327 - RNA, 22 nt, Human
cuggggcucucuggaaugcuug

SEQ ID NO: 24328 - RNA, 22 nt, Human
cuggggcuguaggaggacuuau

SEQ ID NO: 24329 - RNA, 22 nt, Human
cuggggcugugggagacaaggc

SEQ ID NO: 24330 - RNA, 23 nt, Human
cuggggcuuucaaaucugggcag

SEQ ID NO: 24331 - RNA, 22 nt, Human
cugggggucgcgccucugggca

SEQ ID NO: 24332 - RNA, 22 nt, Human
cugggggucuugaaagggagag

SEQ ID NO: 24333 - RNA, 22 nt, Human
cugggguggauggguccaaguu

SEQ ID NO: 24334 - RNA, 22 nt, Human
cuggggugucucgucugccauu

SEQ ID NO: 24335 - RNA, 22 nt, Human
cuggggugugcucagagcaggg

SEQ ID NO: 24336 - RNA, 22 nt, Human
cugggguuggccagggcccuag

SEQ ID NO: 24337 - RNA, 22 nt, Human
cuggguaaaggcugcuuuucua

SEQ ID NO: 24338 - RNA, 22 nt, Human
cuggguagggcaaggaacuggc

SEQ ID NO: 24339 - RNA, 22 nt, Human
cuggguauaggaaacaguuaag

SEQ ID NO: 24340 - RNA, 22 nt, Human
cugggucuccggcagccucggg

SEQ ID NO: 24341 - RNA, 20 nt, Human
cugggucuccuucugcuuaa

SEQ ID NO: 24342 - RNA, 22 nt, Human
cugggucucuuaccaugugacu

SEQ ID NO: 24343 - RNA, 22 nt, Human
cugggucuggcuacugcuuccu

SEQ ID NO: 24344 - RNA, 22 nt, Human
cugggucuggugucaggcgacg

SEQ ID NO: 24345 - RNA, 22 nt, Human
cugggugcugugggcucagagg

SEQ ID NO: 24346 - RNA, 22 nt, Human
cuggguggaaagugcugagaau

SEQ ID NO: 24347 - RNA, 22 nt, Human
cuggguggaucgcagccccagg

SEQ ID NO: 24348 - RNA, 22 nt, Human
cuggguggcgucuggggccagu

SEQ ID NO: 24349 - RNA, 22 nt, Human
cuggguggcuguccagccagcc

SEQ ID NO: 24350 - RNA, 22 nt, Human
cuggguguagcccaguaugagg

SEQ ID NO: 24351 - RNA, 22 nt, Human
cuggguguucacccgaggcgcu

SEQ ID NO: 24352 - RNA, 22 nt, Human
cuggguugcaaagcgcuggcug

SEQ ID NO: 24353 - RNA, 22 nt, Human
cugguacagggaaauaaaggaa

SEQ ID NO: 24354 - RNA, 22 nt, Human
cugguagggccccacauccuua

SEQ ID NO: 24355 - RNA, 22 nt, Human
cuggucaaaaauuaugcuuacu

SEQ ID NO: 24356 - RNA, 22 nt, Human
cuggucagagcaacugcucaca

SEQ ID NO: 24357 - RNA, 22 nt, Human
cuggucagcugaagccccacac

SEQ ID NO: 24358 - RNA, 18 nt, Human
cuggucagggcaaugggc

SEQ ID NO: 24359 - RNA, 22 nt, Human
cuggucccagcucugccaccaa

SEQ ID NO: 24360 - RNA, 22 nt, Human
cuggucccauccuggcuucaug

SEQ ID NO: 24361 - RNA, 22 nt, Human
cugguccuaaagcccuacucca

SEQ ID NO: 24362 - RNA, 19 nt, Human
cugguccugacugaggggu

SEQ ID NO: 24363 - RNA, 22 nt, Human
cuggucugcaaggccauauaga

SEQ ID NO: 24364 - RNA, 21 nt, Human
cuggucuggccaauaaggucc

SEQ ID NO: 24365 - RNA, 22 nt, Human
cuggugaauauuggaggcauug

SEQ ID NO: 24366 - RNA, 22 nt, Human
cuggugacauuuccggcugcca

SEQ ID NO: 24367 - RNA, 22 nt, Human
cuggugagacgguugacaggag

SEQ ID NO: 24368 - RNA, 22 nt, Human
cuggugcaagauucccugcuuc

SEQ ID NO: 24369 - RNA, 22 nt, Human
cuggugcacuacagccuggaac

SEQ ID NO: 24370 - RNA, 22 nt, Human
cuggugccauucuguggccuag

SEQ ID NO: 24371 - RNA, 22 nt, Human
cuggugcccuguguggcaggag

SEQ ID NO: 24372 - RNA, 22 nt, Human
cuggugccuccucccugugcuu

SEQ ID NO: 24373 - RNA, 22 nt, Human
cuggugcuuugcucauuugaua

SEQ ID NO: 24374 - RNA, 22 nt, Human
cugguggaggugccaggauuug

SEQ ID NO: 24375 - RNA, 22 nt, Human
cugguggcaucuugagaugguu

SEQ ID NO: 24376 - RNA, 22 nt, Human
cuggugucugauucuccccuga

SEQ ID NO: 24377 - RNA, 22 nt, Human
cugguguggacuccgcgcggag

SEQ ID NO: 24378 - RNA, 22 nt, Human
cugguucaaguccuggcucugu

SEQ ID NO: 24379 - RNA, 22 nt, Human
cugguucaauacuaaacuucuu

SEQ ID NO: 24380 - RNA, 22 nt, Human
cugguucacaucuguuuaucug

SEQ ID NO: 24381 - RNA, 22 nt, Human
cugguucaucgcggccacuuau

SEQ ID NO: 24382 - RNA, 22 nt, Human
cugguuccaggauggaucuuuc

SEQ ID NO: 24383 - RNA, 22 nt, Human
cugguucccagcaggaguguag

SEQ ID NO: 24384 - RNA, 22 nt, Human
cugguucugauuuugcugcauu

SEQ ID NO: 24385 - RNA, 22 nt, Human
cugguuuaaaauuacugguuaa

SEQ ID NO: 24386 - RNA, 22 nt, Human
cugguuuaagcuuauauaguug

SEQ ID NO: 24387 - RNA, 22 nt, Human
cugguuuacucugcacugcuca

SEQ ID NO: 24388 - RNA, 19 nt, Human
cugguuuagguagugaguc

SEQ ID NO: 24389 - RNA, 22 nt, Human
cugguuuagucauaauggagaa

SEQ ID NO: 24390 - RNA, 22 nt, Human
cugguuuugucagaagcuuuau

SEQ ID NO: 24391 - RNA, 22 nt, Human
cuguaaacuaggucauuuuuaa

SEQ ID NO: 24392 - RNA, 22 nt, Human
cuguaaauaaugacaguugacu

SEQ ID NO: 24393 - RNA, 22 nt, Human
cuguaacagcugucagagcagg

SEQ ID NO: 24394 - RNA, 22 nt, Human
cuguaacucugccaagaaggcu

SEQ ID NO: 24395 - RNA, 22 nt, Human
cuguaacuuaaugagaggcaga

SEQ ID NO: 24396 - RNA, 22 nt, Human
cuguaagaugggauaagacuuu

SEQ ID NO: 24397 - RNA, 22 nt, Human
cuguacaauguuaccuauuuau

SEQ ID NO: 24398 - RNA, 22 nt, Human
cuguacaggagacgucugugca

SEQ ID NO: 24399 - RNA, 22 nt, Human
cuguacaggucaaugauaagau

SEQ ID NO: 24400 - RNA, 22 nt, Human
cuguacaggugaggagggggcu

SEQ ID NO: 24401 - RNA, 22 nt, Human
cuguacaucccaagauauuucu

SEQ ID NO: 24402 - RNA, 22 nt, Human
cuguacuuuugcaggucacagc

SEQ ID NO: 24403 - RNA, 22 nt, Human
cuguagaacgauccaggcauuu

SEQ ID NO: 24404 - RNA, 22 nt, Human
cuguagcagugugcucuuuuuc

SEQ ID NO: 24405 - RNA, 22 nt, Human
cuguagcuccagccugucuaca

SEQ ID NO: 24406 - RNA, 22 nt, Human
cuguaggcuuagcuagaaguga

SEQ ID NO: 24407 - RNA, 20 nt, Human
cuguagggugcagcaggcuc

SEQ ID NO: 24408 - RNA, 22 nt, Human
cuguaggugauugcuauguuau

SEQ ID NO: 24409 - RNA, 22 nt, Human
cuguagguuugcucugaccugg

SEQ ID NO: 24410 - RNA, 22 nt, Human
cuguauaauucaugcucuuauu

SEQ ID NO: 24411 - RNA, 20 nt, Human
cuguaucagguuacaaagua

SEQ ID NO: 24412 - RNA, 22 nt, Human
cuguaugaaauuaaguaaacag

SEQ ID NO: 24413 - RNA, 22 nt, Human
ccaccuggggcuguggccccuu

SEQ ID NO: 24414 - RNA, 22 nt, Human
ccacgacgagucaucagggcga

SEQ ID NO: 24415 - RNA, 22 nt, Human
ccacggccacccgcucaugggc

SEQ ID NO: 24416 - RNA, 23 nt, Human
ccacuagcaccuguucaacuucu

SEQ ID NO: 24417 - RNA, 22 nt, Human
ccacuauuacuguguggcaguc

SEQ ID NO: 24418 - RNA, 22 nt, Human
ccacucagcacaguggaugcag

SEQ ID NO: 24419 - RNA, 17 nt, Human
ccacucaguaauuucuc

SEQ ID NO: 24420 - RNA, 22 nt, Human
ccacuccccacgugcugucaga

SEQ ID NO: 24421 - RNA, 22 nt, Human
ccacucccuuccgguccagggc

SEQ ID NO: 24422 - RNA, 20 nt, Human
ccacuccgcccccagagggc

SEQ ID NO: 24423 - RNA, 22 nt, Human
ccagugcccagucucccugguc

SEQ ID NO: 24424 - RNA, 22 nt, Human
ccagugccuuuuguggguuugu

SEQ ID NO: 24425 - RNA, 22 nt, Human
ccagugcgagccugugcuggcc

SEQ ID NO: 24426 - RNA, 22 nt, Human
ccagugcuaagguagccucugc

SEQ ID NO: 24427 - RNA, 22 nt, Human
ccagugcucauucaaguccuua

SEQ ID NO: 24428 - RNA, 22 nt, Human
ccagugcuucuuugcuagcugg

SEQ ID NO: 24429 - RNA, 22 nt, Human
ccaguggaaauguggucaggau

SEQ ID NO: 24430 - RNA, 22 nt, Human
ccaguggccaugcacgagcagc

SEQ ID NO: 24431 - RNA, 22 nt, Human
ccagugucagaaagauuauccu

SEQ ID NO: 24432 - RNA, 22 nt, Human
ccagugucuucagaguaaaucu

SEQ ID NO: 24433 - RNA, 22 nt, Human
ccagugugaccaucuguuagcu

SEQ ID NO: 24434 - RNA, 22 nt, Human
ccaguguggccaggucuucugg

SEQ ID NO: 24435 - RNA, 22 nt, Human
ccagugugggcugguggaggac

SEQ ID NO: 24436 - RNA, 22 nt, Human
ccagugugguagguccacaggu

SEQ ID NO: 24437 - RNA, 22 nt, Human
ccaguguguucccugccucacu

SEQ ID NO: 24438 - RNA, 22 nt, Human
ccaguguuacggcuugaacuau

SEQ ID NO: 24439 - RNA, 22 nt, Human
ccaguguuagagacugauacag

SEQ ID NO: 24440 - RNA, 22 nt, Human
ccaguguucaauacauauuugu

SEQ ID NO: 24441 - RNA, 22 nt, Human
cccaaaggcauuuugcugacca

SEQ ID NO: 24442 - RNA, 22 nt, Human
cccaaaggcuguacuuguaacc

SEQ ID NO: 24443 - RNA, 22 nt, Human
cccaaagggcuuccuguucuca

SEQ ID NO: 24444 - RNA, 22 nt, Human
cccaaaguacaaguaaacaugu

SEQ ID NO: 24445 - RNA, 23 nt, Human
cccaacacauuccuuuucuucug

SEQ ID NO: 24446 - RNA, 22 nt, Human
cccaaccagaaauugacagaca

SEQ ID NO: 24447 - RNA, 22 nt, Human
cccaaccccaacuuccuauguu

SEQ ID NO: 24448 - RNA, 22 nt, Human
cccaacuacucucaggcagcuu

SEQ ID NO: 24449 - RNA, 22 nt, Human
cccaagccuuucaaaacucaga

SEQ ID NO: 24450 - RNA, 22 nt, Human
cccaaggacacgggcagggaca

SEQ ID NO: 24451 - RNA, 22 nt, Human
cccaaggccucuccuuggcuug

SEQ ID NO: 24452 - RNA, 22 nt, Human
cccaauggcuggauggagggau

SEQ ID NO: 24453 - RNA, 22 nt, Human
cccacagggcugcugauggcag

SEQ ID NO: 24454 - RNA, 23 nt, Human
cccacaugucugagucagugcca

SEQ ID NO: 24455 - RNA, 22 nt, Human
cccaccagccaucugagagugu

SEQ ID NO: 24456 - RNA, 22 nt, Human
cccaccaugugcccauuggcuu

SEQ ID NO: 24457 - RNA, 22 nt, Human
cccacccacucugaccagaagc

SEQ ID NO: 24458 - RNA, 22 nt, Human
cccacccugggcuacacaucca

SEQ ID NO: 24459 - RNA, 22 nt, Human
cccacgucgaacuugcuccaga

SEQ ID NO: 24460 - RNA, 22 nt, Human
cccacucccuacgacacgcucc

SEQ ID NO: 24461 - RNA, 22 nt, Human
cccacucccugcacgccugccg

SEQ ID NO: 24462 - RNA, 22 nt, Human
cccacugagccuauacaaacag

SEQ ID NO: 24463 - RNA, 22 nt, Human
cccacugaggguuaaugccugc

SEQ ID NO: 24464 - RNA, 22 nt, Human
cccacugcaugaguugguauua

SEQ ID NO: 24465 - RNA, 22 nt, Human
cccacugcugcucuccauggca

SEQ ID NO: 24466 - RNA, 18 nt, Human
cccacuguccccacaggc

SEQ ID NO: 24467 - RNA, 22 nt, Human
cccacuuugguugcacucugcc

SEQ ID NO: 24468 - RNA, 22 nt, Human
cccagacccagagggaggcagg

SEQ ID NO: 24469 - RNA, 22 nt, Human
cccagagaagugaagugacuug

SEQ ID NO: 24470 - RNA, 22 nt, Human
cccagagaaucuuucagaaagg

SEQ ID NO: 24471 - RNA, 22 nt, Human
cccagagacuuuguccgacgac

SEQ ID NO: 24472 - RNA, 22 nt, Human
cccagagagcauuuggacaaag

SEQ ID NO: 24473 - RNA, 22 nt, Human
cccagagagguaaaacagccuu

SEQ ID NO: 24474 - RNA, 17 nt, Human
cccagagaugcugccuu

SEQ ID NO: 24475 - RNA, 22 nt, Human
cccagagauguccugagugaua

SEQ ID NO: 24476 - RNA, 22 nt, Human
cccagagcuccgguccugccca

SEQ ID NO: 24477 - RNA, 22 nt, Human
cccagagcugggugggcagcgg

SEQ ID NO: 24478 - RNA, 23 nt, Human
cccagaggagcagggcgugagau

SEQ ID NO: 24479 - RNA, 22 nt, Human
cccagaggugaaggagguggga

SEQ ID NO: 24480 - RNA, 22 nt, Human
cccagaguggagggugcagaau

SEQ ID NO: 24481 - RNA, 22 nt, Human
cccagaguucaaacccugcguc

SEQ ID NO: 24482 - RNA, 22 nt, Human
cccagaugcagguucaagagua

SEQ ID NO: 24483 - RNA, 22 nt, Human
cccagcacuuugaauaugucac

SEQ ID NO: 24484 - RNA, 18 nt, Human
cccagcacuuugggagcc

SEQ ID NO: 24485 - RNA, 23 nt, Human
cccagcagagaugaggagggguc

SEQ ID NO: 24486 - RNA, 22 nt, Human
cccagcaggcauguugggagga

SEQ ID NO: 24487 - RNA, 22 nt, Human
cccagcaggucggugcugccug

SEQ ID NO: 24488 - RNA, 22 nt, Human
cccagcaguuugcuuagaguga

SEQ ID NO: 24489 - RNA, 22 nt, Human
cccagcaucuccaggcauggcc

SEQ ID NO: 24490 - RNA, 22 nt, Human
cccagcaugcacgcugacacuc

SEQ ID NO: 24491 - RNA, 22 nt, Human
cccagccaaggugcugguguug

SEQ ID NO: 24492 - RNA, 18 nt, Human
cccagcccaccauuucuc

SEQ ID NO: 24493 - RNA, 22 nt, Human
cccagcccaucucaaaggucua

SEQ ID NO: 24494 - RNA, 20 nt, Human
cccagccccuaccuguugcc

SEQ ID NO: 24495 - RNA, 22 nt, Human
cccagcccugaccuauuggaaa

SEQ ID NO: 24496 - RNA, 22 nt, Human
cccagccuacucugccauagca

SEQ ID NO: 24497 - RNA, 22 nt, Human
cccagccugucuuucccaauga

SEQ ID NO: 24498 - RNA, 22 nt, Human
cccagccuuccacccuggacua

SEQ ID NO: 24499 - RNA, 22 nt, Human
cccagcucaucaggagccgccc

SEQ ID NO: 24500 - RNA, 22 nt, Human
cccagcuccagagccagaaaca

SEQ ID NO: 24501 - RNA, 22 nt, Human
cccagcucccauguucuccaau

SEQ ID NO: 24502 - RNA, 22 nt, Human
cccagcuccuuacagggccgaa

SEQ ID NO: 24503 - RNA, 22 nt, Human
cccagcuccuuguuugcaucuc

SEQ ID NO: 24504 - RNA, 22 nt, Human
cccagcucugcagaccugcccu

SEQ ID NO: 24505 - RNA, 22 nt, Human
cccagcugaacuugcauuccaa

SEQ ID NO: 24506 - RNA, 17 nt, Human
cccagcuggcagugccg

SEQ ID NO: 24507 - RNA, 22 nt, Human
cccagcuggccagguggcuuug

SEQ ID NO: 24508 - RNA, 18 nt, Human
cccagcuuagcgccccuc

SEQ ID NO: 24509 - RNA, 22 nt, Human
cccagcuugcgggcggcaggag

SEQ ID NO: 24510 - RNA, 22 nt, Human
cccagcuugucugauucagccu

SEQ ID NO: 24511 - RNA, 23 nt, Human
cccagcuuucccacugccgagag

SEQ ID NO: 24512 - RNA, 22 nt, Human
cccaggaaaagcagugccagca

SEQ ID NO: 24513 - RNA, 22 nt, Human
cccaggaaaggaaaugaauggg

SEQ ID NO: 24514 - RNA, 22 nt, Human
cccaggaaauagccaggaggug

SEQ ID NO: 24515 - RNA, 22 nt, Human
cccaggaaauauguuucuuaac

SEQ ID NO: 24516 - RNA, 22 nt, Human
cccaggaacagcacagaacagc

SEQ ID NO: 24517 - RNA, 22 nt, Human
cccaggaacagggcucagaccc

SEQ ID NO: 24518 - RNA, 22 nt, Human
cccaggaagggaugccaaggaa

SEQ ID NO: 24519 - RNA, 22 nt, Human
cccaggaaguggagguugcagu

SEQ ID NO: 24520 - RNA, 22 nt, Human
cccaggaccauccuucugugcc

SEQ ID NO: 24521 - RNA, 21 nt, Human
cccaggagaagaaaagaugca

SEQ ID NO: 24522 - RNA, 22 nt, Human
cccaggagaccugugaaaggac

SEQ ID NO: 24523 - RNA, 22 nt, Human
cccaggagacugagcuguaacc

SEQ ID NO: 24524 - RNA, 22 nt, Human
cccaggagagagacuugaaucu

SEQ ID NO: 24525 - RNA, 22 nt, Human
cccaggagagaggccaguuggc

SEQ ID NO: 24526 - RNA, 22 nt, Human
cccaggagagggaaccaaaugu

SEQ ID NO: 24527 - RNA, 23 nt, Human
cccaggagccugaguccucucug

SEQ ID NO: 24528 - RNA, 20 nt, Human
cccaggagcugugccccauc

SEQ ID NO: 24529 - RNA, 22 nt, Human
cccaggaggaggaaaaagcucg

SEQ ID NO: 24530 - RNA, 22 nt, Human
cccaggaggcagagguuggagc

SEQ ID NO: 24531 - RNA, 22 nt, Human
cccaggaggcgcagguugcggu

SEQ ID NO: 24532 - RNA, 22 nt, Human
cccaagagcuucuaggacgcug

SEQ ID NO: 24533 - RNA, 22 nt, Human
cccaagaucuuucgugcacuaa

SEQ ID NO: 24534 - RNA, 22 nt, Human
cccaaggaauaggaucccagga

SEQ ID NO: 24535 - RNA, 19 nt, Human
cccaaggcccugggcaggc

SEQ ID NO: 24536 - RNA, 22 nt, Human
cccaagggagugccuggucaac

SEQ ID NO: 24537 - RNA, 22 nt, Human
cccaaguauuccuccucugccc

SEQ ID NO: 24538 - RNA, 22 nt, Human
cccacacaaaucauggggagaa

SEQ ID NO: 24539 - RNA, 18 nt, Human
cccacacagcaguagcuc

SEQ ID NO: 24540 - RNA, 22 nt, Human
cccacagaaugccaaugagacc

SEQ ID NO: 24541 - RNA, 19 nt, Human
cccacaggaggacauaugg

SEQ ID NO: 24542 - RNA, 22 nt, Human
cccacaggcuagggguagggca

SEQ ID NO: 24543 - RNA, 22 nt, Human
cccacagguccccaugaacucg

SEQ ID NO: 24544 - RNA, 22 nt, Human
cccacagugaucgcauucguac

SEQ ID NO: 24545 - RNA, 22 nt, Human
cccacaguuaaccaaaggaauu

SEQ ID NO: 24546 - RNA, 22 nt, Human
cccacaucccuuccccgcugug

SEQ ID NO: 24547 - RNA, 22 nt, Human
cccaccagaccugcaccggcac

SEQ ID NO: 24548 - RNA, 21 nt, Human
cccaccccauaaggcagaacc

SEQ ID NO: 24549 - RNA, 18 nt, Human
cccacccuggcucuuagu

SEQ ID NO: 24550 - RNA, 22 nt, Human
cccacccugggaagcuaggcag

SEQ ID NO: 24551 - RNA, 21 nt, Human
cccacggaaugaugaggcacu

SEQ ID NO: 24552 - RNA, 17 nt, Human
cccacggaggugugaaa

SEQ ID NO: 24553 - RNA, 18 nt, Human
cccacggugcuguagggc

SEQ ID NO: 24554 - RNA, 22 nt, Human
cccacuucaugggcaggaagga

SEQ ID NO: 24555 - RNA, 22 nt, Human
cccagaaggcuaagcguggauu

SEQ ID NO: 24556 - RNA, 22 nt, Human
cccagaaggucgaggcugcagu

SEQ ID NO: 24557 - RNA, 22 nt, Human
cccagaaugauucagcgacagu

SEQ ID NO: 24558 - RNA, 22 nt, Human
cccagacagugauuuacuuaau

SEQ ID NO: 24559 - RNA, 22 nt, Human
gaaaggaacuugugagugggag

SEQ ID NO: 24560 - RNA, 22 nt, Human
gaaaggaagaaaggucauuuua

SEQ ID NO: 24561 - RNA, 22 nt, Human
gaaaggagugcuuuccaggucu

SEQ ID NO: 24562 - RNA, 20 nt, Human
gaaaggagugucccugugag

SEQ ID NO: 24563 - RNA, 22 nt, Human
gaaaggcaggcaggguguccau

SEQ ID NO: 24564 - RNA, 22 nt, Human
gaaaggccacgugccaagauua

SEQ ID NO: 24565 - RNA, 22 nt, Human
gaaaggcuacugucaucaauua

SEQ ID NO: 24566 - RNA, 22 nt, Human
gaaaggcuuaaauuguaagggc

SEQ ID NO: 24567 - RNA, 22 nt, Human
gaaaggcuucuuaagcuucacu

SEQ ID NO: 24568 - RNA, 22 nt, Human
gaaaggcuugagacauugauga

SEQ ID NO: 24569 - RNA, 22 nt, Human
gaaagggaguggacaacaggca

SEQ ID NO: 24570 - RNA, 22 nt, Human
gaaaggucaguuccacuuccau

SEQ ID NO: 24571 - RNA, 22 nt, Human
gaaaggucuuccggucuuccag

SEQ ID NO: 24572 - RNA, 22 nt, Human
gaaagguucuugggaguucaca

SEQ ID NO: 24573 - RNA, 22 nt, Human
gaaagguuguaacaagacucuu

SEQ ID NO: 24574 - RNA, 23 nt, Human
gaaagucaauaugguagcuuuga

SEQ ID NO: 24575 - RNA, 22 nt, Human
gaaagucauggaugaacacuac

SEQ ID NO: 24576 - RNA, 22 nt, Human
gaaagugccucaguccucuuau

SEQ ID NO: 24577 - RNA, 22 nt, Human
gaaagugcuaggaaguguuaga

SEQ ID NO: 24578 - RNA, 22 nt, Human
gaaagugcucucucuauacaca

SEQ ID NO: 24579 - RNA, 22 nt, Human
gaaagugcuuuugagugugugc

SEQ ID NO: 24580 - RNA, 22 nt, Human
gaaaguucaaauuauagaaggu

SEQ ID NO: 24581 - RNA, 22 nt, Human
gaaaguuuauagguuauauaau

SEQ ID NO: 24582 - RNA, 22 nt, Human
gaaaguuucucacacaugcaga

SEQ ID NO: 24583 - RNA, 17 nt, Human
gaaaguuucucucucuu

SEQ ID NO: 24584 - RNA, 22 nt, Human
gaaauaagaguccaugccaggu

SEQ ID NO: 24585 - RNA, 22 nt, Human
gaaauaauuuagaagguauucc

SEQ ID NO: 24586 - RNA, 22 nt, Human
gaaauacagaaagggcugaaug

SEQ ID NO: 24587 - RNA, 22 nt, Human
gaaauacaggaaugccacacag

SEQ ID NO: 24588 - RNA, 21 nt, Human
gaaauacugccuuaggagcug

SEQ ID NO: 24589 - RNA, 22 nt, Human
gaaauacuguaaaguuauuauu

SEQ ID NO: 24590 - RNA, 22 nt, Human
gaaauagacacuuucuaugaau

SEQ ID NO: 24591 - RNA, 22 nt, Human
gaaauauacauugcaggaagag

SEQ ID NO: 24592 - RNA, 22 nt, Human
gaaauauucuugucuuguuuuc

SEQ ID NO: 24593 - RNA, 22 nt, Human
gaaaucaaacccuuuucugaua

SEQ ID NO: 24594 - RNA, 22 nt, Human
gaaaucaaggcuacauucaggu

SEQ ID NO: 24595 - RNA, 22 nt, Human
gaaaucaucugaguaauaaucu

SEQ ID NO: 24596 - RNA, 22 nt, Human
gaaaucauuagcaaagauaugu

SEQ ID NO: 24597 - RNA, 22 nt, Human
gaaaucugcuucuugcauagua

SEQ ID NO: 24598 - RNA, 22 nt, Human
gaaaugacaaggacauuccugu

SEQ ID NO: 24599 - RNA, 22 nt, Human
gaaaugcagaaccugagaccau

SEQ ID NO: 24600 - RNA, 22 nt, Human
gaaauguagaguaucugaggau

SEQ ID NO: 24601 - RNA, 22 nt, Human
gaaauguaggcauaauuauuuu

SEQ ID NO: 24602 - RNA, 20 nt, Human
gaaauguaucucuugauucu

SEQ ID NO: 24603 - RNA, 22 nt, Human
gaaaugucucuugauuuuugga

SEQ ID NO: 24604 - RNA, 22 nt, Human
gaaaugugaccuacuuccuugu

SEQ ID NO: 24605 - RNA, 20 nt, Human
gaaaugugaccucuucugug

SEQ ID NO: 24606 - RNA, 22 nt, Human
gaaaugugggucaugacccauu

SEQ ID NO: 24607 - RNA, 22 nt, Human
gaaauucaaauaagauauguag

SEQ ID NO: 24608 - RNA, 22 nt, Human
gaaauuguaaaggauugcgcca

SEQ ID NO: 24609 - RNA, 22 nt, Human
gaaauugucugugcccaagucu

SEQ ID NO: 24610 - RNA, 22 nt, Human
gaacaaacauuuuuggcaguau

SEQ ID NO: 24611 - RNA, 22 nt, Human
gaacaaacugggucccaaugau

SEQ ID NO: 24612 - RNA, 19 nt, Human
gaacaaacuuaaacuuuuc

SEQ ID NO: 24613 - RNA, 22 nt, Human
gaacaacuuugaaacaugaaga

SEQ ID NO: 24614 - RNA, 22 nt, Human
gaacaaugaaagacauaaacuc

SEQ ID NO: 24615 - RNA, 22 nt, Human
gaacaaugagucauucagguga

SEQ ID NO: 24616 - RNA, 22 nt, Human
gaacacagguggcccggcaggg

SEQ ID NO: 24617 - RNA, 22 nt, Human
gaacacaguuuagaaaaugcug

SEQ ID NO: 24618 - RNA, 22 nt, Human
gaacacauuagucugaguuggc

SEQ ID NO: 24619 - RNA, 22 nt, Human
gaacacugacauuuuccugacu

SEQ ID NO: 24620 - RNA, 22 nt, Human
gaacacugagagagaugggcag

SEQ ID NO: 24621 - RNA, 22 nt, Human
gaacacugaggacacugagaau

SEQ ID NO: 24622 - RNA, 22 nt, Human
gaacacugcuguuggguucuga

SEQ ID NO: 24623 - RNA, 22 nt, Human
gaacagacagaagcuuaucucc

SEQ ID NO: 24624 - RNA, 22 nt, Human
gaacagaugggcucagauccug

SEQ ID NO: 24625 - RNA, 22 nt, Human
gaacagcagcucguucucgaug

SEQ ID NO: 24626 - RNA, 22 nt, Human
gaacagcagcuuccugggaauu

SEQ ID NO: 24627 - RNA, 22 nt, Human
gaacagcagucacucauguuau

SEQ ID NO: 24628 - RNA, 22 nt, Human
gaacagcccuguuaagucuguu

SEQ ID NO: 24629 - RNA, 22 nt, Human
gaacaguaaauuuaugcagcac

SEQ ID NO: 24630 - RNA, 22 nt, Human
gaacaguacaguugaguaguug

SEQ ID NO: 24631 - RNA, 22 nt, Human
gaacaguaucaguagugccagu

SEQ ID NO: 24632 - RNA, 20 nt, Human
gaacagucuucugagccaca

SEQ ID NO: 24633 - RNA, 22 nt, Human
gaacauaacuauugugaauagu

SEQ ID NO: 24634 - RNA, 22 nt, Human
gaacauaauuaaauguccuggg

SEQ ID NO: 24635 - RNA, 22 nt, Human
gaacauaugcauguuuguuuug

SEQ ID NO: 24636 - RNA, 22 nt, Human
gaacaucagucauaauuuaacg

SEQ ID NO: 24637 - RNA, 22 nt, Human
gaacaucuuauccauuuccucu

SEQ ID NO: 24638 - RNA, 22 nt, Human
gaacaugaaaagucuuacacgc

SEQ ID NO: 24639 - RNA, 22 nt, Human
gaacauuacugcuugggagagg

SEQ ID NO: 24640 - RNA, 22 nt, Human
gaacauuccuggaagagugcuu

SEQ ID NO: 24641 - RNA, 22 nt, Human
ugugguuuugguucagaaacaa

SEQ ID NO: 24642 - RNA, 21 nt, Human
uguguaaaguugaaauccugu

SEQ ID NO: 24643 - RNA, 21 nt, Human
uguguaauauguauaagaaua

SEQ ID NO: 24644 - RNA, 22 nt, Human
uguguacaaauuuagccagcag

SEQ ID NO: 24645 - RNA, 22 nt, Human
uguguacaagaguguuuacugu

SEQ ID NO: 24646 - RNA, 22 nt, Human
uguguacacaaguauauauaca

SEQ ID NO: 24647 - RNA, 22 nt, Human
uguguacacacagauauauaca

SEQ ID NO: 24648 - RNA, 22 nt, Human
uguguacagcaggauuucucaa

SEQ ID NO: 24649 - RNA, 22 nt, Human
uguguacagcaugguccagcag

SEQ ID NO: 24650 - RNA, 22 nt, Human
uguguacaggccuugcuagacu

SEQ ID NO: 24651 - RNA, 22 nt, Human
uguguacauauacacaaauaca

SEQ ID NO: 24652 - RNA, 22 nt, Human
uguguacauaucuauccuagau

SEQ ID NO: 24653 - RNA, 22 nt, Human
uguguacaucucuucucacauu

SEQ ID NO: 24654 - RNA, 22 nt, Human
uguguacauguaucaacuaucg

SEQ ID NO: 24655 - RNA, 22 nt, Human
uguguacuaaacuuccauauau

SEQ ID NO: 24656 - RNA, 22 nt, Human
uguguacuuuuguuucuaagcc

SEQ ID NO: 24657 - RNA, 22 nt, Human
uguguauagcaguuuccagucu

SEQ ID NO: 24658 - RNA, 22 nt, Human
uguguauagguugugcuaauag

SEQ ID NO: 24659 - RNA, 22 nt, Human
uguguauauaugugcacaugua

SEQ ID NO: 24660 - RNA, 22 nt, Human
uguguauauguaaauauaguug

SEQ ID NO: 24661 - RNA, 22 nt, Human
uguguauauuaggacacauucu

SEQ ID NO: 24662 - RNA, 18 nt, Human
uguguaugucucagggaa

SEQ ID NO: 24663 - RNA, 22 nt, Human
uguguauguguauacacuauau

SEQ ID NO: 24664 - RNA, 22 nt, Human
uguguauuaauguuuguauaug

SEQ ID NO: 24665 - RNA, 22 nt, Human
ugugucaagacauuuagucauu

SEQ ID NO: 24666 - RNA, 22 nt, Human
ugugucaaggcaucagcccagc

SEQ ID NO: 24667 - RNA, 22 nt, Human
ugugucaauuuaugucauucau

SEQ ID NO: 24668 - RNA, 22 nt, Human
ugugucacuguuccuccagcua

SEQ ID NO: 24669 - RNA, 22 nt, Human
ugugucagaauuuuuguggcaa

SEQ ID NO: 24670 - RNA, 19 nt, Human
ugugucagauuugcuccuu

SEQ ID NO: 24671 - RNA, 22 nt, Human
ugugucagcacaguaucaauua

SEQ ID NO: 24672 - RNA, 22 nt, Human
ugugucaucuguguuacauaau

SEQ ID NO: 24673 - RNA, 22 nt, Human
uguguccuaugaaagaggguua

SEQ ID NO: 24674 - RNA, 22 nt, Human
uguguccucacuguaugcaagg

SEQ ID NO: 24675 - RNA, 22 nt, Human
uguguccugcagacagacucag

SEQ ID NO: 24676 - RNA, 22 nt, Human
uguguccugcaggugcugccug

SEQ ID NO: 24677 - RNA, 22 nt, Human
uguguccuuaugaaaauacugu

SEQ ID NO: 24678 - RNA, 22 nt, Human
uguguccuucugggagucccag

SEQ ID NO: 24679 - RNA, 22 nt, Human
ugugucuaaugacuauuucuuc

SEQ ID NO: 24680 - RNA, 19 nt, Human
ugugucucuguguagccug

SEQ ID NO: 24681 - RNA, 22 nt, Human
ugugucuggaccggggaggagc

SEQ ID NO: 24682 - RNA, 22 nt, Human
ugugucuguccucgguugaugc

SEQ ID NO: 24683 - RNA, 22 nt, Human
ugugucuguguauacacggcau

SEQ ID NO: 24684 - RNA, 22 nt, Human
ugugugaagcacauguucaagg

SEQ ID NO: 24685 - RNA, 22 nt, Human
ugugugaaggaauauauacuca

SEQ ID NO: 24686 - RNA, 22 nt, Human
ugugugagacaauuggcugugg

SEQ ID NO: 24687 - RNA, 22 nt, Human
ugugugaggugguucugagaag

SEQ ID NO: 24688 - RNA, 22 nt, Human
ugugugcaauucuuaacauaca

SEQ ID NO: 24689 - RNA, 20 nt, Human
ugugugcacacaugacauuc

SEQ ID NO: 24690 - RNA, 22 nt, Human
ugugugcacaugauuugaaaug

SEQ ID NO: 24691 - RNA, 18 nt, Human
ugugugcaccugccuuga

SEQ ID NO: 24692 - RNA, 22 nt, Human
ugugugcagcggcaggugaagu

SEQ ID NO: 24693 - RNA, 22 nt, Human
ugugugcaggcacugugccaga

SEQ ID NO: 24694 - RNA, 22 nt, Human
ugugugcauacacacgguaaca

SEQ ID NO: 24695 - RNA, 19 nt, Human
ugugugcaugcgcacgugu

SEQ ID NO: 24696 - RNA, 22 nt, Human
ugugugcauguuaaugagaaaa

SEQ ID NO: 24697 - RNA, 22 nt, Human
uguguggaugcagcgugggucu

SEQ ID NO: 24698 - RNA, 22 nt, Human
uguguggcaagcuguaugcuag

SEQ ID NO: 24699 - RNA, 21 nt, Human
ugugugggcauaucugcugca

SEQ ID NO: 24700 - RNA, 22 nt, Human
ugugugggcaugcuuuuaauuu

SEQ ID NO: 24701 - RNA, 22 nt, Human
ugugugggcgaagacagccuuu

SEQ ID NO: 24702 - RNA, 22 nt, Human
uguguguauaugcauuuaucua

SEQ ID NO: 24703 - RNA, 22 nt, Human
uguguguauccauuagaggcca

SEQ ID NO: 24704 - RNA, 22 nt, Human
ugugugucagagucuccauggu

SEQ ID NO: 24705 - RNA, 22 nt, Human
guccugagaauacuaggcacaa

SEQ ID NO: 24706 - RNA, 22 nt, Human
guccugagaugucacaagguuu

SEQ ID NO: 24707 - RNA, 22 nt, Human
guccugagcauuaagcaauugu

SEQ ID NO: 24708 - RNA, 22 nt, Human
guccugaggaugcagagauaaa

SEQ ID NO: 24709 - RNA, 22 nt, Human
guccugaggcaggauggguuuc

SEQ ID NO: 24710 - RNA, 22 nt, Human
guccugcggccucaguggugag

SEQ ID NO: 24711 - RNA, 22 nt, Human
guccuggaguggcauggcaugg

SEQ ID NO: 24712 - RNA, 22 nt, Human
guccuggcaccucacuggcuac

SEQ ID NO: 24713 - RNA, 22 nt, Human
guccuggccucuggggguaugg

SEQ ID NO: 24714 - RNA, 22 nt, Human
guccuggcugguucuguggggc

SEQ ID NO: 24715 - RNA, 22 nt, Human
guccugggaaggaagccaggga

SEQ ID NO: 24716 - RNA, 17 nt, Human
guccugggaggagagag

SEQ ID NO: 24717 - RNA, 22 nt, Human
guccugggcaugcagggcuuuc

SEQ ID NO: 24718 - RNA, 22 nt, Human
guccugggcccaggggcugccu

SEQ ID NO: 24719 - RNA, 22 nt, Human
guccugggcggagggcugcugu

SEQ ID NO: 24720 - RNA, 22 nt, Human
guccugguagcuggcuugguca

SEQ ID NO: 24721 - RNA, 22 nt, Human
guccugguauaauuguuuaaaa

SEQ ID NO: 24722 - RNA, 22 nt, Human
guccugugaccugcauccugag

SEQ ID NO: 24723 - RNA, 22 nt, Human
guccugugcccagacccucugu

SEQ ID NO: 24724 - RNA, 22 nt, Human
guccugugcccuggguggcgcu

SEQ ID NO: 24725 - RNA, 22 nt, Human
guccugugcucagacauggggg

SEQ ID NO: 24726 - RNA, 22 nt, Human
guccugugggcccaccaugagc

SEQ ID NO: 24727 - RNA, 22 nt, Human
guccuguguaagccaggacaau

SEQ ID NO: 24728 - RNA, 21 nt, Human
guccuguuccugaaccuuccc

SEQ ID NO: 24729 - RNA, 22 nt, Human
guccuguuuguauuugcuggaa

SEQ ID NO: 24730 - RNA, 22 nt, Human
guccuuaaagagagcaucauuc

SEQ ID NO: 24731 - RNA, 22 nt, Human
guccuuaacaaacggggaaaag

SEQ ID NO: 24732 - RNA, 22 nt, Human
guccuuaguuacuuuucauguc

SEQ ID NO: 24733 - RNA, 22 nt, Human
guccuuauuucacuuaaacgua

SEQ ID NO: 24734 - RNA, 21 nt, Human
guccuucagcaaguuaguggc

SEQ ID NO: 24735 - RNA, 22 nt, Human
guccuucagcuuuaucugaaca

SEQ ID NO: 24736 - RNA, 22 nt, Human
guccuucagggagucaaacacu

SEQ ID NO: 24737 - RNA, 22 nt, Human
guccuuccccagccagcucugg

SEQ ID NO: 24738 - RNA, 22 nt, Human
guccuucucaaauccuguguuu

SEQ ID NO: 24739 - RNA, 22 nt, Human
guccuugaggaaacagauguga

SEQ ID NO: 24740 - RNA, 22 nt, Human
guccuuggcuguggcuguaaug

SEQ ID NO: 24741 - RNA, 22 nt, Human
guccuuucgagggugagugaaa

SEQ ID NO: 24742 - RNA, 22 nt, Human
gucuaaacaaaaaugcaccuuu

SEQ ID NO: 24743 - RNA, 22 nt, Human
gucuaaacuuuggcccagauuu

SEQ ID NO: 24744 - RNA, 22 nt, Human
gucuaaggaucuguuagcuuuu

SEQ ID NO: 24745 - RNA, 22 nt, Human
gucuacaaagcuucaagucucu

SEQ ID NO: 24746 - RNA, 22 nt, Human
gucuacacugaauuuccacaga

SEQ ID NO: 24747 - RNA, 22 nt, Human
gucuagaaaucauguacuguga

SEQ ID NO: 24748 - RNA, 22 nt, Human
gucuagaaaugccauacgugcc

SEQ ID NO: 24749 - RNA, 22 nt, Human
gucuagaaauguucucaggggu

SEQ ID NO: 24750 - RNA, 22 nt, Human
gucuagaauggaugagcauuuu

SEQ ID NO: 24751 - RNA, 19 nt, Human
gucuagaccaggcuccuua

SEQ ID NO: 24752 - RNA, 22 nt, Human
gucuagagugcuuccuagucau

SEQ ID NO: 24753 - RNA, 22 nt, Human
gucuagggcuccucagugacaa

SEQ ID NO: 24754 - RNA, 22 nt, Human
gucuauguaaacgucuacauua

SEQ ID NO: 24755 - RNA, 22 nt, Human
gucuauguguaauagcaugugu

SEQ ID NO: 24756 - RNA, 22 nt, Human
gucuauuugggaucaugauaug

SEQ ID NO: 24757 - RNA, 20 nt, Human
gucucaaguaucucacaguc

SEQ ID NO: 24758 - RNA, 22 nt, Human
gucucacacagaguagauuuug

SEQ ID NO: 24759 - RNA, 22 nt, Human
gucucagagagcuacucucuua

SEQ ID NO: 24760 - RNA, 22 nt, Human
gucucagaguccuacuuauucc

SEQ ID NO: 24761 - RNA, 22 nt, Human
gucucagauaacauguauucua

SEQ ID NO: 24762 - RNA, 22 nt, Human
gucucagauucagacaucuaca

SEQ ID NO: 24763 - RNA, 22 nt, Human
gucucagggacugcuucugggg

SEQ ID NO: 24764 - RNA, 22 nt, Human
gucucagugcccaaugccauaa

SEQ ID NO: 24765 - RNA, 22 nt, Human
gucucagugucaccuccagcug

SEQ ID NO: 24766 - RNA, 22 nt, Human
gucuccagcccacucuagauau

SEQ ID NO: 24767 - RNA, 22 nt, Human
gucucccaauccgggacagccu

SEQ ID NO: 24768 - RNA, 22 nt, Human
gucucccacuuucuggccucuu

SEQ ID NO: 24769 - RNA, 23 nt, Human
gucucccauagcgcucccaggcu

SEQ ID NO: 24770 - RNA, 22 nt, Human
gucucccaugucccuguccagu

SEQ ID NO: 24771 - RNA, 22 nt, Human
gucuccucuucauauaccuguu

SEQ ID NO: 24772 - RNA, 22 nt, Human
gucuccugagacugcagucacc

SEQ ID NO: 24773 - RNA, 22 nt, Human
gucuccugagccuugacugcaa

SEQ ID NO: 24774 - RNA, 22 nt, Human
gucuccugaggcauccauugaa

SEQ ID NO: 24775 - RNA, 22 nt, Human
gucuccugcuagcaagcaccac

SEQ ID NO: 24776 - RNA, 22 nt, Human
gucuccuggcuuuugucccagu

SEQ ID NO: 24777 - RNA, 23 nt, Human
gucucuagaguguggagcaaaga

SEQ ID NO: 24778 - RNA, 22 nt, Human
gucucucucccaagauuggcua

SEQ ID NO: 24779 - RNA, 22 nt, Human
gucucucugacugguccacacc

SEQ ID NO: 24780 - RNA, 22 nt, Human
gucucugagcucugagcuggcu

SEQ ID NO: 24781 - RNA, 22 nt, Human
gucucugccuggggggaucaga

SEQ ID NO: 24782 - RNA, 22 nt, Human
gucucugcucuagagucuguga

SEQ ID NO: 24783 - RNA, 19 nt, Human
gucucuggauuucaggucc

SEQ ID NO: 24784 - RNA, 22 nt, Human
gucucugggugugugaugccaa

SEQ ID NO: 24785 - RNA, 22 nt, Human
gucucuggguuaagcagugcau

SEQ ID NO: 24786 - RNA, 22 nt, Human
gucucugucacaacuacucauc

SEQ ID NO: 24787 - RNA, 22 nt, Human
gucucugucuuaggccaggccu

SEQ ID NO: 24788 - RNA, 22 nt, Human
gucucugugccuucuccccacc

SEQ ID NO: 24789 - RNA, 22 nt, Human
gucucuuagucaauauuuucug

SEQ ID NO: 24790 - RNA, 22 nt, Human
gucugaaaguagggcugaucua

SEQ ID NO: 24791 - RNA, 22 nt, Human
gucugaaauggaggugggaacu

SEQ ID NO: 24792 - RNA, 22 nt, Human
gucugaauucuguguaacucua

SEQ ID NO: 24793 - RNA, 22 nt, Human
gucugagaacuacugaggauaa

SEQ ID NO: 24794 - RNA, 22 nt, Human
gucugagacugggcacauaccu

SEQ ID NO: 24795 - RNA, 22 nt, Human
gucugagauuagggaagauuuu

SEQ ID NO: 24796 - RNA, 22 nt, Human
gucugagcuacuuaggauauaa

SEQ ID NO: 24797 - RNA, 22 nt, Human
gucugaggccugaggcccuggg

SEQ ID NO: 24798 - RNA, 22 nt, Human
gucugagggacagaguccuggc

SEQ ID NO: 24799 - RNA, 21 nt, Human
gucugaugcuugaugcaguug

SEQ ID NO: 24800 - RNA, 21 nt, Human
gucugcagaccccuucauugc

SEQ ID NO: 24801 - RNA, 22 nt, Human
gucugcccagaagacauccccu

SEQ ID NO: 24802 - RNA, 19 nt, Human
ucuauguggcagugauggc

SEQ ID NO: 24803 - RNA, 22 nt, Human
ucuauguuagagauacauccua

SEQ ID NO: 24804 - RNA, 22 nt, Human
ucuauuacuacaucagccaggu

SEQ ID NO: 24805 - RNA, 22 nt, Human
ucuauuaugguacuuaucauga

SEQ ID NO: 24806 - RNA, 22 nt, Human
ucuauucaggcagagugcagca

SEQ ID NO: 24807 - RNA, 22 nt, Human
ucuauugauuggcuuccuggau

SEQ ID NO: 24808 - RNA, 22 nt, Human
ucuauuucgcauauaaguuuug

SEQ ID NO: 24809 - RNA, 20 nt, Human
ucuauuuguaaagggcugug

SEQ ID NO: 24810 - RNA, 18 nt, Human
ucucaaaaauaauggcuu

SEQ ID NO: 24811 - RNA, 22 nt, Human
ucucaaacuaacaaugauuaua

SEQ ID NO: 24812 - RNA, 22 nt, Human
ucucaaacuacaguauggcugu

SEQ ID NO: 24813 - RNA, 22 nt, Human
ucucaaaguagcucccacagau

SEQ ID NO: 24814 - RNA, 22 nt, Human
gugugcccgggggaagcaggug

SEQ ID NO: 24815 - RNA, 22 nt, Human
gugugcccuuguucagcagagu

SEQ ID NO: 24816 - RNA, 22 nt, Human
gugugccuuaagcucuauagac

SEQ ID NO: 24817 - RNA, 23 nt, Human
gugugccuuuaucuucuguacuc

SEQ ID NO: 24818 - RNA, 22 nt, Human
gugugccuuucacacacuggga

SEQ ID NO: 24819 - RNA, 22 nt, Human
gugugcucagcucauuuggaua

SEQ ID NO: 24820 - RNA, 23 nt, Human
guguggcagcgcugugguuagcu

SEQ ID NO: 24821 - RNA, 22 nt, Human
guguggcagggcguuugcagac

SEQ ID NO: 24822 - RNA, 22 nt, Human
guguggccguguauccauggcu

SEQ ID NO: 24823 - RNA, 22 nt, Human
guguggccuugggagaggucug

SEQ ID NO: 24824 - RNA, 18 nt, Human
guguggcugagaugaggc

SEQ ID NO: 24825 - RNA, 22 nt, Human
guguggcugccagccaagaggc

SEQ ID NO: 24826 - RNA, 22 nt, Human
guguggcuguuuagugacuuuc

SEQ ID NO: 24827 - RNA, 22 nt, Human
gugugggaauggcggucgugca

SEQ ID NO: 24828 - RNA, 22 nt, Human
gugugggaggaaggugaacaga

SEQ ID NO: 24829 - RNA, 22 nt, Human
guguggggaggagagagcccuu

SEQ ID NO: 24830 - RNA, 22 nt, Human
guguguagaugugagaggacug

SEQ ID NO: 24831 - RNA, 22 nt, Human
gugugucagguacugugcuagg

SEQ ID NO: 24832 - RNA, 22 nt, Human
guguguccaaggccacaauagc

SEQ ID NO: 24833 - RNA, 22 nt, Human
guguguccacacauacauacau

SEQ ID NO: 24834 - RNA, 22 nt, Human
guguguccucauaagauggagg

SEQ ID NO: 24835 - RNA, 22 nt, Human
guguguccuugggccucugcag

SEQ ID NO: 24836 - RNA, 22 nt, Human
gugugucuuuauaagaagaggg

SEQ ID NO: 24837 - RNA, 22 nt, Human
gugugugccaacuuuaugugca

SEQ ID NO: 24838 - RNA, 22 nt, Human
gugugugcuccccaggagagcu

SEQ ID NO: 24839 - RNA, 22 nt, Human
guguguguacucuguauauaaa

SEQ ID NO: 24840 - RNA, 22 nt, Human
guguguuuagcauuagcagggg

SEQ ID NO: 24841 - RNA, 22 nt, Human
guguguuucagaagccaggugu

SEQ ID NO: 24842 - RNA, 22 nt, Human
guguuaaauuucuaauuuguga

SEQ ID NO: 24843 - RNA, 22 nt, Human
guguuaaugguagaaucugagu

SEQ ID NO: 24844 - RNA, 22 nt, Human
guguuacaaaucaccugugcug

SEQ ID NO: 24845 - RNA, 18 nt, Human
guguuacaggagugcagc

SEQ ID NO: 24846 - RNA, 22 nt, Human
guguuacugggaggacggaggu

SEQ ID NO: 24847 - RNA, 22 nt, Human
guguuauuugagugggagcgug

SEQ ID NO: 24848 - RNA, 22 nt, Human
guguucaaaauguagguagauu

SEQ ID NO: 24849 - RNA, 17 nt, Human
guguucacaaugacugu

SEQ ID NO: 24850 - RNA, 22 nt, Human
guguucaugccccagugcagga

SEQ ID NO: 24851 - RNA, 22 nt, Human
guguucuaauggcugagggaug

SEQ ID NO: 24852 - RNA, 22 nt, Human
guguugacucuuggacuucaag

SEQ ID NO: 24853 - RNA, 22 nt, Human
guguuguggagcuugucagggg

SEQ ID NO: 24854 - RNA, 20 nt, Human
guguuucaugugauacaaug

SEQ ID NO: 24855 - RNA, 22 nt, Human
guguuucccuggcacaagaacc

SEQ ID NO: 24856 - RNA, 22 nt, Human
guguuucuggggcauucauagu

SEQ ID NO: 24857 - RNA, 22 nt, Human
guguuugucucuuggccuaccu

SEQ ID NO: 24858 - RNA, 22 nt, Human
guguuuguuuggguagcuagac

SEQ ID NO: 24859 - RNA, 22 nt, Human
guguuuuauuggugcagucaga

SEQ ID NO: 24860 - RNA, 20 nt, Human
guuaaaagaguaauuugagg

SEQ ID NO: 24861 - RNA, 22 nt, Human
guuaaacaguuacaugugcugg

SEQ ID NO: 24862 - RNA, 22 nt, Human
guuaaagaguuuggcuuucuuc

SEQ ID NO: 24863 - RNA, 22 nt, Human
guuaaagugagcuacuuuaggu

SEQ ID NO: 24864 - RNA, 22 nt, Human
guuaaagugaucuugucagguu

SEQ ID NO: 24865 - RNA, 22 nt, Human
guuaaauaaccucauguccguu

SEQ ID NO: 24866 - RNA, 22 nt, Human
guuaaaugcacuauugaaagcu

SEQ ID NO: 24867 - RNA, 22 nt, Human
guuaaaugcagauucugacuca

SEQ ID NO: 24868 - RNA, 22 nt, Human
guuaacaaccaaacagaaguuc

SEQ ID NO: 24869 - RNA, 22 nt, Human
guuaacaagaauuacucuggaa

SEQ ID NO: 24870 - RNA, 22 nt, Human
guuaacacaugcaauugcacuu

SEQ ID NO: 24871 - RNA, 22 nt, Human
guuaacauuucuaggugcaggg

SEQ ID NO: 24872 - RNA, 22 nt, Human
guuaagaagcuagagaugaaca

SEQ ID NO: 24873 - RNA, 22 nt, Human
guuaagccugaaucacauuaau

SEQ ID NO: 24874 - RNA, 22 nt, Human
guuaaugcaaagcagagggcaa

SEQ ID NO: 24875 - RNA, 22 nt, Human
guuaaugucacuuuauguggcu

SEQ ID NO: 24876 - RNA, 22 nt, Human
guuaaugucuuccuauucuaca

SEQ ID NO: 24877 - RNA, 22 nt, Human
guuaauuuaguagaguccagau

SEQ ID NO: 24878 - RNA, 22 nt, Human
guuaauuugcagcuuucgagcu

SEQ ID NO: 24879 - RNA, 22 nt, Human
guuacaacucccugaaccucgg

SEQ ID NO: 24880 - RNA, 22 nt, Human
guuacacucuccaggcacuugg

SEQ ID NO: 24881 - RNA, 22 nt, Human
guuacagucaggagauauuuug

SEQ ID NO: 24882 - RNA, 22 nt, Human
guuacauuaaaaacauucacug

SEQ ID NO: 24883 - RNA, 23 nt, Human
guuaccuuacuucugugaucuuc

SEQ ID NO: 24884 - RNA, 22 nt, Human
guuacucuugagaggcugaggu

SEQ ID NO: 24885 - RNA, 22 nt, Human
guuagaaacacauucuuauuga

SEQ ID NO: 24886 - RNA, 22 nt, Human
guuagagcacauacuuugcaug

SEQ ID NO: 24887 - RNA, 22 nt, Human
guuagagguucagucgcuauaa

SEQ ID NO: 24888 - RNA, 22 nt, Human
guuagcaaugcccaggaaugca

SEQ ID NO: 24889 - RNA, 22 nt, Human
guuagcaccagugcucauaaca

SEQ ID NO: 24890 - RNA, 22 nt, Human
guuagcaugacuuagaaucagg

SEQ ID NO: 24891 - RNA, 22 nt, Human
guuagcauuuguuuaauaucag

SEQ ID NO: 24892 - RNA, 18 nt, Human
guuagcuuccuguugccc

SEQ ID NO: 24893 - RNA, 22 nt, Human
guuaggcaaauaacuguggagc

SEQ ID NO: 24894 - RNA, 22 nt, Human
guuaggcaauaccucuuacacc

SEQ ID NO: 24895 - RNA, 22 nt, Human
guuaggcauuugccuuaauuuu

SEQ ID NO: 24896 - RNA, 22 nt, Human
guuagggagucagguggcucuu

SEQ ID NO: 24897 - RNA, 22 nt, Human
guuaguggguuacucucagccc

SEQ ID NO: 24898 - RNA, 22 nt, Human
guuaguguauauugccuucaaa

SEQ ID NO: 24899 - RNA, 22 nt, Human
guuauacacauuccuggugagg

SEQ ID NO: 24900 - RNA, 22 nt, Human
guuauaggucaugcuaugucaa

SEQ ID NO: 24901 - RNA, 22 nt, Human
guuauauaagacaaaucagagu

SEQ ID NO: 24902 - RNA, 19 nt, Human
guuaucaaggggcuacuuu

SEQ ID NO: 24903 - RNA, 22 nt, Human
guuauccauagaauaagucauc

SEQ ID NO: 24904 - RNA, 22 nt, Human
guuaucuagaccaaaagccuaa

SEQ ID NO: 24905 - RNA, 22 nt, Human
guuaucuuaggguacaaaggac

SEQ ID NO: 24906 - RNA, 22 nt, Human
guuaucuucccuuugaugauuu

SEQ ID NO: 24907 - RNA, 22 nt, Human
guuaucuucuauuucucauacu

SEQ ID NO: 24908 - RNA, 22 nt, Human
guuauguaucuugauugggugg

SEQ ID NO: 24909 - RNA, 22 nt, Human
guuauuaaaguauuugauguua

SEQ ID NO: 24910 - RNA, 22 nt, Human
guuauucuuuguaugguacauc

SEQ ID NO: 24911 - RNA, 22 nt, Human
guuauucuuuuauagcaauaca

SEQ ID NO: 24912 - RNA, 22 nt, Human
guuauugacauguauuaagcac

SEQ ID NO: 24913 - RNA, 22 nt, Human
guuauugagacauagaguuaug

SEQ ID NO: 24914 - RNA, 22 nt, Human
guuauugcuggauagauacauc

SEQ ID NO: 24915 - RNA, 22 nt, Human
gucuagagaggaaggaagugug

SEQ ID NO: 24916 - RNA, 22 nt, Human
gucuauauauugcuugaauaau

SEQ ID NO: 24917 - RNA, 22 nt, Human
gucucaaacuccuaggcuaaag

SEQ ID NO: 24918 - RNA, 22 nt, Human
gucucagggcugagggcagugg

SEQ ID NO: 24919 - RNA, 22 nt, Human
gucucaguccgugcuguucagg

SEQ ID NO: 24920 - RNA, 22 nt, Human
gucucaguuacucucccuggua

SEQ ID NO: 24921 - RNA, 22 nt, Human
gucucaguuguaucaccugguu

SEQ ID NO: 24922 - RNA, 22 nt, Human
gucucaguuuuccaaacuguca

SEQ ID NO: 24923 - RNA, 22 nt, Human
guucaagucuggggcugccagu

SEQ ID NO: 24924 - RNA, 21 nt, Human
guucaagugauccuccugucu

SEQ ID NO: 24925 - RNA, 21 nt, Human
guucaaguuccugcucuguga

SEQ ID NO: 24926 - RNA, 21 nt, Human
guucaauagcucuuugaaugc

SEQ ID NO: 24927 - RNA, 22 nt, Human
guucaauuuagaaagcacaguu

SEQ ID NO: 24928 - RNA, 22 nt, Human
guucacaaaauucuggccagug

SEQ ID NO: 24929 - RNA, 22 nt, Human
guucacaaauaugcacuuacga

SEQ ID NO: 24930 - RNA, 22 nt, Human
guucacaagaguuacagacaga

SEQ ID NO: 24931 - RNA, 22 nt, Human
guucacaagaugugguggggag

SEQ ID NO: 24932 - RNA, 22 nt, Human
guucacaagcugauugucuuuc

SEQ ID NO: 24933 - RNA, 22 nt, Human
guucacaauuuuuacugauugg

SEQ ID NO: 24934 - RNA, 22 nt, Human
guucacagcuuguguuuucucu

SEQ ID NO: 24935 - RNA, 20 nt, Human
guucacaggcuuccuuucag

SEQ ID NO: 24936 - RNA, 22 nt, Human
guucacaguuucuaaucccagc

SEQ ID NO: 24937 - RNA, 22 nt, Human
guucacaugcucucaugcuuuu

SEQ ID NO: 24938 - RNA, 22 nt, Human
guucacauggcauuuucacauc

SEQ ID NO: 24939 - RNA, 22 nt, Human
guucagagacacuuauuggaaa

SEQ ID NO: 24940 - RNA, 22 nt, Human
guucagcccacagagggggccg

SEQ ID NO: 24941 - RNA, 22 nt, Human
guucagugccaguucuaagacu

SEQ ID NO: 24942 - RNA, 22 nt, Human
guucaguuaugugaccucaaaa

SEQ ID NO: 24943 - RNA, 22 nt, Human
guucauauucuaaguaacuggc

SEQ ID NO: 24944 - RNA, 22 nt, Human
guucauccauauuauagcaugu

SEQ ID NO: 24945 - RNA, 22 nt, Human
guucauccugacuuggauuagu

SEQ ID NO: 24946 - RNA, 22 nt, Human
guucaucuuccucccagugccu

SEQ ID NO: 24947 - RNA, 19 nt, Human
guucaugugaggaaggaac

SEQ ID NO: 24948 - RNA, 22 nt, Human
guucauucugaaaagcagcuug

SEQ ID NO: 24949 - RNA, 22 nt, Human
guucauuuuuacuuugaucuac

SEQ ID NO: 24950 - RNA, 22 nt, Human
guucauuuuuagaaugcuagua

SEQ ID NO: 24951 - RNA, 22 nt, Human
guuccaauuccaaauuccaagg

SEQ ID NO: 24952 - RNA, 22 nt, Human
guuccacagagucucacuauga

SEQ ID NO: 24953 - RNA, 22 nt, Human
guuccagguggucacagagcuc

SEQ ID NO: 24954 - RNA, 22 nt, Human
guuccaguaugauuccacccau

SEQ ID NO: 24955 - RNA, 22 nt, Human
guucccacuagacugcuacuua

SEQ ID NO: 24956 - RNA, 22 nt, Human
guucccauacaguaucagugcu

SEQ ID NO: 24957 - RNA, 22 nt, Human
guucccaucagggaugagggug

SEQ ID NO: 24958 - RNA, 19 nt, Human
guucccauugcaguugugg

SEQ ID NO: 24959 - RNA, 22 nt, Human
guucccauugcccuagcuugua

SEQ ID NO: 24960 - RNA, 22 nt, Human
guucccuucucaugggguccag

SEQ ID NO: 24961 - RNA, 22 nt, Human
guuccgcuucauauuuggaguc

SEQ ID NO: 24962 - RNA, 22 nt, Human
guuccguuuauaugcuggauua

SEQ ID NO: 24963 - RNA, 22 nt, Human
guuccuaaaucuggaggaccuc

SEQ ID NO: 24964 - RNA, 22 nt, Human
guuccuaagcacugugcauucu

SEQ ID NO: 24965 - RNA, 22 nt, Human
guuccuauauagccuuaaggau

SEQ ID NO: 24966 - RNA, 22 nt, Human
guuccucaaaaaggagagcccc

SEQ ID NO: 24967 - RNA, 22 nt, Human
guuccugggaggcaugggcugg

SEQ ID NO: 24968 - RNA, 23 nt, Human
guuccuucauguggucauugguu

SEQ ID NO: 24969 - RNA, 22 nt, Human
guuccuuccuaucccgagagcc

SEQ ID NO: 24970 - RNA, 22 nt, Human
guuccuugggaacaacgcugaa

SEQ ID NO: 24971 - RNA, 22 nt, Human
guuccuuguauuucagacauga

SEQ ID NO: 24972 - RNA, 22 nt, Human
guucuaauauuuuaaaagccaa

SEQ ID NO: 24973 - RNA, 22 nt, Human
guucuacaguuccuauuacuua

SEQ ID NO: 24974 - RNA, 22 nt, Human
guucuaggagccaagaauauag

SEQ ID NO: 24975 - RNA, 22 nt, Human
guucuaggcuaggggaguaaga

SEQ ID NO: 24976 - RNA, 22 nt, Human
guucuauuacucccugcuucuu

SEQ ID NO: 24977 - RNA, 16 nt, Human
guucuauuuucguccu

SEQ ID NO: 24978 - RNA, 22 nt, Human
guucucauauggcagagagagu

SEQ ID NO: 24979 - RNA, 22 nt, Human
guucucccuguccccugagcuu

SEQ ID NO: 24980 - RNA, 22 nt, Human
guucuccuuguggcugcagcag

SEQ ID NO: 24981 - RNA, 22 nt, Human
guucucuagggcuguagacugg

SEQ ID NO: 24982 - RNA, 22 nt, Human
guucucucagcgauagugaugg

SEQ ID NO: 24983 - RNA, 22 nt, Human
guucucugccacuuaccagcua

SEQ ID NO: 24984 - RNA, 22 nt, Human
guucucugcgcucccggcccgg

SEQ ID NO: 24985 - RNA, 22 nt, Human
guucucuggagucccugggccc

SEQ ID NO: 24986 - RNA, 22 nt, Human
guucugaggcaaaggcagcagc

SEQ ID NO: 24987 - RNA, 22 nt, Human
guucugggaagguggaccuguu

SEQ ID NO: 24988 - RNA, 22 nt, Human
guucugggucuggacacacaga

SEQ ID NO: 24989 - RNA, 22 nt, Human
guucuggguucaaaccccggcc

SEQ ID NO: 24990 - RNA, 22 nt, Human
guucuguacuccaagcucuucc

SEQ ID NO: 24991 - RNA, 22 nt, Human
guucuucacauuuuggggucac

SEQ ID NO: 24992 - RNA, 22 nt, Human
guucuucaggcugugcucuaga

SEQ ID NO: 24993 - RNA, 22 nt, Human
guucuucaguaaaauuaaaugu

SEQ ID NO: 24994 - RNA, 22 nt, Human
guucuucaguucaggcuguuca

SEQ ID NO: 24995 - RNA, 22 nt, Human
guucuucaucauuaacacucug

SEQ ID NO: 24996 - RNA, 22 nt, Human
guucuucaucauuuuagauagg

SEQ ID NO: 24997 - RNA, 22 nt, Human
guucuucucuuguaauggaauc

SEQ ID NO: 24998 - RNA, 22 nt, Human
guucuuuaaccuagucucauuu

SEQ ID NO: 24999 - RNA, 22 nt, Human
guucuuuaggggcccaauuucc

SEQ ID NO: 25000 - RNA, 19 nt, Human
guucuuuucaccucugugc

SEQ ID NO: 25001 - RNA, 22 nt, Human
guucuuuugguagagugugcau

SEQ ID NO: 25002 - RNA, 22 nt, Human
guugaaaauacagauuccuagg

SEQ ID NO: 25003 - RNA, 22 nt, Human
guugaaagcuuuucauuuaguu

SEQ ID NO: 25004 - RNA, 20 nt, Human
guugaaaguaauaugaugcu

SEQ ID NO: 25005 - RNA, 22 nt, Human
guugaaaguagaugcuauuugg

SEQ ID NO: 25006 - RNA, 22 nt, Human
guugaaaguggagaaccugguu

SEQ ID NO: 25007 - RNA, 22 nt, Human
guugaacuauguuuuaucugac

SEQ ID NO: 25008 - RNA, 22 nt, Human
guugaauaauucauagaagcua

SEQ ID NO: 25009 - RNA, 22 nt, Human
guugaaugaaucauucuaugua

SEQ ID NO: 25010 - RNA, 22 nt, Human
guugacagaaaaauaacauagc

SEQ ID NO: 25011 - RNA, 22 nt, Human
guugacagcuggugagcugcua

SEQ ID NO: 25012 - RNA, 22 nt, Human
guugacagugacccugaaagca

SEQ ID NO: 25013 - RNA, 22 nt, Human
guugauacaccucaugguuacu

SEQ ID NO: 25014 - RNA, 22 nt, Human
guugcaggaagcacacacaugu

SEQ ID NO: 25015 - RNA, 22 nt, Human
guugccguuuguucuaccagac

SEQ ID NO: 25016 - RNA, 22 nt, Human
guugcucaggcaggaguacagu

SEQ ID NO: 25017 - RNA, 22 nt, Human
guugcugaaagcccugacuggc

SEQ ID NO: 25018 - RNA, 22 nt, Human
guugcuggaagcuaugguccag

SEQ ID NO: 25019 - RNA, 22 nt, Human
guugcugggagcagggauccug

SEQ ID NO: 25020 - RNA, 22 nt, Human
guugcuuuucuccaucacaugg

SEQ ID NO: 25021 - RNA, 22 nt, Human
guuggacaguuugggaagggag

SEQ ID NO: 25022 - RNA, 22 nt, Human
guuggccugaauggucaagagg

SEQ ID NO: 25023 - RNA, 22 nt, Human
guugggaagcagauggaugagc

SEQ ID NO: 25024 - RNA, 22 nt, Human
guugggaaggcaagaaguagaa

SEQ ID NO: 25025 - RNA, 22 nt, Human
guugggagcagcagaccaagag

SEQ ID NO: 25026 - RNA, 22 nt, Human
guugggguccaaugaagcgagc

SEQ ID NO: 25027 - RNA, 22 nt, Human
guuguaaauacagcagauaauu

SEQ ID NO: 25028 - RNA, 22 nt, Human
gugaaaucugaggcccaugaug

SEQ ID NO: 25029 - RNA, 22 nt, Human
gugaacaaaauagcacauauua

SEQ ID NO: 25030 - RNA, 22 nt, Human
gugaacagacuguucucuacag

SEQ ID NO: 25031 - RNA, 22 nt, Human
gugaacagauaauagaaaugaa

SEQ ID NO: 25032 - RNA, 22 nt, Human
guggcagcugugggacacuggu

SEQ ID NO: 25033 - RNA, 22 nt, Human
guggcagcuguguugcaguuuu

SEQ ID NO: 25034 - RNA, 22 nt, Human
guggcaggagggcaucacuugg

SEQ ID NO: 25035 - RNA, 22 nt, Human
guggcagggcuuugcuguucuu

SEQ ID NO: 25036 - RNA, 22 nt, Human
guggcaggucccauuggagcag

SEQ ID NO: 25037 - RNA, 22 nt, Human
guggcagguuauaagcaucuca

SEQ ID NO: 25038 - RNA, 22 nt, Human
guggcagucuuuggcaaugaca

SEQ ID NO: 25039 - RNA, 22 nt, Human
guggcagugccagcuccgacaa

SEQ ID NO: 25040 - RNA, 22 nt, Human
guggcagugccguuugguucag

SEQ ID NO: 25041 - RNA, 22 nt, Human
guggcaucgucugagguggggu

SEQ ID NO: 25042 - RNA, 22 nt, Human
guggcaugaaagcaucugugau

SEQ ID NO: 25043 - RNA, 22 nt, Human
guggcaugacagugaaugggca

SEQ ID NO: 25044 - RNA, 22 nt, Human
guggcauggagaaggaggcagu

SEQ ID NO: 25045 - RNA, 22 nt, Human
guggcauuaggccaggugcaua

SEQ ID NO: 25046 - RNA, 22 nt, Human
guggccaaaucaugucaaaggc

SEQ ID NO: 25047 - RNA, 22 nt, Human
guggccaagggacucuaaggca

SEQ ID NO: 25048 - RNA, 22 nt, Human
ucugccagaaguucugagagua

SEQ ID NO: 25049 - RNA, 22 nt, Human
ucugccagcucugugggucucg

SEQ ID NO: 25050 - RNA, 21 nt, Human
ucugccagcugaagaggugga

SEQ ID NO: 25051 - RNA, 22 nt, Human
ucugccaggagccaugagcaag

SEQ ID NO: 25052 - RNA, 22 nt, Human
ucugccaggcauugugcugcuc

SEQ ID NO: 25053 - RNA, 22 nt, Human
ucugccaguauucacggcccgu

SEQ ID NO: 25054 - RNA, 22 nt, Human
ucugccaguuuauagacaagcc

SEQ ID NO: 25055 - RNA, 22 nt, Human
ucugccaucaagaugcucuggc

SEQ ID NO: 25056 - RNA, 22 nt, Human
ucugccaucuuaauucucuuuu

SEQ ID NO: 25057 - RNA, 21 nt, Human
ucugcccacacuggccacugc

SEQ ID NO: 25058 - RNA, 22 nt, Human
ucugcccacagccuccugucca

SEQ ID NO: 25059 - RNA, 20 nt, Human
ucugcccaccccggcuccca

SEQ ID NO: 25060 - RNA, 22 nt, Human
ucugcccaggacaccugccacu

SEQ ID NO: 25061 - RNA, 22 nt, Human
ucugcccaggaggucccauggg

SEQ ID NO: 25062 - RNA, 22 nt, Human
ucugcccucgaggagcuugugu

SEQ ID NO: 25063 - RNA, 23 nt, Human
ucugcccucugccuguuuuugua

SEQ ID NO: 25064 - RNA, 22 nt, Human
ucugccuagguuuccaaugugc

SEQ ID NO: 25065 - RNA, 19 nt, Human
ucugccucuggucaggcuc

SEQ ID NO: 25066 - RNA, 22 nt, Human
ucugccugaaauucacauguaa

SEQ ID NO: 25067 - RNA, 22 nt, Human
ucugccugcaguguggcagggc

SEQ ID NO: 25068 - RNA, 22 nt, Human
ucugccugcgcucacggggccg

SEQ ID NO: 25069 - RNA, 19 nt, Human
ucugccugcuuguaggggc

SEQ ID NO: 25070 - RNA, 22 nt, Human
ucugccuggaugauggcagggc

SEQ ID NO: 25071 - RNA, 22 nt, Human
ucugccuggauuuuggaaagcu

SEQ ID NO: 25072 - RNA, 22 nt, Human
ucugccuguaccucuuuuuugc

SEQ ID NO: 25073 - RNA, 22 nt, Human
ucugccuguugcuagaauguca

SEQ ID NO: 25074 - RNA, 20 nt, Human
ucugccuuagggggagccuc

SEQ ID NO: 25075 - RNA, 22 nt, Human
ucugccuuccccauaaucugau

SEQ ID NO: 25076 - RNA, 22 nt, Human
ucugccuugauggcauugagaa

SEQ ID NO: 25077 - RNA, 22 nt, Human
ucugccuuggcaaccacagcuu

SEQ ID NO: 25078 - RNA, 22 nt, Human
ucugccuuguugcaggcgcuau

SEQ ID NO: 25079 - RNA, 22 nt, Human
ucugccuuugcuuuggcuguca

SEQ ID NO: 25080 - RNA, 22 nt, Human
ucugccuuuguggucgggagaa

SEQ ID NO: 25081 - RNA, 22 nt, Human
ucugccuuuucacugccacuaa

SEQ ID NO: 25082 - RNA, 22 nt, Human
ucugcgccgcauguguucuuuc

SEQ ID NO: 25083 - RNA, 22 nt, Human
ucugcgcugccuugauccuugg

SEQ ID NO: 25084 - RNA, 22 nt, Human
ucugcguggcugcugugagcgu

SEQ ID NO: 25085 - RNA, 22 nt, Human
ucugcgugggacugaggaggcu

SEQ ID NO: 25086 - RNA, 22 nt, Human
ucugcuauuuucuaucugugug

SEQ ID NO: 25087 - RNA, 22 nt, Human
ucugcucaauacugcucaugaa

SEQ ID NO: 25088 - RNA, 20 nt, Human
ucugcucagcccucaguggc

SEQ ID NO: 25089 - RNA, 23 nt, Human
ucugcucugaaguucggcugagc

SEQ ID NO: 25090 - RNA, 22 nt, Human
ucugcugaauggagccaaccuc

SEQ ID NO: 25091 - RNA, 22 nt, Human
ucugcugaccuuucucugacac

SEQ ID NO: 25092 - RNA, 22 nt, Human
ucugcugaggugguuuuagaga

SEQ ID NO: 25093 - RNA, 22 nt, Human
ucugcugcacaaauucaucucu

SEQ ID NO: 25094 - RNA, 22 nt, Human
ucugcugcagggaaagacuuuc

SEQ ID NO: 25095 - RNA, 22 nt, Human
ucugcugcugagcacacuccua

SEQ ID NO: 25096 - RNA, 22 nt, Human
ucugcugguuccgaauuaggcc

SEQ ID NO: 25097 - RNA, 22 nt, Human
ucugcuguaaccuucagaggua

SEQ ID NO: 25098 - RNA, 22 nt, Human
ucugcuguccuuuauauagauu

SEQ ID NO: 25099 - RNA, 22 nt, Human
ucugcugucuaugcaaguccuu

SEQ ID NO: 25100 - RNA, 22 nt, Human
ucugcugugauucuacuagugu

SEQ ID NO: 25101 - RNA, 22 nt, Human
ucugcugugggucuauauuuua

SEQ ID NO: 25102 - RNA, 22 nt, Human
ucugcugugucccuggucuccu

SEQ ID NO: 25103 - RNA, 22 nt, Human
ucugcuguucauucuuuuagcu

SEQ ID NO: 25104 - RNA, 22 nt, Human
ucugcuguucucaugcugauuu

SEQ ID NO: 25105 - RNA, 22 nt, Human
ucugcuguugagcacaagugaa

SEQ ID NO: 25106 - RNA, 22 nt, Human
ucugcuguugccaugaguaaua

SEQ ID NO: 25107 - RNA, 22 nt, Human
ucugcuugcguucugcucccuc

SEQ ID NO: 25108 - RNA, 22 nt, Human
ucugcuugugucuguccagccu

SEQ ID NO: 25109 - RNA, 22 nt, Human
ucugcuuuagaauccaguagcu

SEQ ID NO: 25110 - RNA, 22 nt, Human
ucuggaaaagcgauaaaccauu

SEQ ID NO: 25111 - RNA, 22 nt, Human
ucuggaaagaucauuaaaucca

SEQ ID NO: 25112 - RNA, 22 nt, Human
ucuggaaauuucaguuuuagag

SEQ ID NO: 25113 - RNA, 18 nt, Human
ucuggaacaacuucaugu

SEQ ID NO: 25114 - RNA, 21 nt, Human
ucuggaagaaaaaaguauuau

SEQ ID NO: 25115 - RNA, 22 nt, Human
ucuggaagacagugagcccgcu

SEQ ID NO: 25116 - RNA, 22 nt, Human
ucuggaaggaagagcugagucc

SEQ ID NO: 25117 - RNA, 22 nt, Human
ucuggaaucagaccuaauccca

SEQ ID NO: 25118 - RNA, 22 nt, Human
ucuggaaucaguggcuuacccu

SEQ ID NO: 25119 - RNA, 23 nt, Human
ucuggaauccucccccuugguuc

SEQ ID NO: 25120 - RNA, 22 nt, Human
ucuggaaugaaugagguucugu

SEQ ID NO: 25121 - RNA, 22 nt, Human
ucuggaauuuuauugaucaaaa

SEQ ID NO: 25122 - RNA, 22 nt, Human
ucuggacaggggcgcuuugggg

SEQ ID NO: 25123 - RNA, 22 nt, Human
ucuggagaagaaacuugcucug

SEQ ID NO: 25124 - RNA, 22 nt, Human
ucuggagaagcccagggagcug

SEQ ID NO: 25125 - RNA, 22 nt, Human
ucuggagaccugcauuuauauu

SEQ ID NO: 25126 - RNA, 22 nt, Human
ucuggagaggggccuagaauuu

SEQ ID NO: 25127 - RNA, 19 nt, Human
ucuggagcugaugcaggug

SEQ ID NO: 25128 - RNA, 22 nt, Human
ucuggaggcaggcugccaggau

SEQ ID NO: 25129 - RNA, 22 nt, Human
ucuggagggggaugccucaucc

SEQ ID NO: 25130 - RNA, 22 nt, Human
ucuggaguaugucccuggugaa

SEQ ID NO: 25131 - RNA, 22 nt, Human
ucuggaguccuggaaucagcua

SEQ ID NO: 25132 - RNA, 22 nt, Human
ucuggaguggagcugaucauuu

SEQ ID NO: 25133 - RNA, 22 nt, Human
ucuggaguuacugcuggcuuug

SEQ ID NO: 25134 - RNA, 22 nt, Human
ucuggaguugaaguucuucccc

SEQ ID NO: 25135 - RNA, 22 nt, Human
ucuggaguugagagugugcgag

SEQ ID NO: 25136 - RNA, 22 nt, Human
ucuggaguugugcaguggaccu

SEQ ID NO: 25137 - RNA, 22 nt, Human
ucuggaucgccggcgccugggc

SEQ ID NO: 25138 - RNA, 17 nt, Human
ucuggaugucauggaag

SEQ ID NO: 25139 - RNA, 22 nt, Human
ucuggcacuuaaaugagaauuu

SEQ ID NO: 25140 - RNA, 22 nt, Human
ucuggcagagauauccauccca

SEQ ID NO: 25141 - RNA, 22 nt, Human
gugguuuaggggaaagaacugu

SEQ ID NO: 25142 - RNA, 22 nt, Human
gugguuuuauucguuccucugu

SEQ ID NO: 25143 - RNA, 17 nt, Human
guguaacuaugagccau

SEQ ID NO: 25144 - RNA, 22 nt, Human
guguaacuuuuauucaugcucu

SEQ ID NO: 25145 - RNA, 22 nt, Human
guguaauuauauaaagaucuac

SEQ ID NO: 25146 - RNA, 17 nt, Human
guguacaagcagaaggc

SEQ ID NO: 25147 - RNA, 19 nt, Human
guguacagcucagugaauu

SEQ ID NO: 25148 - RNA, 22 nt, Human
guguacagugauuugaguucac

SEQ ID NO: 25149 - RNA, 22 nt, Human
guguacaguuagccaccaaauu

SEQ ID NO: 25150 - RNA, 22 nt, Human
guguacauagaauugugcuuug

SEQ ID NO: 25151 - RNA, 19 nt, Human
guguagcuauuggucaaaa

SEQ ID NO: 25152 - RNA, 22 nt, Human
guguauaaugcuguuuguacau

SEQ ID NO: 25153 - RNA, 22 nt, Human
guguauaaugcuuugaagauua

SEQ ID NO: 25154 - RNA, 22 nt, Human
guguauccuuauucacacacau

SEQ ID NO: 25155 - RNA, 22 nt, Human
guguaugaacgaaagaauggau

SEQ ID NO: 25156 - RNA, 22 nt, Human
guguaugcaauugagucauaga

SEQ ID NO: 25157 - RNA, 22 nt, Human
guguaugugccuuacauuuuau

SEQ ID NO: 25158 - RNA, 22 nt, Human
gugucaacagccgaagauaaau

SEQ ID NO: 25159 - RNA, 22 nt, Human
gugucacuggaauacugucugu

SEQ ID NO: 25160 - RNA, 22 nt, Human
gugucagauguccagggcagca

SEQ ID NO: 25161 - RNA, 22 nt, Human
gugucauggaaaauugcaaugg

SEQ ID NO: 25162 - RNA, 22 nt, Human
gugucauguagaaauugaugaa

SEQ ID NO: 25163 - RNA, 22 nt, Human
gugucauuaaccaccaugcaaa

SEQ ID NO: 25164 - RNA, 22 nt, Human
gugucauuacugaaagauugaa

SEQ ID NO: 25165 - RNA, 22 nt, Human
ucuggcucacuucaggcuucac

SEQ ID NO: 25166 - RNA, 22 nt, Human
ucuggcucaggucagacaggga

SEQ ID NO: 25167 - RNA, 22 nt, Human
ucuggcucauacaagccugcaa

SEQ ID NO: 25168 - RNA, 22 nt, Human
ucuggcuccacaccucacugca

SEQ ID NO: 25169 - RNA, 22 nt, Human
ucuggcucccuggagcuccaca

SEQ ID NO: 25170 - RNA, 22 nt, Human
ucuggcuccugaguccaugcuc

SEQ ID NO: 25171 - RNA, 22 nt, Human
ucuggcucuaacuaggcaucag

SEQ ID NO: 25172 - RNA, 23 nt, Human
ucuggcucuaugugacagcucuc

SEQ ID NO: 25173 - RNA, 22 nt, Human
ucuggcucucaacaaauauuua

SEQ ID NO: 25174 - RNA, 22 nt, Human
ucuggcucugaauucacuucug

SEQ ID NO: 25175 - RNA, 22 nt, Human
ucuggcucuuugggugauugua

SEQ ID NO: 25176 - RNA, 22 nt, Human
ucuggcugaaaggggcugugcc

SEQ ID NO: 25177 - RNA, 22 nt, Human
ucuggcugaauuagccuugggu

SEQ ID NO: 25178 - RNA, 22 nt, Human
ucuggcugccaccauccucccc

SEQ ID NO: 25179 - RNA, 23 nt, Human
ucuggcugcuccuuucaaugcuc

SEQ ID NO: 25180 - RNA, 22 nt, Human
ucuggcugcugcgugagugcuu

SEQ ID NO: 25181 - RNA, 22 nt, Human
ucuggcuggcucggccgggagu

SEQ ID NO: 25182 - RNA, 22 nt, Human
ucuggcuguguaugagaguuuu

SEQ ID NO: 25183 - RNA, 22 nt, Human
ucuggcuucaagucccagcucu

SEQ ID NO: 25184 - RNA, 22 nt, Human
ucuggcuuggcuggcaucucug

SEQ ID NO: 25185 - RNA, 22 nt, Human
ucuggcuuucauuuguuuaaag

SEQ ID NO: 25186 - RNA, 23 nt, Human
ucuggcuuugcuggaaguuuuga

SEQ ID NO: 25187 - RNA, 22 nt, Human
ucugggaaauagaggacccuag

SEQ ID NO: 25188 - RNA, 22 nt, Human
ucugggaaaugcuguuccuugu

SEQ ID NO: 25189 - RNA, 22 nt, Human
ucugggaaaugggcagcuucgc

SEQ ID NO: 25190 - RNA, 22 nt, Human
ucugggaacagccuggcugugu

SEQ ID NO: 25191 - RNA, 22 nt, Human
ucugggaacauuuugagggcaa

SEQ ID NO: 25192 - RNA, 22 nt, Human
ucugggaaccaaagggugcuua

SEQ ID NO: 25193 - RNA, 22 nt, Human
ucugggaacucugucauuuccc

SEQ ID NO: 25194 - RNA, 22 nt, Human
ucugggaagacggauggacccu

SEQ ID NO: 25195 - RNA, 22 nt, Human
ucugggaagcaaauauguaaga

SEQ ID NO: 25196 - RNA, 19 nt, Human
ucugggaagccgggcucca

SEQ ID NO: 25197 - RNA, 22 nt, Human
ucugggaaggcucugcagauau

SEQ ID NO: 25198 - RNA, 22 nt, Human
ucugggaagugagaugcugugu

SEQ ID NO: 25199 - RNA, 22 nt, Human
ucugggaauacacacugauuua

SEQ ID NO: 25200 - RNA, 19 nt, Human
ucugggaaugaugccagca

SEQ ID NO: 25201 - RNA, 21 nt, Human
ucugggacagggccugaggag

SEQ ID NO: 25202 - RNA, 19 nt, Human
ucugggagagugaaucuga

SEQ ID NO: 25203 - RNA, 22 nt, Human
ucugggagcagaugaugguaua

SEQ ID NO: 25204 - RNA, 21 nt, Human
ucugggagugggaaaaugguc

SEQ ID NO: 25205 - RNA, 22 nt, Human
ucugggagugugucuggccauc

SEQ ID NO: 25206 - RNA, 22 nt, Human
ucugggaugcaaacagaaucug

SEQ ID NO: 25207 - RNA, 22 nt, Human
ucugggauuuuauagacaugcu

SEQ ID NO: 25208 - RNA, 22 nt, Human
ucugggauuuuugacacugaag

SEQ ID NO: 25209 - RNA, 22 nt, Human
ucugggcaauggaugcacucac

SEQ ID NO: 25210 - RNA, 22 nt, Human
ucugggcacacaccaugcccac

SEQ ID NO: 25211 - RNA, 22 nt, Human
ucugggcacugcugagccugua

SEQ ID NO: 25212 - RNA, 22 nt, Human
ucugggcagaagcagugcaaag

SEQ ID NO: 25213 - RNA, 22 nt, Human
ucugggcagagggucuuaguca

SEQ ID NO: 25214 - RNA, 22 nt, Human
ucugggcagcagcagcuaguag

SEQ ID NO: 25215 - RNA, 21 nt, Human
ucugggcagcccaguccugag

SEQ ID NO: 25216 - RNA, 19 nt, Human
ucugggcagggccagcacc

SEQ ID NO: 25217 - RNA, 22 nt, Human
ucugggcaguucggauccucug

SEQ ID NO: 25218 - RNA, 22 nt, Human
ucugggcaugucugugaacacg

SEQ ID NO: 25219 - RNA, 22 nt, Human
ucugggccaacccuuccauggg

SEQ ID NO: 25220 - RNA, 23 nt, Human
ucugggccacuugucugcacuuc

SEQ ID NO: 25221 - RNA, 22 nt, Human
ucugggccagaucuagggaucu

SEQ ID NO: 25222 - RNA, 22 nt, Human
ucugggccagugauuuuuccag

SEQ ID NO: 25223 - RNA, 21 nt, Human
ucugggcccaugcugccucac

SEQ ID NO: 25224 - RNA, 22 nt, Human
ucugggcccuaaaccagcucua

SEQ ID NO: 25225 - RNA, 22 nt, Human
ucugggcccugagauguucuuc

SEQ ID NO: 25226 - RNA, 22 nt, Human
ucugggccucaccugcugcuca

SEQ ID NO: 25227 - RNA, 22 nt, Human
ucugggccucaguuucuucauc

SEQ ID NO: 25228 - RNA, 22 nt, Human
ucugggccugauggcuaaagcc

SEQ ID NO: 25229 - RNA, 22 nt, Human
ucugggcucugcgaagcccuuc

SEQ ID NO: 25230 - RNA, 22 nt, Human
ucugggcugaaaugaaggccuu

SEQ ID NO: 25231 - RNA, 23 nt, Human
ucugggcugagcucgaguguaga

SEQ ID NO: 25232 - RNA, 22 nt, Human
ucugggcugcuaugaggcagag

SEQ ID NO: 25233 - RNA, 22 nt, Human
ucugggcugcuucagccuucgc

SEQ ID NO: 25234 - RNA, 22 nt, Human
ucugggcuggugcucaugaauu

SEQ ID NO: 25235 - RNA, 22 nt, Human
ucugggcugucuacagguuggc

SEQ ID NO: 25236 - RNA, 22 nt, Human
ucugggcugugccaaagcucuu

SEQ ID NO: 25237 - RNA, 22 nt, Human
ucugggcugugguuccacuccg

SEQ ID NO: 25238 - RNA, 22 nt, Human
ucugggcuugccugguugugca

SEQ ID NO: 25239 - RNA, 22 nt, Human
ucugggcuuuacacugugcuua

SEQ ID NO: 25240 - RNA, 22 nt, Human
ucugggcuuuguaaugggaggu

SEQ ID NO: 25241 - RNA, 20 nt, Human
ucuggggaugaggucuagga

SEQ ID NO: 25242 - RNA, 22 nt, Human
ucuggggcaguuacuggggccu

SEQ ID NO: 25243 - RNA, 22 nt, Human
ucugggggaggaggcauggccc

SEQ ID NO: 25244 - RNA, 22 nt, Human
ucugggggcgaccagggacugc

SEQ ID NO: 25245 - RNA, 21 nt, Human
ucugggggugagccuagaaau

SEQ ID NO: 25246 - RNA, 22 nt, Human
ucuggggugugaccugagcaug

SEQ ID NO: 25247 - RNA, 18 nt, Human
ucuggggugugcugugua

SEQ ID NO: 25248 - RNA, 22 nt, Human
ucugggguuuucacgcugucuc

SEQ ID NO: 25249 - RNA, 22 nt, Human
ucuggguacuugcaagauuuuc

SEQ ID NO: 25250 - RNA, 22 nt, Human
guguuuauguuuguguagggga

SEQ ID NO: 25251 - RNA, 22 nt, Human
guguuuauuuagaguaggccau

SEQ ID NO: 25252 - RNA, 22 nt, Human
guguuuggucagacguccgggg

SEQ ID NO: 25253 - RNA, 22 nt, Human
guguuuguucgugacuccaaag

SEQ ID NO: 25254 - RNA, 22 nt, Human
guguuuuagugcugcugagcug

SEQ ID NO: 25255 - RNA, 22 nt, Human
guguuuuaucagacaaaguaua

SEQ ID NO: 25256 - RNA, 22 nt, Human
guguuuuauggagucauaacgu

SEQ ID NO: 25257 - RNA, 22 nt, Human
guguuuuggccauuagugugau

SEQ ID NO: 25258 - RNA, 22 nt, Human
guguuuugugaggccuucuuuc

SEQ ID NO: 25259 - RNA, 22 nt, Human
guuaaacauugcuccacggguu

SEQ ID NO: 25260 - RNA, 22 nt, Human
guuaacaaauguaaagcaauua

SEQ ID NO: 25261 - RNA, 22 nt, Human
guuaaccaaggcaccaagugua

SEQ ID NO: 25262 - RNA, 22 nt, Human
guuaacuuccccaugucugcau

SEQ ID NO: 25263 - RNA, 22 nt, Human
guuaacuugguagucuaagugu

SEQ ID NO: 25264 - RNA, 22 nt, Human
guuaacuuuuuacagaaaugaa

SEQ ID NO: 25265 - RNA, 22 nt, Human
guuaagaacuuguugaaggucu

SEQ ID NO: 25266 - RNA, 22 nt, Human
guuaaguaccagauugucugaa

SEQ ID NO: 25267 - RNA, 22 nt, Human
guuaagugaaugucaugucagg

SEQ ID NO: 25268 - RNA, 22 nt, Human
guuaauaaagguauagaaucag

SEQ ID NO: 25269 - RNA, 22 nt, Human
guuaauacaaccaugaucuucu

SEQ ID NO: 25270 - RNA, 22 nt, Human
guuaaugccuacauauuaagca

SEQ ID NO: 25271 - RNA, 22 nt, Human
guuaaugugauauaaaguauuu

SEQ ID NO: 25272 - RNA, 22 nt, Human
guuaaugugguagugcauaucu

SEQ ID NO: 25273 - RNA, 22 nt, Human
guuacaaaggaagcuucacugc

SEQ ID NO: 25274 - RNA, 22 nt, Human
guuacaauguccuuacaugaaa

SEQ ID NO: 25275 - RNA, 22 nt, Human
guuacacagcuaagcuucuccu

SEQ ID NO: 25276 - RNA, 22 nt, Human
guuacacaggaaaacauuagca

SEQ ID NO: 25277 - RNA, 22 nt, Human
guuacaguggguuuggggccca

SEQ ID NO: 25278 - RNA, 22 nt, Human
guuacaguuugggcuugauuca

SEQ ID NO: 25279 - RNA, 22 nt, Human
guuaccauugucuaggucauug

SEQ ID NO: 25280 - RNA, 16 nt, Human
guuacccacccaaggc

SEQ ID NO: 25281 - RNA, 22 nt, Human
guuacccagugcuguggaggga

SEQ ID NO: 25282 - RNA, 22 nt, Human
guuacuagggacugagaguaaa

SEQ ID NO: 25283 - RNA, 22 nt, Human
guguuacugcuuuuaucuacca

SEQ ID NO: 25284 - RNA, 22 nt, Human
guguuacuuaccugggacagca

SEQ ID NO: 25285 - RNA, 22 nt, Human
guguuauuagagcauuaauuuu

SEQ ID NO: 25286 - RNA, 22 nt, Human
guguucuuuugcuucacagaaa

SEQ ID NO: 25287 - RNA, 22 nt, Human
guguuuauacagcaaagagcau

SEQ ID NO: 25288 - RNA, 22 nt, Human
guguuuaugagugaccuugucu

SEQ ID NO: 25289 - RNA, 22 nt, Human
guguuuauuuucauaguuggcc

SEQ ID NO: 25290 - RNA, 22 nt, Human
guguuuccaguucagaaagcaa

SEQ ID NO: 25291 - RNA, 22 nt, Human
guguuuccuaguuuaaugaaug

SEQ ID NO: 25292 - RNA, 21 nt, Human
guguuuccuguuuauggcuug

SEQ ID NO: 25293 - RNA, 22 nt, Human
guguuucuugcacuccccggac

SEQ ID NO: 25294 - RNA, 22 nt, Human
guguuugcuggagcucuggguc

SEQ ID NO: 25295 - RNA, 22 nt, Human
guguuugugagcuaggugacau

SEQ ID NO: 25296 - RNA, 22 nt, Human
guuaaaagaacaacucggaggu

SEQ ID NO: 25297 - RNA, 22 nt, Human
guuaaacaauaacuggcacaca

SEQ ID NO: 25298 - RNA, 22 nt, Human
guuaaaugcauuuuccaagcac

SEQ ID NO: 25299 - RNA, 22 nt, Human
guuaacaagguguagagguuuu

SEQ ID NO: 25300 - RNA, 18 nt, Human
guuaacaauuacuaacgc

SEQ ID NO: 25301 - RNA, 22 nt, Human
guuaacacaggacucucugccu

SEQ ID NO: 25302 - RNA, 22 nt, Human
guuaacauaggaguuuguugua

SEQ ID NO: 25303 - RNA, 23 nt, Human
guuaacaugguccauggaagagc

SEQ ID NO: 25304 - RNA, 22 nt, Human
guuaagaaucaagacuuaucuu

SEQ ID NO: 25305 - RNA, 22 nt, Human
guuaaggaucuugagaugagga

SEQ ID NO: 25306 - RNA, 22 nt, Human
guuaauauuuaccugucaagaa

SEQ ID NO: 25307 - RNA, 22 nt, Human
guuaaugccauuaggaaauuua

SEQ ID NO: 25308 - RNA, 22 nt, Human
guuaaugugucugacacaaugg

SEQ ID NO: 25309 - RNA, 22 nt, Human
guuacaaagcacuucaagugaa

SEQ ID NO: 25310 - RNA, 22 nt, Human
guuacaaaggacugggggccac

SEQ ID NO: 25311 - RNA, 22 nt, Human
guuacaaaugccaaagcugaga

SEQ ID NO: 25312 - RNA, 22 nt, Human
guuacaaauguaaauucugggg

SEQ ID NO: 25313 - RNA, 22 nt, Human
guuacacacaauauauccuaaa

SEQ ID NO: 25314 - RNA, 22 nt, Human
guuagaaacgcaggcucuccgg

SEQ ID NO: 25315 - RNA, 22 nt, Human
guuagaaaugcagaaacuugac

SEQ ID NO: 25316 - RNA, 22 nt, Human
guuagacaugagugugcuuaca

SEQ ID NO: 25317 - RNA, 22 nt, Human
guuagagacaucucugguuucu

SEQ ID NO: 25318 - RNA, 22 nt, Human
guuagcaaugaaaucuggaugc

SEQ ID NO: 25319 - RNA, 22 nt, Human
guuaggaacacuggagccuaaa

SEQ ID NO: 25320 - RNA, 19 nt, Human
guuaggcaggguggggagu

SEQ ID NO: 25321 - RNA, 22 nt, Human
guuagggaagcgcuguguucuu

SEQ ID NO: 25322 - RNA, 22 nt, Human
guuagggaucaggaacaagagc

SEQ ID NO: 25323 - RNA, 22 nt, Human
guuagguagaaguuuacuuuga

SEQ ID NO: 25324 - RNA, 22 nt, Human
guuaguagcauuucaugacaug

SEQ ID NO: 25325 - RNA, 22 nt, Human
guuagugugacugaggaaugca

SEQ ID NO: 25326 - RNA, 22 nt, Human
guuauacauauguguuaacaaa

SEQ ID NO: 25327 - RNA, 22 nt, Human
guuauaggagcccgaacuaaga

SEQ ID NO: 25328 - RNA, 22 nt, Human
guuauauaauuccugugguagu

SEQ ID NO: 25329 - RNA, 22 nt, Human
guuauauauaguauuucucuga

SEQ ID NO: 25330 - RNA, 22 nt, Human
guuaugaaauaaauauagauca

SEQ ID NO: 25331 - RNA, 22 nt, Human
guuaugauggcaccacugcacu

SEQ ID NO: 25332 - RNA, 22 nt, Human
guuaugauugaaauuccaguuu

SEQ ID NO: 25333 - RNA, 22 nt, Human
guuauucaauggcuuauaagga

SEQ ID NO: 25334 - RNA, 22 nt, Human
guuauucuacagucauugaagu

SEQ ID NO: 25335 - RNA, 22 nt, Human
guuauucuaccacuauguacag

SEQ ID NO: 25336 - RNA, 22 nt, Human
guuauucuauuaaugugauugu

SEQ ID NO: 25337 - RNA, 22 nt, Human
guuauucugcgaugcaauccug

SEQ ID NO: 25338 - RNA, 22 nt, Human
guuauugacucucuuguggcuu

SEQ ID NO: 25339 - RNA, 22 nt, Human
guuauugcaguauagaggucua

SEQ ID NO: 25340 - RNA, 22 nt, Human
guuauuguccagcacaguuggg

SEQ ID NO: 25341 - RNA, 22 nt, Human
guuauuucagccacagagugca

SEQ ID NO: 25342 - RNA, 22 nt, Human
guuauuuuaacuucucaguaau

SEQ ID NO: 25343 - RNA, 22 nt, Human
guucaaaauucaaaugguauac

SEQ ID NO: 25344 - RNA, 21 nt, Human
guucaaauggguagauucaca

SEQ ID NO: 25345 - RNA, 22 nt, Human
guucaaauucuaugaaauaugu

SEQ ID NO: 25346 - RNA, 22 nt, Human
guucaaauugagaugguauaaa

SEQ ID NO: 25347 - RNA, 22 nt, Human
guucaaauuuucuaggugggug

SEQ ID NO: 25348 - RNA, 18 nt, Human
guucaagccaacaucaag

SEQ ID NO: 25349 - RNA, 22 nt, Human
guucaaguuucugagcuuuaau

SEQ ID NO: 25350 - RNA, 22 nt, Human
guucaauuaaguuacaaauuua

SEQ ID NO: 25351 - RNA, 22 nt, Human
guucaauuucagcauccauuga

SEQ ID NO: 25352 - RNA, 22 nt, Human
guucacacuuuugauaugugaa

SEQ ID NO: 25353 - RNA, 22 nt, Human
guucacagaaauuguguaccuc

SEQ ID NO: 25354 - RNA, 22 nt, Human
guucacagauccuugaagccag

SEQ ID NO: 25355 - RNA, 22 nt, Human
guucacaggguuaggaaucacu

SEQ ID NO: 25356 - RNA, 22 nt, Human
guucacaguuaggacaacugcu

SEQ ID NO: 25357 - RNA, 22 nt, Human
guucacauguggucaugcuguc

SEQ ID NO: 25358 - RNA, 21 nt, Human
guucagagauuauugagucau

SEQ ID NO: 25359 - RNA, 22 nt, Human
guuuacaacaugccaacugggc

SEQ ID NO: 25360 - RNA, 22 nt, Human
guuuacagagacagaaaguagu

SEQ ID NO: 25361 - RNA, 22 nt, Human
guuuacaguacucacuugcauu

SEQ ID NO: 25362 - RNA, 22 nt, Human
guuuacaguggcuucauuggau

SEQ ID NO: 25363 - RNA, 22 nt, Human
guuuacaugcaugcaagaauga

SEQ ID NO: 25364 - RNA, 22 nt, Human
guuuacauguaauguguuauug

SEQ ID NO: 25365 - RNA, 22 nt, Human
guuuacuuuucauggagcauau

SEQ ID NO: 25366 - RNA, 22 nt, Human
guuuagaagccaagauuugggu

SEQ ID NO: 25367 - RNA, 22 nt, Human
guuuauaauccaacucugcucc

SEQ ID NO: 25368 - RNA, 22 nt, Human
guuuauaaugucugugccaaaa

SEQ ID NO: 25369 - RNA, 22 nt, Human
guuuaucauuauuauuagcaac

SEQ ID NO: 25370 - RNA, 22 nt, Human
guuuaucuuaauggacucagag

SEQ ID NO: 25371 - RNA, 22 nt, Human
guuuaugaaugugucagacaua

SEQ ID NO: 25372 - RNA, 22 nt, Human
guuuaugaggaaaaguuaugau

SEQ ID NO: 25373 - RNA, 22 nt, Human
guuuaugcacuugguuuguguc

SEQ ID NO: 25374 - RNA, 22 nt, Human
guuuauuaacugucaagugauu

SEQ ID NO: 25375 - RNA, 22 nt, Human
guuuauuggguauuguggagcc

SEQ ID NO: 25376 - RNA, 22 nt, Human
guuucaaauagguuucagcaaa

SEQ ID NO: 25377 - RNA, 22 nt, Human
guuucacagcaaaguucccugu

SEQ ID NO: 25378 - RNA, 22 nt, Human
guuucacaugaaacuuggggaa

SEQ ID NO: 25379 - RNA, 22 nt, Human
guuucagagguguucauuuuca

SEQ ID NO: 25380 - RNA, 22 nt, Human
guuucauagcauauacgugugu

SEQ ID NO: 25381 - RNA, 22 nt, Human
guuucauagcuacgauuuuggg

SEQ ID NO: 25382 - RNA, 22 nt, Human
guuucauauaccaagcacuuga

SEQ ID NO: 25383 - RNA, 22 nt, Human
guuuccaaccccaccaaagugc

SEQ ID NO: 25384 - RNA, 22 nt, Human
guuuccaacuaguaugaucagg

SEQ ID NO: 25385 - RNA, 22 nt, Human
guuuccaagucucucaacaccc

SEQ ID NO: 25386 - RNA, 22 nt, Human
guuuccacuugagaggacuccu

SEQ ID NO: 25387 - RNA, 22 nt, Human
guuuccagccuagagaugguga

SEQ ID NO: 25388 - RNA, 22 nt, Human
guuuccagccuccuggguaaag

SEQ ID NO: 25389 - RNA, 22 nt, Human
guuuccaggcacuuuuucugcu

SEQ ID NO: 25390 - RNA, 22 nt, Human
guuuccaggcgauaucagcugc

SEQ ID NO: 25391 - RNA, 22 nt, Human
guuuccagucaacuugugugug

SEQ ID NO: 25392 - RNA, 22 nt, Human
guuuccauuguccuaucuauag

SEQ ID NO: 25393 - RNA, 22 nt, Human
guuucccagucugcagaguucu

SEQ ID NO: 25394 - RNA, 22 nt, Human
guuuccuaccagugguuccaga

SEQ ID NO: 25395 - RNA, 22 nt, Human
guuuccuagaucaguguucuua

SEQ ID NO: 25396 - RNA, 22 nt, Human
guuuccuaggcuuauacagcug

SEQ ID NO: 25397 - RNA, 20 nt, Human
guuuccuauuuaccuccuca

SEQ ID NO: 25398 - RNA, 18 nt, Human
guuuccugaggugaaggg

SEQ ID NO: 25399 - RNA, 22 nt, Human
guuuccugggccccaacccaga

SEQ ID NO: 25400 - RNA, 22 nt, Human
uaauagaaagguauuuuuugca

SEQ ID NO: 25401 - RNA, 22 nt, Human
uaauagcugugggaaauaaaag

SEQ ID NO: 25402 - RNA, 22 nt, Human
uaauagucauuguauaccuugg

SEQ ID NO: 25403 - RNA, 19 nt, Human
uaauauacagacccaucug

SEQ ID NO: 25404 - RNA, 21 nt, Human
uaauauagguucacaacuagu

SEQ ID NO: 25405 - RNA, 22 nt, Human
uaauauauaccuuuguuaggaa

SEQ ID NO: 25406 - RNA, 22 nt, Human
uaauaugggcagucugaauaua

SEQ ID NO: 25407 - RNA, 22 nt, Human
uaauauuucuacccugcugccu

SEQ ID NO: 25408 - RNA, 22 nt, Human
uaaucacaucaggguaaauggg

SEQ ID NO: 25409 - RNA, 20 nt, Human
uaaucacuuauaagacaaug

SEQ ID NO: 25410 - RNA, 22 nt, Human
uaaucauggccucaaauuuuau

SEQ ID NO: 25411 - RNA, 22 nt, Human
uaauccaauggcacaauguaug

SEQ ID NO: 25412 - RNA, 22 nt, Human
uaauccacaauagagauuaucu

SEQ ID NO: 25413 - RNA, 18 nt, Human
uaauccauaugcuuugcc

SEQ ID NO: 25414 - RNA, 22 nt, Human
uaauccugcuucuucucccuuu

SEQ ID NO: 25415 - RNA, 22 nt, Human
uaauccugugcuguguaaguac

SEQ ID NO: 25416 - RNA, 22 nt, Human
uaaucucucuaaguuuccauuu

SEQ ID NO: 25417 - RNA, 23 nt, Human
uaaucucuucaagagaaggggaa

SEQ ID NO: 25418 - RNA, 22 nt, Human
uaaucugaagaaacaggacuug

SEQ ID NO: 25419 - RNA, 22 nt, Human
uaaugaacacagaauuucacuu

SEQ ID NO: 25420 - RNA, 22 nt, Human
uaaugaaugagaauauaacaga

SEQ ID NO: 25421 - RNA, 22 nt, Human
uaaugagaauucuuuuugggua

SEQ ID NO: 25422 - RNA, 22 nt, Human
uaaugagaucauaucuucugag

SEQ ID NO: 25423 - RNA, 22 nt, Human
uaaugaggcaagagucauggcu

SEQ ID NO: 25424 - RNA, 22 nt, Human
uaaugaugcaguuacugucuca

SEQ ID NO: 25425 - RNA, 22 nt, Human
uaaugcaauuuucucaguccau

SEQ ID NO: 25426 - RNA, 19 nt, Human
uaaugcacuuaacacaugg

SEQ ID NO: 25427 - RNA, 22 nt, Human
uaaugccaauuuaaugauccau

SEQ ID NO: 25428 - RNA, 22 nt, Human
uaaugccuagauuauucuguuu

SEQ ID NO: 25429 - RNA, 20 nt, Human
uaaugccucaugauacuaga

SEQ ID NO: 25430 - RNA, 22 nt, Human
uaaugcuuuguuuugaucuaac

SEQ ID NO: 25431 - RNA, 22 nt, Human
uaauggcagagucaugcuuucu

SEQ ID NO: 25432 - RNA, 22 nt, Human
uaauggcuaaaauucagaagaa

SEQ ID NO: 25433 - RNA, 22 nt, Human
uaaugguauuuguugaaaaacu

SEQ ID NO: 25434 - RNA, 22 nt, Human
uaauguagggguguaacacaca

SEQ ID NO: 25435 - RNA, 22 nt, Human
uaaugucuccaggguugaccua

SEQ ID NO: 25436 - RNA, 22 nt, Human
uaaugugaagacauaaaucaga

SEQ ID NO: 25437 - RNA, 22 nt, Human
uaauguuaguauguaaucuuau

SEQ ID NO: 25438 - RNA, 22 nt, Human
uaauguuugagauguuggauuu

SEQ ID NO: 25439 - RNA, 22 nt, Human
uaauguuugggaaggugcuuug

SEQ ID NO: 25440 - RNA, 22 nt, Human
uaauuaacauacaaaacagcug

SEQ ID NO: 25441 - RNA, 22 nt, Human
uaauuacaaagcaagcacaggg

SEQ ID NO: 25442 - RNA, 22 nt, Human
uaauuacagagguuugccaguu

SEQ ID NO: 25443 - RNA, 22 nt, Human
uaauuacagguccaaaacaauc

SEQ ID NO: 25444 - RNA, 22 nt, Human
uaauuagagucacaaguaacca

SEQ ID NO: 25445 - RNA, 21 nt, Human
uaauuagcaaagcugagauuc

SEQ ID NO: 25446 - RNA, 22 nt, Human
uaauuauaacaguuacaucuua

SEQ ID NO: 25447 - RNA, 22 nt, Human
uaauuauuaugacaacaauugc

SEQ ID NO: 25448 - RNA, 22 nt, Human
uaauugcucgagaaauaaccuc

SEQ ID NO: 25449 - RNA, 22 nt, Human
uaauugcucuuggccgugccag

SEQ ID NO: 25450 - RNA, 22 nt, Human
uaauugcuuguaaagcccugaa

SEQ ID NO: 25451 - RNA, 22 nt, Human
uaauuggauguucucuggaagc

SEQ ID NO: 25452 - RNA, 22 nt, Human
uaauuggcuuuacuuaaagucc

SEQ ID NO: 25453 - RNA, 22 nt, Human
uaauugguagcugguauaaugc

SEQ ID NO: 25454 - RNA, 22 nt, Human
uaauuguacucccugugggaaa

SEQ ID NO: 25455 - RNA, 22 nt, Human
uaauuguagcuuuguaaucagc

SEQ ID NO: 25456 - RNA, 22 nt, Human
uaauuuacagagauacagucag

SEQ ID NO: 25457 - RNA, 22 nt, Human
uaauuuacucagauguucaauc

SEQ ID NO: 25458 - RNA, 22 nt, Human
uaauuucaauagcuugcauaau

SEQ ID NO: 25459 - RNA, 22 nt, Human
uaauuucacaguucaacgcaca

SEQ ID NO: 25460 - RNA, 22 nt, Human
uaauuucagugcaagcucacgg

SEQ ID NO: 25461 - RNA, 22 nt, Human
uaauuucuggagggagaaagag

SEQ ID NO: 25462 - RNA, 22 nt, Human
uaauuuuaauaguauguggcau

SEQ ID NO: 25463 - RNA, 22 nt, Human
uaauuuuacuuccugagcaccu

SEQ ID NO: 25464 - RNA, 22 nt, Human
uaauuuuaugacaguguauuuu

SEQ ID NO: 25465 - RNA, 22 nt, Human
uacaaaaggaagagggaucuua

SEQ ID NO: 25466 - RNA, 22 nt, Human
uacaaaaguaauuacgguuuuu

SEQ ID NO: 25467 - RNA, 22 nt, Human
uacaaacuguuauuauuauugu

SEQ ID NO: 25468 - RNA, 22 nt, Human
uaaaagcucuucuguugaguua

SEQ ID NO: 25469 - RNA, 22 nt, Human
uaaaaggauuagcaggaugggc

SEQ ID NO: 25470 - RNA, 22 nt, Human
uaaaaguaggaaugaaacgcau

SEQ ID NO: 25471 - RNA, 22 nt, Human
uaaaauagaggaugucaugcua

SEQ ID NO: 25472 - RNA, 22 nt, Human
uaaaauagccagugccccucug

SEQ ID NO: 25473 - RNA, 22 nt, Human
uaaaaucaccaaaagcaggugg

SEQ ID NO: 25474 - RNA, 22 nt, Human
uaaaaucauucuggugucagua

SEQ ID NO: 25475 - RNA, 22 nt, Human
uaaaaucgcacugcuguuguua

SEQ ID NO: 25476 - RNA, 22 nt, Human
uaaaaugccagaccaguucacg

SEQ ID NO: 25477 - RNA, 19 nt, Human
uaaaaugucuguggucagu

SEQ ID NO: 25478 - RNA, 22 nt, Human
uaaaauugcggugaauauuucc

SEQ ID NO: 25479 - RNA, 22 nt, Human
uaaacaagcuggacugauaagu

SEQ ID NO: 25480 - RNA, 22 nt, Human
uaaacaaggguuacugagcaug

SEQ ID NO: 25481 - RNA, 22 nt, Human
uaaacaauuccucucuaggcau

SEQ ID NO: 25482 - RNA, 22 nt, Human
uaaacagccuaaaacuuucuuu

SEQ ID NO: 25483 - RNA, 22 nt, Human
uaaacaggccccagggagguug

SEQ ID NO: 25484 - RNA, 20 nt, Human
uaaacaguauuuacuaggag

SEQ ID NO: 25485 - RNA, 22 nt, Human
uaaacagugauacguuccagcu

SEQ ID NO: 25486 - RNA, 22 nt, Human
uaaacaucaggaaugaaaaccu

SEQ ID NO: 25487 - RNA, 22 nt, Human
uaaacaucaguacaaagacuaa

SEQ ID NO: 25488 - RNA, 22 nt, Human
uaaacaugcccagugacaggga

SEQ ID NO: 25489 - RNA, 22 nt, Human
uaaacauggauucugaucacag

SEQ ID NO: 25490 - RNA, 22 nt, Human
uaaacaugugagugugcauaua

SEQ ID NO: 25491 - RNA, 22 nt, Human
uaaacauguugacaucuuaccu

SEQ ID NO: 25492 - RNA, 22 nt, Human
uaaaccaaguguccauauuagu

SEQ ID NO: 25493 - RNA, 22 nt, Human
uaaaccauucagacugaaccac

SEQ ID NO: 25494 - RNA, 21 nt, Human
uaaaccuggcgcuguucaaag

SEQ ID NO: 25495 - RNA, 22 nt, Human
uaaaccuucaugauggucauua

SEQ ID NO: 25496 - RNA, 22 nt, Human
uaaaccuugguagcaucuugcu

SEQ ID NO: 25497 - RNA, 18 nt, Human
uaaaccuuucuuguggca

SEQ ID NO: 25498 - RNA, 22 nt, Human
uaaacuguagcucucguaauuc

SEQ ID NO: 25499 - RNA, 22 nt, Human
uaaacuguggaauguucucuuu

SEQ ID NO: 25500 - RNA, 22 nt, Human
uaaagacaauaggaaaguuguu

SEQ ID NO: 25501 - RNA, 22 nt, Human
uaaagacagauggaccagccau

SEQ ID NO: 25502 - RNA, 22 nt, Human
uaaagacauaggaucagggaga

SEQ ID NO: 25503 - RNA, 22 nt, Human
uaaagacaugguguaggugaac

SEQ ID NO: 25504 - RNA, 19 nt, Human
uaaagagaauaccgguggc

SEQ ID NO: 25505 - RNA, 23 nt, Human
uaaagcaaagucaagugcacucc

SEQ ID NO: 25506 - RNA, 22 nt, Human
uaaagcaaugaaaguuuugcag

SEQ ID NO: 25507 - RNA, 22 nt, Human
uaaagcagccagggucuaagcc

SEQ ID NO: 25508 - RNA, 22 nt, Human
uaaagcagugcaaaagcguuuu

SEQ ID NO: 25509 - RNA, 22 nt, Human
uaaagcauuuuugaaauuauga

SEQ ID NO: 25510 - RNA, 22 nt, Human
uaaagccaauauaccuagcaua

SEQ ID NO: 25511 - RNA, 22 nt, Human
uaaagccacuucauucuagucu

SEQ ID NO: 25512 - RNA, 22 nt, Human
uaaagccauacugaaagccacu

SEQ ID NO: 25513 - RNA, 22 nt, Human
uaaagcuacacauuauuaaucc

SEQ ID NO: 25514 - RNA, 22 nt, Human
uaaagcuagaauuguuccagca

SEQ ID NO: 25515 - RNA, 22 nt, Human
uaaagcuauuauaguuauguuu

SEQ ID NO: 25516 - RNA, 22 nt, Human
uaaagcuguuagaguaguaaga

SEQ ID NO: 25517 - RNA, 22 nt, Human
uaaagcuguucagugcagaaag

SEQ ID NO: 25518 - RNA, 22 nt, Human
uaaaggaacugcugcuauggaa

SEQ ID NO: 25519 - RNA, 22 nt, Human
uaaaggaagaauucucugugau

SEQ ID NO: 25520 - RNA, 22 nt, Human
uaaaggagugugaugaaaggga

SEQ ID NO: 25521 - RNA, 22 nt, Human
uaaaggcaaacucuccaaggau

SEQ ID NO: 25522 - RNA, 22 nt, Human
uaaaggcaguucugauuagguc

SEQ ID NO: 25523 - RNA, 22 nt, Human
uaaaggcaugcaggugaaugua

SEQ ID NO: 25524 - RNA, 22 nt, Human
uaaaggcucagggaaccagauc

SEQ ID NO: 25525 - RNA, 22 nt, Human
uaaaggcuucggagugcacacu

SEQ ID NO: 25526 - RNA, 22 nt, Human
uaaaggcuuuauuuuccaguca

SEQ ID NO: 25527 - RNA, 22 nt, Human
uaaaggguagguuuuacuguaa

SEQ ID NO: 25528 - RNA, 22 nt, Human
uaaagguaacaugaacugcuuu

SEQ ID NO: 25529 - RNA, 22 nt, Human
uaaagguaugucuuaaucaaac

SEQ ID NO: 25530 - RNA, 22 nt, Human
uaaaggucaagagaugcugucu

SEQ ID NO: 25531 - RNA, 22 nt, Human
uaaagguccaaagagggcuacg

SEQ ID NO: 25532 - RNA, 22 nt, Human
uaaaguaauccuucauaaggag

SEQ ID NO: 25533 - RNA, 22 nt, Human
uaaaguauccaguuauucuucu

SEQ ID NO: 25534 - RNA, 22 nt, Human
uaaauaggguaagcguguuuac

SEQ ID NO: 25535 - RNA, 18 nt, Human
uaaauauauuucccccuu

SEQ ID NO: 25536 - RNA, 22 nt, Human
uaaauaucaguccagcucuucc

SEQ ID NO: 25537 - RNA, 22 nt, Human
uaaaucacaaauuuucucauuu

SEQ ID NO: 25538 - RNA, 22 nt, Human
uaaaucacaucgaaaucugggu

SEQ ID NO: 25539 - RNA, 22 nt, Human
uaaaucacauucgucugcuccu

SEQ ID NO: 25540 - RNA, 22 nt, Human
uaaaucagccuuugcuauuuua

SEQ ID NO: 25541 - RNA, 22 nt, Human
uaaauccagcuucuaauuuaga

SEQ ID NO: 25542 - RNA, 22 nt, Human
uaaauccuuaucuucuuugaau

SEQ ID NO: 25543 - RNA, 22 nt, Human
uaaaucuccuguuuuucaucua

SEQ ID NO: 25544 - RNA, 22 nt, Human
uaaaucucucaguggccagaga

SEQ ID NO: 25545 - RNA, 22 nt, Human
uaaaucuucuacaucaucauaa

SEQ ID NO: 25546 - RNA, 22 nt, Human
uaaaugauaauaaugcuagugu

SEQ ID NO: 25547 - RNA, 22 nt, Human
uaaaugcagauuccugagccua

SEQ ID NO: 25548 - RNA, 22 nt, Human
uaaaugcagcaguuucuguucu

SEQ ID NO: 25549 - RNA, 22 nt, Human
uaaaugccauucguuucauaca

SEQ ID NO: 25550 - RNA, 22 nt, Human
uaaaugcuuagauucauagaaa

SEQ ID NO: 25551 - RNA, 22 nt, Human
uaaaugcuuucuaugaaagagg

SEQ ID NO: 25552 - RNA, 22 nt, Human
uaaauggcaaccccuagagcug

SEQ ID NO: 25553 - RNA, 22 nt, Human
uaaauguaaauggcgucuugcg

SEQ ID NO: 25554 - RNA, 21 nt, Human
uaaaugugagcagggcugggc

SEQ ID NO: 25555 - RNA, 22 nt, Human
uaaaugugcacagguuagaagg

SEQ ID NO: 25556 - RNA, 22 nt, Human
uaaaugugucuauggacccgcc

SEQ ID NO: 25557 - RNA, 22 nt, Human
uaaauguguguagccaucugug

SEQ ID NO: 25558 - RNA, 22 nt, Human
uaaauguuuuguggguugaguu

SEQ ID NO: 25559 - RNA, 22 nt, Human
uaaauuaaagauuggagaagga

SEQ ID NO: 25560 - RNA, 22 nt, Human
uaaauuagggacuuuaguuaau

SEQ ID NO: 25561 - RNA, 22 nt, Human
uaaauucacuccugguagaccu

SEQ ID NO: 25562 - RNA, 23 nt, Human
uaaauugaugguauggguuaagc

SEQ ID NO: 25563 - RNA, 22 nt, Human
uaaauuguccucccccugguau

SEQ ID NO: 25564 - RNA, 22 nt, Human
uaaauuuuuguuaacagccucu

SEQ ID NO: 25565 - RNA, 22 nt, Human
uaacaaacuggaaauugacauu

SEQ ID NO: 25566 - RNA, 22 nt, Human
uaacaacuggacaauguugcuc

SEQ ID NO: 25567 - RNA, 22 nt, Human
uaacaaggagauggugggucau

SEQ ID NO: 25568 - RNA, 22 nt, Human
uaacaagguaagccuggccaug

SEQ ID NO: 25569 - RNA, 22 nt, Human
uaacaauaguguuugcuaguca

SEQ ID NO: 25570 - RNA, 21 nt, Human
uaacaaucucuacuucucauu

SEQ ID NO: 25571 - RNA, 22 nt, Human
uaacacaaaagaauaugugugu

SEQ ID NO: 25572 - RNA, 22 nt, Human
uaacacaugaaagcaccuucuu

SEQ ID NO: 25573 - RNA, 22 nt, Human
uaacacaugguucugucaggaa

SEQ ID NO: 25574 - RNA, 22 nt, Human
uaacacaugucugggaugugaa

SEQ ID NO: 25575 - RNA, 22 nt, Human
uaacacauuuuccucauacgga

SEQ ID NO: 25576 - RNA, 22 nt, Human
uaacacugccaugcuggaguca

SEQ ID NO: 25577 - RNA, 22 nt, Human
uaaaugugucuuuuuaaggccu

SEQ ID NO: 25578 - RNA, 22 nt, Human
uaaauguguuguggaugaaguu

SEQ ID NO: 25579 - RNA, 22 nt, Human
uaaauguuuagucuuauuuggg

SEQ ID NO: 25580 - RNA, 22 nt, Human
uaaauuacccuuuagggaauug

SEQ ID NO: 25581 - RNA, 23 nt, Human
uaaauuaccuuuccagugcaggg

SEQ ID NO: 25582 - RNA, 22 nt, Human
uaaauuacucaaugcacauaaa

SEQ ID NO: 25583 - RNA, 22 nt, Human
uaaauuagagccagguaaguuu

SEQ ID NO: 25584 - RNA, 22 nt, Human
uaaauucuacaacuucaaagau

SEQ ID NO: 25585 - RNA, 22 nt, Human
uaaauugagauuauuaggguaa

SEQ ID NO: 25586 - RNA, 22 nt, Human
uaaauugaucguuugggaugaa

SEQ ID NO: 25587 - RNA, 22 nt, Human
uaaauugcauaaguacaaauga

SEQ ID NO: 25588 - RNA, 22 nt, Human
uaaauugcugauuuuagaugcu

SEQ ID NO: 25589 - RNA, 18 nt, Human
uaaauugcuucaccugag

SEQ ID NO: 25590 - RNA, 22 nt, Human
uaaauuguguguugcuagggga

SEQ ID NO: 25591 - RNA, 22 nt, Human
uaaauuguuuucuagaaguugu

SEQ ID NO: 25592 - RNA, 22 nt, Human
uaacaaagguugccaaacuaag

SEQ ID NO: 25593 - RNA, 22 nt, Human
uaacaaaguauuguuuguguau

SEQ ID NO: 25594 - RNA, 22 nt, Human
uaacaacaugcaauuuaaccuu

SEQ ID NO: 25595 - RNA, 22 nt, Human
uaacaacucaguuuguuccuug

SEQ ID NO: 25596 - RNA, 23 nt, Human
uaacaagaaccucaugugacuuu

SEQ ID NO: 25597 - RNA, 22 nt, Human
uaacaagauuuguaaaauugua

SEQ ID NO: 25598 - RNA, 22 nt, Human
uaacaagguggucuugguauuu

SEQ ID NO: 25599 - RNA, 22 nt, Human
uaacaagucauuuuaaauuaug

SEQ ID NO: 25600 - RNA, 21 nt, Human
uaacaagucugcauacauuca

SEQ ID NO: 25601 - RNA, 22 nt, Human
uaacaaugauuagugacuacag

SEQ ID NO: 25602 - RNA, 22 nt, Human
uaacaauucucaaaagagggga

SEQ ID NO: 25603 - RNA, 20 nt, Human
uaacacagaaagcuuccuuc

SEQ ID NO: 25604 - RNA, 22 nt, Human
uaacacagacagccacuaguaa

SEQ ID NO: 25605 - RNA, 22 nt, Human
uaacacaguguccucagaaaca

SEQ ID NO: 25606 - RNA, 22 nt, Human
uaacacauaagcugagaccaug

SEQ ID NO: 25607 - RNA, 22 nt, Human
uaacacuaagaaucuaaauuua

SEQ ID NO: 25608 - RNA, 22 nt, Human
uaacacuggagaguugguugug

SEQ ID NO: 25609 - RNA, 22 nt, Human
uaacacuggcuuuugcugaggc

SEQ ID NO: 25610 - RNA, 22 nt, Human
uaacacuguaaaccuagauguu

SEQ ID NO: 25611 - RNA, 22 nt, Human
uaacacugugcccagaguccca

SEQ ID NO: 25612 - RNA, 22 nt, Human
uaacacugugguguucuuuguc

SEQ ID NO: 25613 - RNA, 22 nt, Human
uaacacuucagaugauuuuguu

SEQ ID NO: 25614 - RNA, 22 nt, Human
uaacacuugaagccauuuuugc

SEQ ID NO: 25615 - RNA, 22 nt, Human
uaacagaaaagaacugaguuug

SEQ ID NO: 25616 - RNA, 22 nt, Human
uaacagaagagcaggcagcccu

SEQ ID NO: 25617 - RNA, 22 nt, Human
uaacagaaguuguucauugugg

SEQ ID NO: 25618 - RNA, 22 nt, Human
uaacagcauaugaaauuacugg

SEQ ID NO: 25619 - RNA, 20 nt, Human
uaacaggaagcauuauuuua

SEQ ID NO: 25620 - RNA, 22 nt, Human
uaacaggaugacagcagacauu

SEQ ID NO: 25621 - RNA, 22 nt, Human
uaacaguauccccauuugcaag

SEQ ID NO: 25622 - RNA, 22 nt, Human
uaacaguauugaagauaaacua

SEQ ID NO: 25623 - RNA, 22 nt, Human
uaacagucaugugcuacugcua

SEQ ID NO: 25624 - RNA, 22 nt, Human
uaacagugaccugaaugucaau

SEQ ID NO: 25625 - RNA, 22 nt, Human
uaacaguguggacuugagaucu

SEQ ID NO: 25626 - RNA, 20 nt, Human
uaacaguugaagaacaagga

SEQ ID NO: 25627 - RNA, 22 nt, Human
uaacaguuuugaguuuugcuuc

SEQ ID NO: 25628 - RNA, 22 nt, Human
uaacauauuguguggcacuagg

SEQ ID NO: 25629 - RNA, 22 nt, Human
uaacauccacauuagaugauuc

SEQ ID NO: 25630 - RNA, 18 nt, Human
uaacaucggcuaugcauc

SEQ ID NO: 25631 - RNA, 22 nt, Human
uaacaucuaagggagagaaagu

SEQ ID NO: 25632 - RNA, 22 nt, Human
uaacaucucccugacuuuugcu

SEQ ID NO: 25633 - RNA, 22 nt, Human
uaacaucuugcaguagcagaac

SEQ ID NO: 25634 - RNA, 22 nt, Human
uaacaucuuuagcagcucgaac

SEQ ID NO: 25635 - RNA, 22 nt, Human
uaacaugaaacuccaaauggua

SEQ ID NO: 25636 - RNA, 22 nt, Human
uaacaugagagcuaagacauua

SEQ ID NO: 25637 - RNA, 22 nt, Human
uaacaugcuaauuugcagauag

SEQ ID NO: 25638 - RNA, 22 nt, Human
uaacaugucccugauucuuugu

SEQ ID NO: 25639 - RNA, 22 nt, Human
uaacauguuaagaaauuagaua

SEQ ID NO: 25640 - RNA, 22 nt, Human
uaacauguuuguacacugaaac

SEQ ID NO: 25641 - RNA, 22 nt, Human
uaacauuaaaagagauaauuga

SEQ ID NO: 25642 - RNA, 22 nt, Human
uaaccagacagaaacagcuaga

SEQ ID NO: 25643 - RNA, 22 nt, Human
uaaccauauucacacuaugccc

SEQ ID NO: 25644 - RNA, 22 nt, Human
uaaccugcaacagaucugucuu

SEQ ID NO: 25645 - RNA, 22 nt, Human
uaaccuguuaagggcugaccca

SEQ ID NO: 25646 - RNA, 22 nt, Human
uaaccuuugaccuugcuugugc

SEQ ID NO: 25647 - RNA, 22 nt, Human
uaaccuuuggugaaauauuaac

SEQ ID NO: 25648 - RNA, 22 nt, Human
uaaccuuuuuaucuuaccucca

SEQ ID NO: 25649 - RNA, 22 nt, Human
uaacuaacuaguguucaaaaua

SEQ ID NO: 25650 - RNA, 22 nt, Human
uaacuagaagaaugcaccaaga

SEQ ID NO: 25651 - RNA, 22 nt, Human
uaacuccacaccccucuuggug

SEQ ID NO: 25652 - RNA, 22 nt, Human
uaacuccagagaauccauccau

SEQ ID NO: 25653 - RNA, 22 nt, Human
uaacuccaucucugugucugcu

SEQ ID NO: 25654 - RNA, 22 nt, Human
uaggaagaagcagccuugcuua

SEQ ID NO: 25655 - RNA, 22 nt, Human
uaggaagcacuuaaagaauuug

SEQ ID NO: 25656 - RNA, 22 nt, Human
uaggaagcucuuuguuuuguga

SEQ ID NO: 25657 - RNA, 18 nt, Human
uaggaagcuuaauguuuu

SEQ ID NO: 25658 - RNA, 22 nt, Human
uaggaaguaaacuuucuucagc

SEQ ID NO: 25659 - RNA, 22 nt, Human
uaggaauccagaucuagacugu

SEQ ID NO: 25660 - RNA, 22 nt, Human
uaggaaugaagaaguaugauau

SEQ ID NO: 25661 - RNA, 22 nt, Human
uaggaaugauuggaauuccagg

SEQ ID NO: 25662 - RNA, 22 nt, Human
uaggaaugucuaugcagugagg

SEQ ID NO: 25663 - RNA, 22 nt, Human
uaggaauugcccgugggguccu

SEQ ID NO: 25664 - RNA, 22 nt, Human
uaggacagagauuuguuuuaug

SEQ ID NO: 25665 - RNA, 21 nt, Human
uaggacagccccccugcccuc

SEQ ID NO: 25666 - RNA, 22 nt, Human
uaggacaguggagauaaccaga

SEQ ID NO: 25667 - RNA, 22 nt, Human
uaggacaguuauggguuuuauu

SEQ ID NO: 25668 - RNA, 22 nt, Human
uaggaccaaguggagugcaggu

SEQ ID NO: 25669 - RNA, 22 nt, Human
uaggacuuggugacucucaaug

SEQ ID NO: 25670 - RNA, 22 nt, Human
uaggacuuuggcgucagaacug

SEQ ID NO: 25671 - RNA, 17 nt, Human
uaggagacuggcugucc

SEQ ID NO: 25672 - RNA, 20 nt, Human
uaggagcaaugagaguagaa

SEQ ID NO: 25673 - RNA, 22 nt, Human
uaggagcuaaaauauuuuauau

SEQ ID NO: 25674 - RNA, 23 nt, Human
uaggaggagaccgcaguguuacc

SEQ ID NO: 25675 - RNA, 18 nt, Human
uaggaggauacugagaug

SEQ ID NO: 25676 - RNA, 22 nt, Human
uaggaggcauuugcucccaggg

SEQ ID NO: 25677 - RNA, 22 nt, Human
uaggaggcuuaaagcugcucag

SEQ ID NO: 25678 - RNA, 22 nt, Human
uaggaguaggaguggccauccc

SEQ ID NO: 25679 - RNA, 22 nt, Human
uaggauaggauggagacagaau

SEQ ID NO: 25680 - RNA, 22 nt, Human
uaggauaugguagaaaucauuc

SEQ ID NO: 25681 - RNA, 22 nt, Human
uaggaucucaccauagaaggaa

SEQ ID NO: 25682 - RNA, 22 nt, Human
uaggaugacacagcaaguauag

SEQ ID NO: 25683 - RNA, 22 nt, Human
uaggaugguacaaggcaggggu

SEQ ID NO: 25684 - RNA, 22 nt, Human
uaggaugugccaggaaagaaag

SEQ ID NO: 25685 - RNA, 22 nt, Human
uaggauuuacuuugacaauauu

SEQ ID NO: 25686 - RNA, 22 nt, Human
ugaggagccacucuagcaguca

SEQ ID NO: 25687 - RNA, 22 nt, Human
ugaggaugacgauggcaauggc

SEQ ID NO: 25688 - RNA, 19 nt, Human
ugaggauugagguccagua

SEQ ID NO: 25689 - RNA, 22 nt, Human
ugaggauuggcaaaacucaggg

SEQ ID NO: 25690 - RNA, 22 nt, Human
ugaggauuuaaugggacucauu

SEQ ID NO: 25691 - RNA, 17 nt, Human
ugaggcaaccaucacua

SEQ ID NO: 25692 - RNA, 22 nt, Human
ugaggcaagaguuugauuagag

SEQ ID NO: 25693 - RNA, 19 nt, Human
ugaggcaagcuuuuucuug

SEQ ID NO: 25694 - RNA, 22 nt, Human
ugaggcacuccaggaugcuguu

SEQ ID NO: 25695 - RNA, 22 nt, Human
ugaggcagaaaauagcaguuca

SEQ ID NO: 25696 - RNA, 22 nt, Human
ugaggcagcaauugauuauuca

SEQ ID NO: 25697 - RNA, 22 nt, Human
ugaggcagcauucuucaagaca

SEQ ID NO: 25698 - RNA, 22 nt, Human
ugaggcagccugcauuaaagag

SEQ ID NO: 25699 - RNA, 22 nt, Human
ugaggcaggaaguuauauaaug

SEQ ID NO: 25700 - RNA, 22 nt, Human
ugaggcaggagaaucaccggaa

SEQ ID NO: 25701 - RNA, 22 nt, Human
ugaggcaggagguugagaacug

SEQ ID NO: 25702 - RNA, 18 nt, Human
ugaggcagucagugaugg

SEQ ID NO: 25703 - RNA, 22 nt, Human
ugaggcagugugagauaauaaa

SEQ ID NO: 25704 - RNA, 22 nt, Human
ugaggcaugguccugagggagc

SEQ ID NO: 25705 - RNA, 22 nt, Human
ugaggccaacuagggagaugga

SEQ ID NO: 25706 - RNA, 22 nt, Human
ugaggccaagccuccucugcca

SEQ ID NO: 25707 - RNA, 22 nt, Human
ugaggccaaugacccugggcag

SEQ ID NO: 25708 - RNA, 22 nt, Human
ugaggccacaggaaagggcccg

SEQ ID NO: 25709 - RNA, 22 nt, Human
ugaggccagagaguuugcauuu

SEQ ID NO: 25710 - RNA, 19 nt, Human
ugaggccagcuggcauuuu

SEQ ID NO: 25711 - RNA, 22 nt, Human
ugaggccagugacauauauuaa

SEQ ID NO: 25712 - RNA, 22 nt, Human
ugaggccauggaacuagcuugg

SEQ ID NO: 25713 - RNA, 22 nt, Human
ugaggccuaccccccuguguuu

SEQ ID NO: 25714 - RNA, 22 nt, Human
ugaggccucauuuagggagagg

SEQ ID NO: 25715 - RNA, 22 nt, Human
ugaggccucugaggccuaggcu

SEQ ID NO: 25716 - RNA, 22 nt, Human
ugaggccugaagccuggagccu

SEQ ID NO: 25717 - RNA, 22 nt, Human
ugaggccugggcacauaaccuc

SEQ ID NO: 25718 - RNA, 22 nt, Human
ugaggcucaagaauagacagua

SEQ ID NO: 25719 - RNA, 22 nt, Human
ugaggcucagaagugccaagug

SEQ ID NO: 25720 - RNA, 17 nt, Human
ugaggcucggugaggag

SEQ ID NO: 25721 - RNA, 22 nt, Human
ugaggcucuaugugguagauua

SEQ ID NO: 25722 - RNA, 22 nt, Human
ugaggcucugcuucuguggcuc

SEQ ID NO: 25723 - RNA, 22 nt, Human
ugaggcugacaaaagaugaggu

SEQ ID NO: 25724 - RNA, 22 nt, Human
ugaggcuggaugggaugccucc

SEQ ID NO: 25725 - RNA, 22 nt, Human
ugaggcuuagauuugguaacuc

SEQ ID NO: 25726 - RNA, 22 nt, Human
ugaggcuuggagaggucaggga

SEQ ID NO: 25727 - RNA, 22 nt, Human
ugagggaauccucacaucaauc

SEQ ID NO: 25728 - RNA, 22 nt, Human
ugagggacaccagggcuggagc

SEQ ID NO: 25729 - RNA, 22 nt, Human
ugagggccgaggagcugugggu

SEQ ID NO: 25730 - RNA, 22 nt, Human
ugagggcugcuuccagagcuag

SEQ ID NO: 25731 - RNA, 22 nt, Human
ugaggggaacugaugcccauug

SEQ ID NO: 25732 - RNA, 19 nt, Human
ugaggggaggagaggccug

SEQ ID NO: 25733 - RNA, 22 nt, Human
ugaggggccagaccccaccuag

SEQ ID NO: 25734 - RNA, 22 nt, Human
ugaggggccgcccaagcacuuc

SEQ ID NO: 25735 - RNA, 22 nt, Human
ugaggggcgcuggcagguuccu

SEQ ID NO: 25736 - RNA, 22 nt, Human
ugaggggcggccugcagaggcc

SEQ ID NO: 25737 - RNA, 21 nt, Human
ugagggguuauaacagggugg

SEQ ID NO: 25738 - RNA, 22 nt, Human
ugagggguugugagaaauguag

SEQ ID NO: 25739 - RNA, 22 nt, Human
ugaggguaaccuggagcugcug

SEQ ID NO: 25740 - RNA, 22 nt, Human
ugaggguagaggcaggagugca

SEQ ID NO: 25741 - RNA, 22 nt, Human
ugaggguauauauuguguggag

SEQ ID NO: 25742 - RNA, 22 nt, Human
ugagggugggccugcaggaaga

SEQ ID NO: 25743 - RNA, 22 nt, Human
ugagguaaauagaaaaaccaug

SEQ ID NO: 25744 - RNA, 22 nt, Human
ugagguaggaggauugauugag

SEQ ID NO: 25745 - RNA, 22 nt, Human
ugagguaggcuugagaugggag

SEQ ID NO: 25746 - RNA, 22 nt, Human
ugagguagggaaggcugguauu

SEQ ID NO: 25747 - RNA, 22 nt, Human
ugagguaggugucgagagaggu

SEQ ID NO: 25748 - RNA, 22 nt, Human
ugagguagguugaaagauagau

SEQ ID NO: 25749 - RNA, 22 nt, Human
ugagguaguaaagguguuaguu

SEQ ID NO: 25750 - RNA, 22 nt, Human
ugagguaguagauuuuugucca

SEQ ID NO: 25751 - RNA, 22 nt, Human
ugagguaguuuguuguacagua

SEQ ID NO: 25752 - RNA, 22 nt, Human
ugagguaugagugugccaggug

SEQ ID NO: 25753 - RNA, 22 nt, Human
ugagguauuuuuuaaagcacaa

SEQ ID NO: 25754 - RNA, 22 nt, Human
ugaggucauggcugauauuucc

SEQ ID NO: 25755 - RNA, 22 nt, Human
ugaggucugcagggcugugcau

SEQ ID NO: 25756 - RNA, 16 nt, Human
ugaggucuuauuagca

SEQ ID NO: 25757 - RNA, 22 nt, Human
ugaggucuuuuauaguguguca

SEQ ID NO: 25758 - RNA, 22 nt, Human
ugaggugaauggugucccugga

SEQ ID NO: 25759 - RNA, 22 nt, Human
ugaggugacaauucauucucca

SEQ ID NO: 25760 - RNA, 22 nt, Human
ugaggugccacccaagagccuu

SEQ ID NO: 25761 - RNA, 22 nt, Human
ugagguggccgaggagcaggac

SEQ ID NO: 25762 - RNA, 22 nt, Human
ugagguggcuggaucucagccu

SEQ ID NO: 25763 - RNA, 22 nt, Human
ugaggugggugucaggucagag

SEQ ID NO: 25764 - RNA, 22 nt, Human
ugagguggugcuaaucucugcu

SEQ ID NO: 25765 - RNA, 22 nt, Human
ugagguuauuuauuaugcauga

SEQ ID NO: 25766 - RNA, 22 nt, Human
ugaguaaaaauucuacauuucc

SEQ ID NO: 25767 - RNA, 22 nt, Human
ugaguaaauauuuaugacuaga

SEQ ID NO: 25768 - RNA, 22 nt, Human
ugaguacugauuuaagauacac

SEQ ID NO: 25769 - RNA, 22 nt, Human
ugaguaggaaaggaaauguuuu

SEQ ID NO: 25770 - RNA, 22 nt, Human
ugaguaucaauuacauaguugu

SEQ ID NO: 25771 - RNA, 22 nt, Human
uaacucugaauccucacagcag

SEQ ID NO: 25772 - RNA, 20 nt, Human
uaacugaucauuuucaccag

SEQ ID NO: 25773 - RNA, 22 nt, Human
uaacugcacugacagugaguga

SEQ ID NO: 25774 - RNA, 22 nt, Human
uaacugccagcagcgaugaaca

SEQ ID NO: 25775 - RNA, 22 nt, Human
uaacugguacucugguagccug

SEQ ID NO: 25776 - RNA, 22 nt, Human
uaacugguccucggauguugug

SEQ ID NO: 25777 - RNA, 22 nt, Human
uaacugguccugaacagcccag

SEQ ID NO: 25778 - RNA, 19 nt, Human
uaacuggugccuucaguca

SEQ ID NO: 25779 - RNA, 22 nt, Human
uaacuguagcuaaccgaugaga

SEQ ID NO: 25780 - RNA, 22 nt, Human
uaacuguauagcuuggacuaaa

SEQ ID NO: 25781 - RNA, 23 nt, Human
uaacuuacaucauucugcacaag

SEQ ID NO: 25782 - RNA, 22 nt, Human
uaacuuagaaguuuaauuguau

SEQ ID NO: 25783 - RNA, 22 nt, Human
uaacuucugcacagaaaauuug

SEQ ID NO: 25784 - RNA, 22 nt, Human
uaacuugaccuguauaaaacac

SEQ ID NO: 25785 - RNA, 19 nt, Human
uaacuuguagauaugaagu

SEQ ID NO: 25786 - RNA, 22 nt, Human
uaacuuuaguguaugagguaag

SEQ ID NO: 25787 - RNA, 22 nt, Human
uaacuuugauaagaaucaggga

SEQ ID NO: 25788 - RNA, 22 nt, Human
uaacuuuggggacacuucucuu

SEQ ID NO: 25789 - RNA, 15 nt, Human
uaacuuuuuugggcu

SEQ ID NO: 25790 - RNA, 22 nt, Human
uaagaaacaugauacuuuuccu

SEQ ID NO: 25791 - RNA, 22 nt, Human
uaagaaacccaggaauuucuua

SEQ ID NO: 25792 - RNA, 22 nt, Human
uaagaaacugucacaguacuau

SEQ ID NO: 25793 - RNA, 23 nt, Human
uaagaacagacaagcauuuacau

SEQ ID NO: 25794 - RNA, 22 nt, Human
uaagaacaguagaacaguaggu

SEQ ID NO: 25795 - RNA, 22 nt, Human
uaauagaauaguggaaacauug

SEQ ID NO: 25796 - RNA, 22 nt, Human
uaauagcauuaucaucaaaacu

SEQ ID NO: 25797 - RNA, 22 nt, Human
uaauaggagccaggucacauag

SEQ ID NO: 25798 - RNA, 22 nt, Human
uaauauaccaaacuguaauuuu

SEQ ID NO: 25799 - RNA, 22 nt, Human
uaauauacuucccauaguuuga

SEQ ID NO: 25800 - RNA, 22 nt, Human
uaauaucuacuucauagaguuu

SEQ ID NO: 25801 - RNA, 22 nt, Human
uaaucacagaaacagacuguuu

SEQ ID NO: 25802 - RNA, 22 nt, Human
uaaucacugugagucuguuuuc

SEQ ID NO: 25803 - RNA, 22 nt, Human
uaaucauauggguaauccaaug

SEQ ID NO: 25804 - RNA, 22 nt, Human
uaauccaaaacugaaucugugg

SEQ ID NO: 25805 - RNA, 22 nt, Human
uaauccacggaccggcagcauu

SEQ ID NO: 25806 - RNA, 22 nt, Human
uaauccaggguauucuaguuuc

SEQ ID NO: 25807 - RNA, 22 nt, Human
uaauccuucuuguguucauuag

SEQ ID NO: 25808 - RNA, 22 nt, Human
uaaucguauguguaucaaauca

SEQ ID NO: 25809 - RNA, 22 nt, Human
uaaucuaccacuauugcaauau

SEQ ID NO: 25810 - RNA, 22 nt, Human
uaaucuacuguuuauaugaaau

SEQ ID NO: 25811 - RNA, 22 nt, Human
uaaucuaucaagcaacaaagug

SEQ ID NO: 25812 - RNA, 22 nt, Human
uaaucucuuuaugagaagaagg

SEQ ID NO: 25813 - RNA, 22 nt, Human
uaaucuguaauuuuugcaauag

SEQ ID NO: 25814 - RNA, 22 nt, Human
uaaucuguuaauauuuguaucc

SEQ ID NO: 25815 - RNA, 18 nt, Human
uaaucuuacagacaggau

SEQ ID NO: 25816 - RNA, 22 nt, Human
uaaucuuagcaaccuccagugu

SEQ ID NO: 25817 - RNA, 21 nt, Human
uaaucuucgaaaauguauuag

SEQ ID NO: 25818 - RNA, 22 nt, Human
uaaugaacaauauaucaauagc

SEQ ID NO: 25819 - RNA, 22 nt, Human
uaaugaacaugcaucgugugua

SEQ ID NO: 25820 - RNA, 22 nt, Human
uaaugaauaaacuugagaguca

SEQ ID NO: 25821 - RNA, 22 nt, Human
uaaugacugccgucucucuuca

SEQ ID NO: 25822 - RNA, 22 nt, Human
uaaugacuugaaggacccaugg

SEQ ID NO: 25823 - RNA, 22 nt, Human
uaaugaggaaauagagggaaug

SEQ ID NO: 25824 - RNA, 22 nt, Human
uaaugaggggaaccaucuguag

SEQ ID NO: 25825 - RNA, 22 nt, Human
uaaugagucauuccugaaugcu

SEQ ID NO: 25826 - RNA, 22 nt, Human
uaaugauauuucccauuucucu

SEQ ID NO: 25827 - RNA, 22 nt, Human
uaaugcaacgugagauaauuaa

SEQ ID NO: 25828 - RNA, 22 nt, Human
uaaugcaaggaauuccaaguag

SEQ ID NO: 25829 - RNA, 22 nt, Human
uaaugcacauagaaguacuuag

SEQ ID NO: 25830 - RNA, 22 nt, Human
uaaugcacaugacugaacuauu

SEQ ID NO: 25831 - RNA, 22 nt, Human
uaaugcauguaaugggcugaua

SEQ ID NO: 25832 - RNA, 23 nt, Human
uaaugccagcccugcaguuaagc

SEQ ID NO: 25833 - RNA, 22 nt, Human
uaaugccgucucuacaagacuc

SEQ ID NO: 25834 - RNA, 22 nt, Human
uaaugccuuaugucaaauguaa

SEQ ID NO: 25835 - RNA, 22 nt, Human
uaaugcucacccugcaucaggc

SEQ ID NO: 25836 - RNA, 22 nt, Human
uaaugcuucaauuuccuugauu

SEQ ID NO: 25837 - RNA, 22 nt, Human
uaaugcuucuguuaggaucuuc

SEQ ID NO: 25838 - RNA, 22 nt, Human
uaaugcuugcaaauuaugggac

SEQ ID NO: 25839 - RNA, 22 nt, Human
uaauggaaguuaaauaugguau

SEQ ID NO: 25840 - RNA, 22 nt, Human
uaauguacaagaggcuagggug

SEQ ID NO: 25841 - RNA, 22 nt, Human
uaauguauaacaaauacucauc

SEQ ID NO: 25842 - RNA, 22 nt, Human
uaaugucaaggucauucuagag

SEQ ID NO: 25843 - RNA, 22 nt, Human
uaaugucuuaguaccuuaauuu

SEQ ID NO: 25844 - RNA, 22 nt, Human
uaaugucuucuuuuaauuuggc

SEQ ID NO: 25845 - RNA, 22 nt, Human
uaaugucuuuaagagcauuggg

SEQ ID NO: 25846 - RNA, 22 nt, Human
uaauguguugaauauuuguaca

SEQ ID NO: 25847 - RNA, 22 nt, Human
uaauuagaguuugguaaacaau

SEQ ID NO: 25848 - RNA, 22 nt, Human
uaauuauacaaaaaggcaugca

SEQ ID NO: 25849 - RNA, 23 nt, Human
uaauuauggaauaauuugcaacg

SEQ ID NO: 25850 - RNA, 22 nt, Human
uaauuauucuagucacauagca

SEQ ID NO: 25851 - RNA, 22 nt, Human
uaauuauuugaagacauuagag

SEQ ID NO: 25852 - RNA, 22 nt, Human
uaauucagggccagaaucccca

SEQ ID NO: 25853 - RNA, 22 nt, Human
uaauucuucaggccuuuugucu

SEQ ID NO: 25854 - RNA, 22 nt, Human
uaauugcagaacuuugggaggc

SEQ ID NO: 25855 - RNA, 22 nt, Human
uaauugcuauuggaaugcuuug

SEQ ID NO: 25856 - RNA, 22 nt, Human
uaauuguaaaguaguaguacag

SEQ ID NO: 25857 - RNA, 22 nt, Human
uaauuguauggagaaggcugca

SEQ ID NO: 25858 - RNA, 22 nt, Human
uaauuuaauccaaguguuacau

SEQ ID NO: 25859 - RNA, 22 nt, Human
uaauuuaauuccauggauucua

SEQ ID NO: 25860 - RNA, 22 nt, Human
uaauuuacaguucgccaugucu

SEQ ID NO: 25861 - RNA, 22 nt, Human
uaauuuauauggaauuguugcu

SEQ ID NO: 25862 - RNA, 22 nt, Human
uaauuucaaguuuagggcucua

SEQ ID NO: 25863 - RNA, 18 nt, Human
uaauuugcacaguugcaa

SEQ ID NO: 25864 - RNA, 22 nt, Human
uaauuuuccacucuguuuaucu

SEQ ID NO: 25865 - RNA, 22 nt, Human
uaauuuugcugugaccauugaa

SEQ ID NO: 25866 - RNA, 22 nt, Human
uaauuuugucacagugacaugc

SEQ ID NO: 25867 - RNA, 22 nt, Human
uacaaaacagugcucugguccu

SEQ ID NO: 25868 - RNA, 20 nt, Human
uacaaagaaugagguucagg

SEQ ID NO: 25869 - RNA, 20 nt, Human
uacaaagagccccucucuuc

SEQ ID NO: 25870 - RNA, 22 nt, Human
uacaaagauaguguuagaguaa

SEQ ID NO: 25871 - RNA, 22 nt, Human
uacaaagauggaagguuauguu

SEQ ID NO: 25872 - RNA, 22 nt, Human
uacaaagccugguagauaucug

SEQ ID NO: 25873 - RNA, 22 nt, Human
uacaaaggcagguuucccagga

SEQ ID NO: 25874 - RNA, 22 nt, Human
uacaaaggcgguuuuucugggc

SEQ ID NO: 25875 - RNA, 22 nt, Human
uacaaaggcuuaaagagauuuc

SEQ ID NO: 25876 - RNA, 22 nt, Human
uacaaagucagaauaacaggug

SEQ ID NO: 25877 - RNA, 22 nt, Human
uacaaagucccauugccaugga

SEQ ID NO: 25878 - RNA, 22 nt, Human
uacaaagugcuuuagaaaugaa

SEQ ID NO: 25879 - RNA, 22 nt, Human
uacaaagugugcccaugcugag

SEQ ID NO: 25880 - RNA, 22 nt, Human
uacaaaugaguuguaugaacca

SEQ ID NO: 25881 - RNA, 22 nt, Human
uacaaauuaaugggcauguuua

SEQ ID NO: 25882 - RNA, 20 nt, Human
uacaaauuuuccauguuucc

SEQ ID NO: 25883 - RNA, 22 nt, Human
uacaacaauuuccacauuagaa

SEQ ID NO: 25884 - RNA, 22 nt, Human
uacaacagaaguguuuauuuag

SEQ ID NO: 25885 - RNA, 22 nt, Human
uacaacagacaggaauaagauu

SEQ ID NO: 25886 - RNA, 22 nt, Human
uacaacaggaauuucaacuuug

SEQ ID NO: 25887 - RNA, 22 nt, Human
uacaacugcacaucugaaucac

SEQ ID NO: 25888 - RNA, 22 nt, Human
uauagacuugaugguauuaagu

SEQ ID NO: 25889 - RNA, 20 nt, Human
uauagaucacaucuucuagc

SEQ ID NO: 25890 - RNA, 22 nt, Human
uauagcaagcaggacagucuca

SEQ ID NO: 25891 - RNA, 22 nt, Human
uauagcauauacagauaagcug

SEQ ID NO: 25892 - RNA, 22 nt, Human
uauagcuaaggucagacuguuu

SEQ ID NO: 25893 - RNA, 22 nt, Human
uauaggaaauaggucuucugug

SEQ ID NO: 25894 - RNA, 22 nt, Human
uauaggaacagcuagcacagaa

SEQ ID NO: 25895 - RNA, 22 nt, Human
uauaggaaguaauuguugccug

SEQ ID NO: 25896 - RNA, 22 nt, Human
uauaggaaguauucaaagacug

SEQ ID NO: 25897 - RNA, 21 nt, Human
uauaggaaucagucacaucug

SEQ ID NO: 25898 - RNA, 22 nt, Human
uauaggaaugacgucauuuccu

SEQ ID NO: 25899 - RNA, 22 nt, Human
uauaggaccgacuuguuuauag

SEQ ID NO: 25900 - RNA, 22 nt, Human
uauaggcuuuuguugcagaaca

SEQ ID NO: 25901 - RNA, 22 nt, Human
uauagugugugagagagugaaa

SEQ ID NO: 25902 - RNA, 22 nt, Human
uauauaacuacuauuuugcuca

SEQ ID NO: 25903 - RNA, 22 nt, Human
uauauacuuucuuccuggguag

SEQ ID NO: 25904 - RNA, 22 nt, Human
ucaagguucaaggcuggcuucu

SEQ ID NO: 25905 - RNA, 22 nt, Human
ucaagguugccaggaaggaaga

SEQ ID NO: 25906 - RNA, 22 nt, Human
ucaaguagaacuauaaugaugu

SEQ ID NO: 25907 - RNA, 22 nt, Human
ucaaguuaccuggucauuacua

SEQ ID NO: 25908 - RNA, 22 nt, Human
ucaaguucacagucuggucgcu

SEQ ID NO: 25909 - RNA, 22 nt, Human
ucaauaaaauuguuuuccuauc

SEQ ID NO: 25910 - RNA, 23 nt, Human
ucaauaacucggguuaaaauaga

SEQ ID NO: 25911 - RNA, 22 nt, Human
ucaauaaggcaacauuaaguua

SEQ ID NO: 25912 - RNA, 22 nt, Human
uaccuuggguugaguucauucu

SEQ ID NO: 25913 - RNA, 22 nt, Human
uacgacacaucugaucucaaaa

SEQ ID NO: 25914 - RNA, 22 nt, Human
uacgcgaagaaggaccugaugg

SEQ ID NO: 25915 - RNA, 21 nt, Human
uacgugugugcauguuuauau

SEQ ID NO: 25916 - RNA, 22 nt, Human
uacuaaaugauuaagcaggaau

SEQ ID NO: 25917 - RNA, 22 nt, Human
uacuaacuuguacacagccuaa

SEQ ID NO: 25918 - RNA, 22 nt, Human
uacuacuuucccccacauauuu

SEQ ID NO: 25919 - RNA, 17 nt, Human
uacuagaauagagacag

SEQ ID NO: 25920 - RNA, 23 nt, Human
uacuauaacgcugugucagcucc

SEQ ID NO: 25921 - RNA, 22 nt, Human
uacuauugaaucauugucaauc

SEQ ID NO: 25922 - RNA, 22 nt, Human
uacucacauucuguuucuugcu

SEQ ID NO: 25923 - RNA, 22 nt, Human
uacucauuucaaacagcacaaa

SEQ ID NO: 25924 - RNA, 22 nt, Human
uacuccagacauucuguccucg

SEQ ID NO: 25925 - RNA, 22 nt, Human
uacugaaaacugagucuuccgu

SEQ ID NO: 25926 - RNA, 22 nt, Human
uacugaaaagccacaaggacca

SEQ ID NO: 25927 - RNA, 22 nt, Human
uacugaaaauccugccuguccu

SEQ ID NO: 25928 - RNA, 22 nt, Human
uacugaaacuuuucuucaacug

SEQ ID NO: 25929 - RNA, 22 nt, Human
uacugaaagagugguggacucu

SEQ ID NO: 25930 - RNA, 22 nt, Human
uacugaaagucuguggguccuc

SEQ ID NO: 25931 - RNA, 22 nt, Human
uacugaaggacuugaggguuuc

SEQ ID NO: 25932 - RNA, 22 nt, Human
uacugcauaacuggcauguggg

SEQ ID NO: 25933 - RNA, 22 nt, Human
uacugcaucgaaaugcuuuuau

SEQ ID NO: 25934 - RNA, 22 nt, Human
uacugcaugaaggcaccuauuu

SEQ ID NO: 25935 - RNA, 22 nt, Human
uacugcauuaaauuuagguuau

SEQ ID NO: 25936 - RNA, 22 nt, Human
uacugccugggggagacagcug

SEQ ID NO: 25937 - RNA, 22 nt, Human
uacugcuagaugaaaauguagg

SEQ ID NO: 25938 - RNA, 22 nt, Human
uacugcugauuagagcugaggu

SEQ ID NO: 25939 - RNA, 20 nt, Human
uacuggaaauuucuccaccu

SEQ ID NO: 25940 - RNA, 22 nt, Human
uacuggagauggaaugcuuuug

SEQ ID NO: 25941 - RNA, 22 nt, Human
uacuggagucagaaaugccuug

SEQ ID NO: 25942 - RNA, 22 nt, Human
uacuggcaauuucauauggugc

SEQ ID NO: 25943 - RNA, 22 nt, Human
uacuguaggugggucacuagua

SEQ ID NO: 25944 - RNA, 23 nt, Human
uacuguauauuacuguguuauac

SEQ ID NO: 25945 - RNA, 22 nt, Human
uacuguaugauuucauguauau

SEQ ID NO: 25946 - RNA, 22 nt, Human
uacuguauuugauaagugaagu

SEQ ID NO: 25947 - RNA, 22 nt, Human
uacugucauuagcauuaacuuu

SEQ ID NO: 25948 - RNA, 22 nt, Human
uacugucuaauaagauugaugg

SEQ ID NO: 25949 - RNA, 22 nt, Human
uacugucucugcccuggccagg

SEQ ID NO: 25950 - RNA, 23 nt, Human
uacugucuucuauuaaguaagga

SEQ ID NO: 25951 - RNA, 22 nt, Human
uacugugguuacugcuauuaga

SEQ ID NO: 25952 - RNA, 22 nt, Human
uacugugucuuaggauguggaa

SEQ ID NO: 25953 - RNA, 22 nt, Human
uacugugugacccuggguaggu

SEQ ID NO: 25954 - RNA, 22 nt, Human
uacuguguugugcugaaaggga

SEQ ID NO: 25955 - RNA, 22 nt, Human
uacuguuagagccagaaaccua

SEQ ID NO: 25956 - RNA, 22 nt, Human
uacuguuucaagcccucacaga

SEQ ID NO: 25957 - RNA, 22 nt, Human
uacuguuucuacuacuuaggga

SEQ ID NO: 25958 - RNA, 22 nt, Human
uacuguuugcaguuugcaguau

SEQ ID NO: 25959 - RNA, 22 nt, Human
uacuuaaaacugauagaaucuc

SEQ ID NO: 25960 - RNA, 22 nt, Human
uacuuacaguuacggcaagugg

SEQ ID NO: 25961 - RNA, 23 nt, Human
uacuuaggaauggggacggcaag

SEQ ID NO: 25962 - RNA, 22 nt, Human
uacuuauaaggaggcacacaaa

SEQ ID NO: 25963 - RNA, 19 nt, Human
uacuuauuagaaauauggg

SEQ ID NO: 25964 - RNA, 22 nt, Human
uacuuauugguucagaaguuua

SEQ ID NO: 25965 - RNA, 22 nt, Human
uacuucaaacaaugguacaaac

SEQ ID NO: 25966 - RNA, 22 nt, Human
uacuucaacaccauaugguccu

SEQ ID NO: 25967 - RNA, 22 nt, Human
uacuucaauuauaugccaguua

SEQ ID NO: 25968 - RNA, 22 nt, Human
uacuucaauuuguauaugugaa

SEQ ID NO: 25969 - RNA, 22 nt, Human
uacuucauuccuuuguaaaaug

SEQ ID NO: 25970 - RNA, 22 nt, Human
uacuuccagcaaucugcauauu

SEQ ID NO: 25971 - RNA, 22 nt, Human
uacuucuagccugccccuugug

SEQ ID NO: 25972 - RNA, 22 nt, Human
uacuucugccuuagagaacacu

SEQ ID NO: 25973 - RNA, 22 nt, Human
uacuucuguuagcucugagagu

SEQ ID NO: 25974 - RNA, 22 nt, Human
uacuugcuguuaguauuuuaca

SEQ ID NO: 25975 - RNA, 23 nt, Human
uacuugguuuugauagaaaucca

SEQ ID NO: 25976 - RNA, 22 nt, Human
uacuuguguucuacuagagaaa

SEQ ID NO: 25977 - RNA, 22 nt, Human
uacuuuaaagagguguaaugag

SEQ ID NO: 25978 - RNA, 22 nt, Human
uacuuuauauuguggcuggcca

SEQ ID NO: 25979 - RNA, 22 nt, Human
uacuuuauucaggaaggcuggu

SEQ ID NO: 25980 - RNA, 22 nt, Human
uacuuucauggguuuucuuuau

SEQ ID NO: 25981 - RNA, 22 nt, Human
uacuuucaugucuauacauauu

SEQ ID NO: 25982 - RNA, 22 nt, Human
uacuuugaauuaaauauuucag

SEQ ID NO: 25983 - RNA, 22 nt, Human
uacuuugauaagguucuucuau

SEQ ID NO: 25984 - RNA, 22 nt, Human
uacuuugcuaaaaugugcagaa

SEQ ID NO: 25985 - RNA, 22 nt, Human
uacuuugguaucaaacuaaaac

SEQ ID NO: 25986 - RNA, 22 nt, Human
uacuuuuccagggcuggcugag

SEQ ID NO: 25987 - RNA, 22 nt, Human
uacuuuuuaugauaagaacuga

SEQ ID NO: 25988 - RNA, 22 nt, Human
uagaaaacuaauacaugcuuga

SEQ ID NO: 25989 - RNA, 22 nt, Human
uagaaaagauaacauucugugc

SEQ ID NO: 25990 - RNA, 22 nt, Human
uagaaaagccccagcuggaggg

SEQ ID NO: 25991 - RNA, 22 nt, Human
uagaaaauccaguguggggaga

SEQ ID NO: 25992 - RNA, 22 nt, Human
uagaaaauggccaagcaggacu

SEQ ID NO: 25993 - RNA, 22 nt, Human
uagaaaauguuccacugccauu

SEQ ID NO: 25994 - RNA, 22 nt, Human
uagaaacaaagaccugggugcu

SEQ ID NO: 25995 - RNA, 22 nt, Human
uagaaacaaguuucucuuuggg

SEQ ID NO: 25996 - RNA, 22 nt, Human
uagaaacaaugacaugcuugua

SEQ ID NO: 25997 - RNA, 22 nt, Human
uagaaacagaauaugagugaga

SEQ ID NO: 25998 - RNA, 22 nt, Human
uagaaacagagagauaugcccc

SEQ ID NO: 25999 - RNA, 22 nt, Human
uagaaacagagcagguggccca

SEQ ID NO: 26000 - RNA, 22 nt, Human
uagaaacauauaggauggcagg

SEQ ID NO: 26001 - RNA, 22 nt, Human
uagaaacaucagcuaaccaaaa

SEQ ID NO: 26002 - RNA, 22 nt, Human
uagaaacucacguuaucauugc

SEQ ID NO: 26003 - RNA, 22 nt, Human
uagaaagaacuucauguaaaac

SEQ ID NO: 26004 - RNA, 22 nt, Human
uagaaagacaaugggaagugcu

SEQ ID NO: 26005 - RNA, 22 nt, Human
uagaaagacagagguuuugucu

SEQ ID NO: 26006 - RNA, 22 nt, Human
uagaaagacuguccagauuuca

SEQ ID NO: 26007 - RNA, 22 nt, Human
uagaaagcaguaucuccauuuu

SEQ ID NO: 26008 - RNA, 22 nt, Human
uagaaaggcaagcgugaaauau

SEQ ID NO: 26009 - RNA, 22 nt, Human
uagaaaguacuaaauuuaacug

SEQ ID NO: 26010 - RNA, 22 nt, Human
uagaaaguagggaagguaggau

SEQ ID NO: 26011 - RNA, 21 nt, Human
uagaaagucaaagcuaucagc

SEQ ID NO: 26012 - RNA, 22 nt, Human
uagaaagugaagguuaauuaau

SEQ ID NO: 26013 - RNA, 22 nt, Human
ucacaguuauagucuguagaau

SEQ ID NO: 26014 - RNA, 22 nt, Human
ucacaguugagcagguugugca

SEQ ID NO: 26015 - RNA, 22 nt, Human
ucacaguuucuuuucugauaaa

SEQ ID NO: 26016 - RNA, 22 nt, Human
ucacaguuuuagcuguuaaaua

SEQ ID NO: 26017 - RNA, 22 nt, Human
ucacauaaauuauacaauuuca

SEQ ID NO: 26018 - RNA, 23 nt, Human
ucacauaauccuucauccacagg

SEQ ID NO: 26019 - RNA, 22 nt, Human
ucacaucaacauuauagcauga

SEQ ID NO: 26020 - RNA, 22 nt, Human
ucacaucaaggacugucuggcu

SEQ ID NO: 26021 - RNA, 17 nt, Human
ucacaucacacaagcaa

SEQ ID NO: 26022 - RNA, 22 nt, Human
ucacaucacaugagugcaagga

SEQ ID NO: 26023 - RNA, 22 nt, Human
ucacaucuaauucgguuagguu

SEQ ID NO: 26024 - RNA, 22 nt, Human
ucacaucucuguuuucuaaauc

SEQ ID NO: 26025 - RNA, 22 nt, Human
ucacaucugaaaaaauauugag

SEQ ID NO: 26026 - RNA, 22 nt, Human
ucacaucugccuccauagcacc

SEQ ID NO: 26027 - RNA, 22 nt, Human
ucacaucuuggauuacaauuuu

SEQ ID NO: 26028 - RNA, 22 nt, Human
ucacaucuugugauguuuucau

SEQ ID NO: 26029 - RNA, 21 nt, Human
uagaacugacgauuucagagu

SEQ ID NO: 26030 - RNA, 22 nt, Human
uagaacuggaauuuugugguuu

SEQ ID NO: 26031 - RNA, 22 nt, Human
uagaacuuaaauauguuuuccc

SEQ ID NO: 26032 - RNA, 22 nt, Human
uagaacuuauuagaaaggcuca

SEQ ID NO: 26033 - RNA, 22 nt, Human
uagaacuuccaauucagggcug

SEQ ID NO: 26034 - RNA, 22 nt, Human
uagaacuugauagacaguacaa

SEQ ID NO: 26035 - RNA, 20 nt, Human
uagaacuuuucaguauggau

SEQ ID NO: 26036 - RNA, 22 nt, Human
uagaagauaagacaagugcugc

SEQ ID NO: 26037 - RNA, 22 nt, Human
uagaagaucuuaaaagcugacu

SEQ ID NO: 26038 - RNA, 22 nt, Human
uagaagcacagccugauggaca

SEQ ID NO: 26039 - RNA, 22 nt, Human
uagaagcaccacucaucacgug

SEQ ID NO: 26040 - RNA, 22 nt, Human
uagaagcucaggaauaggcaua

SEQ ID NO: 26041 - RNA, 22 nt, Human
uagaaguggcaacacucagaaa

SEQ ID NO: 26042 - RNA, 18 nt, Human
uagaagugugcuauacaa

SEQ ID NO: 26043 - RNA, 22 nt, Human
uagaaguucaugcgaauuauuu

SEQ ID NO: 26044 - RNA, 22 nt, Human
uagaaguugcucaauaaauguu

SEQ ID NO: 26045 - RNA, 22 nt, Human
uagaauauacacuacagcuuaa

SEQ ID NO: 26046 - RNA, 18 nt, Human
uagaauauaggucauucu

SEQ ID NO: 26047 - RNA, 22 nt, Human
uagaauaugugguaggaucugg

SEQ ID NO: 26048 - RNA, 22 nt, Human
uagaaucagaagauuugacugu

SEQ ID NO: 26049 - RNA, 21 nt, Human
uagaauccuggacugggacuc

SEQ ID NO: 26050 - RNA, 20 nt, Human
uagaaucuacuauuuggccc

SEQ ID NO: 26051 - RNA, 22 nt, Human
uagaaucugaaaguggcuguga

SEQ ID NO: 26052 - RNA, 22 nt, Human
uagaaucugauuacccuaugaa

SEQ ID NO: 26053 - RNA, 20 nt, Human
uagaaucuguucugauucau

SEQ ID NO: 26054 - RNA, 22 nt, Human
uagaaugaccuccucuuagcuu

SEQ ID NO: 26055 - RNA, 22 nt, Human
uagaaugagaaaguguagcagg

SEQ ID NO: 26056 - RNA, 19 nt, Human
uagaaugcccacuuaaaaa

SEQ ID NO: 26057 - RNA, 22 nt, Human
uagaauguagugcuucaagauu

SEQ ID NO: 26058 - RNA, 23 nt, Human
uagaaugucauucaaugauaugg

SEQ ID NO: 26059 - RNA, 22 nt, Human
uagaauucaagauucaacaggc

SEQ ID NO: 26060 - RNA, 22 nt, Human
uagacaaaagggggcagauaug

SEQ ID NO: 26061 - RNA, 22 nt, Human
uagacaauauuugaaaguagug

SEQ ID NO: 26062 - RNA, 22 nt, Human
uagacacauacccuugcccaaa

SEQ ID NO: 26063 - RNA, 22 nt, Human
uagacacaucuucauccacaau

SEQ ID NO: 26064 - RNA, 22 nt, Human
uagacacuuuagaaguaagggu

SEQ ID NO: 26065 - RNA, 22 nt, Human
uagacauacagugcaguacaua

SEQ ID NO: 26066 - RNA, 22 nt, Human
uagacauuuagauaucucgcug

SEQ ID NO: 26067 - RNA, 22 nt, Human
uagacauuuuaagacauauacc

SEQ ID NO: 26068 - RNA, 22 nt, Human
uagacauuuucccuacccucau

SEQ ID NO: 26069 - RNA, 22 nt, Human
uagaccaggggagucaacaggu

SEQ ID NO: 26070 - RNA, 22 nt, Human
uagaccugaaauauggaccugg

SEQ ID NO: 26071 - RNA, 19 nt, Human
uagacucuaauguuaagcu

SEQ ID NO: 26072 - RNA, 22 nt, Human
uagacucugcauuuaccuccca

SEQ ID NO: 26073 - RNA, 22 nt, Human
uagacuggugaauuagggggaa

SEQ ID NO: 26074 - RNA, 22 nt, Human
uagacuuuuaagucccucuuua

SEQ ID NO: 26075 - RNA, 21 nt, Human
uagagaaaagaagcuguuccu

SEQ ID NO: 26076 - RNA, 22 nt, Human
uagagaaaagcagggaucagga

SEQ ID NO: 26077 - RNA, 22 nt, Human
uagagaauuguagccugcaaga

SEQ ID NO: 26078 - RNA, 22 nt, Human
uagagagccaguugucauaguu

SEQ ID NO: 26079 - RNA, 21 nt, Human
uagagaugacgagcucuagca

SEQ ID NO: 26080 - RNA, 22 nt, Human
uagagauggggucuugcuauga

SEQ ID NO: 26081 - RNA, 21 nt, Human
uagagauguuugcuaaguagc

SEQ ID NO: 26082 - RNA, 22 nt, Human
uagagcagauagugaaacagaa

SEQ ID NO: 26083 - RNA, 22 nt, Human
uagagcaguguuguccaucaga

SEQ ID NO: 26084 - RNA, 22 nt, Human
uagagcauuaugacaaccccau

SEQ ID NO: 26085 - RNA, 22 nt, Human
uagagcuauuuagagcauuuua

SEQ ID NO: 26086 - RNA, 22 nt, Human
uagagcugcuggacuguaacag

SEQ ID NO: 26087 - RNA, 22 nt, Human
uagagcuggaaaacugcaggua

SEQ ID NO: 26088 - RNA, 22 nt, Human
uagagcuuggggauuuaguagu

SEQ ID NO: 26089 - RNA, 22 nt, Human
uagaggaacugccuuucuucug

SEQ ID NO: 26090 - RNA, 22 nt, Human
uagaggagcggcgagcugagcu

SEQ ID NO: 26091 - RNA, 23 nt, Human
uagaggaggaugugaugcauauu

SEQ ID NO: 26092 - RNA, 22 nt, Human
uagaggcacccuggaggagacu

SEQ ID NO: 26093 - RNA, 21 nt, Human
uagaggcaggagggacugcag

SEQ ID NO: 26094 - RNA, 22 nt, Human
uagaggcauuaaugaauaaaca

SEQ ID NO: 26095 - RNA, 22 nt, Human
uagaggccgaaugcugagcugg

SEQ ID NO: 26096 - RNA, 22 nt, Human
uagaggcucuucauugcaguag

SEQ ID NO: 26097 - RNA, 22 nt, Human
uagaggcuucuacugcucacuu

SEQ ID NO: 26098 - RNA, 22 nt, Human
uagaggcuuucagcgguagguc

SEQ ID NO: 26099 - RNA, 22 nt, Human
uagagggccagcuggacagcga

SEQ ID NO: 26100 - RNA, 18 nt, Human
uagagggggccugggcau

SEQ ID NO: 26101 - RNA, 22 nt, Human
uagaggguuauuaggacagaag

SEQ ID NO: 26102 - RNA, 22 nt, Human
uagagguauuuuugauggucau

SEQ ID NO: 26103 - RNA, 22 nt, Human
uagaggugucacuuugggaagu

SEQ ID NO: 26104 - RNA, 22 nt, Human
uagagguguucauucucuccau

SEQ ID NO: 26105 - RNA, 22 nt, Human
uagaguaacacaaacgaauugg

SEQ ID NO: 26106 - RNA, 22 nt, Human
uagaguccuucauucugugcag

SEQ ID NO: 26107 - RNA, 22 nt, Human
uagaguguuguaauugaaaagg

SEQ ID NO: 26108 - RNA, 22 nt, Human
uagaguguuuuguuaggcagca

SEQ ID NO: 26109 - RNA, 22 nt, Human
uagauaacagcacuggccucgc

SEQ ID NO: 26110 - RNA, 22 nt, Human
uagauaacuugcaccuacagga

SEQ ID NO: 26111 - RNA, 22 nt, Human
uagauaauuuggcaucauauug

SEQ ID NO: 26112 - RNA, 22 nt, Human
uagauacauacauuuuaaaaug

SEQ ID NO: 26113 - RNA, 22 nt, Human
uagauacauuuuucuuuccugu

SEQ ID NO: 26114 - RNA, 22 nt, Human
uagauaccugcuggaccucauu

SEQ ID NO: 26115 - RNA, 23 nt, Human
uagauacugcauauagguggaau

SEQ ID NO: 26116 - RNA, 22 nt, Human
uagaucauaaauacuauggugc

SEQ ID NO: 26117 - RNA, 22 nt, Human
uagaucauauuuguggagaaaa

SEQ ID NO: 26118 - RNA, 22 nt, Human
uagaucauggguacugcauaug

SEQ ID NO: 26119 - RNA, 21 nt, Human
uagaucaugguauucuuuggc

SEQ ID NO: 26120 - RNA, 22 nt, Human
uagauccugcauagguugugcu

SEQ ID NO: 26121 - RNA, 23 nt, Human
uagauccuuccaacuacucuuac

SEQ ID NO: 26122 - RNA, 22 nt, Human
ucagaaagacgaaacagauggg

SEQ ID NO: 26123 - RNA, 22 nt, Human
ucagaaagcuauaugguguguc

SEQ ID NO: 26124 - RNA, 22 nt, Human
ucagaaagcugauucuugauac

SEQ ID NO: 26125 - RNA, 22 nt, Human
ucagaaagcuuuuacuuaaaca

SEQ ID NO: 26126 - RNA, 22 nt, Human
ucagaaauaaugaaugaugggg

SEQ ID NO: 26127 - RNA, 22 nt, Human
ucagaaauagcucuaagcuccu

SEQ ID NO: 26128 - RNA, 22 nt, Human
ucagaacaauuccuuuauaaca

SEQ ID NO: 26129 - RNA, 22 nt, Human
ucagaacacuuucucuacugac

SEQ ID NO: 26130 - RNA, 22 nt, Human
ucagaacagcgagaauauucac

SEQ ID NO: 26131 - RNA, 22 nt, Human
ucagaacagguuguacuauguc

SEQ ID NO: 26132 - RNA, 22 nt, Human
ucagaacauauauuuugugaug

SEQ ID NO: 26133 - RNA, 22 nt, Human
ucagaacauuacauuuugagcu

SEQ ID NO: 26134 - RNA, 22 nt, Human
ucagaacauuuaaaaagugguu

SEQ ID NO: 26135 - RNA, 22 nt, Human
ucagaaccagcccagcagauga

SEQ ID NO: 26136 - RNA, 22 nt, Human
ucagaaccugcaagucuaaccu

SEQ ID NO: 26137 - RNA, 22 nt, Human
ucagaagaaagauguuauuacu

SEQ ID NO: 26138 - RNA, 22 nt, Human
ucagaagaagagacuccacagc

SEQ ID NO: 26139 - RNA, 22 nt, Human
ucagaagaagguauauuuauac

SEQ ID NO: 26140 - RNA, 22 nt, Human
ucagaagacuacuaggacacau

SEQ ID NO: 26141 - RNA, 22 nt, Human
ucagaagagcuggugcugccug

SEQ ID NO: 26142 - RNA, 22 nt, Human
ucagaagcaagcuucuacuucu

SEQ ID NO: 26143 - RNA, 22 nt, Human
ucagaagcagaaaauagguggg

SEQ ID NO: 26144 - RNA, 22 nt, Human
ucagaagcauccauuucaccac

SEQ ID NO: 26145 - RNA, 22 nt, Human
ucagaagccggaagugcuccuc

SEQ ID NO: 26146 - RNA, 22 nt, Human
ucagaagcuaaauuugauauuu

SEQ ID NO: 26147 - RNA, 22 nt, Human
ucagaagcugguguccuuugaa

SEQ ID NO: 26148 - RNA, 22 nt, Human
ucagaagguacugaagacaugg

SEQ ID NO: 26149 - RNA, 22 nt, Human
uagcucaaagguuaagugugga

SEQ ID NO: 26150 - RNA, 22 nt, Human
uagcucuagcacuggauaaucc

SEQ ID NO: 26151 - RNA, 22 nt, Human
uagcucucuuuaucuuucuaua

SEQ ID NO: 26152 - RNA, 22 nt, Human
uagcucuggagucuucucagaa

SEQ ID NO: 26153 - RNA, 22 nt, Human
uagcucuuaagucugugauaga

SEQ ID NO: 26154 - RNA, 22 nt, Human
uagcugaauauaggcacaacag

SEQ ID NO: 26155 - RNA, 22 nt, Human
uagcugacagauacaaucagau

SEQ ID NO: 26156 - RNA, 22 nt, Human
uagcugagagcucacuugagga

SEQ ID NO: 26157 - RNA, 22 nt, Human
uagcugagaggccaauugaacu

SEQ ID NO: 26158 - RNA, 19 nt, Human
uagcugauagcuacuuuau

SEQ ID NO: 26159 - RNA, 22 nt, Human
uagcugccagaccauucuuacu

SEQ ID NO: 26160 - RNA, 22 nt, Human
uagcugccauugcuccaggaag

SEQ ID NO: 26161 - RNA, 17 nt, Human
uagcugccccgaaugcu

SEQ ID NO: 26162 - RNA, 22 nt, Human
uagcugcuugaccaggcagugg

SEQ ID NO: 26163 - RNA, 22 nt, Human
uagcuggcuuauauaaaagggc

SEQ ID NO: 26164 - RNA, 22 nt, Human
uagcugguucuccaggagcuag

SEQ ID NO: 26165 - RNA, 22 nt, Human
uagcugucagcaaucaaguggu

SEQ ID NO: 26166 - RNA, 21 nt, Human
uagcugugcaacuuugggcaa

SEQ ID NO: 26167 - RNA, 22 nt, Human
uagcuguguaacaugagaaugu

SEQ ID NO: 26168 - RNA, 22 nt, Human
uagcuguguguccuugggcaaa

SEQ ID NO: 26169 - RNA, 17 nt, Human
uagcuguguuucagcua

SEQ ID NO: 26170 - RNA, 22 nt, Human
uagcuguuaaguuguuuggaaa

SEQ ID NO: 26171 - RNA, 22 nt, Human
uagcuguuacccauaaaagcca

SEQ ID NO: 26172 - RNA, 22 nt, Human
uagcuguuauuuugcuacccau

SEQ ID NO: 26173 - RNA, 22 nt, Human
uagcuguucaaguuccuggaaa

SEQ ID NO: 26174 - RNA, 22 nt, Human
uagcuguugcaauaaacaguuc

SEQ ID NO: 26175 - RNA, 22 nt, Human
uagcuguuucuaaguguuguuu

SEQ ID NO: 26176 - RNA, 22 nt, Human
uagcuguuuuuugugaggaaau

SEQ ID NO: 26177 - RNA, 22 nt, Human
uagcuuaaaaucucuagauucu

SEQ ID NO: 26178 - RNA, 22 nt, Human
uagcuuaucccacagugcccag

SEQ ID NO: 26179 - RNA, 22 nt, Human
uagcuuaucuauacagacuuuu

SEQ ID NO: 26180 - RNA, 22 nt, Human
uagcuucaguggcccuagacac

SEQ ID NO: 26181 - RNA, 22 nt, Human
uagcuuccagaauuuaauguca

SEQ ID NO: 26182 - RNA, 22 nt, Human
uagcuucucuuuucaacaucuu

SEQ ID NO: 26183 - RNA, 22 nt, Human
uagcuucuugagaaagggugcc

SEQ ID NO: 26184 - RNA, 22 nt, Human
uagcuugaguguuucauaaaua

SEQ ID NO: 26185 - RNA, 22 nt, Human
uagcuuggaauaaaaugagaau

SEQ ID NO: 26186 - RNA, 22 nt, Human
uagcuuuaagaugagaugugga

SEQ ID NO: 26187 - RNA, 21 nt, Human
uagcuuuaauauucccacauu

SEQ ID NO: 26188 - RNA, 22 nt, Human
uagcuuuaaugaguugguaaga

SEQ ID NO: 26189 - RNA, 22 nt, Human
uagcuuugaacuucugggcuca

SEQ ID NO: 26190 - RNA, 22 nt, Human
uagcuuugacaguugcaggcag

SEQ ID NO: 26191 - RNA, 22 nt, Human
uagcuuugaccaacgacugguc

SEQ ID NO: 26192 - RNA, 22 nt, Human
uagcuuugccugaaguaaucag

SEQ ID NO: 26193 - RNA, 22 nt, Human
uagcuuugcuggcaagcauguc

SEQ ID NO: 26194 - RNA, 22 nt, Human
uagcuuugggaaugcucuccug

SEQ ID NO: 26195 - RNA, 22 nt, Human
uagcuuuguguaugaugucugu

SEQ ID NO: 26196 - RNA, 22 nt, Human
uagcuuuuaagucauaaccuca

SEQ ID NO: 26197 - RNA, 22 nt, Human
uagcuuuuauccacugcuuuug

SEQ ID NO: 26198 - RNA, 22 nt, Human
uaggaaaauaucucuuauuggg

SEQ ID NO: 26199 - RNA, 22 nt, Human
uaggaaacaaaguggaugaaau

SEQ ID NO: 26200 - RNA, 16 nt, Human
uaggaaacugcaugug

SEQ ID NO: 26201 - RNA, 22 nt, Human
uaggaaaucagagaaagaggug

SEQ ID NO: 26202 - RNA, 22 nt, Human
uaggaaaugaaugcaggcuccc

SEQ ID NO: 26203 - RNA, 22 nt, Human
uaggaaaugaggccaacaugug

SEQ ID NO: 26204 - RNA, 22 nt, Human
uaggaaaugccagccuuccucc

SEQ ID NO: 26205 - RNA, 22 nt, Human
uaggaaauggcucaguuacugc

SEQ ID NO: 26206 - RNA, 22 nt, Human
uaggaaauucucuugcuaaguu

SEQ ID NO: 26207 - RNA, 22 nt, Human
uaggaaauugacaccugcuuga

SEQ ID NO: 26208 - RNA, 22 nt, Human
uaggaaauuggaaacucuucac

SEQ ID NO: 26209 - RNA, 22 nt, Human
uaggaaauuuauagagguguuu

SEQ ID NO: 26210 - RNA, 22 nt, Human
uaggaaccuugaucuuggauuu

SEQ ID NO: 26211 - RNA, 22 nt, Human
uaggaacuuagaugaacacaug

SEQ ID NO: 26212 - RNA, 22 nt, Human
uaggaagagcuauaggucccca

SEQ ID NO: 26213 - RNA, 22 nt, Human
uaggaagaugaguaucaacuug

SEQ ID NO: 26214 - RNA, 22 nt, Human
uaggaagcauuuaaagagaugg

SEQ ID NO: 26215 - RNA, 22 nt, Human
uaggaagccuaaauuaaguggu

SEQ ID NO: 26216 - RNA, 22 nt, Human
uaggaagccugcugugcacagc

SEQ ID NO: 26217 - RNA, 22 nt, Human
uaggaagcuaugggagauguga

SEQ ID NO: 26218 - RNA, 22 nt, Human
uaggaagcugagcagcauuccu

SEQ ID NO: 26219 - RNA, 22 nt, Human
uaggaaggaagagccucagauu

SEQ ID NO: 26220 - RNA, 22 nt, Human
uaggaaguagauagguuguucu

SEQ ID NO: 26221 - RNA, 22 nt, Human
uaggaaugagaaagaauuagau

SEQ ID NO: 26222 - RNA, 19 nt, Human
uaggaauguagaauccuag

SEQ ID NO: 26223 - RNA, 22 nt, Human
uaggaauguuuuuaucaacuua

SEQ ID NO: 26224 - RNA, 22 nt, Human
uaggacagaguucccugauggc

SEQ ID NO: 26225 - RNA, 22 nt, Human
uaggacaggcuaaaagggauaa

SEQ ID NO: 26226 - RNA, 20 nt, Human
uaggacagggccuggcuucu

SEQ ID NO: 26227 - RNA, 22 nt, Human
uaggacaguuuacuuugguuac

SEQ ID NO: 26228 - RNA, 22 nt, Human
uaggacaugcuacauaaauagg

SEQ ID NO: 26229 - RNA, 22 nt, Human
uaggacuuagaacuggaagaca

SEQ ID NO: 26230 - RNA, 22 nt, Human
uaggacuuggaaggagcuccca

SEQ ID NO: 26231 - RNA, 22 nt, Human
ugcuccaugcgcucggccggcg

SEQ ID NO: 26232 - RNA, 22 nt, Human
ugcucccagggacucuggcugg

SEQ ID NO: 26233 - RNA, 22 nt, Human
ugcuccuauccuccugcugaca

SEQ ID NO: 26234 - RNA, 22 nt, Human
ugcuccugaacacagcccuaug

SEQ ID NO: 26235 - RNA, 22 nt, Human
ugcuccugaauuacacuacuac

SEQ ID NO: 26236 - RNA, 22 nt, Human
ugcuccugccguggucgggacu

SEQ ID NO: 26237 - RNA, 22 nt, Human
ugcuccuggcuccuucccuaac

SEQ ID NO: 26238 - RNA, 22 nt, Human
ugcuccuucccuucccagugag

SEQ ID NO: 26239 - RNA, 22 nt, Human
ugcuccuuucauccaauucuca

SEQ ID NO: 26240 - RNA, 22 nt, Human
ugcucuaagaacucuaggaauu

SEQ ID NO: 26241 - RNA, 22 nt, Human
ugcucuaucuuugcuugaggga

SEQ ID NO: 26242 - RNA, 22 nt, Human
ugcucuauuaauuuuaacgaug

SEQ ID NO: 26243 - RNA, 22 nt, Human
ugcucuggacgcugagugguuu

SEQ ID NO: 26244 - RNA, 22 nt, Human
ugcucuggaguggcuugugcac

SEQ ID NO: 26245 - RNA, 22 nt, Human
ugcucuggcugggaugagugca

SEQ ID NO: 26246 - RNA, 22 nt, Human
ugcucugggaccgucauuaaaa

SEQ ID NO: 26247 - RNA, 22 nt, Human
ugcucuggguucuugcuguuac

SEQ ID NO: 26248 - RNA, 22 nt, Human
ugcucugguaacucacuuccau

SEQ ID NO: 26249 - RNA, 22 nt, Human
ugcucugguccucccucggcgc

SEQ ID NO: 26250 - RNA, 22 nt, Human
ugcucuguccagugcaccauca

SEQ ID NO: 26251 - RNA, 22 nt, Human
ugcucugugugugguuauuucc

SEQ ID NO: 26252 - RNA, 22 nt, Human
ugcucuuaauuccauuagacuu

SEQ ID NO: 26253 - RNA, 22 nt, Human
ugcucuucacaguuucagcauc

SEQ ID NO: 26254 - RNA, 22 nt, Human
ugcucuucggggccacugcuug

SEQ ID NO: 26255 - RNA, 22 nt, Human
ugcugaaacaauaacauacugg

SEQ ID NO: 26256 - RNA, 22 nt, Human
ugcugaaagaccguauuuaucu

SEQ ID NO: 26257 - RNA, 22 nt, Human
ugcugaaagucccaaaucucau

SEQ ID NO: 26258 - RNA, 22 nt, Human
ugcugaaauauuuaugggucaa

SEQ ID NO: 26259 - RNA, 22 nt, Human
ugcugaagggaaggucuugaau

SEQ ID NO: 26260 - RNA, 22 nt, Human
ugcugaaguccaagagcuccaa

SEQ ID NO: 26261 - RNA, 22 nt, Human
ugcugaaguccaucuguuugac

SEQ ID NO: 26262 - RNA, 22 nt, Human
ugcugaauaagacguggcuugu

SEQ ID NO: 26263 - RNA, 22 nt, Human
ugcugaaucauaugguaauucu

SEQ ID NO: 26264 - RNA, 21 nt, Human
ugcugaaucugccauauuuuc

SEQ ID NO: 26265 - RNA, 22 nt, Human
ugcugaaugguaaagaaguaua

SEQ ID NO: 26266 - RNA, 23 nt, Human
uaggccagggugaccuggggaga

SEQ ID NO: 26267 - RNA, 22 nt, Human
uaggccaugcagcaaagaggcu

SEQ ID NO: 26268 - RNA, 22 nt, Human
uaggccauugauuuuuauaagu

SEQ ID NO: 26269 - RNA, 19 nt, Human
uaggcccuagcucugcagu

SEQ ID NO: 26270 - RNA, 22 nt, Human
uaggcucagugaguagggaguu

SEQ ID NO: 26271 - RNA, 22 nt, Human
uaggcucccagaucguuugcug

SEQ ID NO: 26272 - RNA, 22 nt, Human
uaggcuccugaguccacagcac

SEQ ID NO: 26273 - RNA, 22 nt, Human
uaggcugagcuaagagagcuua

SEQ ID NO: 26274 - RNA, 22 nt, Human
uaggcugggagccugaggcuag

SEQ ID NO: 26275 - RNA, 22 nt, Human
uaggcuuccgagucuugguauc

SEQ ID NO: 26276 - RNA, 23 nt, Human
uaggcuucugcuguccccgacgc

SEQ ID NO: 26277 - RNA, 22 nt, Human
uaggcuugcuucuccuccacag

SEQ ID NO: 26278 - RNA, 22 nt, Human
uagggaaaagacuucacuguuu

SEQ ID NO: 26279 - RNA, 22 nt, Human
uagggaaggagaccaagccaca

SEQ ID NO: 26280 - RNA, 22 nt, Human
uagggaaguguauaggggucau

SEQ ID NO: 26281 - RNA, 22 nt, Human
uagggacacugcucaugaguuc

SEQ ID NO: 26282 - RNA, 22 nt, Human
uagggacugugugagggacuug

SEQ ID NO: 26283 - RNA, 22 nt, Human
uagggaugaaguugcuauuuac

SEQ ID NO: 26284 - RNA, 22 nt, Human
uagggaugacgaaaggacagag

SEQ ID NO: 26285 - RNA, 22 nt, Human
uagggaugacuaugauucccac

SEQ ID NO: 26286 - RNA, 22 nt, Human
uagggaugagccaguggguagu

SEQ ID NO: 26287 - RNA, 20 nt, Human
uagggaugccaguacuucuc

SEQ ID NO: 26288 - RNA, 22 nt, Human
uagggauggaaacccguuuucu

SEQ ID NO: 26289 - RNA, 22 nt, Human
uagggauggaaacuaggaaucu

SEQ ID NO: 26290 - RNA, 22 nt, Human
uagggaugggagauucucaaac

SEQ ID NO: 26291 - RNA, 22 nt, Human
uagggcaauauuucccagaaaa

SEQ ID NO: 26292 - RNA, 22 nt, Human
uagggcagauucgguggaguuu

SEQ ID NO: 26293 - RNA, 22 nt, Human
uagggcagccuuauagcuccca

SEQ ID NO: 26294 - RNA, 22 nt, Human
uagggcaggugaagaaaagcua

SEQ ID NO: 26295 - RNA, 22 nt, Human
uagggcucagagaaguggggcc

SEQ ID NO: 26296 - RNA, 22 nt, Human
uagggcucagaguccaguuucu

SEQ ID NO: 26297 - RNA, 22 nt, Human
uagggcucagcucuagcuccug

SEQ ID NO: 26298 - RNA, 21 nt, Human
uagggcucuauuuuuauuuca

SEQ ID NO: 26299 - RNA, 22 nt, Human
uagggcugccuauggcuagaua

SEQ ID NO: 26300 - RNA, 22 nt, Human
uagggcugcugcagaugacagg

SEQ ID NO: 26301 - RNA, 22 nt, Human
uagggcugcuuuguauucugcu

SEQ ID NO: 26302 - RNA, 22 nt, Human
uagggcuguggucaguccucua

SEQ ID NO: 26303 - RNA, 22 nt, Human
uagggcuguuaguaauucucag

SEQ ID NO: 26304 - RNA, 22 nt, Human
uagggcuguuuaaaagugaggu

SEQ ID NO: 26305 - RNA, 22 nt, Human
uagggcuucaggugugaggcag

SEQ ID NO: 26306 - RNA, 22 nt, Human
uaggggaggggaucaugugcug

SEQ ID NO: 26307 - RNA, 22 nt, Human
uaggggcagaagcggcggucca

SEQ ID NO: 26308 - RNA, 21 nt, Human
uaggggcuggggcuccagcug

SEQ ID NO: 26309 - RNA, 22 nt, Human
uagggggcuguccugugcauua

SEQ ID NO: 26310 - RNA, 22 nt, Human
uaggguacaugugcacaacaug

SEQ ID NO: 26311 - RNA, 22 nt, Human
uaggguccugccuacagagaca

SEQ ID NO: 26312 - RNA, 22 nt, Human
uagggugggcaguucuugggga

SEQ ID NO: 26313 - RNA, 22 nt, Human
uagguaagauguuaacagcuga

SEQ ID NO: 26314 - RNA, 22 nt, Human
uagguacauuauuagaugcaug

SEQ ID NO: 26315 - RNA, 22 nt, Human
uagguagaaauagauauuggua

SEQ ID NO: 26316 - RNA, 22 nt, Human
uagguagguaaacaggacuaau

SEQ ID NO: 26317 - RNA, 22 nt, Human
uagguaggugcaauuaaaagua

SEQ ID NO: 26318 - RNA, 22 nt, Human
uagguauaauauuuugaagaaa

SEQ ID NO: 26319 - RNA, 21 nt, Human
uagguauuucuaucaugucuc

SEQ ID NO: 26320 - RNA, 22 nt, Human
uagguccacagauuugguuucu

SEQ ID NO: 26321 - RNA, 22 nt, Human
uagguccagcacgguguagcuu

SEQ ID NO: 26322 - RNA, 22 nt, Human
uaggucugauuuccauucaguc

SEQ ID NO: 26323 - RNA, 22 nt, Human
uaggucuggcagaagaaaaaug

SEQ ID NO: 26324 - RNA, 22 nt, Human
uaggugagggagcauugugaga

SEQ ID NO: 26325 - RNA, 22 nt, Human
uaggugcuggauaaagaauggu

SEQ ID NO: 26326 - RNA, 22 nt, Human
uaggugucaggccuccuccagc

SEQ ID NO: 26327 - RNA, 22 nt, Human
uaggugucagguauagaauuua

SEQ ID NO: 26328 - RNA, 22 nt, Human
uagguguccauauaugugugua

SEQ ID NO: 26329 - RNA, 19 nt, Human
uagguguccgccggaggug

SEQ ID NO: 26330 - RNA, 22 nt, Human
uagguguccucguccaaagauu

SEQ ID NO: 26331 - RNA, 22 nt, Human
uaggugucuaacaauaagugua

SEQ ID NO: 26332 - RNA, 23 nt, Human
uaggugucuaguguccacuaugu

SEQ ID NO: 26333 - RNA, 22 nt, Human
uaggugucuugucacuaccguu

SEQ ID NO: 26334 - RNA, 22 nt, Human
uaggugugggcucaggaaugug

SEQ ID NO: 26335 - RNA, 22 nt, Human
uagguucacacaucuuccagau

SEQ ID NO: 26336 - RNA, 22 nt, Human
uagguucacugucuugaggagc

SEQ ID NO: 26337 - RNA, 22 nt, Human
uagguucucuauugcccccaaa

SEQ ID NO: 26338 - RNA, 22 nt, Human
uaguaaaaggucuuccuuuguu

SEQ ID NO: 26339 - RNA, 22 nt, Human
uaguaaaucucagaaaaagauc

SEQ ID NO: 26340 - RNA, 17 nt, Human
uggacccuugggccucc

SEQ ID NO: 26341 - RNA, 22 nt, Human
uggaccugcguaggugcugggc

SEQ ID NO: 26342 - RNA, 21 nt, Human
uggaccuguccuucucgcugu

SEQ ID NO: 26343 - RNA, 20 nt, Human
uggaccugucucuuuaggga

SEQ ID NO: 26344 - RNA, 22 nt, Human
uggacucagugcugccauuccc

SEQ ID NO: 26345 - RNA, 22 nt, Human
uggacugggcuaauggcagaca

SEQ ID NO: 26346 - RNA, 22 nt, Human
uggagaaagcugcauauggaaa

SEQ ID NO: 26347 - RNA, 22 nt, Human
uggagaagauuggucaccauuc

SEQ ID NO: 26348 - RNA, 22 nt, Human
uggagaauuaggccaaaucucc

SEQ ID NO: 26349 - RNA, 22 nt, Human
uggagaauucuauguugagggg

SEQ ID NO: 26350 - RNA, 22 nt, Human
uggagacagagauagccaauug

SEQ ID NO: 26351 - RNA, 22 nt, Human
uggagacucagaaggggaagca

SEQ ID NO: 26352 - RNA, 22 nt, Human
uggagacugugcuaagggaguu

SEQ ID NO: 26353 - RNA, 22 nt, Human
uggagagaaaguugaauggagg

SEQ ID NO: 26354 - RNA, 22 nt, Human
uggagagcaggggaugcgggcg

SEQ ID NO: 26355 - RNA, 22 nt, Human
uggagaggaaagugcaguuuug

SEQ ID NO: 26356 - RNA, 22 nt, Human
uggagaguaauuucugaagacc

SEQ ID NO: 26357 - RNA, 22 nt, Human
uggagagucucaaggcaggaaa

SEQ ID NO: 26358 - RNA, 21 nt, Human
uggagagugauuucagugugg

SEQ ID NO: 26359 - RNA, 22 nt, Human
uggagagugguuugggggacau

SEQ ID NO: 26360 - RNA, 22 nt, Human
uggagaugaacauggugauguu

SEQ ID NO: 26361 - RNA, 22 nt, Human
uggagauggccucaggcccuca

SEQ ID NO: 26362 - RNA, 22 nt, Human
uggagcaagcuggagagaacau

SEQ ID NO: 26363 - RNA, 22 nt, Human
uggagcagaaauggccucuugu

SEQ ID NO: 26364 - RNA, 22 nt, Human
uggagcagagaugggagcccaa

SEQ ID NO: 26365 - RNA, 22 nt, Human
uggagcagaggaagaaggcuuu

SEQ ID NO: 26366 - RNA, 22 nt, Human
uggagcagaguucagcggggag

SEQ ID NO: 26367 - RNA, 22 nt, Human
uggagcagcuaagccucugaga

SEQ ID NO: 26368 - RNA, 22 nt, Human
uggagcaggaagucuauggcug

SEQ ID NO: 26369 - RNA, 22 nt, Human
uggagcaggacugcugcccuca

SEQ ID NO: 26370 - RNA, 22 nt, Human
uggagcaggcaucuuucucucu

SEQ ID NO: 26371 - RNA, 19 nt, Human
uggagcagggcccuuguuu

SEQ ID NO: 26372 - RNA, 18 nt, Human
uggagcagguaggcauga

SEQ ID NO: 26373 - RNA, 22 nt, Human
uggagcaggucggcaccauuug

SEQ ID NO: 26374 - RNA, 22 nt, Human
uggagcaggugccaggugugug

SEQ ID NO: 26375 - RNA, 22 nt, Human
uggagcagugguccuggagaug

SEQ ID NO: 26376 - RNA, 22 nt, Human
uggagcauacuaacccacucug

SEQ ID NO: 26377 - RNA, 22 nt, Human
uggagccaaggccaguucucag

SEQ ID NO: 26378 - RNA, 22 nt, Human
uggagccagcaggacucagagg

SEQ ID NO: 26379 - RNA, 18 nt, Human
uggagccagcucuaggau

SEQ ID NO: 26380 - RNA, 22 nt, Human
uggagccaggcuggcccugcca

SEQ ID NO: 26381 - RNA, 22 nt, Human
uggagccaugccuggccuuucc

SEQ ID NO: 26382 - RNA, 18 nt, Human
uggagccauugccaccau

SEQ ID NO: 26383 - RNA, 22 nt, Human
uggagcccacggaugucgcuuu

SEQ ID NO: 26384 - RNA, 22 nt, Human
uggagcccagggugagaaggag

SEQ ID NO: 26385 - RNA, 22 nt, Human
uggagccugagucagcggaggc

SEQ ID NO: 26386 - RNA, 22 nt, Human
uggagcuccacuggaaaaaugu

SEQ ID NO: 26387 - RNA, 22 nt, Human
uggagcucugauuaaauuggaa

SEQ ID NO: 26388 - RNA, 22 nt, Human
uggagcuggcagcggaaaaggg

SEQ ID NO: 26389 - RNA, 22 nt, Human
uggagcuugggacucuugguag

SEQ ID NO: 26390 - RNA, 22 nt, Human
uggaggaauaacagcaaccuua

SEQ ID NO: 26391 - RNA, 22 nt, Human
uggaggagaacucccuggcuac

SEQ ID NO: 26392 - RNA, 22 nt, Human
uggaggagaccgcauuuuauuu

SEQ ID NO: 26393 - RNA, 22 nt, Human
uggaggagugugauugucugcc

SEQ ID NO: 26394 - RNA, 18 nt, Human
uggaggcagaguucuggc

SEQ ID NO: 26395 - RNA, 23 nt, Human
uggaggcaggaugcuaaggaguc

SEQ ID NO: 26396 - RNA, 22 nt, Human
uggaggcagucaccugaaguca

SEQ ID NO: 26397 - RNA, 22 nt, Human
uggaggcaugacagugucugga

SEQ ID NO: 26398 - RNA, 22 nt, Human
uaugaugggaggaauggaauuu

SEQ ID NO: 26399 - RNA, 22 nt, Human
uaugauguguaccuaagucacc

SEQ ID NO: 26400 - RNA, 22 nt, Human
uaugcaaacaguucaggugaca

SEQ ID NO: 26401 - RNA, 22 nt, Human
uaugcaaaguccuaagaaagaa

SEQ ID NO: 26402 - RNA, 22 nt, Human
uaugcacacauguaugcaugug

SEQ ID NO: 26403 - RNA, 22 nt, Human
uaugcacauucacacaaaaaug

SEQ ID NO: 26404 - RNA, 22 nt, Human
uaugcacauugguuuccucauu

SEQ ID NO: 26405 - RNA, 22 nt, Human
uaugcacuggauuacaaagcaa

SEQ ID NO: 26406 - RNA, 22 nt, Human
uaugcacugguacuauucgugu

SEQ ID NO: 26407 - RNA, 22 nt, Human
uaugcaguguaugcacugagau

SEQ ID NO: 26408 - RNA, 22 nt, Human
uaugcauauagaugcacacaca

SEQ ID NO: 26409 - RNA, 22 nt, Human
uaugccagggacuguuucacca

SEQ ID NO: 26410 - RNA, 22 nt, Human
uaugccugauaacugugucucu

SEQ ID NO: 26411 - RNA, 22 nt, Human
uaugccuggggugcucaggcca

SEQ ID NO: 26412 - RNA, 22 nt, Human
uaugcuaaugacacucuagaaa

SEQ ID NO: 26413 - RNA, 22 nt, Human
uaugcuccuauuggaaugauag

SEQ ID NO: 26414 - RNA, 22 nt, Human
uaugcugcaauaucauuuugcu

SEQ ID NO: 26415 - RNA, 22 nt, Human
uaugcuuuaacauuaaacaaca

SEQ ID NO: 26416 - RNA, 22 nt, Human
uaugcuuuaacccucuuauauu

SEQ ID NO: 26417 - RNA, 22 nt, Human
uauggaaagcucuuuuugauug

SEQ ID NO: 26418 - RNA, 22 nt, Human
uauggaaaguguuuucuucugu

SEQ ID NO: 26419 - RNA, 22 nt, Human
uauggaauggcuauuuucuagg

SEQ ID NO: 26420 - RNA, 22 nt, Human
uauggagauucaaaagcaucuu

SEQ ID NO: 26421 - RNA, 22 nt, Human
uauggauggaaagggccaagcu

SEQ ID NO: 26422 - RNA, 22 nt, Human
uauggcaagagaaucaacugaa

SEQ ID NO: 26423 - RNA, 22 nt, Human
uauggcaagaugacauguucuc

SEQ ID NO: 26424 - RNA, 22 nt, Human
uauggcaauauguaucaagauc

SEQ ID NO: 26425 - RNA, 23 nt, Human
uauggcuuacagugcuuuaggua

SEQ ID NO: 26426 - RNA, 22 nt, Human
uauggcuuaggagaguuuaacu

SEQ ID NO: 26427 - RNA, 22 nt, Human
uauggcuuaugcugaacaccug

SEQ ID NO: 26428 - RNA, 22 nt, Human
uauggcuuccaggcuggccagg

SEQ ID NO: 26429 - RNA, 22 nt, Human
uauggcuucuauaaggaagcuu

SEQ ID NO: 26430 - RNA, 22 nt, Human
uauggcuucuuguguuacugug

SEQ ID NO: 26431 - RNA, 22 nt, Human
uauggcuugacuugcaccggca

SEQ ID NO: 26432 - RNA, 20 nt, Human
uauggcuugcagccacccuu

SEQ ID NO: 26433 - RNA, 22 nt, Human
uauggcuugucccuggucaguc

SEQ ID NO: 26434 - RNA, 22 nt, Human
uauggcuuguggagaguuguag

SEQ ID NO: 26435 - RNA, 22 nt, Human
uauggcuuuaaacaacuuaggu

SEQ ID NO: 26436 - RNA, 22 nt, Human
uauggcuuuaaacuuuucauuu

SEQ ID NO: 26437 - RNA, 22 nt, Human
uauggcuuuuaaggagaucuga

SEQ ID NO: 26438 - RNA, 22 nt, Human
uauggguaaagggcuaggguuu

SEQ ID NO: 26439 - RNA, 22 nt, Human
uauggguauuauugguaagaau

SEQ ID NO: 26440 - RNA, 22 nt, Human
uaugguaaaugagcauauguuc

SEQ ID NO: 26441 - RNA, 22 nt, Human
uaugguuauguaaucaguuguu

SEQ ID NO: 26442 - RNA, 22 nt, Human
uauguaaaaauucaucaggcug

SEQ ID NO: 26443 - RNA, 22 nt, Human
uauguaaaggauugagaugaau

SEQ ID NO: 26444 - RNA, 22 nt, Human
uauguaaaguagauggcaggua

SEQ ID NO: 26445 - RNA, 22 nt, Human
uauguacaauuuguuguauguc

SEQ ID NO: 26446 - RNA, 22 nt, Human
uauguacaccaaggauugaaaa

SEQ ID NO: 26447 - RNA, 22 nt, Human
uauguacaccggggaagguggg

SEQ ID NO: 26448 - RNA, 22 nt, Human
uauguacauauacacgugugug

SEQ ID NO: 26449 - RNA, 22 nt, Human
uggauguuugaaguugcaugug

SEQ ID NO: 26450 - RNA, 22 nt, Human
uggauuagguacuaugaauaua

SEQ ID NO: 26451 - RNA, 22 nt, Human
uggauucaugcugggauuuuuc

SEQ ID NO: 26452 - RNA, 22 nt, Human
uggauucuaaugcacuucaaau

SEQ ID NO: 26453 - RNA, 22 nt, Human
uggauucugggcuguuugcauu

SEQ ID NO: 26454 - RNA, 22 nt, Human
uggauuuaacagaauaccaggu

SEQ ID NO: 26455 - RNA, 22 nt, Human
uggauuuaguucuucacaggcc

SEQ ID NO: 26456 - RNA, 22 nt, Human
uggauuucagcauauggauuuu

SEQ ID NO: 26457 - RNA, 22 nt, Human
uggauuuuagcauguaacugug

SEQ ID NO: 26458 - RNA, 22 nt, Human
uggcaaagauuaccacaucuac

SEQ ID NO: 26459 - RNA, 23 nt, Human
uggcaaagcauucuuauaacagu

SEQ ID NO: 26460 - RNA, 22 nt, Human
uggcaaauucaucuuuaguucu

SEQ ID NO: 26461 - RNA, 22 nt, Human
uggcaacucaauuucuacaaga

SEQ ID NO: 26462 - RNA, 22 nt, Human
uggcaagaacugcaauugcuuu

SEQ ID NO: 26463 - RNA, 22 nt, Human
uggcaagagcaaaauguacagu

SEQ ID NO: 26464 - RNA, 22 nt, Human
uggcaagagggaugcaagguuu

SEQ ID NO: 26465 - RNA, 22 nt, Human
uggcaaggaaauuaguucuccu

SEQ ID NO: 26466 - RNA, 22 nt, Human
uggcaaggaagagccuggugca

SEQ ID NO: 26467 - RNA, 22 nt, Human
uggcaaggcugugggggcagag

SEQ ID NO: 26468 - RNA, 22 nt, Human
uggcaagggauuguggagaacu

SEQ ID NO: 26469 - RNA, 22 nt, Human
uggcaauauuaacaguacuuau

SEQ ID NO: 26470 - RNA, 22 nt, Human
uggcaaugaggucagaugucuu

SEQ ID NO: 26471 - RNA, 22 nt, Human
uggcaauguaaauugaacuaga

SEQ ID NO: 26472 - RNA, 22 nt, Human
uggcaauguaggcaagaacauu

SEQ ID NO: 26473 - RNA, 22 nt, Human
uggcaauucccuuggucaacag

SEQ ID NO: 26474 - RNA, 22 nt, Human
uggcaauuggcaauuucguaug

SEQ ID NO: 26475 - RNA, 22 nt, Human
uggcaauuguccacugucugcc

SEQ ID NO: 26476 - RNA, 22 nt, Human
uggcacaaaucuagucccuggu

SEQ ID NO: 26477 - RNA, 21 nt, Human
uggcacagaaaggaaaguuca

SEQ ID NO: 26478 - RNA, 22 nt, Human
uggcacagacauuuaauagccu

SEQ ID NO: 26479 - RNA, 23 nt, Human
uggcacagaggaccaugcuuugc

SEQ ID NO: 26480 - RNA, 21 nt, Human
uggcacagcaagugggcucau

SEQ ID NO: 26481 - RNA, 22 nt, Human
uggcacagcccauucagagaag

SEQ ID NO: 26482 - RNA, 22 nt, Human
uggcacagcuugucauaaacuc

SEQ ID NO: 26483 - RNA, 22 nt, Human
uggcacaggaauuuagaugcag

SEQ ID NO: 26484 - RNA, 22 nt, Human
uggcacaggaucucagcggcca

SEQ ID NO: 26485 - RNA, 22 nt, Human
uggcacagggcuuggucgcuca

SEQ ID NO: 26486 - RNA, 22 nt, Human
uggcacaguccugggugccugc

SEQ ID NO: 26487 - RNA, 22 nt, Human
uggcacagugcuggauggugcu

SEQ ID NO: 26488 - RNA, 22 nt, Human
uggcacaguuaaaguuguagaa

SEQ ID NO: 26489 - RNA, 22 nt, Human
uggcacaugguaagugcuuaac

SEQ ID NO: 26490 - RNA, 22 nt, Human
uggcacaugguuaaucauaauu

SEQ ID NO: 26491 - RNA, 22 nt, Human
uggcaccaucaaggcugagaac

SEQ ID NO: 26492 - RNA, 22 nt, Human
uggcaccugaacuuagaggugu

SEQ ID NO: 26493 - RNA, 22 nt, Human
uggcacgacaauuggcaccaau

SEQ ID NO: 26494 - RNA, 22 nt, Human
uggcacuauggaugagacugau

SEQ ID NO: 26495 - RNA, 22 nt, Human
uggcacucacucucagagucug

SEQ ID NO: 26496 - RNA, 22 nt, Human
uggcacugaaaaaggagagguu

SEQ ID NO: 26497 - RNA, 22 nt, Human
uggcacugaagcuggaaagccu

SEQ ID NO: 26498 - RNA, 22 nt, Human
uggcacugacagggugcucaag

SEQ ID NO: 26499 - RNA, 22 nt, Human
uggcacugaccccaggccugug

SEQ ID NO: 26500 - RNA, 22 nt, Human
uggcacugccuggcagggcccc

SEQ ID NO: 26501 - RNA, 22 nt, Human
uggcacugggacagaugcucuc

SEQ ID NO: 26502 - RNA, 22 nt, Human
uggcacugucaccaaugcuguc

SEQ ID NO: 26503 - RNA, 22 nt, Human
uggcacuuagaucagguugggu

SEQ ID NO: 26504 - RNA, 22 nt, Human
uggcacuuuacacccauuuggc

SEQ ID NO: 26505 - RNA, 22 nt, Human
uggcagaauuucuagcagauuc

SEQ ID NO: 26506 - RNA, 22 nt, Human
uggcagaccaucuuauuaacaa

SEQ ID NO: 26507 - RNA, 22 nt, Human
uggcagacuuuagggucuacau

SEQ ID NO: 26508 - RNA, 22 nt, Human
uggcagagaacacggcugaucu

SEQ ID NO: 26509 - RNA, 23 nt, Human
uggcagagacccagaaucuacau

SEQ ID NO: 26510 - RNA, 22 nt, Human
uggcagagcaaaaagauagaau

SEQ ID NO: 26511 - RNA, 22 nt, Human
uggcagagcccagaacugagca

SEQ ID NO: 26512 - RNA, 22 nt, Human
uggcagagcccagacuccaguc

SEQ ID NO: 26513 - RNA, 22 nt, Human
uggcagagcuggcugcggauga

SEQ ID NO: 26514 - RNA, 22 nt, Human
uggcagaggaggcucagauuga

SEQ ID NO: 26515 - RNA, 22 nt, Human
uggcagagguaauucaaauccc

SEQ ID NO: 26516 - RNA, 22 nt, Human
uggcagagguauauugggagga

SEQ ID NO: 26517 - RNA, 22 nt, Human
uauuuuagguaauauccauugu

SEQ ID NO: 26518 - RNA, 22 nt, Human
uauuuucaucuuguccuuggau

SEQ ID NO: 26519 - RNA, 19 nt, Human
uauuuucguggaggccuau

SEQ ID NO: 26520 - RNA, 22 nt, Human
uauuuucuggggagagugaacc

SEQ ID NO: 26521 - RNA, 22 nt, Human
uauuuugagccccugacaucua

SEQ ID NO: 26522 - RNA, 22 nt, Human
uauuuuggcugauucaucaugu

SEQ ID NO: 26523 - RNA, 22 nt, Human
uauuuuguaauuggucauagcu

SEQ ID NO: 26524 - RNA, 22 nt, Human
uauuuuguauuuaugcaagaaa

SEQ ID NO: 26525 - RNA, 22 nt, Human
uauuuuguuaauaauccagucc

SEQ ID NO: 26526 - RNA, 22 nt, Human
ucaaaaauaagauauucuggac

SEQ ID NO: 26527 - RNA, 22 nt, Human
ucaaaaauguuuuauauuggua

SEQ ID NO: 26528 - RNA, 22 nt, Human
ucaaaacacuauuaccuuuaau

SEQ ID NO: 26529 - RNA, 22 nt, Human
ucaaaaguggccuguaaaaucu

SEQ ID NO: 26530 - RNA, 18 nt, Human
ucaaaauauuucugugga

SEQ ID NO: 26531 - RNA, 22 nt, Human
ucaaaaucaaagauacuugaaa

SEQ ID NO: 26532 - RNA, 22 nt, Human
ucaaaaugccgagugcccaggu

SEQ ID NO: 26533 - RNA, 22 nt, Human
ucaaaauucuagggagaauggu

SEQ ID NO: 26534 - RNA, 22 nt, Human
ucaaaauuuuauuucucaagga

SEQ ID NO: 26535 - RNA, 22 nt, Human
ucaaacacuguaacauggaaaa

SEQ ID NO: 26536 - RNA, 22 nt, Human
ucaaacagcaggucuuucauag

SEQ ID NO: 26537 - RNA, 22 nt, Human
ucaaacaggacuacauucucau

SEQ ID NO: 26538 - RNA, 22 nt, Human
ucaaacaugaaagcuugauuuu

SEQ ID NO: 26539 - RNA, 22 nt, Human
ucaaaccaccuuguuacugggg

SEQ ID NO: 26540 - RNA, 22 nt, Human
ucaaacuagccugacugguauu

SEQ ID NO: 26541 - RNA, 22 nt, Human
ucaaacugcuaccuuuuaugug

SEQ ID NO: 26542 - RNA, 22 nt, Human
ucaaacuggcagacuucuacuu

SEQ ID NO: 26543 - RNA, 22 nt, Human
ucaaacuggggaacuuauuuau

SEQ ID NO: 26544 - RNA, 18 nt, Human
ucaaacugucauugguga

SEQ ID NO: 26545 - RNA, 23 nt, Human
ucaaacuguuauauugccagagu

SEQ ID NO: 26546 - RNA, 22 nt, Human
ucaaacuguuuacagugagaua

SEQ ID NO: 26547 - RNA, 20 nt, Human
ucaaagcacugccugucauc

SEQ ID NO: 26548 - RNA, 22 nt, Human
ucaaagcagcacauucgcaagc

SEQ ID NO: 26549 - RNA, 22 nt, Human
ucaaagcaucagucaauuuagg

SEQ ID NO: 26550 - RNA, 22 nt, Human
ucaaagcaugguuuugaaagac

SEQ ID NO: 26551 - RNA, 22 nt, Human
ucaaaggaauuugauuuugaug

SEQ ID NO: 26552 - RNA, 22 nt, Human
ucaaaggaguuuaaguuacugg

SEQ ID NO: 26553 - RNA, 20 nt, Human
ucaaaggcaaaggugggugu

SEQ ID NO: 26554 - RNA, 22 nt, Human
ucaaaggcgguccaggaauaaa

SEQ ID NO: 26555 - RNA, 22 nt, Human
ucaaaggcugcuugucuucugg

SEQ ID NO: 26556 - RNA, 22 nt, Human
ucaaaggguaauguaauagucu

SEQ ID NO: 26557 - RNA, 22 nt, Human
ucaaaggguccuuaacaugaga

SEQ ID NO: 26558 - RNA, 22 nt, Human
ucacaagagcuggacugucuuu

SEQ ID NO: 26559 - RNA, 22 nt, Human
ucacaagguccugguggauaga

SEQ ID NO: 26560 - RNA, 22 nt, Human
ucacaauauuuaucuuccaauu

SEQ ID NO: 26561 - RNA, 22 nt, Human
ucacaauucagaaaccaaguag

SEQ ID NO: 26562 - RNA, 22 nt, Human
ucacacagauugguagagcuga

SEQ ID NO: 26563 - RNA, 22 nt, Human
ucacacagcuaguaagggccga

SEQ ID NO: 26564 - RNA, 22 nt, Human
ucacacagcugacagagccuuu

SEQ ID NO: 26565 - RNA, 22 nt, Human
ucacacagcugcucuguuuuau

SEQ ID NO: 26566 - RNA, 23 nt, Human
ucacacagcuggucagguacaga

SEQ ID NO: 26567 - RNA, 22 nt, Human
ucacacaggguucuggucucau

SEQ ID NO: 26568 - RNA, 22 nt, Human
ucacacauaaaaagaagacuag

SEQ ID NO: 26569 - RNA, 20 nt, Human
ucacacauaagugaacgcac

SEQ ID NO: 26570 - RNA, 22 nt, Human
ucacacauacucaugugugagu

SEQ ID NO: 26571 - RNA, 23 nt, Human
ucacacuggauacacaugcaaga

SEQ ID NO: 26572 - RNA, 22 nt, Human
ucacacuggcagugcugaaggc

SEQ ID NO: 26573 - RNA, 22 nt, Human
ucacacuuaucccacucaguca

SEQ ID NO: 26574 - RNA, 22 nt, Human
ucacacuucaaaggguuagauc

SEQ ID NO: 26575 - RNA, 18 nt, Human
ucacacuuccuuuggguc

SEQ ID NO: 26576 - RNA, 22 nt, Human
ucacagaaagcuguguccugac

SEQ ID NO: 26577 - RNA, 22 nt, Human
ucacagaacacaaaugccacuu

SEQ ID NO: 26578 - RNA, 22 nt, Human
ucacagaagaaguagauugcau

SEQ ID NO: 26579 - RNA, 22 nt, Human
ucacagaagagauauugacaga

SEQ ID NO: 26580 - RNA, 22 nt, Human
ucacagaagaugcuggauguug

SEQ ID NO: 26581 - RNA, 22 nt, Human
ucacagaaggaccuuguuucau

SEQ ID NO: 26582 - RNA, 22 nt, Human
ucacagaagggaaagaugccaa

SEQ ID NO: 26583 - RNA, 22 nt, Human
ucacagaaguguguuucaggag

SEQ ID NO: 26584 - RNA, 22 nt, Human
ucacagaauagcacuguaagcg

SEQ ID NO: 26585 - RNA, 22 nt, Human
ucacagaaugucuagcauaauu

SEQ ID NO: 26586 - RNA, 22 nt, Human
ucacagaauugacaugggaauc

SEQ ID NO: 26587 - RNA, 22 nt, Human
ucacagaauuuuugcuuccagu

SEQ ID NO: 26588 - RNA, 22 nt, Human
ucacagacacagggagaagcau

SEQ ID NO: 26589 - RNA, 22 nt, Human
ucacagacacuggguuauugca

SEQ ID NO: 26590 - RNA, 22 nt, Human
ucacagacucaagggcauagga

SEQ ID NO: 26591 - RNA, 22 nt, Human
ucacagacucuugauugucuaa

SEQ ID NO: 26592 - RNA, 22 nt, Human
ucacagagaaaagcuaucacaa

SEQ ID NO: 26593 - RNA, 22 nt, Human
ucacagagaacuauaauccauc

SEQ ID NO: 26594 - RNA, 22 nt, Human
ucacagagagguuaagcaguug

SEQ ID NO: 26595 - RNA, 23 nt, Human
ucacagagcauacugcauuuugc

SEQ ID NO: 26596 - RNA, 21 nt, Human
ucacagagccacagaauuggu

SEQ ID NO: 26597 - RNA, 22 nt, Human
ucacagaguuaaaaguuucuuu

SEQ ID NO: 26598 - RNA, 22 nt, Human
ucacagcaacccugaggcgagu

SEQ ID NO: 26599 - RNA, 22 nt, Human
ucacagcaguaaagaaaacacu

SEQ ID NO: 26600 - RNA, 22 nt, Human
ucacagcauuuuuagaaagauu

SEQ ID NO: 26601 - RNA, 22 nt, Human
ucacagccuggucacucugccc

SEQ ID NO: 26602 - RNA, 22 nt, Human
ucacagcuaagcuuggucacug

SEQ ID NO: 26603 - RNA, 20 nt, Human
ucacagcuggcuaugacagg

SEQ ID NO: 26604 - RNA, 22 nt, Human
ucacagcugggguuuuggcagc

SEQ ID NO: 26605 - RNA, 22 nt, Human
ucacagcuuucagauuguuccc

SEQ ID NO: 26606 - RNA, 22 nt, Human
ucacagcuuugagcagagacca

SEQ ID NO: 26607 - RNA, 22 nt, Human
ucacaggaaccaucagagaaau

SEQ ID NO: 26608 - RNA, 22 nt, Human
ucacaggacccugaggguggcg

SEQ ID NO: 26609 - RNA, 22 nt, Human
ucacaggagauuaugugugcua

SEQ ID NO: 26610 - RNA, 22 nt, Human
ucacaggaggaaccuggccugg

SEQ ID NO: 26611 - RNA, 22 nt, Human
ucacaggaggacugaaagauau

SEQ ID NO: 26612 - RNA, 22 nt, Human
ucacaggagucaaggaauagua

SEQ ID NO: 26613 - RNA, 22 nt, Human
ucacaggagucauaauuacagu

SEQ ID NO: 26614 - RNA, 22 nt, Human
ucacaggcccaaaccacgcuua

SEQ ID NO: 26615 - RNA, 22 nt, Human
ucacagggcauuauggcuccag

SEQ ID NO: 26616 - RNA, 20 nt, Human
ucacaggggaccaggagcag

SEQ ID NO: 26617 - RNA, 23 nt, Human
ucacaggggccagcgcucugugg

SEQ ID NO: 26618 - RNA, 22 nt, Human
ucacaggguguacaucaccuau

SEQ ID NO: 26619 - RNA, 22 nt, Human
ucacaguacuccccaaaguuuc

SEQ ID NO: 26620 - RNA, 22 nt, Human
ucacaguagccauuucaugagu

SEQ ID NO: 26621 - RNA, 22 nt, Human
ucacagugaggaguuacaguuu

SEQ ID NO: 26622 - RNA, 22 nt, Human
ucacagugaggcaguucuugua

SEQ ID NO: 26623 - RNA, 22 nt, Human
ucacagugcacagcaggcgugg

SEQ ID NO: 26624 - RNA, 22 nt, Human
ucacaguguggcaacucacaga

SEQ ID NO: 26625 - RNA, 22 nt, Human
ucacaguuaugggccuugguca

SEQ ID NO: 26626 - RNA, 22 nt, Human
ucacaguucaacuaguucagau

SEQ ID NO: 26627 - RNA, 17 nt, Human
ucacaguuggucucagu

SEQ ID NO: 26628 - RNA, 22 nt, Human
ucacaguuuuaagugugaucca

SEQ ID NO: 26629 - RNA, 22 nt, Human
ucacauacugaaaguccaguga

SEQ ID NO: 26630 - RNA, 16 nt, Human
ucacauacuuccuugc

SEQ ID NO: 26631 - RNA, 23 nt, Human
ucacauauguagaaguggaauuc

SEQ ID NO: 26632 - RNA, 22 nt, Human
ucacauauuuaagaaaguuaaa

SEQ ID NO: 26633 - RNA, 22 nt, Human
ucacaucacaugacaguaggcc

SEQ ID NO: 26634 - RNA, 22 nt, Human
ucacaucaggugucuccccaag

SEQ ID NO: 26635 - RNA, 22 nt, Human
ucacaucuauacccaauaauuu

SEQ ID NO: 26636 - RNA, 21 nt, Human
ucacaucuauguuaagcaaac

SEQ ID NO: 26637 - RNA, 22 nt, Human
uggcagagugcagaagaggcau

SEQ ID NO: 26638 - RNA, 22 nt, Human
uggcagaguucgcuccuauuca

SEQ ID NO: 26639 - RNA, 23 nt, Human
uggcagauacaggcaugacuucu

SEQ ID NO: 26640 - RNA, 22 nt, Human
uggcagaugcguuuucauuuuc

SEQ ID NO: 26641 - RNA, 22 nt, Human
uggcagauggccuggaaccaaa

SEQ ID NO: 26642 - RNA, 22 nt, Human
uggcagauucugguugauacuu

SEQ ID NO: 26643 - RNA, 22 nt, Human
uggcagauuguaggcaguuagg

SEQ ID NO: 26644 - RNA, 22 nt, Human
uggcagauuuugaagacagaga

SEQ ID NO: 26645 - RNA, 22 nt, Human
uggcagcaaaaccagaaucaga

SEQ ID NO: 26646 - RNA, 22 nt, Human
uggcagcaauagaaauauaauc

SEQ ID NO: 26647 - RNA, 22 nt, Human
uggcagcacauugacccgggcu

SEQ ID NO: 26648 - RNA, 22 nt, Human
uggcagcaccagcaguguccuu

SEQ ID NO: 26649 - RNA, 22 nt, Human
uggcagcacggcauccacucuc

SEQ ID NO: 26650 - RNA, 22 nt, Human
uggcagcacuagguacugagcu

SEQ ID NO: 26651 - RNA, 22 nt, Human
uggcagcagacaaaaggccauu

SEQ ID NO: 26652 - RNA, 22 nt, Human
uggcagcagcaaauggcauauc

SEQ ID NO: 26653 - RNA, 22 nt, Human
uggcagcagggaggccaguguu

SEQ ID NO: 26654 - RNA, 22 nt, Human
uggcagcauuaauuauucaggu

SEQ ID NO: 26655 - RNA, 22 nt, Human
uggcagccaucugagggugggg

SEQ ID NO: 26656 - RNA, 22 nt, Human
uggcagccuucucugagaaggu

SEQ ID NO: 26657 - RNA, 22 nt, Human
uggcagcuagauaguguguuua

SEQ ID NO: 26658 - RNA, 22 nt, Human
uggcagcucccagagcuuccaa

SEQ ID NO: 26659 - RNA, 22 nt, Human
uggcagcugcaggccuccugag

SEQ ID NO: 26660 - RNA, 22 nt, Human
uggcagcuggaucccaaggcag

SEQ ID NO: 26661 - RNA, 22 nt, Human
uggcagcugucagaaugcaaau

SEQ ID NO: 26662 - RNA, 22 nt, Human
uggcagcugugcuucauucuuu

SEQ ID NO: 26663 - RNA, 22 nt, Human
uggcagcuuccugcucauagga

SEQ ID NO: 26664 - RNA, 22 nt, Human
uggcagcuugaaugcagucuuu

SEQ ID NO: 26665 - RNA, 18 nt, Human
uggcaggaaaugcacuuu

SEQ ID NO: 26666 - RNA, 22 nt, Human
uggcaggaaccuuaaccacaaa

SEQ ID NO: 26667 - RNA, 22 nt, Human
ucaguuucacuugaagaaaaga

SEQ ID NO: 26668 - RNA, 23 nt, Human
ucaguuuguauaauccauaugca

SEQ ID NO: 26669 - RNA, 19 nt, Human
ucaguuuuagucaucaguu

SEQ ID NO: 26670 - RNA, 22 nt, Human
ucaguuuucaauuucaucagag

SEQ ID NO: 26671 - RNA, 22 nt, Human
ucaguuuucauuucaugagcag

SEQ ID NO: 26672 - RNA, 22 nt, Human
ucaguuuugaaaacauugaaug

SEQ ID NO: 26673 - RNA, 22 nt, Human
ucaguuuuucuauacuuuguag

SEQ ID NO: 26674 - RNA, 22 nt, Human
ucaguuuuuguuugccagauag

SEQ ID NO: 26675 - RNA, 19 nt, Human
ucauaaaaaugguaaccca

SEQ ID NO: 26676 - RNA, 22 nt, Human
ucauaaacaaaacaguuuaugc

SEQ ID NO: 26677 - RNA, 22 nt, Human
ucauaaacucacuaguuuaugu

SEQ ID NO: 26678 - RNA, 19 nt, Human
ucauaaacugggcacagug

SEQ ID NO: 26679 - RNA, 22 nt, Human
ucauaaagcauuucagcuuuug

SEQ ID NO: 26680 - RNA, 22 nt, Human
ucauaaaguucuaagaauugua

SEQ ID NO: 26681 - RNA, 22 nt, Human
ucauaaauaguugugccugaau

SEQ ID NO: 26682 - RNA, 23 nt, Human
ucauaaauauuagcacaguagga

SEQ ID NO: 26683 - RNA, 22 nt, Human
ucauaaauugauuaugugcuuu

SEQ ID NO: 26684 - RNA, 22 nt, Human
ucauaacaaccuggaaggccag

SEQ ID NO: 26685 - RNA, 23 nt, Human
ucauaagugcucaguuacuguua

SEQ ID NO: 26686 - RNA, 22 nt, Human
ucauaauacaaagaguucugca

SEQ ID NO: 26687 - RNA, 22 nt, Human
ucauaauguaguucauggcugg

SEQ ID NO: 26688 - RNA, 22 nt, Human
ucauacauucagcagauauuug

SEQ ID NO: 26689 - RNA, 22 nt, Human
ucauagaaauaucacgucuuuu

SEQ ID NO: 26690 - RNA, 18 nt, Human
ucauagaagugaaucaga

SEQ ID NO: 26691 - RNA, 22 nt, Human
ucauaguuuuacuuaguggugu

SEQ ID NO: 26692 - RNA, 22 nt, Human
ucauauaaguuuaaaacuaucu

SEQ ID NO: 26693 - RNA, 22 nt, Human
ucauauaccagagaguuuauau

SEQ ID NO: 26694 - RNA, 22 nt, Human
ucauauaccugcaugugcaugu

SEQ ID NO: 26695 - RNA, 22 nt, Human
ucauaugauuguaaugagaaua

SEQ ID NO: 26696 - RNA, 20 nt, Human
ucauaugugguuguauacaa

SEQ ID NO: 26697 - RNA, 22 nt, Human
ucauauuaacaaugaaacucag

SEQ ID NO: 26698 - RNA, 20 nt, Human
ucauauugauguagagcagc

SEQ ID NO: 26699 - RNA, 22 nt, Human
ucauauuuggggguguguguuu

SEQ ID NO: 26700 - RNA, 22 nt, Human
ucaucaaaagccuucuggguua

SEQ ID NO: 26701 - RNA, 22 nt, Human
ucaucaaagcgcuuggaguagg

SEQ ID NO: 26702 - RNA, 22 nt, Human
ucaucaucacucuggcaagcau

SEQ ID NO: 26703 - RNA, 22 nt, Human
ucaucaucauucucccccacuu

SEQ ID NO: 26704 - RNA, 22 nt, Human
ucaucauucugacaagucuaca

SEQ ID NO: 26705 - RNA, 22 nt, Human
ucauccagccucaucaggagcu

SEQ ID NO: 26706 - RNA, 21 nt, Human
ucauccagguccugcuucuuc

SEQ ID NO: 26707 - RNA, 22 nt, Human
ucauccaguaugacuggugucu

SEQ ID NO: 26708 - RNA, 22 nt, Human
ucauccaguuguggagagggaa

SEQ ID NO: 26709 - RNA, 22 nt, Human
ucauccauauagaaagaugauu

SEQ ID NO: 26710 - RNA, 21 nt, Human
ucauccauggcuuuugugcuu

SEQ ID NO: 26711 - RNA, 22 nt, Human
ucauccauuguccucacauuag

SEQ ID NO: 26712 - RNA, 22 nt, Human
ucaucccucugccaggcccagg

SEQ ID NO: 26713 - RNA, 22 nt, Human
ucaucucaaaauuaugcugcac

SEQ ID NO: 26714 - RNA, 22 nt, Human
ucaucucucaggauaccagcag

SEQ ID NO: 26715 - RNA, 23 nt, Human
ucaucuguaaguaucuguggagu

SEQ ID NO: 26716 - RNA, 22 nt, Human
ucaucugugaauaaugaacugg

SEQ ID NO: 26717 - RNA, 22 nt, Human
ucaucuguuaugggaguuuuug

SEQ ID NO: 26718 - RNA, 22 nt, Human
ucaucuguugauuuuaagucuu

SEQ ID NO: 26719 - RNA, 21 nt, Human
ucaucuuacaguccuuucuuu

SEQ ID NO: 26720 - RNA, 23 nt, Human
ucaucuuccucauuucuccaggg

SEQ ID NO: 26721 - RNA, 22 nt, Human
ucaucuucuauuaauagggaga

SEQ ID NO: 26722 - RNA, 22 nt, Human
ucaugaacaucucaaauaacca

SEQ ID NO: 26723 - RNA, 22 nt, Human
ucaugaacuuccuagccagacu

SEQ ID NO: 26724 - RNA, 22 nt, Human
ucaugaauauugaaugcuucau

SEQ ID NO: 26725 - RNA, 22 nt, Human
ucaugacaacuugcacaguuuu

SEQ ID NO: 26726 - RNA, 22 nt, Human
ucaugacagccagagcucugac

SEQ ID NO: 26727 - RNA, 22 nt, Human
ucaugauacccaaguaccuaga

SEQ ID NO: 26728 - RNA, 18 nt, Human
ucaugcaaacgcuucaua

SEQ ID NO: 26729 - RNA, 22 nt, Human
ucaugcaaagccaauuccagcu

SEQ ID NO: 26730 - RNA, 22 nt, Human
ucaugcaagaauaauaggaagg

SEQ ID NO: 26731 - RNA, 20 nt, Human
ucaugcaagauucauaaagg

SEQ ID NO: 26732 - RNA, 22 nt, Human
ucaugcaagcaggcacugggaa

SEQ ID NO: 26733 - RNA, 22 nt, Human
ucaugcacaugugucaccauca

SEQ ID NO: 26734 - RNA, 22 nt, Human
ucaugcagaguagaaagggcaa

SEQ ID NO: 26735 - RNA, 22 nt, Human
ucaugcagauaagaauaaguaa

SEQ ID NO: 26736 - RNA, 22 nt, Human
ucaugcagcaauaugcauuagg

SEQ ID NO: 26737 - RNA, 22 nt, Human
ucaugcagcuuuuccauucagc

SEQ ID NO: 26738 - RNA, 20 nt, Human
ucaugcagguguucuagguu

SEQ ID NO: 26739 - RNA, 22 nt, Human
ucaugcagguuuccagccagau

SEQ ID NO: 26740 - RNA, 19 nt, Human
ucaugcaguggggggugug

SEQ ID NO: 26741 - RNA, 23 nt, Human
ucaugcccaggcuccagauguca

SEQ ID NO: 26742 - RNA, 22 nt, Human
ucaugcugugaacuguauacau

SEQ ID NO: 26743 - RNA, 22 nt, Human
ucauggaaacagcaaugcuaau

SEQ ID NO: 26744 - RNA, 22 nt, Human
ucauggaagagguauuuuuugu

SEQ ID NO: 26745 - RNA, 22 nt, Human
ucauggaagauguagggucagg

SEQ ID NO: 26746 - RNA, 22 nt, Human
ucauggaaggaguggccaagug

SEQ ID NO: 26747 - RNA, 22 nt, Human
ucauggacgucaccaugguccu

SEQ ID NO: 26748 - RNA, 22 nt, Human
ucauggauaaaauauugguuaa

SEQ ID NO: 26749 - RNA, 22 nt, Human
ucauggaugauagcuucauugc

SEQ ID NO: 26750 - RNA, 18 nt, Human
ucauggcuugcagauggu

SEQ ID NO: 26751 - RNA, 22 nt, Human
ucauggcuuuuauuauguugag

SEQ ID NO: 26752 - RNA, 22 nt, Human
ucauggggcucuucaaguggag

SEQ ID NO: 26753 - RNA, 22 nt, Human
ucaugggguagaagcauguuua

SEQ ID NO: 26754 - RNA, 22 nt, Human
ucauggggugacagaagggagg

SEQ ID NO: 26755 - RNA, 22 nt, Human
ucauguaaaguguagguuuaga

SEQ ID NO: 26756 - RNA, 18 nt, Human
ucaugucacugugcuccc

SEQ ID NO: 26757 - RNA, 21 nt, Human
ucaugugcugaggaugaugcc

SEQ ID NO: 26758 - RNA, 21 nt, Human
ucauguguaacuuuugaccac

SEQ ID NO: 26759 - RNA, 22 nt, Human
ucaugugucugccaguguuuau

SEQ ID NO: 26760 - RNA, 22 nt, Human
ucauguuucucuuacagcagcu

SEQ ID NO: 26761 - RNA, 22 nt, Human
ucauguuuguuggaaauguggc

SEQ ID NO: 26762 - RNA, 22 nt, Human
ucauguuuuagcugcaaaauga

SEQ ID NO: 26763 - RNA, 22 nt, Human
ucauuaauuugcuuagacuuau

SEQ ID NO: 26764 - RNA, 22 nt, Human
ucauuacuuauuaaaagccuug

SEQ ID NO: 26765 - RNA, 22 nt, Human
ucauuauagaguuguauuuuag

SEQ ID NO: 26766 - RNA, 22 nt, Human
ucauucaagauuucaauagauu

SEQ ID NO: 26767 - RNA, 22 nt, Human
ucauucauaucucucaagcuua

SEQ ID NO: 26768 - RNA, 18 nt, Human
ucauucauuaaacuuggc

SEQ ID NO: 26769 - RNA, 22 nt, Human
ucauucauugcaagcacacgca

SEQ ID NO: 26770 - RNA, 20 nt, Human
ucauuccaaauaguucagca

SEQ ID NO: 26771 - RNA, 23 nt, Human
ucauuccacaaauacuuaucuag

SEQ ID NO: 26772 - RNA, 22 nt, Human
ucauucccccauaaugguauuu

SEQ ID NO: 26773 - RNA, 22 nt, Human
ucauucccuccagcuguggcua

SEQ ID NO: 26774 - RNA, 22 nt, Human
ucauuccuuaacauucauuugc

SEQ ID NO: 26775 - RNA, 22 nt, Human
ucauucggcaauaguguguuag

SEQ ID NO: 26776 - RNA, 22 nt, Human
uccaaaaaacguuugaauaguu

SEQ ID NO: 26777 - RNA, 21 nt, Human
uccaaaccugucucuggcucu

SEQ ID NO: 26778 - RNA, 22 nt, Human
uccaaagaaccuggcuacuguc

SEQ ID NO: 26779 - RNA, 22 nt, Human
uccaaagagcuuaggagagaaa

SEQ ID NO: 26780 - RNA, 18 nt, Human
uccaaagccagagaaguu

SEQ ID NO: 26781 - RNA, 19 nt, Human
uccaaaggacccaccucca

SEQ ID NO: 26782 - RNA, 22 nt, Human
uccaaaguaauuucacuucugu

SEQ ID NO: 26783 - RNA, 22 nt, Human
uccaaaguguugggauuauagg

SEQ ID NO: 26784 - RNA, 22 nt, Human
ucauugaagcccuugacaagcc

SEQ ID NO: 26785 - RNA, 22 nt, Human
ucauugaagugacugaaagauu

SEQ ID NO: 26786 - RNA, 22 nt, Human
ucauugaaugcucugcagguug

SEQ ID NO: 26787 - RNA, 22 nt, Human
ucauugaauuucacagcuuuau

SEQ ID NO: 26788 - RNA, 22 nt, Human
ucauugacuugaagaaaacaau

SEQ ID NO: 26789 - RNA, 22 nt, Human
ucauugagcgguucuuaaccca

SEQ ID NO: 26790 - RNA, 22 nt, Human
ucauugaggaaagguaguggcu

SEQ ID NO: 26791 - RNA, 22 nt, Human
ucauugaguucaaauccuucau

SEQ ID NO: 26792 - RNA, 22 nt, Human
ucauugcaagcucauuuaucug

SEQ ID NO: 26793 - RNA, 22 nt, Human
ucauugcagacuaacaaucuca

SEQ ID NO: 26794 - RNA, 22 nt, Human
ucauugcaggcauuccccugcc

SEQ ID NO: 26795 - RNA, 22 nt, Human
ucauugcucuagguuccuugga

SEQ ID NO: 26796 - RNA, 22 nt, Human
ucauugguaauuauuuuugaca

SEQ ID NO: 26797 - RNA, 22 nt, Human
ucauuguaauuaucugugguau

SEQ ID NO: 26798 - RNA, 22 nt, Human
ucauuguagggcauuuagagag

SEQ ID NO: 26799 - RNA, 22 nt, Human
ucauugucgcucugcgguguuc

SEQ ID NO: 26800 - RNA, 22 nt, Human
ucauugucucucuuuucauaua

SEQ ID NO: 26801 - RNA, 22 nt, Human
ucauuuaauagcuuuugucuuu

SEQ ID NO: 26802 - RNA, 22 nt, Human
ucauuuaauugguuuugcucgu

SEQ ID NO: 26803 - RNA, 22 nt, Human
ucauuuacagacugugugggug

SEQ ID NO: 26804 - RNA, 22 nt, Human
ucauuuacaggugaagcaacua

SEQ ID NO: 26805 - RNA, 22 nt, Human
ucauuuacgcgccuccuuccuu

SEQ ID NO: 26806 - RNA, 22 nt, Human
ucauuuacuguaggcaaaaauu

SEQ ID NO: 26807 - RNA, 22 nt, Human
ucauuuacuucuaugacaacau

SEQ ID NO: 26808 - RNA, 22 nt, Human
ucauuuauaaggaugcaauuaa

SEQ ID NO: 26809 - RNA, 22 nt, Human
ucauuuaucauuugugcuguag

SEQ ID NO: 26810 - RNA, 22 nt, Human
ucauuuauuuauaccauugccu

SEQ ID NO: 26811 - RNA, 22 nt, Human
ucauuuauuugacuuuggagug

SEQ ID NO: 26812 - RNA, 23 nt, Human
ucauuucacagugagcuuccuag

SEQ ID NO: 26813 - RNA, 22 nt, Human
ucauuucacuucucuagggaga

SEQ ID NO: 26814 - RNA, 23 nt, Human
ucauuucagguugcaugguacca

SEQ ID NO: 26815 - RNA, 22 nt, Human
ucauuucaguucagaggccuuu

SEQ ID NO: 26816 - RNA, 22 nt, Human
ucauuuccucaaauucaagguu

SEQ ID NO: 26817 - RNA, 22 nt, Human
ucauuucuaucuaugcagcuuc

SEQ ID NO: 26818 - RNA, 21 nt, Human
ucauuucucuauguauuucac

SEQ ID NO: 26819 - RNA, 22 nt, Human
ucauuucugagccuuccaugau

SEQ ID NO: 26820 - RNA, 17 nt, Human
ucauuugggccucacaa

SEQ ID NO: 26821 - RNA, 22 nt, Human
ucauuugguccucccaacaagc

SEQ ID NO: 26822 - RNA, 21 nt, Human
ucauuugugaucugauuucca

SEQ ID NO: 26823 - RNA, 22 nt, Human
ucauuuguggaagugauugugg

SEQ ID NO: 26824 - RNA, 22 nt, Human
ucauuuguuacagccacauacc

SEQ ID NO: 26825 - RNA, 22 nt, Human
ucauuuguucucauucucuacu

SEQ ID NO: 26826 - RNA, 22 nt, Human
ucauuuguugaacuuuagugcg

SEQ ID NO: 26827 - RNA, 22 nt, Human
ucauuuucacacauaaauagca

SEQ ID NO: 26828 - RNA, 22 nt, Human
ucauuuucccacugaagcuguc

SEQ ID NO: 26829 - RNA, 22 nt, Human
ucauuuugcagagcugaggaac

SEQ ID NO: 26830 - RNA, 22 nt, Human
ucauuuugccugccauuugagu

SEQ ID NO: 26831 - RNA, 18 nt, Human
ucauuuugucugccuuug

SEQ ID NO: 26832 - RNA, 22 nt, Human
ucauuuugugccuuaugaccgc

SEQ ID NO: 26833 - RNA, 21 nt, Human
ucauuuuuauugcuaccuugc

SEQ ID NO: 26834 - RNA, 22 nt, Human
ucauuuuucacacagggucacc

SEQ ID NO: 26835 - RNA, 22 nt, Human
ucauuuuucucuuacacguaga

SEQ ID NO: 26836 - RNA, 22 nt, Human
ucauuuuugaccauggguagga

SEQ ID NO: 26837 - RNA, 22 nt, Human
ucauuuuuuuccgguaggaaua

SEQ ID NO: 26838 - RNA, 22 nt, Human
uccaaacgggagccaaaugagc

SEQ ID NO: 26839 - RNA, 22 nt, Human
uccaaagaacauugcugagacc

SEQ ID NO: 26840 - RNA, 22 nt, Human
uccaaagaauagaggugacauu

SEQ ID NO: 26841 - RNA, 22 nt, Human
uccaaagacuugcuguauguaa

SEQ ID NO: 26842 - RNA, 22 nt, Human
uccaaagccccaugcacuuucu

SEQ ID NO: 26843 - RNA, 22 nt, Human
uccaaaggaagaggcugucagu

SEQ ID NO: 26844 - RNA, 22 nt, Human
uccaaagggaagcgcuuucugu

SEQ ID NO: 26845 - RNA, 22 nt, Human
uccaaauaccagaugggcuaau

SEQ ID NO: 26846 - RNA, 22 nt, Human
uccaaauaguucuggaagacug

SEQ ID NO: 26847 - RNA, 22 nt, Human
uccaaauauacagaaucuccuc

SEQ ID NO: 26848 - RNA, 22 nt, Human
uccaaauauaggaugugauaua

SEQ ID NO: 26849 - RNA, 16 nt, Human
uccaagaagugccccu

SEQ ID NO: 26850 - RNA, 22 nt, Human
uccaagacaagcacauuccugc

SEQ ID NO: 26851 - RNA, 22 nt, Human
uccaagaguaagaggacucuuu

SEQ ID NO: 26852 - RNA, 20 nt, Human
uccaagcccuccuuccauuc

SEQ ID NO: 26853 - RNA, 21 nt, Human
uccaagccuucaacacauuca

SEQ ID NO: 26854 - RNA, 21 nt, Human
uccaagcucaacucccuuccu

SEQ ID NO: 26855 - RNA, 22 nt, Human
uccaagcucucuaugccaugau

SEQ ID NO: 26856 - RNA, 22 nt, Human
uccaaggaagucauuuaaacug

SEQ ID NO: 26857 - RNA, 22 nt, Human
uccaaggacuaaauucuagauu

SEQ ID NO: 26858 - RNA, 22 nt, Human
uccaaggacucuugucagcugu

SEQ ID NO: 26859 - RNA, 22 nt, Human
uccaaggagcagauccagagga

SEQ ID NO: 26860 - RNA, 22 nt, Human
uccaaggcuccggcccuggcgu

SEQ ID NO: 26861 - RNA, 22 nt, Human
uccaagggaaugugggcaaugc

SEQ ID NO: 26862 - RNA, 22 nt, Human
uccaagggaauuuaaaguugcu

SEQ ID NO: 26863 - RNA, 22 nt, Human
uccaagucuuccuucccaaacc

SEQ ID NO: 26864 - RNA, 22 nt, Human
uccaauauucauuaaaaugcag

SEQ ID NO: 26865 - RNA, 22 nt, Human
uccaaucagcuccuaugagaau

SEQ ID NO: 26866 - RNA, 22 nt, Human
uccaauuuucugauuucacuug

SEQ ID NO: 26867 - RNA, 21 nt, Human
uccaauuuuuaagacuauggc

SEQ ID NO: 26868 - RNA, 22 nt, Human
uccacaagaugauaaagagagg

SEQ ID NO: 26869 - RNA, 22 nt, Human
uccacagaccaguaucugcagc

SEQ ID NO: 26870 - RNA, 22 nt, Human
uccacagauaaaaacagagguu

SEQ ID NO: 26871 - RNA, 22 nt, Human
uccacagauuaaaaacauacuu

SEQ ID NO: 26872 - RNA, 22 nt, Human
uccacagcauuauuagaaggau

SEQ ID NO: 26873 - RNA, 22 nt, Human
uccacagcuguccuguaacagg

SEQ ID NO: 26874 - RNA, 22 nt, Human
uccacaggcugaggcccuucug

SEQ ID NO: 26875 - RNA, 22 nt, Human
uccacagggaugccugcggcuu

SEQ ID NO: 26876 - RNA, 22 nt, Human
uccacagguauuucuccuugcu

SEQ ID NO: 26877 - RNA, 22 nt, Human
uccacagugguggaauuguuca

SEQ ID NO: 26878 - RNA, 22 nt, Human
uccacaguuuugccacuagcug

SEQ ID NO: 26879 - RNA, 22 nt, Human
uccacaucaagggcagagaggu

SEQ ID NO: 26880 - RNA, 14 nt, Human
uccacaucagcagu

SEQ ID NO: 26881 - RNA, 22 nt, Human
uccacauccauugcuugacuuu

SEQ ID NO: 26882 - RNA, 22 nt, Human
uccacaucucucgccaaccaau

SEQ ID NO: 26883 - RNA, 22 nt, Human
uccacauuagaauguuuucuca

SEQ ID NO: 26884 - RNA, 22 nt, Human
uccacauuauguuucuccuuuc

SEQ ID NO: 26885 - RNA, 22 nt, Human
uggggcaagaagugcccugaag

SEQ ID NO: 26886 - RNA, 22 nt, Human
uggggcagcuccaucuauucca

SEQ ID NO: 26887 - RNA, 22 nt, Human
uggggcaguuaauaaacauucu

SEQ ID NO: 26888 - RNA, 22 nt, Human
uggggccacagccuccuagcuu

SEQ ID NO: 26889 - RNA, 22 nt, Human
uggggccagguggcugcagguc

SEQ ID NO: 26890 - RNA, 19 nt, Human
uggggccuccugucccugg

SEQ ID NO: 26891 - RNA, 22 nt, Human
uggggccuggucagagcugcac

SEQ ID NO: 26892 - RNA, 22 nt, Human
uggggcgcgagguccuggcucc

SEQ ID NO: 26893 - RNA, 22 nt, Human
uggggcucuccacagugucuca

SEQ ID NO: 26894 - RNA, 23 nt, Human
uggggcucuggcaggccugaggu

SEQ ID NO: 26895 - RNA, 22 nt, Human
uggggcuggcacagucucuauu

SEQ ID NO: 26896 - RNA, 22 nt, Human
uggggcuguggauucucacgaa

SEQ ID NO: 26897 - RNA, 22 nt, Human
ugggggacugcacuggcgucag

SEQ ID NO: 26898 - RNA, 22 nt, Human
ugggggagagugcaagcaugaa

SEQ ID NO: 26899 - RNA, 22 nt, Human
ugggggagauuagagcuucuua

SEQ ID NO: 26900 - RNA, 22 nt, Human
ugggggcugugcacaggcucac

SEQ ID NO: 26901 - RNA, 19 nt, Human
ucuaagccucaauguuuuc

SEQ ID NO: 26902 - RNA, 22 nt, Human
ucuaagccuguguccucugcag

SEQ ID NO: 26903 - RNA, 22 nt, Human
ucuaaggacaaggucuuggaga

SEQ ID NO: 26904 - RNA, 22 nt, Human
ucuaaggacaguuauuacuggg

SEQ ID NO: 26905 - RNA, 22 nt, Human
ucuaaguaaaauuugucauuuc

SEQ ID NO: 26906 - RNA, 19 nt, Human
ucuaauaucuacuucccug

SEQ ID NO: 26907 - RNA, 22 nt, Human
ucuaaugagggugaaggcccag

SEQ ID NO: 26908 - RNA, 23 nt, Human
ucuaaugcaauuagaaauuaggg

SEQ ID NO: 26909 - RNA, 22 nt, Human
ucuacaaagaagaauuaauguc

SEQ ID NO: 26910 - RNA, 22 nt, Human
ucuacaaagccauucaggaucu

SEQ ID NO: 26911 - RNA, 22 nt, Human
ucuacagcugcugcuucucaug

SEQ ID NO: 26912 - RNA, 22 nt, Human
ucuacaguagaaagaucccagu

SEQ ID NO: 26913 - RNA, 22 nt, Human
ucuacagugagucauucaaaca

SEQ ID NO: 26914 - RNA, 22 nt, Human
ucuacauaaaaauucagaaggc

SEQ ID NO: 26915 - RNA, 22 nt, Human
ucuacaugauguaccaucuaag

SEQ ID NO: 26916 - RNA, 22 nt, Human
ucuaccacuuauuagcucugug

SEQ ID NO: 26917 - RNA, 22 nt, Human
ucuaccacuuugaccucucugu

SEQ ID NO: 26918 - RNA, 22 nt, Human
ucuaccagggucacagaggccc

SEQ ID NO: 26919 - RNA, 23 nt, Human
ucuacccacacugcucuagaagg

SEQ ID NO: 26920 - RNA, 22 nt, Human
ucuacccugcggucuuggggca

SEQ ID NO: 26921 - RNA, 22 nt, Human
ucuaccuauuucuucuauuggu

SEQ ID NO: 26922 - RNA, 22 nt, Human
ucuacgaagccaccauggagac

SEQ ID NO: 26923 - RNA, 22 nt, Human
ucuacuauguaugcuuuaugcg

SEQ ID NO: 26924 - RNA, 22 nt, Human
ucuacugagugcugagauuuug

SEQ ID NO: 26925 - RNA, 22 nt, Human
ucuacuuucacucauacuuauu

SEQ ID NO: 26926 - RNA, 22 nt, Human
ucuagaaaaaaacugcugugga

SEQ ID NO: 26927 - RNA, 22 nt, Human
ucuagaaaaccaauauuacaug

SEQ ID NO: 26928 - RNA, 23 nt, Human
ucuagaaaaugaaagaaugcagu

SEQ ID NO: 26929 - RNA, 22 nt, Human
ucuagaaacaugacauugaucu

SEQ ID NO: 26930 - RNA, 22 nt, Human
ucuagaaucuaaacuauaguuu

SEQ ID NO: 26931 - RNA, 22 nt, Human
ucuagaauggcugggcacagcu

SEQ ID NO: 26932 - RNA, 22 nt, Human
ucuagaauguuccaccuuguuu

SEQ ID NO: 26933 - RNA, 22 nt, Human
ucuagaauuugcguagguuaga

SEQ ID NO: 26934 - RNA, 22 nt, Human
ucuagagacaaaggaaggaggg

SEQ ID NO: 26935 - RNA, 22 nt, Human
ucuagauuuggggcaugaaguu

SEQ ID NO: 26936 - RNA, 22 nt, Human
ucuagauuuuugugcaccuuug

SEQ ID NO: 26937 - RNA, 22 nt, Human
ucuagcaccacauuaaauagca

SEQ ID NO: 26938 - RNA, 22 nt, Human
ucuagcagagggaagaggcuuu

SEQ ID NO: 26939 - RNA, 22 nt, Human
ucuagcuuggcguuugccuucu

SEQ ID NO: 26940 - RNA, 22 nt, Human
ucuaggaaauuguuacuauauu

SEQ ID NO: 26941 - RNA, 18 nt, Human
ucuaggagaguaccuacc

SEQ ID NO: 26942 - RNA, 22 nt, Human
ucuagggaacaugggucaagcu

SEQ ID NO: 26943 - RNA, 22 nt, Human
ucuagggagaagcucugucugu

SEQ ID NO: 26944 - RNA, 22 nt, Human
ucuaggggcaaugugcaaggac

SEQ ID NO: 26945 - RNA, 22 nt, Human
ucuaggguccacagggucagcc

SEQ ID NO: 26946 - RNA, 22 nt, Human
ucuaggguggagcugggaaucc

SEQ ID NO: 26947 - RNA, 22 nt, Human
ucuaguacuaguuaggaagagu

SEQ ID NO: 26948 - RNA, 19 nt, Human
ucuagucagucagucauuc

SEQ ID NO: 26949 - RNA, 22 nt, Human
ucuagucauauuuuuucaguau

SEQ ID NO: 26950 - RNA, 22 nt, Human
ucuaguguuuuggaacauggaa

SEQ ID NO: 26951 - RNA, 22 nt, Human
ucuaguuaauuccuuugguguu

SEQ ID NO: 26952 - RNA, 22 nt, Human
ucuaguucuagaucccugagga

SEQ ID NO: 26953 - RNA, 22 nt, Human
ucuaguuuucucaaaugacuug

SEQ ID NO: 26954 - RNA, 22 nt, Human
ucuauaaaugcagauaugugug

SEQ ID NO: 26955 - RNA, 22 nt, Human
ucuauacaaguuucacuuugac

SEQ ID NO: 26956 - RNA, 22 nt, Human
ucuauagacuuggacauauagu

SEQ ID NO: 26957 - RNA, 22 nt, Human
ucuauagaucaguaaauaucuc

SEQ ID NO: 26958 - RNA, 22 nt, Human
ucuauaucuuggcugcugugaa

SEQ ID NO: 26959 - RNA, 21 nt, Human
ucuaucaccuaaauuaaacag

SEQ ID NO: 26960 - RNA, 22 nt, Human
ucuaucagaguagaaggcaacg

SEQ ID NO: 26961 - RNA, 22 nt, Human
ucuauccugcuuagaaguaugu

SEQ ID NO: 26962 - RNA, 22 nt, Human
ucuaucuggccccuuuuauaua

SEQ ID NO: 26963 - RNA, 22 nt, Human
ucuaugaagugcgaagaggcac

SEQ ID NO: 26964 - RNA, 22 nt, Human
ucuaugaaugacacagauaaua

SEQ ID NO: 26965 - RNA, 22 nt, Human
ucuauguauggaccuuuucugu

SEQ ID NO: 26966 - RNA, 22 nt, Human
ucuauguugugugucacacaga

SEQ ID NO: 26967 - RNA, 23 nt, Human
ucuauuacuuauuguacucugga

SEQ ID NO: 26968 - RNA, 22 nt, Human
ucuauuagauuauucucaagga

SEQ ID NO: 26969 - RNA, 22 nt, Human
ucuauuuuauacucaaaucuuc

SEQ ID NO: 26970 - RNA, 22 nt, Human
ucucaaacuacacuguaaauug

SEQ ID NO: 26971 - RNA, 22 nt, Human
ucucaaaucaaacuuugagcuu

SEQ ID NO: 26972 - RNA, 22 nt, Human
ucucaaauggcaaauguggguc

SEQ ID NO: 26973 - RNA, 22 nt, Human
ucucaaauuuauacagaguuca

SEQ ID NO: 26974 - RNA, 22 nt, Human
ucucaacaccacuugcugaaga

SEQ ID NO: 26975 - RNA, 22 nt, Human
ucucaacuuugagaaacauugu

SEQ ID NO: 26976 - RNA, 19 nt, Human
ucucaauucuccccacugc

SEQ ID NO: 26977 - RNA, 22 nt, Human
ucucacacuaaugcucuaucag

SEQ ID NO: 26978 - RNA, 22 nt, Human
ucucacagcaucauugcucaug

SEQ ID NO: 26979 - RNA, 22 nt, Human
ucucacagccauuucucccucu

SEQ ID NO: 26980 - RNA, 22 nt, Human
ucucacagugcaggucugucuc

SEQ ID NO: 26981 - RNA, 22 nt, Human
ucucaccauggugcuugcuuau

SEQ ID NO: 26982 - RNA, 22 nt, Human
ucucacugggucacagcagagg

SEQ ID NO: 26983 - RNA, 22 nt, Human
ucucagaaccucaguuugcucu

SEQ ID NO: 26984 - RNA, 19 nt, Human
ucucagaauuggcaaucau

SEQ ID NO: 26985 - RNA, 22 nt, Human
ucucagacucuuuagugaaggu

SEQ ID NO: 26986 - RNA, 22 nt, Human
ucucagagaacaguuggugcuu

SEQ ID NO: 26987 - RNA, 22 nt, Human
ucucagagaagugaugagcaau

SEQ ID NO: 26988 - RNA, 22 nt, Human
ucucagagaucuuucugcaugu

SEQ ID NO: 26989 - RNA, 22 nt, Human
ucucagagauuuauggaaaacu

SEQ ID NO: 26990 - RNA, 22 nt, Human
ucucagagccuaacuaaccuaa

SEQ ID NO: 26991 - RNA, 22 nt, Human
ucucagagcuucaguuauuuuc

SEQ ID NO: 26992 - RNA, 18 nt, Human
ucucagaggccauccuag

SEQ ID NO: 26993 - RNA, 22 nt, Human
ucucagagggaggauuacugcc

SEQ ID NO: 26994 - RNA, 22 nt, Human
ucucuaaauacagaugucaugg

SEQ ID NO: 26995 - RNA, 22 nt, Human
ucucuaaaugauuguguacucc

SEQ ID NO: 26996 - RNA, 22 nt, Human
ucucuaacaaaggagcugcugc

SEQ ID NO: 26997 - RNA, 22 nt, Human
ucucuaaccuaauguggaggga

SEQ ID NO: 26998 - RNA, 22 nt, Human
ucucuacaaaaauuagcaugca

SEQ ID NO: 26999 - RNA, 21 nt, Human
ucucuacacuuucacuaggcu

SEQ ID NO: 27000 - RNA, 22 nt, Human
ucucuacagaaucuuauuauug

SEQ ID NO: 27001 - RNA, 22 nt, Human
ucucuagacauggggaauguca

SEQ ID NO: 27002 - RNA, 22 nt, Human
ucucuaguauaauauagcaaaa

SEQ ID NO: 27003 - RNA, 22 nt, Human
ucucuaguugaggacugagcag

SEQ ID NO: 27004 - RNA, 22 nt, Human
ucucuauuaauugacaauggcu

SEQ ID NO: 27005 - RNA, 19 nt, Human
ucucucaauugcuucaauu

SEQ ID NO: 27006 - RNA, 22 nt, Human
ucucucagaacugcagcugcag

SEQ ID NO: 27007 - RNA, 22 nt, Human
ucucucagcuuugagaccugcu

SEQ ID NO: 27008 - RNA, 22 nt, Human
ucucucagggggaaggcugaag

SEQ ID NO: 27009 - RNA, 22 nt, Human
ucucucagucagaugcuaaaga

SEQ ID NO: 27010 - RNA, 22 nt, Human
ucucucauagagaaaaauauau

SEQ ID NO: 27011 - RNA, 18 nt, Human
ucucuccaucuauuuguu

SEQ ID NO: 27012 - RNA, 22 nt, Human
ucucuccuaauuucaggugcuu

SEQ ID NO: 27013 - RNA, 22 nt, Human
ucucuccugcacugaauuaugu

SEQ ID NO: 27014 - RNA, 22 nt, Human
ucucuccuuaucauuguguuua

SEQ ID NO: 27015 - RNA, 22 nt, Human
ucucucuccuaguuuuuagugg

SEQ ID NO: 27016 - RNA, 18 nt, Human
ucucucugaagaguuccc

SEQ ID NO: 27017 - RNA, 18 nt, Human
ucucucugauaacauuuu

SEQ ID NO: 27018 - RNA, 22 nt, Human
ucucucugugacagcuuugcug

SEQ ID NO: 27019 - RNA, 22 nt, Human
uggggggauacuugcuacuggc

SEQ ID NO: 27020 - RNA, 23 nt, Human
ugggggugcacgggccacaucuu

SEQ ID NO: 27021 - RNA, 22 nt, Human
ugggguacuuguaucaaagcac

SEQ ID NO: 27022 - RNA, 22 nt, Human
uggggucgaggguucucuggca

SEQ ID NO: 27023 - RNA, 20 nt, Human
uggggucuaguuggccuggg

SEQ ID NO: 27024 - RNA, 22 nt, Human
uggggucugaguaucugcauuu

SEQ ID NO: 27025 - RNA, 22 nt, Human
uggggugaaucuuuguuguccg

SEQ ID NO: 27026 - RNA, 22 nt, Human
uggggugagauucagauauuca

SEQ ID NO: 27027 - RNA, 22 nt, Human
uggggugggguuacucauucug

SEQ ID NO: 27028 - RNA, 22 nt, Human
uggggugguaauacaccguucu

SEQ ID NO: 27029 - RNA, 22 nt, Human
ugggguugaagaaaggaucuag

SEQ ID NO: 27030 - RNA, 22 nt, Human
ugggguugccucccgcccugga

SEQ ID NO: 27031 - RNA, 22 nt, Human
uggguaaacugggucuggagag

SEQ ID NO: 27032 - RNA, 22 nt, Human
uggguacuccuauuaguucagu

SEQ ID NO: 27033 - RNA, 22 nt, Human
uggguagacauuccugaaacuc

SEQ ID NO: 27034 - RNA, 23 nt, Human
uggguagagcugcaaggacacug

SEQ ID NO: 27035 - RNA, 22 nt, Human
uggguagggacuuagcuggcug

SEQ ID NO: 27036 - RNA, 22 nt, Human
uggguaggggacguggaagaaa

SEQ ID NO: 27037 - RNA, 22 nt, Human
uggguaggugcuggggauucag

SEQ ID NO: 27038 - RNA, 22 nt, Human
uggguauacaaauaaucucuuu

SEQ ID NO: 27039 - RNA, 22 nt, Human
uggguauauauguugcuacaga

SEQ ID NO: 27040 - RNA, 22 nt, Human
ugggucacucuauccugcuuag

SEQ ID NO: 27041 - RNA, 23 nt, Human
ugggucacuguuucaccauugcu

SEQ ID NO: 27042 - RNA, 22 nt, Human
ugggucagaaucagagaguugc

SEQ ID NO: 27043 - RNA, 22 nt, Human
uggguccacggaagacuuaggg

SEQ ID NO: 27044 - RNA, 22 nt, Human
uggguccacuucugcacugugg

SEQ ID NO: 27045 - RNA, 22 nt, Human
uggguccauggaacagaggugc

SEQ ID NO: 27046 - RNA, 21 nt, Human
uggguccccgacacgcuaccu

SEQ ID NO: 27047 - RNA, 20 nt, Human
ugggucccugcaguuugaag

SEQ ID NO: 27048 - RNA, 22 nt, Human
ugggucccuucagcucucaugg

SEQ ID NO: 27049 - RNA, 22 nt, Human
uggguccuucaaagcugggucu

SEQ ID NO: 27050 - RNA, 22 nt, Human
ugggucuccaguucagggcagg

SEQ ID NO: 27051 - RNA, 22 nt, Human
ugggugaagaggcuaugcuacu

SEQ ID NO: 27052 - RNA, 22 nt, Human
ugggugagccacaggaguuguc

SEQ ID NO: 27053 - RNA, 22 nt, Human
ugggugagggacaaaaguuucu

SEQ ID NO: 27054 - RNA, 22 nt, Human
ugggugcaggaugagugcuggc

SEQ ID NO: 27055 - RNA, 22 nt, Human
ugggugcuucgucagcucugag

SEQ ID NO: 27056 - RNA, 21 nt, Human
uggguggaagcgggaggccgc

SEQ ID NO: 27057 - RNA, 22 nt, Human
uggguggagaaguggaccugcu

SEQ ID NO: 27058 - RNA, 22 nt, Human
uggguggagcuccacaaccugu

SEQ ID NO: 27059 - RNA, 18 nt, Human
uggguggcuagggaguuu

SEQ ID NO: 27060 - RNA, 22 nt, Human
ugggugggagcacccugucugg

SEQ ID NO: 27061 - RNA, 22 nt, Human
ugggugggagcgcccugucugg

SEQ ID NO: 27062 - RNA, 21 nt, Human
ugggugggcagagucucuuca

SEQ ID NO: 27063 - RNA, 17 nt, Human
ugggugguagggagagg

SEQ ID NO: 27064 - RNA, 22 nt, Human
uggguggucuugcuucccagga

SEQ ID NO: 27065 - RNA, 22 nt, Human
ugggugguugcugaggcuccuu

SEQ ID NO: 27066 - RNA, 18 nt, Human
ugggugguuuuucucucc

SEQ ID NO: 27067 - RNA, 22 nt, Human
ugggugugaagucuguuggccu

SEQ ID NO: 27068 - RNA, 22 nt, Human
ugggugugccauauuccauuuc

SEQ ID NO: 27069 - RNA, 22 nt, Human
uggguuaaaaugauaccuugca

SEQ ID NO: 27070 - RNA, 22 nt, Human
uggguuaacaguuuauaccaga

SEQ ID NO: 27071 - RNA, 22 nt, Human
uggguuaagccucauucauagc

SEQ ID NO: 27072 - RNA, 22 nt, Human
uggguucgauguauauguagcc

SEQ ID NO: 27073 - RNA, 22 nt, Human
uggguuggaagcaggaggcacc

SEQ ID NO: 27074 - RNA, 19 nt, Human
uggguuggaagggaaugaa

SEQ ID NO: 27075 - RNA, 22 nt, Human
uggguuggucagcauaagaugg

SEQ ID NO: 27076 - RNA, 22 nt, Human
ugguaaaguggcuucacagugu

SEQ ID NO: 27077 - RNA, 22 nt, Human
ugguaaaguugauuggugcucu

SEQ ID NO: 27078 - RNA, 22 nt, Human
ugguaaaugcuccaagcaguac

SEQ ID NO: 27079 - RNA, 22 nt, Human
ugguaacacaggcauuaaaguu

SEQ ID NO: 27080 - RNA, 22 nt, Human
ugguaacuuucagcauggugac

SEQ ID NO: 27081 - RNA, 22 nt, Human
ugguaagauaagagccaggccu

SEQ ID NO: 27082 - RNA, 16 nt, Human
ugguaagguuaccaga

SEQ ID NO: 27083 - RNA, 22 nt, Human
ugguaaguaagugaaacaucca

SEQ ID NO: 27084 - RNA, 23 nt, Human
ugguaauagggagcagaagguag

SEQ ID NO: 27085 - RNA, 22 nt, Human
ugguaauauaugccagauaaaa

SEQ ID NO: 27086 - RNA, 22 nt, Human
ugguaauuauaaaauguuuuug

SEQ ID NO: 27087 - RNA, 22 nt, Human
ugguacaaucacagcucacugu

SEQ ID NO: 27088 - RNA, 22 nt, Human
ugguacacauguccaaggucag

SEQ ID NO: 27089 - RNA, 22 nt, Human
ugguacuuggaggcagaaaaau

SEQ ID NO: 27090 - RNA, 21 nt, Human
ugguaggauccaggaaucugc

SEQ ID NO: 27091 - RNA, 22 nt, Human
ugguauauguguuagcacaagu

SEQ ID NO: 27092 - RNA, 22 nt, Human
ugguauauuaacuaguuucuuc

SEQ ID NO: 27093 - RNA, 21 nt, Human
ugguaucaaacuauacaauau

SEQ ID NO: 27094 - RNA, 22 nt, Human
ugguaucugugaaugugacauu

SEQ ID NO: 27095 - RNA, 22 nt, Human
ugguauggcuaacgaggucaag

SEQ ID NO: 27096 - RNA, 22 nt, Human
ugguauuacuucuagacacaag

SEQ ID NO: 27097 - RNA, 22 nt, Human
ugguauuuaagacuucacuccu

SEQ ID NO: 27098 - RNA, 22 nt, Human
ugguauuuccaggcuuauggua

SEQ ID NO: 27099 - RNA, 22 nt, Human
uggucaagggacagagcugaac

SEQ ID NO: 27100 - RNA, 22 nt, Human
uggucaaugaagauacacuauu

SEQ ID NO: 27101 - RNA, 22 nt, Human
uggucacacauguaucucaaug

SEQ ID NO: 27102 - RNA, 22 nt, Human
uggucacaguguauugaucagg

SEQ ID NO: 27103 - RNA, 22 nt, Human
ugucuuuaaaauuaaacacauc

SEQ ID NO: 27104 - RNA, 22 nt, Human
ugucuuuagaccucucuggccu

SEQ ID NO: 27105 - RNA, 21 nt, Human
ugucuuuaggaccuguuaaau

SEQ ID NO: 27106 - RNA, 22 nt, Human
ugucuuuaugcacacugacuug

SEQ ID NO: 27107 - RNA, 22 nt, Human
ugucuuucugacccaagguagu

SEQ ID NO: 27108 - RNA, 23 nt, Human
ugucuuuguuaggacuguguuua

SEQ ID NO: 27109 - RNA, 22 nt, Human
ugucuuuuaguuugugagaucu

SEQ ID NO: 27110 - RNA, 22 nt, Human
ugucuuuuauaacugacauaua

SEQ ID NO: 27111 - RNA, 22 nt, Human
ugucuuuuuacuauguucaauc

SEQ ID NO: 27112 - RNA, 22 nt, Human
ugugaaaagcguguguucuagg

SEQ ID NO: 27113 - RNA, 22 nt, Human
ugugaaacggagucagggaagg

SEQ ID NO: 27114 - RNA, 22 nt, Human
ugugaaagcagccaugggcauu

SEQ ID NO: 27115 - RNA, 20 nt, Human
ugugaaagcaguagaaugac

SEQ ID NO: 27116 - RNA, 22 nt, Human
ugugaaauauuggcaauuucau

SEQ ID NO: 27117 - RNA, 22 nt, Human
ugugaaauauuuauauacucaa

SEQ ID NO: 27118 - RNA, 22 nt, Human
ugugaaaucaauuagcugcaga

SEQ ID NO: 27119 - RNA, 22 nt, Human
ugugaaaucugaugaauugacc

SEQ ID NO: 27120 - RNA, 22 nt, Human
ugugaaaugaagauaauucuug

SEQ ID NO: 27121 - RNA, 22 nt, Human
ugugaaauugagaaacuuucac

SEQ ID NO: 27122 - RNA, 22 nt, Human
ugugaacauuucugguuauuug

SEQ ID NO: 27123 - RNA, 22 nt, Human
ugugaacuuacuguccccacag

SEQ ID NO: 27124 - RNA, 22 nt, Human
ugugaagaucaggguccuagag

SEQ ID NO: 27125 - RNA, 22 nt, Human
ugugaagcuggauccuggagcu

SEQ ID NO: 27126 - RNA, 22 nt, Human
ugugaagguagcucuuggcacu

SEQ ID NO: 27127 - RNA, 22 nt, Human
ugugaauaccuugaauucauca

SEQ ID NO: 27128 - RNA, 22 nt, Human
ugugaauagauugaagcuuugg

SEQ ID NO: 27129 - RNA, 22 nt, Human
ugugaauauccauuuguuucag

SEQ ID NO: 27130 - RNA, 22 nt, Human
ugugaaugcuuguuauggagug

SEQ ID NO: 27131 - RNA, 22 nt, Human
ugugaauguuaauauuggauua

SEQ ID NO: 27132 - RNA, 22 nt, Human
ugugacagccaguaaaguaagc

SEQ ID NO: 27133 - RNA, 22 nt, Human
ugugacaggaacuauguggaug

SEQ ID NO: 27134 - RNA, 22 nt, Human
ugugacagucguuaggagcuca

SEQ ID NO: 27135 - RNA, 22 nt, Human
ugugacaugugucaucuuuucu

SEQ ID NO: 27136 - RNA, 17 nt, Human
ugugacauugggacauu

SEQ ID NO: 27137 - RNA, 21 nt, Human
ugugaccugauguaguacauu

SEQ ID NO: 27138 - RNA, 22 nt, Human
ugugacuaucauucuaaacauc

SEQ ID NO: 27139 - RNA, 22 nt, Human
ugugacuggcuuauuucacuua

SEQ ID NO: 27140 - RNA, 19 nt, Human
ugugacugguugucucgcu

SEQ ID NO: 27141 - RNA, 22 nt, Human
ugugacuuagggcaggugagau

SEQ ID NO: 27142 - RNA, 22 nt, Human
ugugacuucuuuuugaguucaa

SEQ ID NO: 27143 - RNA, 22 nt, Human
ugugacuuugucaaguugcaua

SEQ ID NO: 27144 - RNA, 22 nt, Human
ugugagaagggcaugcagggag

SEQ ID NO: 27145 - RNA, 22 nt, Human
ugugagaagggugaggcuuuua

SEQ ID NO: 27146 - RNA, 22 nt, Human
ugugagacaauugcaucagggc

SEQ ID NO: 27147 - RNA, 22 nt, Human
ugugagagcagaagacacauag

SEQ ID NO: 27148 - RNA, 19 nt, Human
ugugagaggcuagcugccc

SEQ ID NO: 27149 - RNA, 22 nt, Human
ugugagaguauaaucucucugu

SEQ ID NO: 27150 - RNA, 22 nt, Human
ugugagcagagccugacaugag

SEQ ID NO: 27151 - RNA, 20 nt, Human
ugugagcagaugcugaguga

SEQ ID NO: 27152 - RNA, 20 nt, Human
ugugaggagcauggccgcug

SEQ ID NO: 27153 - RNA, 22 nt, Human
ugugaggaggcggccagaagag

SEQ ID NO: 27154 - RNA, 22 nt, Human
ucugcauggagaggagaugcua

SEQ ID NO: 27155 - RNA, 20 nt, Human
ucugccacuaauuaggugau

SEQ ID NO: 27156 - RNA, 22 nt, Human
ucugccacuguggccaugggag

SEQ ID NO: 27157 - RNA, 22 nt, Human
ucugccagcuucuggugguugc

SEQ ID NO: 27158 - RNA, 22 nt, Human
ucugccaggccacacagggcac

SEQ ID NO: 27159 - RNA, 22 nt, Human
ucugcccaaggcugucacuaga

SEQ ID NO: 27160 - RNA, 19 nt, Human
ucugcccacaagaaaggga

SEQ ID NO: 27161 - RNA, 22 nt, Human
ucugcccacaguccaauaguug

SEQ ID NO: 27162 - RNA, 18 nt, Human
ucugcccaggacuuggac

SEQ ID NO: 27163 - RNA, 22 nt, Human
ucugcccagggacaggacacag

SEQ ID NO: 27164 - RNA, 22 nt, Human
ucugcccagggcagggcuugca

SEQ ID NO: 27165 - RNA, 22 nt, Human
ucugcccucauugcugccugga

SEQ ID NO: 27166 - RNA, 21 nt, Human
ucugcccuccaggagcucaua

SEQ ID NO: 27167 - RNA, 22 nt, Human
ucugcccuggggucagccucca

SEQ ID NO: 27168 - RNA, 17 nt, Human
ucugccgacugccagcu

SEQ ID NO: 27169 - RNA, 22 nt, Human
ucugccuaugcuguaccuuugu

SEQ ID NO: 27170 - RNA, 22 nt, Human
ucugccugaaccacucuuggag

SEQ ID NO: 27171 - RNA, 21 nt, Human
ucugccugagacuuugcuggu

SEQ ID NO: 27172 - RNA, 22 nt, Human
ucugccugcuucuucauagucu

SEQ ID NO: 27173 - RNA, 22 nt, Human
ucugccuggcggacucccggaa

SEQ ID NO: 27174 - RNA, 22 nt, Human
ucugccuggguguggagcagag

SEQ ID NO: 27175 - RNA, 22 nt, Human
ucugccuguagucccacaccuc

SEQ ID NO: 27176 - RNA, 22 nt, Human
ucugccuguucccgauuccaug

SEQ ID NO: 27177 - RNA, 22 nt, Human
ucugccuucuuuuagucaucuu

SEQ ID NO: 27178 - RNA, 22 nt, Human
ucugccuugagguccucagcuc

SEQ ID NO: 27179 - RNA, 22 nt, Human
ucugccuuucacacagacggcc

SEQ ID NO: 27180 - RNA, 22 nt, Human
ucugccuuucccaggcuacugu

SEQ ID NO: 27181 - RNA, 22 nt, Human
ucugcgccaccuugugcuugug

SEQ ID NO: 27182 - RNA, 22 nt, Human
ucugcgcccugucgccugcucc

SEQ ID NO: 27183 - RNA, 22 nt, Human
ucugcgugaugagggugcagca

SEQ ID NO: 27184 - RNA, 22 nt, Human
ucugcguuauugaaaagcagcc

SEQ ID NO: 27185 - RNA, 22 nt, Human
ucugcucagugcuuaucucuaa

SEQ ID NO: 27186 - RNA, 22 nt, Human
ucugcugaaucagauagcuaag

SEQ ID NO: 27187 - RNA, 22 nt, Human
ucugcugagaugcccaugguua

SEQ ID NO: 27188 - RNA, 22 nt, Human
ucugcugaggccuucccacucc

SEQ ID NO: 27189 - RNA, 22 nt, Human
ucugcugagucagaccucuggg

SEQ ID NO: 27190 - RNA, 22 nt, Human
ucugcugcagagcugcgggugc

SEQ ID NO: 27191 - RNA, 22 nt, Human
ucugcugcugaccaacacugug

SEQ ID NO: 27192 - RNA, 18 nt, Human
ucugcugcugcguccugc

SEQ ID NO: 27193 - RNA, 19 nt, Human
ucugcuggcagaauucccu

SEQ ID NO: 27194 - RNA, 22 nt, Human
ucugcuggucaaggcugggucc

SEQ ID NO: 27195 - RNA, 23 nt, Human
ucugcuggugacacggucacauu

SEQ ID NO: 27196 - RNA, 22 nt, Human
ucugcuguauuagguugaacug

SEQ ID NO: 27197 - RNA, 22 nt, Human
ucugcugucacucauuugcuuc

SEQ ID NO: 27198 - RNA, 22 nt, Human
ucugcugucugauucccacuuc

SEQ ID NO: 27199 - RNA, 22 nt, Human
ucugcuguguccccugugcggg

SEQ ID NO: 27200 - RNA, 22 nt, Human
ucugcuguuuacugugugauau

SEQ ID NO: 27201 - RNA, 22 nt, Human
ucugcuucuccuacuucauggg

SEQ ID NO: 27202 - RNA, 22 nt, Human
ucugcuuucuuacuaaaaauga

SEQ ID NO: 27203 - RNA, 22 nt, Human
ucuggaaauaaaauuauaguug

SEQ ID NO: 27204 - RNA, 22 nt, Human
ucuggaagaacggggcaugcug

SEQ ID NO: 27205 - RNA, 22 nt, Human
ucuggaaggaacccuuagagga

SEQ ID NO: 27206 - RNA, 22 nt, Human
ucuggaaggcuucaaggucuaa

SEQ ID NO: 27207 - RNA, 22 nt, Human
ucuggaaguuagaggaggaaag

SEQ ID NO: 27208 - RNA, 22 nt, Human
ucuggaauaacccugcuuccaa

SEQ ID NO: 27209 - RNA, 22 nt, Human
ucuggaauucucaaguccugga

SEQ ID NO: 27210 - RNA, 21 nt, Human
ucuggaccaccuuguaaagcu

SEQ ID NO: 27211 - RNA, 22 nt, Human
ucuggagaaggaagagucuuug

SEQ ID NO: 27212 - RNA, 22 nt, Human
ucuaaagccuuccauauaacgc

SEQ ID NO: 27213 - RNA, 21 nt, Human
ucuaaauguccagcaauagaa

SEQ ID NO: 27214 - RNA, 22 nt, Human
ucuaaaugugguagucauaaga

SEQ ID NO: 27215 - RNA, 22 nt, Human
ucuaacauuguuuuucacagau

SEQ ID NO: 27216 - RNA, 22 nt, Human
ucuaaccuuugaaacugcuuuc

SEQ ID NO: 27217 - RNA, 22 nt, Human
ucuaacuuagggaauacuuuag

SEQ ID NO: 27218 - RNA, 22 nt, Human
ucuaacuugugaguauagauga

SEQ ID NO: 27219 - RNA, 22 nt, Human
ucuaagaaaucagaugaugagg

SEQ ID NO: 27220 - RNA, 22 nt, Human
ucuaaggagccaggacuauuag

SEQ ID NO: 27221 - RNA, 22 nt, Human
ucuaaggccuucaugucaguau

SEQ ID NO: 27222 - RNA, 22 nt, Human
ucuaauccuugcuaccugggug

SEQ ID NO: 27223 - RNA, 21 nt, Human
ucuaaugacauccucugacaa

SEQ ID NO: 27224 - RNA, 22 nt, Human
ucuaauugcaauucucagagau

SEQ ID NO: 27225 - RNA, 19 nt, Human
ucuacaaaguggcaucagg

SEQ ID NO: 27226 - RNA, 22 nt, Human
ucuacaacgugguuuuguugua

SEQ ID NO: 27227 - RNA, 22 nt, Human
ucuacagacuccuauguaacac

SEQ ID NO: 27228 - RNA, 22 nt, Human
ucuacagugucaaugugucuug

SEQ ID NO: 27229 - RNA, 22 nt, Human
ucuacaguuuucuugggaguug

SEQ ID NO: 27230 - RNA, 22 nt, Human
ucuacauuuucuuuauguacau

SEQ ID NO: 27231 - RNA, 22 nt, Human
ucuacuagguguacuacugcag

SEQ ID NO: 27232 - RNA, 22 nt, Human
ucuacuguagugaugcugcagu

SEQ ID NO: 27233 - RNA, 22 nt, Human
ucuacuuccgcaaaaggcacau

SEQ ID NO: 27234 - RNA, 22 nt, Human
ucuacuugucagucuucaaauc

SEQ ID NO: 27235 - RNA, 18 nt, Human
ucuagaaacccagacucu

SEQ ID NO: 27236 - RNA, 22 nt, Human
ucuagaaaguacuagagcuggu

SEQ ID NO: 27237 - RNA, 22 nt, Human
ucuagaaaguuuguacugauuu

SEQ ID NO: 27238 - RNA, 22 nt, Human
ucuagaacuucucuaaaaugaa

SEQ ID NO: 27239 - RNA, 21 nt, Human
ucuagaagagguugagaauau

SEQ ID NO: 27240 - RNA, 22 nt, Human
ucuagaagauaccugcugccaa

SEQ ID NO: 27241 - RNA, 22 nt, Human
ucuagaauacugugacaugcca

SEQ ID NO: 27242 - RNA, 21 nt, Human
ucuagaauccuguauaagacu

SEQ ID NO: 27243 - RNA, 22 nt, Human
ucuagacacuacuaguaaccgg

SEQ ID NO: 27244 - RNA, 22 nt, Human
ucuagacaucuuggcugcaauu

SEQ ID NO: 27245 - RNA, 22 nt, Human
ucuagaccuggcacugcccugu

SEQ ID NO: 27246 - RNA, 22 nt, Human
ucuagagacuauaauguguccu

SEQ ID NO: 27247 - RNA, 17 nt, Human
ucuagagcacuuugaga

SEQ ID NO: 27248 - RNA, 22 nt, Human
ucuagaucugcacuguuggaca

SEQ ID NO: 27249 - RNA, 22 nt, Human
ucuagaugaaugugaggauauc

SEQ ID NO: 27250 - RNA, 22 nt, Human
ucuagcaguagcccaaauccag

SEQ ID NO: 27251 - RNA, 22 nt, Human
ucuagcaugggaaaaucacagc

SEQ ID NO: 27252 - RNA, 22 nt, Human
ucuagcauuucuuuccugagga

SEQ ID NO: 27253 - RNA, 20 nt, Human
ucuagcuuagugccugccuc

SEQ ID NO: 27254 - RNA, 22 nt, Human
ucuaggaaagccuuucacaacu

SEQ ID NO: 27255 - RNA, 22 nt, Human
ucuaggaggcacacaaguaguu

SEQ ID NO: 27256 - RNA, 22 nt, Human
ucuaggaggcggagauugcagu

SEQ ID NO: 27257 - RNA, 22 nt, Human
ucuaggaguaaugagcuagcac

SEQ ID NO: 27258 - RNA, 22 nt, Human
ucuagggaaccuauccuaugau

SEQ ID NO: 27259 - RNA, 22 nt, Human
ucuagggaauugugguuuucuu

SEQ ID NO: 27260 - RNA, 22 nt, Human
ucuagggaggcaauagcaaugu

SEQ ID NO: 27261 - RNA, 22 nt, Human
ucuaggguguauaaggaagccu

SEQ ID NO: 27262 - RNA, 22 nt, Human
ucuagggugugcggcagggcua

SEQ ID NO: 27263 - RNA, 22 nt, Human
ucuagguucaugggauucagug

SEQ ID NO: 27264 - RNA, 22 nt, Human
ucuagucaauagaggucacacu

SEQ ID NO: 27265 - RNA, 22 nt, Human
ucuaguguuaaggcaaaguaaa

SEQ ID NO: 27266 - RNA, 19 nt, Human
ucuaguuuugagagacuuc

SEQ ID NO: 27267 - RNA, 22 nt, Human
ucuauaaaacucaagagcaauu

SEQ ID NO: 27268 - RNA, 22 nt, Human
ucuauaaauuaugcagucucag

SEQ ID NO: 27269 - RNA, 21 nt, Human
ucuauaauaugcaggucauca

SEQ ID NO: 27270 - RNA, 22 nt, Human
ucuauacacacaaagaaugcuu

SEQ ID NO: 27271 - RNA, 22 nt, Human
ucuauacaugugcacacacauc

SEQ ID NO: 27272 - RNA, 21 nt, Human
uccucuccaugaucuguuugu

SEQ ID NO: 27273 - RNA, 22 nt, Human
uccucucugcacuggcccugcc

SEQ ID NO: 27274 - RNA, 22 nt, Human
uccucugccaaagggaguugcc

SEQ ID NO: 27275 - RNA, 22 nt, Human
uccucugccccagaugaaauuu

SEQ ID NO: 27276 - RNA, 21 nt, Human
uccucugcucucauaccacaa

SEQ ID NO: 27277 - RNA, 22 nt, Human
uccucugcuggaagggcaagag

SEQ ID NO: 27278 - RNA, 22 nt, Human
uccucuggaaccucacccuugc

SEQ ID NO: 27279 - RNA, 22 nt, Human
uccucuggauauaagccucacc

SEQ ID NO: 27280 - RNA, 22 nt, Human
uccucuggcccagcugccucug

SEQ ID NO: 27281 - RNA, 22 nt, Human
uccucuggccuuggaauccuuu

SEQ ID NO: 27282 - RNA, 22 nt, Human
uccucuggcucuuucccuagga

SEQ ID NO: 27283 - RNA, 22 nt, Human
uccucugggcucccugcaacag

SEQ ID NO: 27284 - RNA, 19 nt, Human
uccucugguaccacccuug

SEQ ID NO: 27285 - RNA, 22 nt, Human
uccucugguuauacuugcaccc

SEQ ID NO: 27286 - RNA, 22 nt, Human
uccucuguggaccgggcuuugg

SEQ ID NO: 27287 - RNA, 22 nt, Human
uccucuucaaaaggauuuccuu

SEQ ID NO: 27288 - RNA, 22 nt, Human
uccucuucaaaauagcucugaa

SEQ ID NO: 27289 - RNA, 22 nt, Human
uccugaaaaauuacauguucag

SEQ ID NO: 27290 - RNA, 22 nt, Human
uccugaagagcccugcucugug

SEQ ID NO: 27291 - RNA, 22 nt, Human
uccugaagagguugucuuuaua

SEQ ID NO: 27292 - RNA, 19 nt, Human
uccugaagauuuccucagc

SEQ ID NO: 27293 - RNA, 22 nt, Human
uccugaagcaguuagcaugagc

SEQ ID NO: 27294 - RNA, 22 nt, Human
uccugaaggagcaguugcuggg

SEQ ID NO: 27295 - RNA, 22 nt, Human
uccugaaggcagauggggauca

SEQ ID NO: 27296 - RNA, 22 nt, Human
uccugaaguauuguuugaguaa

SEQ ID NO: 27297 - RNA, 22 nt, Human
uccugaauaaauuagcugucac

SEQ ID NO: 27298 - RNA, 22 nt, Human
uccugacuaggagggcuaaggu

SEQ ID NO: 27299 - RNA, 22 nt, Human
uccugacucugguguccucuac

SEQ ID NO: 27300 - RNA, 22 nt, Human
uccugacuuaacuacucucugg

SEQ ID NO: 27301 - RNA, 22 nt, Human
uccugagagggguggguuuccc

SEQ ID NO: 27302 - RNA, 22 nt, Human
uccugagauguggagcuccaug

SEQ ID NO: 27303 - RNA, 22 nt, Human
uccugagcacagagacaaggaa

SEQ ID NO: 27304 - RNA, 22 nt, Human
uccugagcccuggggucagugu

SEQ ID NO: 27305 - RNA, 22 nt, Human
uccugagcuacaguaguaugau

SEQ ID NO: 27306 - RNA, 22 nt, Human
uccugagcuucaaaacacuuug

SEQ ID NO: 27307 - RNA, 22 nt, Human
uccugagcuuuacaguaaggac

SEQ ID NO: 27308 - RNA, 23 nt, Human
uccugaggaauggcaucucacau

SEQ ID NO: 27309 - RNA, 22 nt, Human
uccugaggacuaacaggaagga

SEQ ID NO: 27310 - RNA, 22 nt, Human
uccugaggcacaauccuagaau

SEQ ID NO: 27311 - RNA, 22 nt, Human
uccugaggccucugugauguga

SEQ ID NO: 27312 - RNA, 22 nt, Human
uccugaggcuaaagugcagugg

SEQ ID NO: 27313 - RNA, 22 nt, Human
uccugaggcucacuuugaaugu

SEQ ID NO: 27314 - RNA, 20 nt, Human
uccugaggcuucgccagugu

SEQ ID NO: 27315 - RNA, 22 nt, Human
uccugagggcugcagucauagg

SEQ ID NO: 27316 - RNA, 22 nt, Human
uccugagguauaugcuuugcag

SEQ ID NO: 27317 - RNA, 20 nt, Human
uccugagugcaguuggcuug

SEQ ID NO: 27318 - RNA, 22 nt, Human
uccugauggccucuggcuccag

SEQ ID NO: 27319 - RNA, 21 nt, Human
uccugcagaaugccuuccuac

SEQ ID NO: 27320 - RNA, 19 nt, Human
uccugcagaccagaccugu

SEQ ID NO: 27321 - RNA, 22 nt, Human
ucuguucauaguaguguauaug

SEQ ID NO: 27322 - RNA, 22 nt, Human
ucuguucaucucaugggagaau

SEQ ID NO: 27323 - RNA, 22 nt, Human
ucuguucaugaaauaucuuuuu

SEQ ID NO: 27324 - RNA, 22 nt, Human
ucuguucauguugggcuuuucc

SEQ ID NO: 27325 - RNA, 22 nt, Human
ucuguucauuugccucggcucu

SEQ ID NO: 27326 - RNA, 22 nt, Human
ucuguucuaagcauucuaugug

SEQ ID NO: 27327 - RNA, 22 nt, Human
ucuguucuuccuacauucacau

SEQ ID NO: 27328 - RNA, 22 nt, Human
ucuguucuuuagccugcuugag

SEQ ID NO: 27329 - RNA, 22 nt, Human
ucuguugaccaagucuucuucc

SEQ ID NO: 27330 - RNA, 22 nt, Human
ucuguugcuuucuuccugugug

SEQ ID NO: 27331 - RNA, 22 nt, Human
ucuguuggagccuaggaugaca

SEQ ID NO: 27332 - RNA, 22 nt, Human
ucuguugguucuguuucucuga

SEQ ID NO: 27333 - RNA, 22 nt, Human
ucuguuuagacucaguugaaac

SEQ ID NO: 27334 - RNA, 22 nt, Human
ucuguuuaugcauauuuaaaac

SEQ ID NO: 27335 - RNA, 22 nt, Human
ucuguuucuauaaagacaagag

SEQ ID NO: 27336 - RNA, 22 nt, Human
ucuguuucuccaacauugugag

SEQ ID NO: 27337 - RNA, 22 nt, Human
ucuguuuuagauaagaaaggcu

SEQ ID NO: 27338 - RNA, 22 nt, Human
ucuguuuugcauaauguucuuu

SEQ ID NO: 27339 - RNA, 22 nt, Human
ucuguuuuugaggcuaucuucu

SEQ ID NO: 27340 - RNA, 22 nt, Human
ucuuaaagagcgcaauuugagg

SEQ ID NO: 27341 - RNA, 22 nt, Human
ucuuaaagcagcuuguaaaaug

SEQ ID NO: 27342 - RNA, 22 nt, Human
ucuuaacaagcuccucagugcu

SEQ ID NO: 27343 - RNA, 22 nt, Human
ucuuaaguaccuccuuuaucac

SEQ ID NO: 27344 - RNA, 22 nt, Human
ucuuaaugaaagugaaauauca

SEQ ID NO: 27345 - RNA, 22 nt, Human
ucuuacaagaaggaaaagggag

SEQ ID NO: 27346 - RNA, 22 nt, Human
ucuuacccggcaacgugugucg

SEQ ID NO: 27347 - RNA, 22 nt, Human
ucuuacgaauucuuagaggaca

SEQ ID NO: 27348 - RNA, 22 nt, Human
ucuuagaaaugaaguucuuucu

SEQ ID NO: 27349 - RNA, 22 nt, Human
ucuuagaaguucauguuccagc

SEQ ID NO: 27350 - RNA, 22 nt, Human
ucuuagaauugaagucagaggg

SEQ ID NO: 27351 - RNA, 22 nt, Human
ucuuagauggcagcuagagcuc

SEQ ID NO: 27352 - RNA, 22 nt, Human
ucuuagcaugcauguauaaaua

SEQ ID NO: 27353 - RNA, 22 nt, Human
ucuuagcauuucauaacaacug

SEQ ID NO: 27354 - RNA, 22 nt, Human
ucuuauaagcaaacugcugaga

SEQ ID NO: 27355 - RNA, 22 nt, Human
ucuuauacagaagauguuuaau

SEQ ID NO: 27356 - RNA, 22 nt, Human
ucuuaugaaaagcacuuagaac

SEQ ID NO: 27357 - RNA, 22 nt, Human
ucuuaugcauauucauaacaca

SEQ ID NO: 27358 - RNA, 22 nt, Human
ucuuauuauuguuguaaaagca

SEQ ID NO: 27359 - RNA, 22 nt, Human
ucuuauucagugggcucugcca

SEQ ID NO: 27360 - RNA, 19 nt, Human
ucuuauugagcagcugagg

SEQ ID NO: 27361 - RNA, 22 nt, Human
ucuuauuggauaaaaggaaacc

SEQ ID NO: 27362 - RNA, 22 nt, Human
ucuuauugugaugaugaagaac

SEQ ID NO: 27363 - RNA, 22 nt, Human
ucuuauuguuuaaaaguacaca

SEQ ID NO: 27364 - RNA, 22 nt, Human
ucuucaaaaaauauccaucagu

SEQ ID NO: 27365 - RNA, 22 nt, Human
ucuucaaaauugauuggagaag

SEQ ID NO: 27366 - RNA, 22 nt, Human
ucuucaaacugaaaauuuagaa

SEQ ID NO: 27367 - RNA, 22 nt, Human
ucuucaaagaagccuuggauua

SEQ ID NO: 27368 - RNA, 22 nt, Human
ucuucaaauacagucauauuga

SEQ ID NO: 27369 - RNA, 22 nt, Human
ucuucaaguuccaaagugcagg

SEQ ID NO: 27370 - RNA, 22 nt, Human
ucuucaauuuagaauggauuua

SEQ ID NO: 27371 - RNA, 22 nt, Human
ucuucacacacaguccucuuuc

SEQ ID NO: 27372 - RNA, 22 nt, Human
ucuucacaccgggcagcaggaa

SEQ ID NO: 27373 - RNA, 22 nt, Human
ucuucacagaugcauauacuuc

SEQ ID NO: 27374 - RNA, 22 nt, Human
ucuucacagcuuuguccagaag

SEQ ID NO: 27375 - RNA, 22 nt, Human
ucuucacaggagccugccugcc

SEQ ID NO: 27376 - RNA, 22 nt, Human
ucuucacaucauguuuuuuaau

SEQ ID NO: 27377 - RNA, 22 nt, Human
ucuucacaugaccuucaugucu

SEQ ID NO: 27378 - RNA, 22 nt, Human
ucuucaccaucaacagaaugaa

SEQ ID NO: 27379 - RNA, 22 nt, Human
ucuucagacuccaaauguuuua

SEQ ID NO: 27380 - RNA, 22 nt, Human
ucuucagagacucugagccccu

SEQ ID NO: 27381 - RNA, 22 nt, Human
ucuucagaggaagucagucuuu

SEQ ID NO: 27382 - RNA, 20 nt, Human
ucuucagcacuccuuaggua

SEQ ID NO: 27383 - RNA, 22 nt, Human
ucuucagcagagaauuaugaug

SEQ ID NO: 27384 - RNA, 22 nt, Human
ucuucagcagggccucucugag

SEQ ID NO: 27385 - RNA, 22 nt, Human
ucuucaggaagggaaaucaucc

SEQ ID NO: 27386 - RNA, 22 nt, Human
ucuucaggagcugaaagccugc

SEQ ID NO: 27387 - RNA, 22 nt, Human
ucuucaguagguccucagaauc

SEQ ID NO: 27388 - RNA, 18 nt, Human
uccugggaaaggcauaca

SEQ ID NO: 27389 - RNA, 22 nt, Human
uccugggaaguggcuggcugag

SEQ ID NO: 27390 - RNA, 22 nt, Human
uccugggacaccccaauaugag

SEQ ID NO: 27391 - RNA, 22 nt, Human
uccugggacccugggugcagag

SEQ ID NO: 27392 - RNA, 22 nt, Human
uccugggacucuuuaucagaga

SEQ ID NO: 27393 - RNA, 22 nt, Human
uccugggacuuucaaggcuagg

SEQ ID NO: 27394 - RNA, 22 nt, Human
uccugggagcacaugguccugc

SEQ ID NO: 27395 - RNA, 22 nt, Human
uccugggagcaugaagagggau

SEQ ID NO: 27396 - RNA, 22 nt, Human
uccugggaggaacauuuaccua

SEQ ID NO: 27397 - RNA, 22 nt, Human
uccugggaggcaggaccccuuu

SEQ ID NO: 27398 - RNA, 22 nt, Human
uccugggauucugcauuucuaa

SEQ ID NO: 27399 - RNA, 22 nt, Human
uccugggcagcgggacgcucag

SEQ ID NO: 27400 - RNA, 22 nt, Human
uccugggcccaggcugccaggg

SEQ ID NO: 27401 - RNA, 22 nt, Human
uccugggcgauuuucugaauau

SEQ ID NO: 27402 - RNA, 19 nt, Human
uccugggcugcgucuugcc

SEQ ID NO: 27403 - RNA, 22 nt, Human
uccugggcuguggccccgggca

SEQ ID NO: 27404 - RNA, 22 nt, Human
uccugggcuuaguggcuagguc

SEQ ID NO: 27405 - RNA, 22 nt, Human
uccuggggaggucgaggcugag

SEQ ID NO: 27406 - RNA, 16 nt, Human
uccuggggauacugga

SEQ ID NO: 27407 - RNA, 19 nt, Human
uccuggggauguggucacc

SEQ ID NO: 27408 - RNA, 22 nt, Human
uccuggggcugcaaggccuguc

SEQ ID NO: 27409 - RNA, 21 nt, Human
uccugggggguaggugaguuu

SEQ ID NO: 27410 - RNA, 22 nt, Human
uccugggguguguuuugcugcu

SEQ ID NO: 27411 - RNA, 22 nt, Human
uccugggguuuuggccgcagcu

SEQ ID NO: 27412 - RNA, 22 nt, Human
uccugggucccgcacaucuguc

SEQ ID NO: 27413 - RNA, 22 nt, Human
uccuggguccugggaagcccug

SEQ ID NO: 27414 - RNA, 22 nt, Human
uccuggguggcucugcccggcu

SEQ ID NO: 27415 - RNA, 22 nt, Human
uccuggguucauguccuggugc

SEQ ID NO: 27416 - RNA, 20 nt, Human
uccuggucauguggcugggc

SEQ ID NO: 27417 - RNA, 19 nt, Human
uccuggugacccugaaauu

SEQ ID NO: 27418 - RNA, 22 nt, Human
uccuggugaucaaaauucauuu

SEQ ID NO: 27419 - RNA, 22 nt, Human
uccuggugccuggagcucucca

SEQ ID NO: 27420 - RNA, 22 nt, Human
uccugguggcucuuugggaagg

SEQ ID NO: 27421 - RNA, 22 nt, Human
uccugguggcuuucccugccuu

SEQ ID NO: 27422 - RNA, 22 nt, Human
uccugguggucugugcuucuuc

SEQ ID NO: 27423 - RNA, 22 nt, Human
uccugguggugccggugcccgg

SEQ ID NO: 27424 - RNA, 22 nt, Human
uccugguguaaugguaagcaug

SEQ ID NO: 27425 - RNA, 18 nt, Human
uccugguucuguggccac

SEQ ID NO: 27426 - RNA, 22 nt, Human
uccuguauccugauacaauaag

SEQ ID NO: 27427 - RNA, 22 nt, Human
uccugucagugaggcagaugaa

SEQ ID NO: 27428 - RNA, 22 nt, Human
uccuguccacagcccugaccuc

SEQ ID NO: 27429 - RNA, 22 nt, Human
uccugucuaaagaccugcaggc

SEQ ID NO: 27430 - RNA, 22 nt, Human
ucucagaauccuugcccaggug

SEQ ID NO: 27431 - RNA, 22 nt, Human
ucucagagagcuguguuuuccu

SEQ ID NO: 27432 - RNA, 22 nt, Human
ucucagagaggggccgggccuu

SEQ ID NO: 27433 - RNA, 22 nt, Human
ucucagagaugucaagagucua

SEQ ID NO: 27434 - RNA, 22 nt, Human
ucucagagauguuagggaagag

SEQ ID NO: 27435 - RNA, 22 nt, Human
ucucagagcaucauuuucuuag

SEQ ID NO: 27436 - RNA, 19 nt, Human
ucucagagcccuagaggcc

SEQ ID NO: 27437 - RNA, 22 nt, Human
ucucagaguaauucuuuaaggu

SEQ ID NO: 27438 - RNA, 22 nt, Human
ucucagaguuuacggggcugaa

SEQ ID NO: 27439 - RNA, 22 nt, Human
ucucagaguuugaaucuggagu

SEQ ID NO: 27440 - RNA, 22 nt, Human
ucucagaguuuuuuuccaggac

SEQ ID NO: 27441 - RNA, 22 nt, Human
ucucagcagggccauccugagc

SEQ ID NO: 27442 - RNA, 22 nt, Human
ucucagccucaccucuauggag

SEQ ID NO: 27443 - RNA, 23 nt, Human
ucucaggacacacaugucuauca

SEQ ID NO: 27444 - RNA, 23 nt, Human
ucucaggcaaaccaggacaaguu

SEQ ID NO: 27445 - RNA, 20 nt, Human
ucucaggccccaguuuucuu

SEQ ID NO: 27446 - RNA, 22 nt, Human
ucucaggcuaguaaaagauggg

SEQ ID NO: 27447 - RNA, 22 nt, Human
ucucaggcuccugacauauaug

SEQ ID NO: 27448 - RNA, 22 nt, Human
ucucaggcugacauugggacuc

SEQ ID NO: 27449 - RNA, 22 nt, Human
ucucagggagguuccccguucu

SEQ ID NO: 27450 - RNA, 22 nt, Human
ucucagggcaauucucagcgac

SEQ ID NO: 27451 - RNA, 22 nt, Human
ucucagggccucccucuguuuc

SEQ ID NO: 27452 - RNA, 22 nt, Human
ucucagggcucagagcucaggc

SEQ ID NO: 27453 - RNA, 22 nt, Human
ucucaggggauucacuggcacc

SEQ ID NO: 27454 - RNA, 22 nt, Human
ucucaggggccuggaguccugg

SEQ ID NO: 27455 - RNA, 23 nt, Human
ucucaggguggcugggcccaucc

SEQ ID NO: 27456 - RNA, 20 nt, Human
ucucaggguucagcaaagua

SEQ ID NO: 27457 - RNA, 22 nt, Human
ucucagguaaaaggguaucuac

SEQ ID NO: 27458 - RNA, 22 nt, Human
ucucagucuuuuugguuacuca

SEQ ID NO: 27459 - RNA, 23 nt, Human
ucucagugaaucucagaauucgc

SEQ ID NO: 27460 - RNA, 22 nt, Human
ucucagugacacucuucauaca

SEQ ID NO: 27461 - RNA, 17 nt, Human
ucucagugacugauagc

SEQ ID NO: 27462 - RNA, 22 nt, Human
ucucagugacugcugggucccc

SEQ ID NO: 27463 - RNA, 23 nt, Human
ucucagugcacgcaccaugccug

SEQ ID NO: 27464 - RNA, 23 nt, Human
ucucagugccgauugcauacaca

SEQ ID NO: 27465 - RNA, 22 nt, Human
ucucaguggacgugucugucuu

SEQ ID NO: 27466 - RNA, 22 nt, Human
ucucagugguggcauuccagac

SEQ ID NO: 27467 - RNA, 22 nt, Human
ucucagugguguuuugagucca

SEQ ID NO: 27468 - RNA, 22 nt, Human
ucucaguguguugagaggucug

SEQ ID NO: 27469 - RNA, 22 nt, Human
ucucaguuucucauuauaaaag

SEQ ID NO: 27470 - RNA, 22 nt, Human
ucucauaauagcauuucucacc

SEQ ID NO: 27471 - RNA, 22 nt, Human
ucucauacguuuccagguguca

SEQ ID NO: 27472 - RNA, 22 nt, Human
ucucaucuagacucugcccuug

SEQ ID NO: 27473 - RNA, 22 nt, Human
ucucaucuauucacauuaacug

SEQ ID NO: 27474 - RNA, 22 nt, Human
ucucaucucaaauuguaauccc

SEQ ID NO: 27475 - RNA, 21 nt, Human
ucucaucuccugaccugugcc

SEQ ID NO: 27476 - RNA, 22 nt, Human
ucucaucucggaucagaaguga

SEQ ID NO: 27477 - RNA, 22 nt, Human
ucucaucugcgagcucugccag

SEQ ID NO: 27478 - RNA, 22 nt, Human
ucucaucuuguucaucuacccu

SEQ ID NO: 27479 - RNA, 22 nt, Human
ucucaugcaugcauaagucuag

SEQ ID NO: 27480 - RNA, 22 nt, Human
ucucauggcuuaacaagcccac

SEQ ID NO: 27481 - RNA, 22 nt, Human
ucucauguuucugguacuccuu

SEQ ID NO: 27482 - RNA, 18 nt, Human
ucucauuacaaucuuugu

SEQ ID NO: 27483 - RNA, 22 nt, Human
ucucauuauccaucacugcacu

SEQ ID NO: 27484 - RNA, 22 nt, Human
ucucauucauacccuacaugcu

SEQ ID NO: 27485 - RNA, 22 nt, Human
ucucauuuacuuccacaggcug

SEQ ID NO: 27486 - RNA, 23 nt, Human
ucucauuucccuugaucuaucuu

SEQ ID NO: 27487 - RNA, 22 nt, Human
ucuccaaauaguuauauuuaga

SEQ ID NO: 27488 - RNA, 22 nt, Human
ucuccaaggagcuccugugccg

SEQ ID NO: 27489 - RNA, 22 nt, Human
ucuccacgugauggaguccagg

SEQ ID NO: 27490 - RNA, 22 nt, Human
ucuccacuauuuucuagcucuu

SEQ ID NO: 27491 - RNA, 18 nt, Human
ucuccacuucugugagaa

SEQ ID NO: 27492 - RNA, 19 nt, Human
ucuccagcuuugggcuuuu

SEQ ID NO: 27493 - RNA, 17 nt, Human
ucuccaggacgagcuca

SEQ ID NO: 27494 - RNA, 22 nt, Human
ucuccagggacauguuucugga

SEQ ID NO: 27495 - RNA, 22 nt, Human
ucuccaggggcagggucuggag

SEQ ID NO: 27496 - RNA, 22 nt, Human
ucuccaggugaaacuugcaggg

SEQ ID NO: 27497 - RNA, 22 nt, Human
ucuccaggugacucugauguau

SEQ ID NO: 27498 - RNA, 22 nt, Human
ucuccaggugcuaagugugccu

SEQ ID NO: 27499 - RNA, 22 nt, Human
ucuccagguucagucgauggaa

SEQ ID NO: 27500 - RNA, 21 nt, Human
ucuccaguauccuucucugag

SEQ ID NO: 27501 - RNA, 21 nt, Human
ucuccaguugacagugucucc

SEQ ID NO: 27502 - RNA, 21 nt, Human
ucucccaaggagguccugagg

SEQ ID NO: 27503 - RNA, 22 nt, Human
ucucccacagccgugcuucaag

SEQ ID NO: 27504 - RNA, 22 nt, Human
uguuauugucgcugcacuggga

SEQ ID NO: 27505 - RNA, 22 nt, Human
uguuauuuauuucaccuccaga

SEQ ID NO: 27506 - RNA, 22 nt, Human
uguucaaaaauaucuucugcaa

SEQ ID NO: 27507 - RNA, 22 nt, Human
uguucaauccccagguccugaa

SEQ ID NO: 27508 - RNA, 22 nt, Human
uguucacaagaugucuguggcu

SEQ ID NO: 27509 - RNA, 22 nt, Human
uguucacacacggaggccacag

SEQ ID NO: 27510 - RNA, 22 nt, Human
uguucacuuauguucucccauu

SEQ ID NO: 27511 - RNA, 22 nt, Human
uguucagaacaaagguaaauga

SEQ ID NO: 27512 - RNA, 21 nt, Human
uguucagaccaacuuggacug

SEQ ID NO: 27513 - RNA, 19 nt, Human
uguucagauaugucagcuu

SEQ ID NO: 27514 - RNA, 22 nt, Human
uguucaguuugcuaucauaauc

SEQ ID NO: 27515 - RNA, 22 nt, Human
uguucauaucauuuugaaagcu

SEQ ID NO: 27516 - RNA, 22 nt, Human
uguucauauuccuguccgcuga

SEQ ID NO: 27517 - RNA, 22 nt, Human
uguucauuaaacuacugugugg

SEQ ID NO: 27518 - RNA, 22 nt, Human
uguucauucgcuauugucuaug

SEQ ID NO: 27519 - RNA, 22 nt, Human
uguucauugcccccuguguaaa

SEQ ID NO: 27520 - RNA, 22 nt, Human
uguucauuuugaaguacuucaa

SEQ ID NO: 27521 - RNA, 20 nt, Human
uguuccaugacuauuuggau

SEQ ID NO: 27522 - RNA, 17 nt, Human
uguuccauuugaccacc

SEQ ID NO: 27523 - RNA, 22 nt, Human
uguucccuccuccccacugggu

SEQ ID NO: 27524 - RNA, 22 nt, Human
uguuccuguacugcuguggcuu

SEQ ID NO: 27525 - RNA, 22 nt, Human
uguuccuguguggaaaagggcc

SEQ ID NO: 27526 - RNA, 22 nt, Human
uguuccuguuuaaugugcucau

SEQ ID NO: 27527 - RNA, 22 nt, Human
uguuccuucacagcaguggaca

SEQ ID NO: 27528 - RNA, 22 nt, Human
uguucuaaauugcuagcuggaa

SEQ ID NO: 27529 - RNA, 22 nt, Human
uguucucuaagccacccauuuu

SEQ ID NO: 27530 - RNA, 22 nt, Human
uguucucucuggcugccaguac

SEQ ID NO: 27531 - RNA, 23 nt, Human
uguucucuuguccaggccuuaac

SEQ ID NO: 27532 - RNA, 22 nt, Human
uguucugccagcacuucucagc

SEQ ID NO: 27533 - RNA, 22 nt, Human
uguucuggagauaagagguaga

SEQ ID NO: 27534 - RNA, 22 nt, Human
uguucuggugaggccauggggu

SEQ ID NO: 27535 - RNA, 22 nt, Human
uguucuugggaaucuuacaguu

SEQ ID NO: 27536 - RNA, 20 nt, Human
uguugaauucauggugacuu

SEQ ID NO: 27537 - RNA, 22 nt, Human
uguugagacugagggagucagc

SEQ ID NO: 27538 - RNA, 22 nt, Human
uguugcaggccccugggguaug

SEQ ID NO: 27539 - RNA, 22 nt, Human
ugacacaugcaccagucuuuaa

SEQ ID NO: 27540 - RNA, 22 nt, Human
ugacaccacaacuagccauuga

SEQ ID NO: 27541 - RNA, 22 nt, Human
ugacacccaucugugccagucc

SEQ ID NO: 27542 - RNA, 22 nt, Human
ugacacccauuaucugugugac

SEQ ID NO: 27543 - RNA, 22 nt, Human
ugacacccucuccuggagagag

SEQ ID NO: 27544 - RNA, 22 nt, Human
ugacacugcaaauauaaauauu

SEQ ID NO: 27545 - RNA, 22 nt, Human
ugacacuuccgguaaaaaaugc

SEQ ID NO: 27546 - RNA, 22 nt, Human
ugacagacagcuucucauuuua

SEQ ID NO: 27547 - RNA, 22 nt, Human
ugacagagcauguagugacagc

SEQ ID NO: 27548 - RNA, 22 nt, Human
ugacagagucggggcaagcugu

SEQ ID NO: 27549 - RNA, 22 nt, Human
ugacagaguucggauugaguuu

SEQ ID NO: 27550 - RNA, 22 nt, Human
ugacagaugaagcuggggacca

SEQ ID NO: 27551 - RNA, 21 nt, Human
ugacagcauagagcagggagg

SEQ ID NO: 27552 - RNA, 22 nt, Human
ugacagcccaccucacaggauu

SEQ ID NO: 27553 - RNA, 22 nt, Human
ugacagccucacuuuguuaauu

SEQ ID NO: 27554 - RNA, 22 nt, Human
ugacaggacagagaaaugaccu

SEQ ID NO: 27555 - RNA, 22 nt, Human
ugacaggaguggcuagugggag

SEQ ID NO: 27556 - RNA, 22 nt, Human
ugacaggcacugcuguagugcu

SEQ ID NO: 27557 - RNA, 23 nt, Human
ugacaggcuuugcuccuucugcc

SEQ ID NO: 27558 - RNA, 22 nt, Human
ugacagggacaguggagaugga

SEQ ID NO: 27559 - RNA, 22 nt, Human
ugacagggggcagagguggcug

SEQ ID NO: 27560 - RNA, 22 nt, Human
ugacagggugauuaugagagcu

SEQ ID NO: 27561 - RNA, 19 nt, Human
ugacagguuuuauguguuu

SEQ ID NO: 27562 - RNA, 22 nt, Human
ugacaguagaagaugcuguuac

SEQ ID NO: 27563 - RNA, 22 nt, Human
ugacaguauacuugugauggga

SEQ ID NO: 27564 - RNA, 22 nt, Human
ugacagucugcaguuuuaaaaa

SEQ ID NO: 27565 - RNA, 22 nt, Human
ugacagugucaguuuccuaaua

SEQ ID NO: 27566 - RNA, 22 nt, Human
ugacagugugcccggagguuag

SEQ ID NO: 27567 - RNA, 21 nt, Human
ugacaguguggcauggaaggu

SEQ ID NO: 27568 - RNA, 22 nt, Human
ugacaguguuugcacuucaggu

SEQ ID NO: 27569 - RNA, 22 nt, Human
ugacaguugagcauguaagaga

SEQ ID NO: 27570 - RNA, 22 nt, Human
ugacauaaaccagugagcaaaa

SEQ ID NO: 27571 - RNA, 22 nt, Human
ugacauaauaauccaaacauac

SEQ ID NO: 27572 - RNA, 22 nt, Human
ugacaucauuaguaacauagcu

SEQ ID NO: 27573 - RNA, 22 nt, Human
ugacaucuggagucugggcugu

SEQ ID NO: 27574 - RNA, 22 nt, Human
ugacaucugucacccugcugac

SEQ ID NO: 27575 - RNA, 22 nt, Human
ugacaucuuugaucucauuuag

SEQ ID NO: 27576 - RNA, 22 nt, Human
ugacauguaagauggaaaagcg

SEQ ID NO: 27577 - RNA, 22 nt, Human
ugacauguauguuguuggcaug

SEQ ID NO: 27578 - RNA, 22 nt, Human
ugacauguccaggugguccugu

SEQ ID NO: 27579 - RNA, 22 nt, Human
ugacauguguaaucagcuccgu

SEQ ID NO: 27580 - RNA, 22 nt, Human
ugacauuauuaucaugucacca

SEQ ID NO: 27581 - RNA, 22 nt, Human
ugacauugguugcaagguacuc

SEQ ID NO: 27582 - RNA, 22 nt, Human
ugacauuugagcauacauguaa

SEQ ID NO: 27583 - RNA, 21 nt, Human
ugacauuuggauucauaguaa

SEQ ID NO: 27584 - RNA, 22 nt, Human
ugacauuuuaucaauaucacag

SEQ ID NO: 27585 - RNA, 22 nt, Human
ugacauuuuuauaagagucaaa

SEQ ID NO: 27586 - RNA, 22 nt, Human
ugacauuuuuguacaaagucag

SEQ ID NO: 27587 - RNA, 22 nt, Human
ugaccaaagaguugcuuguauu

SEQ ID NO: 27588 - RNA, 22 nt, Human
ugaccacuguagccacuuaaga

SEQ ID NO: 27589 - RNA, 21 nt, Human
ugaccagugccccauccuguc

SEQ ID NO: 27590 - RNA, 22 nt, Human
ugacccugaaauguagugguuu

SEQ ID NO: 27591 - RNA, 22 nt, Human
ugacccugagagcugaauggcu

SEQ ID NO: 27592 - RNA, 22 nt, Human
ugacccuuagaagcugcagcga

SEQ ID NO: 27593 - RNA, 21 nt, Human
ugacccuucuagcagaacaca

SEQ ID NO: 27594 - RNA, 21 nt, Human
ugacccuugccgagcuacauu

SEQ ID NO: 27595 - RNA, 22 nt, Human
ugacccuuggucuugcuuuucc

SEQ ID NO: 27596 - RNA, 22 nt, Human
ugacccuuguggcagaaaacag

SEQ ID NO: 27597 - RNA, 18 nt, Human
ugacccuuucucccugug

SEQ ID NO: 27598 - RNA, 22 nt, Human
ugaccgucuucccacuuucugu

SEQ ID NO: 27599 - RNA, 22 nt, Human
ugaccugacaugaauuaaaaac

SEQ ID NO: 27600 - RNA, 22 nt, Human
ugaccugucacauuuugaugaa

SEQ ID NO: 27601 - RNA, 22 nt, Human
ugaccuuauuugaaaauagaga

SEQ ID NO: 27602 - RNA, 22 nt, Human
ugaccuuucaacccuucuuggc

SEQ ID NO: 27603 - RNA, 22 nt, Human
ugacguuuuagguguuaaaucg

SEQ ID NO: 27604 - RNA, 22 nt, Human
ugacuagaauuguauuuagugu

SEQ ID NO: 27605 - RNA, 22 nt, Human
ugacuagaccuauaucuuuuug

SEQ ID NO: 27606 - RNA, 22 nt, Human
ugacucaggaggaaagacucca

SEQ ID NO: 27607 - RNA, 22 nt, Human
ugacucaguacaucuggaguug

SEQ ID NO: 27608 - RNA, 22 nt, Human
ugacucauauuucauggauacg

SEQ ID NO: 27609 - RNA, 22 nt, Human
ugacuccaaacagaaaacgaau

SEQ ID NO: 27610 - RNA, 22 nt, Human
ugacuccugguauggaugacag

SEQ ID NO: 27611 - RNA, 22 nt, Human
ugacucugcugugaaagcauuu

SEQ ID NO: 27612 - RNA, 22 nt, Human
ugacucugggguugaccagaug

SEQ ID NO: 27613 - RNA, 22 nt, Human
ugacugaaauugcauuuuaaaa

SEQ ID NO: 27614 - RNA, 22 nt, Human
ugacugagagagaacucagcuu

SEQ ID NO: 27615 - RNA, 22 nt, Human
ugacugaggcagccugaguuau

SEQ ID NO: 27616 - RNA, 22 nt, Human
ugacugaggccugauaacaguu

SEQ ID NO: 27617 - RNA, 22 nt, Human
ugacugugccuguugaaugaau

SEQ ID NO: 27618 - RNA, 22 nt, Human
ugacuucaaaggcucuacuccu

SEQ ID NO: 27619 - RNA, 22 nt, Human
ugacuucuagcauuuagcaacc

SEQ ID NO: 27620 - RNA, 22 nt, Human
ugacuuuacagauauguuuccu

SEQ ID NO: 27621 - RNA, 22 nt, Human
ugacuuuagagaugggagguca

SEQ ID NO: 27622 - RNA, 22 nt, Human
ugacuuugucccuuucaaaucc

SEQ ID NO: 27623 - RNA, 22 nt, Human
ugacuuugugccauuuuuauaa

SEQ ID NO: 27624 - RNA, 22 nt, Human
ugagaaaauuacuauaauuguc

SEQ ID NO: 27625 - RNA, 22 nt, Human
ugagaacaguuggaagcaguca

SEQ ID NO: 27626 - RNA, 22 nt, Human
ugagaacauuccucuuccuggc

SEQ ID NO: 27627 - RNA, 22 nt, Human
ugagaaccaagaccaagggccu

SEQ ID NO: 27628 - RNA, 22 nt, Human
ugagaaccaccuggaggugacu

SEQ ID NO: 27629 - RNA, 22 nt, Human
ugagaaccacgacugugcuuaa

SEQ ID NO: 27630 - RNA, 19 nt, Human
ugagaacuuuuacuuaugc

SEQ ID NO: 27631 - RNA, 22 nt, Human
ugagaagagcaaggaacugguu

SEQ ID NO: 27632 - RNA, 23 nt, Human
ugagaagccauuagagcaggugg

SEQ ID NO: 27633 - RNA, 20 nt, Human
ugagaagcuccugucuccuc

SEQ ID NO: 27634 - RNA, 22 nt, Human
ugagaagcucugaaacaguauc

SEQ ID NO: 27635 - RNA, 22 nt, Human
ugagaagcugcuugugcuguau

SEQ ID NO: 27636 - RNA, 22 nt, Human
uuacaaugcacucaccuuuaga

SEQ ID NO: 27637 - RNA, 22 nt, Human
uuacaauuacuugaucucagcu

SEQ ID NO: 27638 - RNA, 22 nt, Human
uuacacacagagcugggccugg

SEQ ID NO: 27639 - RNA, 21 nt, Human
uuacacacugcuucuagaaug

SEQ ID NO: 27640 - RNA, 22 nt, Human
uuacacagaugguuaguagagg

SEQ ID NO: 27641 - RNA, 22 nt, Human
uuacacaggcacuuaaaaugca

SEQ ID NO: 27642 - RNA, 22 nt, Human
uuacacagugaauuuacucaag

SEQ ID NO: 27643 - RNA, 22 nt, Human
uuacacagugguuaagucuggg

SEQ ID NO: 27644 - RNA, 22 nt, Human
uuacacaguugguaggggcaga

SEQ ID NO: 27645 - RNA, 22 nt, Human
uuacacaugaagguccaauguu

SEQ ID NO: 27646 - RNA, 22 nt, Human
uuacacauugcagaucaaaaug

SEQ ID NO: 27647 - RNA, 22 nt, Human
uuacacuaagcuacuucuauau

SEQ ID NO: 27648 - RNA, 22 nt, Human
ugagaaugaaucuuuugcuuuc

SEQ ID NO: 27649 - RNA, 22 nt, Human
ugagaauuuucaguuucacuuu

SEQ ID NO: 27650 - RNA, 22 nt, Human
ugagaauuuuuugucaugcauu

SEQ ID NO: 27651 - RNA, 22 nt, Human
ugagacaacagcuugugcugcu

SEQ ID NO: 27652 - RNA, 20 nt, Human
ugagacaaggcuggagagac

SEQ ID NO: 27653 - RNA, 22 nt, Human
ugagacaauauuaaccuaucuu

SEQ ID NO: 27654 - RNA, 22 nt, Human
ugagacaggagaggccccuccu

SEQ ID NO: 27655 - RNA, 19 nt, Human
ugagacagggauucaggug

SEQ ID NO: 27656 - RNA, 22 nt, Human
ugagaccuguagcuucacagag

SEQ ID NO: 27657 - RNA, 22 nt, Human
ugagaccuuggacuccauccuu

SEQ ID NO: 27658 - RNA, 22 nt, Human
ugagacuuggcacugaggaacu

SEQ ID NO: 27659 - RNA, 21 nt, Human
ugagagacugguggauacagg

SEQ ID NO: 27660 - RNA, 22 nt, Human
ugagagagggaugcacccuccu

SEQ ID NO: 27661 - RNA, 22 nt, Human
ugagagaggggacugccugcuu

SEQ ID NO: 27662 - RNA, 22 nt, Human
ugagagaugaacucugauaugu

SEQ ID NO: 27663 - RNA, 22 nt, Human
ugagagauugcuguauguuuug

SEQ ID NO: 27664 - RNA, 22 nt, Human
ugagagcaacacgcaguaguau

SEQ ID NO: 27665 - RNA, 22 nt, Human
ugagagcacacagaaauauuuu

SEQ ID NO: 27666 - RNA, 18 nt, Human
ugagagcauucgaggcaa

SEQ ID NO: 27667 - RNA, 22 nt, Human
ugagagccuaguagguggaaaa

SEQ ID NO: 27668 - RNA, 22 nt, Human
ugagagccuguguucaaaugcc

SEQ ID NO: 27669 - RNA, 22 nt, Human
ugagagcugcugagacuguccu

SEQ ID NO: 27670 - RNA, 22 nt, Human
ugagagcugggaaauguuagcu

SEQ ID NO: 27671 - RNA, 20 nt, Human
ugagaggacauuuuucaugu

SEQ ID NO: 27672 - RNA, 22 nt, Human
ugagaggguucccagggguuuc

SEQ ID NO: 27673 - RNA, 22 nt, Human
ugagagguaggaaaugaacaag

SEQ ID NO: 27674 - RNA, 22 nt, Human
ugagaggucauuaggccaugag

SEQ ID NO: 27675 - RNA, 22 nt, Human
ugagaguacuuauaugaacauu

SEQ ID NO: 27676 - RNA, 22 nt, Human
ugagaguauuuuggcauuauca

SEQ ID NO: 27677 - RNA, 22 nt, Human
ugagagucuguuccucuugcag

SEQ ID NO: 27678 - RNA, 19 nt, Human
ugagagugaggaaggcuuc

SEQ ID NO: 27679 - RNA, 22 nt, Human
ugagagugauugguucgaaugu

SEQ ID NO: 27680 - RNA, 22 nt, Human
ugagauaacauggaagaguagc

SEQ ID NO: 27681 - RNA, 22 nt, Human
ugagauaacuauucugucaacu

SEQ ID NO: 27682 - RNA, 22 nt, Human
ugagauaagcaaggauaaaggu

SEQ ID NO: 27683 - RNA, 22 nt, Human
ugagauaaggauguuauacucg

SEQ ID NO: 27684 - RNA, 22 nt, Human
ugagauaauaaauagcuuucuu

SEQ ID NO: 27685 - RNA, 22 nt, Human
ugagaugaagugauguaaaaca

SEQ ID NO: 27686 - RNA, 22 nt, Human
ugagaugcuaaagggcugcuca

SEQ ID NO: 27687 - RNA, 22 nt, Human
ugagauggagucucacucuguu

SEQ ID NO: 27688 - RNA, 22 nt, Human
ugagauggaguucugcucuugu

SEQ ID NO: 27689 - RNA, 22 nt, Human
ugagauggauuggguugguucc

SEQ ID NO: 27690 - RNA, 22 nt, Human
ugagaugggucaucagguuugg

SEQ ID NO: 27691 - RNA, 22 nt, Human
ugagaugguucacagagaaggc

SEQ ID NO: 27692 - RNA, 22 nt, Human
ugagauucccauuaauuuuaua

SEQ ID NO: 27693 - RNA, 22 nt, Human
ugagauuuuaauauugagaaaa

SEQ ID NO: 27694 - RNA, 23 nt, Human
ugagcaagugaccaacugucugu

SEQ ID NO: 27695 - RNA, 22 nt, Human
ugagcacaaguuugcaugugug

SEQ ID NO: 27696 - RNA, 22 nt, Human
ugagcacagcucgcaccagcuu

SEQ ID NO: 27697 - RNA, 22 nt, Human
ugagcaccaucuguuugugugc

SEQ ID NO: 27698 - RNA, 22 nt, Human
ugagcagaagauuggaacuuac

SEQ ID NO: 27699 - RNA, 22 nt, Human
ugagcagaagcccuccuggacu

SEQ ID NO: 27700 - RNA, 22 nt, Human
ugagcagaaguuauaaauaaga

SEQ ID NO: 27701 - RNA, 22 nt, Human
ugagcagacucugcagagccac

SEQ ID NO: 27702 - RNA, 22 nt, Human
ugagcagacuugaugaggcagc

SEQ ID NO: 27703 - RNA, 22 nt, Human
ugagcagagacuucaagggcag

SEQ ID NO: 27704 - RNA, 22 nt, Human
ugagcagagaugacugggcauu

SEQ ID NO: 27705 - RNA, 22 nt, Human
ugagcagagcaauaggacucuc

SEQ ID NO: 27706 - RNA, 22 nt, Human
ugagcagauggaggcuucugca

SEQ ID NO: 27707 - RNA, 22 nt, Human
ugagcagaugucuaacuuuuac

SEQ ID NO: 27708 - RNA, 23 nt, Human
ugagcagcuaaaggugaugcggg

SEQ ID NO: 27709 - RNA, 22 nt, Human
ugagcagcuacuguguucaggg

SEQ ID NO: 27710 - RNA, 22 nt, Human
ugagcaggcucccacuucagug

SEQ ID NO: 27711 - RNA, 22 nt, Human
ugagcaguaacagcucacaggg

SEQ ID NO: 27712 - RNA, 22 nt, Human
ugagcagucagacaagcaucac

SEQ ID NO: 27713 - RNA, 22 nt, Human
ugagcagucauccauuucuccu

SEQ ID NO: 27714 - RNA, 22 nt, Human
ugagcagugaugcguuuuguuu

SEQ ID NO: 27715 - RNA, 22 nt, Human
ugagcaguggcuccugcuggac

SEQ ID NO: 27716 - RNA, 22 nt, Human
ugagcaguggggccugcauucu

SEQ ID NO: 27717 - RNA, 22 nt, Human
ugagcagugguguuuuucuauc

SEQ ID NO: 27718 - RNA, 22 nt, Human
ugagcauagcccuucuaguguu

SEQ ID NO: 27719 - RNA, 19 nt, Human
ugagcaugcgagcugagaa

SEQ ID NO: 27720 - RNA, 22 nt, Human
ugagccacagugagagcuccug

SEQ ID NO: 27721 - RNA, 22 nt, Human
ugagccagaggaggcugugugg

SEQ ID NO: 27722 - RNA, 22 nt, Human
ugagccagaguggagugugccu

SEQ ID NO: 27723 - RNA, 22 nt, Human
ugagccagccucagaagucacg

SEQ ID NO: 27724 - RNA, 22 nt, Human
ugagccaggcccagugggguca

SEQ ID NO: 27725 - RNA, 22 nt, Human
ugagccaggucucacucaccuu

SEQ ID NO: 27726 - RNA, 22 nt, Human
ugagccagguuaagacaggagc

SEQ ID NO: 27727 - RNA, 22 nt, Human
ugagccagucugucugggugaa

SEQ ID NO: 27728 - RNA, 22 nt, Human
ugagccaguucuucagauccau

SEQ ID NO: 27729 - RNA, 22 nt, Human
ugagcccagcgucccguucugu

SEQ ID NO: 27730 - RNA, 22 nt, Human
ugagcccaggaguaugaggcug

SEQ ID NO: 27731 - RNA, 22 nt, Human
ugagccccggaguuucaggcug

SEQ ID NO: 27732 - RNA, 22 nt, Human
ugagcccuaagggucaagcagg

SEQ ID NO: 27733 - RNA, 22 nt, Human
ugagcccuccaaacccaggauu

SEQ ID NO: 27734 - RNA, 22 nt, Human
ugagcccuggagcccucuguua

SEQ ID NO: 27735 - RNA, 22 nt, Human
ugagcccuggcucuuucacuua

SEQ ID NO: 27736 - RNA, 22 nt, Human
ugagcccugugacugcuuugag

SEQ ID NO: 27737 - RNA, 18 nt, Human
ugagcccuuaucuuuggc

SEQ ID NO: 27738 - RNA, 22 nt, Human
ugagccuggccugcagagacca

SEQ ID NO: 27739 - RNA, 22 nt, Human
ugagccugggagauggaggcug

SEQ ID NO: 27740 - RNA, 22 nt, Human
ugagccuggggccugggcagcg

SEQ ID NO: 27741 - RNA, 22 nt, Human
ugagccuguccugugcauguga

SEQ ID NO: 27742 - RNA, 23 nt, Human
ugagccuguuaauacuggcucug

SEQ ID NO: 27743 - RNA, 22 nt, Human
ugagcgugcaguaguguuggua

SEQ ID NO: 27744 - RNA, 22 nt, Human
ugagcuacacacuaggcauggg

SEQ ID NO: 27745 - RNA, 22 nt, Human
ugagcuagggcuggugaggagc

SEQ ID NO: 27746 - RNA, 22 nt, Human
ugagcuagguccugugucagcu

SEQ ID NO: 27747 - RNA, 22 nt, Human
ugagcugaguuuaaaagcugcu

SEQ ID NO: 27748 - RNA, 22 nt, Human
ugagcugcauuacagccucugu

SEQ ID NO: 27749 - RNA, 22 nt, Human
ugagcuggcuugucaaccaggg

SEQ ID NO: 27750 - RNA, 22 nt, Human
ugagcugggcugggcugagcug

SEQ ID NO: 27751 - RNA, 22 nt, Human
ugagcuggggucagcuccccug

SEQ ID NO: 27752 - RNA, 23 nt, Human
ugagcugguauuguccaucucca

SEQ ID NO: 27753 - RNA, 22 nt, Human
ugagcuguaaggcugucacuga

SEQ ID NO: 27754 - RNA, 22 nt, Human
ugagcuguagcagaugcuguug

SEQ ID NO: 27755 - RNA, 22 nt, Human
ugagcugucaagguacagugaa

SEQ ID NO: 27756 - RNA, 22 nt, Human
ucuggggagugccuaaguggaa

SEQ ID NO: 27757 - RNA, 21 nt, Human
ucugcacagccccgcaggagg

SEQ ID NO: 27758 - RNA, 22 nt, Human
ucugcacaucccccaaaguauu

SEQ ID NO: 27759 - RNA, 22 nt, Human
ucugcaccuccugcuugcuaga

SEQ ID NO: 27760 - RNA, 22 nt, Human
uuaucucucacuuuuaaggaca

SEQ ID NO: 27761 - RNA, 18 nt, Human
uuaucugcugcaaagggu

SEQ ID NO: 27762 - RNA, 22 nt, Human
uuaucugucuaucaagacuagc

SEQ ID NO: 27763 - RNA, 22 nt, Human
uuaucugugauccuaaaugucu

SEQ ID NO: 27764 - RNA, 22 nt, Human
uuaucuuggcaauucuaaggua

SEQ ID NO: 27765 - RNA, 22 nt, Human
uuaucuuguagagauauuuucg

SEQ ID NO: 27766 - RNA, 22 nt, Human
uuaugaaaacaaucaguaggca

SEQ ID NO: 27767 - RNA, 19 nt, Human
uuaugaaggcuggggggag

SEQ ID NO: 27768 - RNA, 22 nt, Human
uuaugacagaaaugaaaagcug

SEQ ID NO: 27769 - RNA, 22 nt, Human
uuaugacaggaaaaucacagaa

SEQ ID NO: 27770 - RNA, 22 nt, Human
uuaugacauaugaguacaagua

SEQ ID NO: 27771 - RNA, 22 nt, Human
uuaugagcuaaguuguggcccc

SEQ ID NO: 27772 - RNA, 22 nt, Human
uuaugauuuagaaagauucacu

SEQ ID NO: 27773 - RNA, 22 nt, Human
uuaugauuugccacagauuggu

SEQ ID NO: 27774 - RNA, 22 nt, Human
uuaugcaacaggugagcagaca

SEQ ID NO: 27775 - RNA, 23 nt, Human
uuaugcaagcuuccuggucucag

SEQ ID NO: 27776 - RNA, 22 nt, Human
uuaugcuaagugaaauaagcca

SEQ ID NO: 27777 - RNA, 22 nt, Human
uuaugcuguuaggaaaaucaaa

SEQ ID NO: 27778 - RNA, 22 nt, Human
uuaugcuuccugauuggacucu

SEQ ID NO: 27779 - RNA, 22 nt, Human
uuauggaaaugaaauuuuauug

SEQ ID NO: 27780 - RNA, 23 nt, Human
uuauggagugccagacauuuggc

SEQ ID NO: 27781 - RNA, 22 nt, Human
uuauggcuaaauuucaauauua

SEQ ID NO: 27782 - RNA, 22 nt, Human
uuauggcuuaaauacuacaggg

SEQ ID NO: 27783 - RNA, 22 nt, Human
uuaugguaauuaaaacauguau

SEQ ID NO: 27784 - RNA, 22 nt, Human
uuaugguaggagcugucaguuu

SEQ ID NO: 27785 - RNA, 22 nt, Human
uuauguacccacucauauuccc

SEQ ID NO: 27786 - RNA, 22 nt, Human
uuaugugagguucagcuuuauc

SEQ ID NO: 27787 - RNA, 22 nt, Human
uuaugugccacuuuuugaagau

SEQ ID NO: 27788 - RNA, 22 nt, Human
uuauguguaccucaaucugagg

SEQ ID NO: 27789 - RNA, 20 nt, Human
uuauguguaccugugcuccc

SEQ ID NO: 27790 - RNA, 22 nt, Human
uuauguguguacaugcauaugu

SEQ ID NO: 27791 - RNA, 22 nt, Human
uuauguuugaguauaugacuca

SEQ ID NO: 27792 - RNA, 22 nt, Human
uuauuaguguugauauuaggau

SEQ ID NO: 27793 - RNA, 22 nt, Human
uuauuaugccauuaccucccug

SEQ ID NO: 27794 - RNA, 22 nt, Human
uuauuaugugcuagagaaugua

SEQ ID NO: 27795 - RNA, 22 nt, Human
uuauuauuuuguguacagcaaa

SEQ ID NO: 27796 - RNA, 22 nt, Human
uuauucaccaguguaaaacacu

SEQ ID NO: 27797 - RNA, 22 nt, Human
uuauucaccgcaggugcuuccc

SEQ ID NO: 27798 - RNA, 22 nt, Human
uuauucacucauuaaagcagga

SEQ ID NO: 27799 - RNA, 22 nt, Human
uuauucacucauuuaacauuau

SEQ ID NO: 27800 - RNA, 22 nt, Human
uuauucagcucucuagaggcac

SEQ ID NO: 27801 - RNA, 22 nt, Human
uuauucaggcucucuuuggcua

SEQ ID NO: 27802 - RNA, 22 nt, Human
uuauucaggucauggacuguca

SEQ ID NO: 27803 - RNA, 22 nt, Human
uuauucagugcauauauuaaaa

SEQ ID NO: 27804 - RNA, 22 nt, Human
uuauucaguuuguguagaggug

SEQ ID NO: 27805 - RNA, 22 nt, Human
uuauucaucagugcauuaauuu

SEQ ID NO: 27806 - RNA, 22 nt, Human
uuauuccauagaagucaaggaa

SEQ ID NO: 27807 - RNA, 22 nt, Human
uuauuccauugucuuuugacuu

SEQ ID NO: 27808 - RNA, 22 nt, Human
uuauucugccaggagcgucagu

SEQ ID NO: 27809 - RNA, 22 nt, Human
uuauucuguagaaccuaguaca

SEQ ID NO: 27810 - RNA, 22 nt, Human
uuauucugucaaacuuauacau

SEQ ID NO: 27811 - RNA, 22 nt, Human
uuauucuguuggcccucucauc

SEQ ID NO: 27812 - RNA, 18 nt, Human
uuauucuuccaggccacc

SEQ ID NO: 27813 - RNA, 22 nt, Human
uuauucuuuaaacauauauguu

SEQ ID NO: 27814 - RNA, 22 nt, Human
uuauucuuuucuccagaauccc

SEQ ID NO: 27815 - RNA, 21 nt, Human
uuauugaauguuuaccgugug

SEQ ID NO: 27816 - RNA, 22 nt, Human
uuauugcaccuuccucacuaac

SEQ ID NO: 27817 - RNA, 22 nt, Human
uuauugccauccuggaaccuag

SEQ ID NO: 27818 - RNA, 22 nt, Human
uuauugccugucauuauugaau

SEQ ID NO: 27819 - RNA, 22 nt, Human
uuauugcugcuaacauuuuaug

SEQ ID NO: 27820 - RNA, 22 nt, Human
uuauugcuuuggaaaacacuca

SEQ ID NO: 27821 - RNA, 22 nt, Human
uuauugucaaaaacaggacacu

SEQ ID NO: 27822 - RNA, 22 nt, Human
uuauuguggacuacuguucugg

SEQ ID NO: 27823 - RNA, 22 nt, Human
uuauugugugcguuagccuaug

SEQ ID NO: 27824 - RNA, 22 nt, Human
uuauuuaaugugaucugaagag

SEQ ID NO: 27825 - RNA, 22 nt, Human
uuauuuauaucucugcaguuua

SEQ ID NO: 27826 - RNA, 22 nt, Human
uuauuuauuguguaccuacugu

SEQ ID NO: 27827 - RNA, 22 nt, Human
uuauuucaaaagagcuuggggu

SEQ ID NO: 27828 - RNA, 21 nt, Human
uuauuucacauggacuuccag

SEQ ID NO: 27829 - RNA, 20 nt, Human
uuauuucaguugcuagauug

SEQ ID NO: 27830 - RNA, 22 nt, Human
uuauuucauauaauguuaucaa

SEQ ID NO: 27831 - RNA, 22 nt, Human
uuauuucuacuauuuugccuga

SEQ ID NO: 27832 - RNA, 20 nt, Human
uuauuucucauucuccuacu

SEQ ID NO: 27833 - RNA, 22 nt, Human
uuauuugaaaagaagguuacgu

SEQ ID NO: 27834 - RNA, 22 nt, Human
uuauuugcccauguuuagcaga

SEQ ID NO: 27835 - RNA, 23 nt, Human
uuauuuggauuuuaguggaaaga

SEQ ID NO: 27836 - RNA, 22 nt, Human
uuauuuggcaaugcuucaccau

SEQ ID NO: 27837 - RNA, 22 nt, Human
uuauuuguaucaaggacgguug

SEQ ID NO: 27838 - RNA, 22 nt, Human
uuauuuguggcauaugagacga

SEQ ID NO: 27839 - RNA, 22 nt, Human
uuauuuguggcauccauguugg

SEQ ID NO: 27840 - RNA, 22 nt, Human
uuauuuucagcuaggaaagcca

SEQ ID NO: 27841 - RNA, 21 nt, Human
uucaaaaugguguguuugucu

SEQ ID NO: 27842 - RNA, 22 nt, Human
uucaaacaacucauuuaugcaa

SEQ ID NO: 27843 - RNA, 22 nt, Human
uucaaacacagacagcagcaug

SEQ ID NO: 27844 - RNA, 22 nt, Human
uucaaacacugcuuugagaggg

SEQ ID NO: 27845 - RNA, 22 nt, Human
uucaaacaguguagaauauaug

SEQ ID NO: 27846 - RNA, 22 nt, Human
uucaaacuaguuaaaagucaga

SEQ ID NO: 27847 - RNA, 22 nt, Human
uucaaacucacacuagggagac

SEQ ID NO: 27848 - RNA, 22 nt, Human
uucaaacucugaguaguucugc

SEQ ID NO: 27849 - RNA, 22 nt, Human
uucaaacuguguaauuuauaaa

SEQ ID NO: 27850 - RNA, 22 nt, Human
uucaaagauaauuaccaaacau

SEQ ID NO: 27851 - RNA, 22 nt, Human
uucaaagauggagggauagauu

SEQ ID NO: 27852 - RNA, 22 nt, Human
uucaaagcaagacacaauuccu

SEQ ID NO: 27853 - RNA, 22 nt, Human
uucaaagcugcagacuccuggg

SEQ ID NO: 27854 - RNA, 22 nt, Human
uucaaaguuucaaucuguauca

SEQ ID NO: 27855 - RNA, 22 nt, Human
uucaaaucagaccgaaggcaac

SEQ ID NO: 27856 - RNA, 22 nt, Human
uucaacaaaauauauuuuucca

SEQ ID NO: 27857 - RNA, 21 nt, Human
uucaacaaagggaauaaguuu

SEQ ID NO: 27858 - RNA, 22 nt, Human
uucaacaacuugguucaaaugg

SEQ ID NO: 27859 - RNA, 22 nt, Human
uucaacaaggcugucaaaaguu

SEQ ID NO: 27860 - RNA, 22 nt, Human
uucaacacaggaacaugauaua

SEQ ID NO: 27861 - RNA, 22 nt, Human
uucaacauagcugaggcauaua

SEQ ID NO: 27862 - RNA, 22 nt, Human
uucaacaucaagaaugcaugga

SEQ ID NO: 27863 - RNA, 22 nt, Human
uucaacaugcuuuauuucuaaa

SEQ ID NO: 27864 - RNA, 22 nt, Human
uucaacauguucuacauaaggg

SEQ ID NO: 27865 - RNA, 22 nt, Human
uucaacauuacacaggcaauuc

SEQ ID NO: 27866 - RNA, 22 nt, Human
ucuggaggccauagggaaggau

SEQ ID NO: 27867 - RNA, 22 nt, Human
ucuggagggcccacauccacaa

SEQ ID NO: 27868 - RNA, 22 nt, Human
ucuggaguggacccagagcacu

SEQ ID NO: 27869 - RNA, 22 nt, Human
ucuggaguggaggugccuuggg

SEQ ID NO: 27870 - RNA, 22 nt, Human
ucuggaguggcagucaucugaa

SEQ ID NO: 27871 - RNA, 22 nt, Human
ucuggagugggacuuugcaucu

SEQ ID NO: 27872 - RNA, 22 nt, Human
ucuggaguuccugcaggcugug

SEQ ID NO: 27873 - RNA, 22 nt, Human
ucuggaguuugagcacuucaau

SEQ ID NO: 27874 - RNA, 22 nt, Human
ucuggaguuuuuucugucugug

SEQ ID NO: 27875 - RNA, 22 nt, Human
ugaguaauucacaaaacagaug

SEQ ID NO: 27876 - RNA, 22 nt, Human
ugaguacucggagugcuuugga

SEQ ID NO: 27877 - RNA, 22 nt, Human
ugaguacuuuauguuaguuauu

SEQ ID NO: 27878 - RNA, 22 nt, Human
ugaguagacgugaucuaguaac

SEQ ID NO: 27879 - RNA, 22 nt, Human
ugaguagagaauucagcuaagg

SEQ ID NO: 27880 - RNA, 22 nt, Human
ugaguagauccaagacuguccu

SEQ ID NO: 27881 - RNA, 22 nt, Human
ugaguagcggcuauguguaacu

SEQ ID NO: 27882 - RNA, 22 nt, Human
ugaguauccuauaugguguaag

SEQ ID NO: 27883 - RNA, 22 nt, Human
ugaguauuccuuaucugaaaug

SEQ ID NO: 27884 - RNA, 22 nt, Human
ugagucacauccauuuuugugu

SEQ ID NO: 27885 - RNA, 23 nt, Human
ugagucaccacaguuacagucac

SEQ ID NO: 27886 - RNA, 20 nt, Human
ugagucagcugcaugggugg

SEQ ID NO: 27887 - RNA, 22 nt, Human
ugaguccaagagccagugggaa

SEQ ID NO: 27888 - RNA, 22 nt, Human
ugaguccagaugggccagcagg

SEQ ID NO: 27889 - RNA, 22 nt, Human
ugaguccauaguggauccuuca

SEQ ID NO: 27890 - RNA, 22 nt, Human
ugaguccgaaguugcagugagc

SEQ ID NO: 27891 - RNA, 22 nt, Human
ugagucuagguagagaaaugca

SEQ ID NO: 27892 - RNA, 22 nt, Human
ugagucugcuccugguagcaga

SEQ ID NO: 27893 - RNA, 22 nt, Human
ugagugaaaaauuugccuggag

SEQ ID NO: 27894 - RNA, 22 nt, Human
ugagugaaauucugguaaagga

SEQ ID NO: 27895 - RNA, 22 nt, Human
ugagugaggcugggcagucccu

SEQ ID NO: 27896 - RNA, 22 nt, Human
ugagugaggugcuuagggcaca

SEQ ID NO: 27897 - RNA, 22 nt, Human
ugagugccuaccaagugcugga

SEQ ID NO: 27898 - RNA, 22 nt, Human
ugagugccugaacauagaguag

SEQ ID NO: 27899 - RNA, 20 nt, Human
ugagugcuccauucugccca

SEQ ID NO: 27900 - RNA, 22 nt, Human
ugagugcucuguaugugccaga

SEQ ID NO: 27901 - RNA, 22 nt, Human
ugaguggaguagugaaugcauu

SEQ ID NO: 27902 - RNA, 17 nt, Human
ugaguggccgggggaca

SEQ ID NO: 27903 - RNA, 22 nt, Human
ugagugggaccugcguguguca

SEQ ID NO: 27904 - RNA, 22 nt, Human
ugaguguauaucaggagagagc

SEQ ID NO: 27905 - RNA, 22 nt, Human
ugaguguauaugaagguuguaa

SEQ ID NO: 27906 - RNA, 22 nt, Human
ugagugucuggucauggcaggc

SEQ ID NO: 27907 - RNA, 22 nt, Human
ugagugugcagggaaguggcgg

SEQ ID NO: 27908 - RNA, 23 nt, Human
ugaguguggggacagugguuugc

SEQ ID NO: 27909 - RNA, 22 nt, Human
ugaguguuguaaccauaugauu

SEQ ID NO: 27910 - RNA, 21 nt, Human
ugaguuaaaauggagagucuu

SEQ ID NO: 27911 - RNA, 22 nt, Human
ugaguuagcucuauucuuuugg

SEQ ID NO: 27912 - RNA, 22 nt, Human
ugaguuauugagaaauaacugc

SEQ ID NO: 27913 - RNA, 22 nt, Human
ugaguucauauaguucaagaua

SEQ ID NO: 27914 - RNA, 22 nt, Human
ugaguucauuugagugaacacu

SEQ ID NO: 27915 - RNA, 23 nt, Human
ugaguucuaggcuuaaaacuagc

SEQ ID NO: 27916 - RNA, 22 nt, Human
ugaguucuccaagagaagguau

SEQ ID NO: 27917 - RNA, 22 nt, Human
ugaguucugacugugaugccag

SEQ ID NO: 27918 - RNA, 19 nt, Human
ugaguucugugguucucaa

SEQ ID NO: 27919 - RNA, 22 nt, Human
ugaguuuaaugauauuuauaug

SEQ ID NO: 27920 - RNA, 22 nt, Human
ugaguuuagugugagacuuauc

SEQ ID NO: 27921 - RNA, 21 nt, Human
ugaguuucagaggggaaggaa

SEQ ID NO: 27922 - RNA, 22 nt, Human
ugaguuuugucuugcuagaagu

SEQ ID NO: 27923 - RNA, 22 nt, Human
ugaguuuuuucaacauaugaag

SEQ ID NO: 27924 - RNA, 22 nt, Human
ugauaaacauuuuaggaacuaa

SEQ ID NO: 27925 - RNA, 22 nt, Human
ugauaaacuggagagguggagg

SEQ ID NO: 27926 - RNA, 22 nt, Human
ugauacaaucaugagagaggac

SEQ ID NO: 27927 - RNA, 22 nt, Human
ugauagaagcagaagcauacca

SEQ ID NO: 27928 - RNA, 22 nt, Human
ugauaggcuuaauuuuccuguc

SEQ ID NO: 27929 - RNA, 22 nt, Human
ugauaucuaagaaauucuacca

SEQ ID NO: 27930 - RNA, 22 nt, Human
ugauaugcauguaagggagaca

SEQ ID NO: 27931 - RNA, 22 nt, Human
ugauaugugaagcuauuaguuc

SEQ ID NO: 27932 - RNA, 22 nt, Human
ugauauuuaagcaaaaauaugg

SEQ ID NO: 27933 - RNA, 22 nt, Human
ugauauuuuucacuggccucug

SEQ ID NO: 27934 - RNA, 22 nt, Human
ugaucaaagugcuggaauuaca

SEQ ID NO: 27935 - RNA, 21 nt, Human
ugaucacaugaaaaccaugca

SEQ ID NO: 27936 - RNA, 22 nt, Human
ugaucagacaguuaugugcaug

SEQ ID NO: 27937 - RNA, 22 nt, Human
ugaucauuaucaaacuggucau

SEQ ID NO: 27938 - RNA, 22 nt, Human
ugauccauauguguuacuucuc

SEQ ID NO: 27939 - RNA, 22 nt, Human
ugaucccaaucuuuccugcucc

SEQ ID NO: 27940 - RNA, 22 nt, Human
ugaucugagagcagaucaccau

SEQ ID NO: 27941 - RNA, 19 nt, Human
ugaucuggaaggaaccagg

SEQ ID NO: 27942 - RNA, 22 nt, Human
ugaucuggaauucccuguggua

SEQ ID NO: 27943 - RNA, 22 nt, Human
ugaucuuuucuauuuaugguag

SEQ ID NO: 27944 - RNA, 22 nt, Human
ugaugaaaguucaguagugaau

SEQ ID NO: 27945 - RNA, 22 nt, Human
ugaugaaugucauacauaauga

SEQ ID NO: 27946 - RNA, 22 nt, Human
ugaugacuauauaugacuagug

SEQ ID NO: 27947 - RNA, 22 nt, Human
ugaugaggacccaucaccuggu

SEQ ID NO: 27948 - RNA, 22 nt, Human
ugaugaggcauaugcuacacau

SEQ ID NO: 27949 - RNA, 22 nt, Human
ugaugaggcuucuuggugaaca

SEQ ID NO: 27950 - RNA, 22 nt, Human
ugaugagguggauucaaagcag

SEQ ID NO: 27951 - RNA, 22 nt, Human
ugaugaguuuacucuuuucuaa

SEQ ID NO: 27952 - RNA, 22 nt, Human
ugaugauuucauuucuagcugu

SEQ ID NO: 27953 - RNA, 18 nt, Human
ugaugcaagagugagcua

SEQ ID NO: 27954 - RNA, 22 nt, Human
ugaugcaauguuuacaucuuga

SEQ ID NO: 27955 - RNA, 22 nt, Human
ugaugcagaauccuagaguguc

SEQ ID NO: 27956 - RNA, 22 nt, Human
ugaugcccccaaaucuggcuca

SEQ ID NO: 27957 - RNA, 22 nt, Human
ugaugcucuccuaauaugaaaa

SEQ ID NO: 27958 - RNA, 22 nt, Human
ugaugcugagccugggacugac

SEQ ID NO: 27959 - RNA, 22 nt, Human
ugaugcugucaaggaggugaac

SEQ ID NO: 27960 - RNA, 22 nt, Human
ugaugcuguuccaguuauauug

SEQ ID NO: 27961 - RNA, 22 nt, Human
ugaugcuucacgcugaauaugc

SEQ ID NO: 27962 - RNA, 22 nt, Human
ugauggaaauaaaagcauagcu

SEQ ID NO: 27963 - RNA, 22 nt, Human
ugauggaaauguucuguaucug

SEQ ID NO: 27964 - RNA, 22 nt, Human
ugauggaagagcuaacaauauc

SEQ ID NO: 27965 - RNA, 22 nt, Human
ugauggauguggcucuggagcu

SEQ ID NO: 27966 - RNA, 23 nt, Human
ugauggccgcccuuugcccuguc

SEQ ID NO: 27967 - RNA, 22 nt, Human
ugauggcucauguuuggggaug

SEQ ID NO: 27968 - RNA, 22 nt, Human
ugauggcuuauggagagagcaa

SEQ ID NO: 27969 - RNA, 22 nt, Human
ugaugggaaaaugaggccuggg

SEQ ID NO: 27970 - RNA, 22 nt, Human
ugaugguaaacaaagacauuua

SEQ ID NO: 27971 - RNA, 20 nt, Human
ugaugguauuaggaggugug

SEQ ID NO: 27972 - RNA, 22 nt, Human
ugaugguugauuauaaaucagu

SEQ ID NO: 27973 - RNA, 22 nt, Human
ugaugugaacucuugauaugau

SEQ ID NO: 27974 - RNA, 22 nt, Human
ugauguguggcaguuaaacugu

SEQ ID NO: 27975 - RNA, 22 nt, Human
uucagcaaauggcuugagauaa

SEQ ID NO: 27976 - RNA, 22 nt, Human
uucagcaaggcaugugcaggag

SEQ ID NO: 27977 - RNA, 22 nt, Human
uucagcacaagacuagacaggu

SEQ ID NO: 27978 - RNA, 22 nt, Human
uucagcaccuggaauagcaccu

SEQ ID NO: 27979 - RNA, 22 nt, Human
uucagcaggcgguagcugccac

SEQ ID NO: 27980 - RNA, 19 nt, Human
uucagcaggcugaagcuuc

SEQ ID NO: 27981 - RNA, 22 nt, Human
uucagcagugcagacacccagu

SEQ ID NO: 27982 - RNA, 19 nt, Human
uucagcagugucugcucuu

SEQ ID NO: 27983 - RNA, 22 nt, Human
uucagcaugaaaggauuugagu

SEQ ID NO: 27984 - RNA, 23 nt, Human
uucagcaugaagagugaaggcug

SEQ ID NO: 27985 - RNA, 19 nt, Human
uucagcauuauauucuagc

SEQ ID NO: 27986 - RNA, 22 nt, Human
uucagcuauaacauugagacuu

SEQ ID NO: 27987 - RNA, 22 nt, Human
uucagcuaugcgcuuugggcaa

SEQ ID NO: 27988 - RNA, 22 nt, Human
uucagcuauggagucuuaguua

SEQ ID NO: 27989 - RNA, 22 nt, Human
uucagcucuaguaagcagacac

SEQ ID NO: 27990 - RNA, 22 nt, Human
uucagcuugaaucuggcuuuga

SEQ ID NO: 27991 - RNA, 22 nt, Human
uucagcuugcugacugcggcag

SEQ ID NO: 27992 - RNA, 23 nt, Human
uucaggaaaugaauacagacaca

SEQ ID NO: 27993 - RNA, 22 nt, Human
ucuggaucccaccgccacacac

SEQ ID NO: 27994 - RNA, 22 nt, Human
ucuggaugaaagggcuauauau

SEQ ID NO: 27995 - RNA, 22 nt, Human
ucuggaugacagaauggucaua

SEQ ID NO: 27996 - RNA, 22 nt, Human
ucuggaugcucugagcccaagg

SEQ ID NO: 27997 - RNA, 22 nt, Human
ucuggauuuguggaaaaucugc

SEQ ID NO: 27998 - RNA, 22 nt, Human
ucuggcaaaggcaaccacaguu

SEQ ID NO: 27999 - RNA, 22 nt, Human
ucuggcaccacugagucugcag

SEQ ID NO: 28000 - RNA, 22 nt, Human
ucuggcagaaggcagaaauuca

SEQ ID NO: 28001 - RNA, 22 nt, Human
ucuggcagaagugcugucagua

SEQ ID NO: 28002 - RNA, 22 nt, Human
ucuggcagaucuucccacguuu

SEQ ID NO: 28003 - RNA, 22 nt, Human
ucuggcagcuauccucuggcca

SEQ ID NO: 28004 - RNA, 22 nt, Human
ucuggcagcucuccucggcgga

SEQ ID NO: 28005 - RNA, 21 nt, Human
ucuggcaggaagacggauggg

SEQ ID NO: 28006 - RNA, 22 nt, Human
ucuggcaggguguguauuuaca

SEQ ID NO: 28007 - RNA, 22 nt, Human
ucuggcagugaagucaugaggu

SEQ ID NO: 28008 - RNA, 22 nt, Human
ucuggcaguggaugagggcagc

SEQ ID NO: 28009 - RNA, 22 nt, Human
ucuggcaguuccuuguugauau

SEQ ID NO: 28010 - RNA, 22 nt, Human
ucuggcaguugccgcuucaguc

SEQ ID NO: 28011 - RNA, 22 nt, Human
ucuggcaucuguuuucauauuu

SEQ ID NO: 28012 - RNA, 22 nt, Human
ucuggcauuuuggcugggaaac

SEQ ID NO: 28013 - RNA, 22 nt, Human
ucuggccacuaauaggucucac

SEQ ID NO: 28014 - RNA, 22 nt, Human
ucuggccagaaagacuugaugu

SEQ ID NO: 28015 - RNA, 22 nt, Human
ucuggccagcaugagaccuggu

SEQ ID NO: 28016 - RNA, 22 nt, Human
ucuggccaggggucccugaagg

SEQ ID NO: 28017 - RNA, 22 nt, Human
ucuggccaguagauguggguug

SEQ ID NO: 28018 - RNA, 22 nt, Human
ucuggccagugaaaugcagaau

SEQ ID NO: 28019 - RNA, 22 nt, Human
ucuggccccuggucucuggugu

SEQ ID NO: 28020 - RNA, 21 nt, Human
ucuggcccucacagucacacc

SEQ ID NO: 28021 - RNA, 22 nt, Human
ucuggcccugcugcugugagca

SEQ ID NO: 28022 - RNA, 22 nt, Human
ucuggcucaggagcuguguuca

SEQ ID NO: 28023 - RNA, 22 nt, Human
ucuggcuccacuuucuucauuu

SEQ ID NO: 28024 - RNA, 19 nt, Human
ucuggcuccugccaggcug

SEQ ID NO: 28025 - RNA, 22 nt, Human
ucuggcuccuggcuccacugcc

SEQ ID NO: 28026 - RNA, 22 nt, Human
ucuggcucggauuugucuagca

SEQ ID NO: 28027 - RNA, 22 nt, Human
ucuggcucuauaacuccuagcu

SEQ ID NO: 28028 - RNA, 22 nt, Human
ucuggcucucauacucgccagu

SEQ ID NO: 28029 - RNA, 22 nt, Human
ucuggcucuguguccccaccca

SEQ ID NO: 28030 - RNA, 22 nt, Human
ucuggcugcaccauuauaguag

SEQ ID NO: 28031 - RNA, 22 nt, Human
ucuggcugcguggccuuuagca

SEQ ID NO: 28032 - RNA, 22 nt, Human
ucuggcuguguaauauguguag

SEQ ID NO: 28033 - RNA, 22 nt, Human
ucuggcuguuaggccugaccuu

SEQ ID NO: 28034 - RNA, 22 nt, Human
ucuggcuucuccuagagcaaug

SEQ ID NO: 28035 - RNA, 22 nt, Human
ucuggcuuguguccuuccuugc

SEQ ID NO: 28036 - RNA, 22 nt, Human
ucuggcuuuccuggagcaagaa

SEQ ID NO: 28037 - RNA, 22 nt, Human
ucuggcuuucugacucuacaac

SEQ ID NO: 28038 - RNA, 22 nt, Human
ucugggaaacacugcaucccca

SEQ ID NO: 28039 - RNA, 22 nt, Human
ucugggaaaguaaauguaaagg

SEQ ID NO: 28040 - RNA, 22 nt, Human
ucugggaacacuuugugagcuc

SEQ ID NO: 28041 - RNA, 22 nt, Human
ucugggaacgaaggcuaauaug

SEQ ID NO: 28042 - RNA, 22 nt, Human
ucugggaagauguuucaaaggu

SEQ ID NO: 28043 - RNA, 23 nt, Human
ucugggaauuggcuguccacagg

SEQ ID NO: 28044 - RNA, 22 nt, Human
ucugggaauuuauuggcacuuu

SEQ ID NO: 28045 - RNA, 22 nt, Human
ucugggacauucucuccauagu

SEQ ID NO: 28046 - RNA, 22 nt, Human
ucugggagagggaaagaagacu

SEQ ID NO: 28047 - RNA, 22 nt, Human
ucugggagcuggcuuugccuca

SEQ ID NO: 28048 - RNA, 22 nt, Human
ucugggagggcugguucaguau

SEQ ID NO: 28049 - RNA, 22 nt, Human
ucugggagguacugggaggugu

SEQ ID NO: 28050 - RNA, 22 nt, Human
ucugggagguguuuugagaacu

SEQ ID NO: 28051 - RNA, 22 nt, Human
ucugggagugaagcaacagaug

SEQ ID NO: 28052 - RNA, 22 nt, Human
ucugggaguuguaguccggugg

SEQ ID NO: 28053 - RNA, 18 nt, Human
ucugggcaaucucaguau

SEQ ID NO: 28054 - RNA, 23 nt, Human
ucugggcaccuuguugacaugau

SEQ ID NO: 28055 - RNA, 20 nt, Human
ucugggcagggcacauggaa

SEQ ID NO: 28056 - RNA, 22 nt, Human
ucugggcaguaccccucuccua

SEQ ID NO: 28057 - RNA, 22 nt, Human
ucugggcccacucaacuucacu

SEQ ID NO: 28058 - RNA, 22 nt, Human
ucugggccggagccgacggcag

SEQ ID NO: 28059 - RNA, 22 nt, Human
ucugggccuauagaagucuacc

SEQ ID NO: 28060 - RNA, 22 nt, Human
ucugggcuauauggucucugcu

SEQ ID NO: 28061 - RNA, 22 nt, Human
ucugggcucacgagucuggaca

SEQ ID NO: 28062 - RNA, 22 nt, Human
ucugggcucugucagcaccucu

SEQ ID NO: 28063 - RNA, 23 nt, Human
ucugggcugagacuuggaagguc

SEQ ID NO: 28064 - RNA, 21 nt, Human
ucugggcugcugcugcccauc

SEQ ID NO: 28065 - RNA, 22 nt, Human
ucugggcugcugugcagugacc

SEQ ID NO: 28066 - RNA, 23 nt, Human
ucugggcugcuuaaggaucaagg

SEQ ID NO: 28067 - RNA, 22 nt, Human
ucugggcugggagcguguggac

SEQ ID NO: 28068 - RNA, 22 nt, Human
ucugggcugguugugcuugcuu

SEQ ID NO: 28069 - RNA, 22 nt, Human
ucugggcuuggguagaaaucac

SEQ ID NO: 28070 - RNA, 22 nt, Human
ucugggcuugguuagggcuguu

SEQ ID NO: 28071 - RNA, 22 nt, Human
ucugggcuuuaagaacucuguu

SEQ ID NO: 28072 - RNA, 22 nt, Human
ucugggcuuuuccaugccugug

SEQ ID NO: 28073 - RNA, 22 nt, Human
ucugggcuuuugcacuggccau

SEQ ID NO: 28074 - RNA, 22 nt, Human
ucuggggagggagccacagguc

SEQ ID NO: 28075 - RNA, 22 nt, Human
ucuggggauaagacccagguau

SEQ ID NO: 28076 - RNA, 22 nt, Human
ucuggggaugaggaccuagaug

SEQ ID NO: 28077 - RNA, 22 nt, Human
ucuggggaugagguccagugau

SEQ ID NO: 28078 - RNA, 22 nt, Human
ucuggggguuaagugaggacaa

SEQ ID NO: 28079 - RNA, 20 nt, Human
ucuggggugaagcccaggaa

SEQ ID NO: 28080 - RNA, 22 nt, Human
ucuggggugcagccuggacaua

SEQ ID NO: 28081 - RNA, 22 nt, Human
ucugggguggagcccuggaguc

SEQ ID NO: 28082 - RNA, 22 nt, Human
ucugggguugagucugggucag

SEQ ID NO: 28083 - RNA, 22 nt, Human
ucuggguaugaccuauuuuucc

SEQ ID NO: 28084 - RNA, 22 nt, Human
ugcaugcuucaggcuggcucug

SEQ ID NO: 28085 - RNA, 18 nt, Human
ugcaugcuuuuguuucca

SEQ ID NO: 28086 - RNA, 22 nt, Human
ugcauggagcugucugcauggu

SEQ ID NO: 28087 - RNA, 22 nt, Human
ugcauggauauauacccuaggc

SEQ ID NO: 28088 - RNA, 22 nt, Human
ugcaugguguaauucuaaugcu

SEQ ID NO: 28089 - RNA, 22 nt, Human
ugcauguaugugcucacaugug

SEQ ID NO: 28090 - RNA, 22 nt, Human
ugcauguauuuaaaguugcaau

SEQ ID NO: 28091 - RNA, 17 nt, Human
ugcauguccuuuguucc

SEQ ID NO: 28092 - RNA, 22 nt, Human
ugcauguguguauucagagacu

SEQ ID NO: 28093 - RNA, 22 nt, Human
ugcauguuccaacuccaucacu

SEQ ID NO: 28094 - RNA, 22 nt, Human
ugcauguuuauaacagaugagg

SEQ ID NO: 28095 - RNA, 22 nt, Human
ugcauuaaaaugauggagaaau

SEQ ID NO: 28096 - RNA, 22 nt, Human
ugcauuaaauauaaucuguuga

SEQ ID NO: 28097 - RNA, 22 nt, Human
ugcauuaagggccuggagauac

SEQ ID NO: 28098 - RNA, 22 nt, Human
ugcauuaagugucugcauaugg

SEQ ID NO: 28099 - RNA, 22 nt, Human
ugcauuauacauggaucuaaag

SEQ ID NO: 28100 - RNA, 22 nt, Human
ugcauuaucgucuugauccucu

SEQ ID NO: 28101 - RNA, 22 nt, Human
ugcauucaaaucuccaggcuca

SEQ ID NO: 28102 - RNA, 21 nt, Human
ugcauucuagcagcucugagg

SEQ ID NO: 28103 - RNA, 21 nt, Human
ugcauucuuguguaagguagu

SEQ ID NO: 28104 - RNA, 22 nt, Human
ugcauugagauuuuaaaauuca

SEQ ID NO: 28105 - RNA, 22 nt, Human
ugcauuggaaaacuauggcuca

SEQ ID NO: 28106 - RNA, 22 nt, Human
ugcauugggagagauuagggca

SEQ ID NO: 28107 - RNA, 22 nt, Human
ugcauugggagucagugcugaa

SEQ ID NO: 28108 - RNA, 22 nt, Human
ugcauuggucauuugaaaauau

SEQ ID NO: 28109 - RNA, 22 nt, Human
ugcauuuaguuuuaauaaagga

SEQ ID NO: 28110 - RNA, 22 nt, Human
ugcauuuauaaaauguucgugg

SEQ ID NO: 28111 - RNA, 22 nt, Human
ugcauuuaugucucccaccagc

SEQ ID NO: 28112 - RNA, 22 nt, Human
ugcauuucacagacugagaaau

SEQ ID NO: 28113 - RNA, 22 nt, Human
ugcauuucccauuguguggcuc

SEQ ID NO: 28114 - RNA, 21 nt, Human
ugcauuucuaacuaguugacc

SEQ ID NO: 28115 - RNA, 22 nt, Human
ugcauuugaagucagacaggcu

SEQ ID NO: 28116 - RNA, 22 nt, Human
ugcauuuguaacauucaagaau

SEQ ID NO: 28117 - RNA, 20 nt, Human
ugcauuuguuauuuguacuc

SEQ ID NO: 28118 - RNA, 22 nt, Human
ugccaaauuagaguucccaggc

SEQ ID NO: 28119 - RNA, 22 nt, Human
ugccaaauugcccuauaaauga

SEQ ID NO: 28120 - RNA, 17 nt, Human
ugccaagaagagcagag

SEQ ID NO: 28121 - RNA, 22 nt, Human
ugccaagagggcagagggcagu

SEQ ID NO: 28122 - RNA, 22 nt, Human
ugccaagagguccaggugggaa

SEQ ID NO: 28123 - RNA, 22 nt, Human
ugccaagcacagaggggccacu

SEQ ID NO: 28124 - RNA, 22 nt, Human
ugacccuuugcuuccucauugu

SEQ ID NO: 28125 - RNA, 22 nt, Human
ugaccugcagucaagaggggaa

SEQ ID NO: 28126 - RNA, 22 nt, Human
ugaccugcguaggugguuucug

SEQ ID NO: 28127 - RNA, 22 nt, Human
ugaccugggcauuacaggugca

SEQ ID NO: 28128 - RNA, 22 nt, Human
ugacgguauuuagggagcagcg

SEQ ID NO: 28129 - RNA, 22 nt, Human
ugacgucaacugcaaaggccuu

SEQ ID NO: 28130 - RNA, 22 nt, Human
ugacuaaacgcaugaauagcuc

SEQ ID NO: 28131 - RNA, 22 nt, Human
ugacuauuacggccacgaauuu

SEQ ID NO: 28132 - RNA, 21 nt, Human
ugacugaaauagaauuuagcu

SEQ ID NO: 28133 - RNA, 22 nt, Human
ugacugaagaagccacauugga

SEQ ID NO: 28134 - RNA, 22 nt, Human
ugacugaaggacuagauugauu

SEQ ID NO: 28135 - RNA, 22 nt, Human
ugacugccaugagggugagggc

SEQ ID NO: 28136 - RNA, 22 nt, Human
ugacugccgauuguccuucucu

SEQ ID NO: 28137 - RNA, 22 nt, Human
ugacuggagaccucaguagggu

SEQ ID NO: 28138 - RNA, 22 nt, Human
ugacugugcaagcagagagcau

SEQ ID NO: 28139 - RNA, 22 nt, Human
ugacuuaagcuguucuuuagau

SEQ ID NO: 28140 - RNA, 22 nt, Human
ugacuucaagguucagcaccuu

SEQ ID NO: 28141 - RNA, 20 nt, Human
ugacuucuucaugcuguacu

SEQ ID NO: 28142 - RNA, 22 nt, Human
ugacuugucucuuugggagaca

SEQ ID NO: 28143 - RNA, 22 nt, Human
ugacuuuaagcuaucugauucu

SEQ ID NO: 28144 - RNA, 22 nt, Human
ugacuuuaauaggauuuugcau

SEQ ID NO: 28145 - RNA, 22 nt, Human
ugacuuuggacuagugauuuaa

SEQ ID NO: 28146 - RNA, 22 nt, Human
ugagaaaacaguuuguaauaau

SEQ ID NO: 28147 - RNA, 22 nt, Human
ugagaaaacucaaagacagauc

SEQ ID NO: 28148 - RNA, 22 nt, Human
ugagaaaagguugagaugauaa

SEQ ID NO: 28149 - RNA, 22 nt, Human
ugagaaagacagacauuccuaa

SEQ ID NO: 28150 - RNA, 22 nt, Human
ugagaaagccuuuagucccagg

SEQ ID NO: 28151 - RNA, 22 nt, Human
ugagaaagguauuucaugcacu

SEQ ID NO: 28152 - RNA, 22 nt, Human
ugagaaauccagaugugcaguu

SEQ ID NO: 28153 - RNA, 22 nt, Human
ugagaaauggcagcauuacugg

SEQ ID NO: 28154 - RNA, 19 nt, Human
ugagaaauuccacaggaug

SEQ ID NO: 28155 - RNA, 23 nt, Human
ugagaaauuuugauucaguagga

SEQ ID NO: 28156 - RNA, 22 nt, Human
ugagaacaaaguugaaaguuug

SEQ ID NO: 28157 - RNA, 22 nt, Human
ugagaacggauacuaagggcug

SEQ ID NO: 28158 - RNA, 22 nt, Human
ugagaagcagcuuacagguguc

SEQ ID NO: 28159 - RNA, 22 nt, Human
ugagaagcugcugacuuagccu

SEQ ID NO: 28160 - RNA, 19 nt, Human
ugagaaggcaguggggagc

SEQ ID NO: 28161 - RNA, 22 nt, Human
ugagaaggccugugugacaggg

SEQ ID NO: 28162 - RNA, 22 nt, Human
ugagaaggugaaaguguggaga

SEQ ID NO: 28163 - RNA, 22 nt, Human
ugagaauagcagacugguaacu

SEQ ID NO: 28164 - RNA, 22 nt, Human
ugagaaucauccagaggcuucu

SEQ ID NO: 28165 - RNA, 22 nt, Human
ugagaaugaggggguagaaggu

SEQ ID NO: 28166 - RNA, 22 nt, Human
ugagaaugccauaagagcuauu

SEQ ID NO: 28167 - RNA, 22 nt, Human
ugagaauucuacaauagaucaa

SEQ ID NO: 28168 - RNA, 22 nt, Human
ugagaauuuuuggcagaaacaa

SEQ ID NO: 28169 - RNA, 22 nt, Human
ugagacaaagcagcugacagaa

SEQ ID NO: 28170 - RNA, 22 nt, Human
ugagacaacauugggcaagucc

SEQ ID NO: 28171 - RNA, 22 nt, Human
ugagacaaccuaauuaaacacc

SEQ ID NO: 28172 - RNA, 22 nt, Human
ugagacaauaaggcugagaagc

SEQ ID NO: 28173 - RNA, 23 nt, Human
ugagacacucauucauggaguau

SEQ ID NO: 28174 - RNA, 22 nt, Human
ugagacagcccuucugcacagg

SEQ ID NO: 28175 - RNA, 22 nt, Human
ugagacagccucugcacucaug

SEQ ID NO: 28176 - RNA, 18 nt, Human
ugagacagcuaccacuug

SEQ ID NO: 28177 - RNA, 22 nt, Human
ugagacaguaucgccccaaggc

SEQ ID NO: 28178 - RNA, 22 nt, Human
ugagacagucaccaggcaggcc

SEQ ID NO: 28179 - RNA, 22 nt, Human
ugagacagucccaugaucugca

SEQ ID NO: 28180 - RNA, 22 nt, Human
ugagacaugugaauauuuguac

SEQ ID NO: 28181 - RNA, 22 nt, Human
ugagaccucuggguucugagcu

SEQ ID NO: 28182 - RNA, 22 nt, Human
ugagaccugccucugcacuagg

SEQ ID NO: 28183 - RNA, 22 nt, Human
ugagaccuuggggagcccuguu

SEQ ID NO: 28184 - RNA, 19 nt, Human
ugagacugggugcaguacu

SEQ ID NO: 28185 - RNA, 22 nt, Human
ugagagaugaaguuaguuguuc

SEQ ID NO: 28186 - RNA, 22 nt, Human
ugagagcagaggugggcagccu

SEQ ID NO: 28187 - RNA, 22 nt, Human
ugagagccaggaucugcucuau

SEQ ID NO: 28188 - RNA, 21 nt, Human
ugagagccuccaaccggcuac

SEQ ID NO: 28189 - RNA, 18 nt, Human
ugagagccugcuuguccc

SEQ ID NO: 28190 - RNA, 22 nt, Human
ugagagcugccacgugaccaug

SEQ ID NO: 28191 - RNA, 22 nt, Human
ugagaggaacaggcaguagguu

SEQ ID NO: 28192 - RNA, 22 nt, Human
ugagaggauauuuugggaggau

SEQ ID NO: 28193 - RNA, 22 nt, Human
ucuuuuagagcauuucugauuc

SEQ ID NO: 28194 - RNA, 22 nt, Human
ucuuuuagcucugcaaggaaag

SEQ ID NO: 28195 - RNA, 20 nt, Human
ucuuuuauuggcagauccug

SEQ ID NO: 28196 - RNA, 22 nt, Human
ucuuuucacagacaaauggaga

SEQ ID NO: 28197 - RNA, 22 nt, Human
ucuuuucaggaauggcucuagu

SEQ ID NO: 28198 - RNA, 21 nt, Human
ucuuuuguaacuauuucagcc

SEQ ID NO: 28199 - RNA, 22 nt, Human
ucuuuugugauucuucaguuac

SEQ ID NO: 28200 - RNA, 22 nt, Human
ucuuuuguggaugaagaaaugg

SEQ ID NO: 28201 - RNA, 22 nt, Human
ucuuuuucuucuguggaaggug

SEQ ID NO: 28202 - RNA, 22 nt, Human
ugaaaaggaguccuuguuuuca

SEQ ID NO: 28203 - RNA, 22 nt, Human
ugaaaaggguagaucccuaagu

SEQ ID NO: 28204 - RNA, 22 nt, Human
ugaaaauggccugaagaagcaa

SEQ ID NO: 28205 - RNA, 22 nt, Human
ugaaaauucucaggcucacccc

SEQ ID NO: 28206 - RNA, 22 nt, Human
ugaaaauuguuguacuugauaa

SEQ ID NO: 28207 - RNA, 22 nt, Human
ugaaacaaaauuaagauucucg

SEQ ID NO: 28208 - RNA, 19 nt, Human
ugaaacaaacuuaaaagga

SEQ ID NO: 28209 - RNA, 22 nt, Human
ugaaacaagggccaugggaaac

SEQ ID NO: 28210 - RNA, 21 nt, Human
ugaaacaaucagacagagucu

SEQ ID NO: 28211 - RNA, 21 nt, Human
ugaaacacucuuuccaugaga

SEQ ID NO: 28212 - RNA, 21 nt, Human
ugaaacagauggaaguauuug

SEQ ID NO: 28213 - RNA, 22 nt, Human
ugaaacaggaugcagaggagga

SEQ ID NO: 28214 - RNA, 22 nt, Human
ugaaacaggcaaaacugcagau

SEQ ID NO: 28215 - RNA, 22 nt, Human
ugaaacaguagucuguggguuu

SEQ ID NO: 28216 - RNA, 22 nt, Human
ugaaacagugcuucacucagcc

SEQ ID NO: 28217 - RNA, 22 nt, Human
ugaaacauugcacuguaugaau

SEQ ID NO: 28218 - RNA, 22 nt, Human
ugaaaccauucucagguacacu

SEQ ID NO: 28219 - RNA, 22 nt, Human
ugaaaccccagauuaccacaaa

SEQ ID NO: 28220 - RNA, 22 nt, Human
ugaaaccucaaccaaagguuac

SEQ ID NO: 28221 - RNA, 22 nt, Human
ugaaacuuauucaguuucuacc

SEQ ID NO: 28222 - RNA, 22 nt, Human
ugaaagaguuugacaugauucu

SEQ ID NO: 28223 - RNA, 22 nt, Human
ugaaagcacugauucucaacuc

SEQ ID NO: 28224 - RNA, 22 nt, Human
ugaaagcaggcgggcuacuuua

SEQ ID NO: 28225 - RNA, 22 nt, Human
ugaaagcagugauuucuccuuc

SEQ ID NO: 28226 - RNA, 22 nt, Human
ugaaagcagugccaugauuaug

SEQ ID NO: 28227 - RNA, 22 nt, Human
ugaaagcauuagucuaagguag

SEQ ID NO: 28228 - RNA, 22 nt, Human
ugaaaggaagagggcuacuccu

SEQ ID NO: 28229 - RNA, 22 nt, Human
ugaaagggguugaguuacagcu

SEQ ID NO: 28230 - RNA, 22 nt, Human
ugaaagguagcuggccucauag

SEQ ID NO: 28231 - RNA, 22 nt, Human
ugaaagucucuguuauagagaa

SEQ ID NO: 28232 - RNA, 22 nt, Human
ugaaaguuaggauguaguaauu

SEQ ID NO: 28233 - RNA, 22 nt, Human
ugaaaguugcacauaagagaau

SEQ ID NO: 28234 - RNA, 22 nt, Human
ugaaauaacuuuugggugaguu

SEQ ID NO: 28235 - RNA, 20 nt, Human
ugaaauaaggaguuguccuu

SEQ ID NO: 28236 - RNA, 22 nt, Human
ugaaauaauaucuggaucaauc

SEQ ID NO: 28237 - RNA, 20 nt, Human
ugaaauagauacucagagau

SEQ ID NO: 28238 - RNA, 22 nt, Human
ugaaauagucaaguauuugaac

SEQ ID NO: 28239 - RNA, 22 nt, Human
ugaaaucaaugucuucugucuc

SEQ ID NO: 28240 - RNA, 22 nt, Human
uucuggaauacuaaguuccuuu

SEQ ID NO: 28241 - RNA, 22 nt, Human
uucuggaauucuugcagccacu

SEQ ID NO: 28242 - RNA, 22 nt, Human
uucuggagagaaaccuuacaaa

SEQ ID NO: 28243 - RNA, 22 nt, Human
uucuggagaucugccuauggga

SEQ ID NO: 28244 - RNA, 20 nt, Human
uucuggaggcuacaagucug

SEQ ID NO: 28245 - RNA, 22 nt, Human
uucuggagguuauuaggagucu

SEQ ID NO: 28246 - RNA, 22 nt, Human
uucuggaguauuccuggcaccu

SEQ ID NO: 28247 - RNA, 22 nt, Human
uucuggagucccacagccaggg

SEQ ID NO: 28248 - RNA, 22 nt, Human
uucuggaguguauugggucugc

SEQ ID NO: 28249 - RNA, 22 nt, Human
uucuggaguuugaagaucaggu

SEQ ID NO: 28250 - RNA, 22 nt, Human
uucuggauagggguauggagcu

SEQ ID NO: 28251 - RNA, 22 nt, Human
uucuggauuauguguaagugaa

SEQ ID NO: 28252 - RNA, 20 nt, Human
uucuggcaaacagaguucuu

SEQ ID NO: 28253 - RNA, 22 nt, Human
uucuggcucauaugcuaagaag

SEQ ID NO: 28254 - RNA, 22 nt, Human
uucuggcuccagaugcuucugu

SEQ ID NO: 28255 - RNA, 23 nt, Human
uucuggcuccgagcuccaucuuc

SEQ ID NO: 28256 - RNA, 22 nt, Human
uucuggcucuccccugcugggu

SEQ ID NO: 28257 - RNA, 22 nt, Human
uucuggcugcagucccuguaau

SEQ ID NO: 28258 - RNA, 23 nt, Human
uucuggcuguggguggcgucucu

SEQ ID NO: 28259 - RNA, 22 nt, Human
uucuggcuucaucugacaagcc

SEQ ID NO: 28260 - RNA, 22 nt, Human
uucuggcuuugaccaaguucaa

SEQ ID NO: 28261 - RNA, 22 nt, Human
uucugggaacaaaguggagugg

SEQ ID NO: 28262 - RNA, 22 nt, Human
uucugggaggcuggcugucaua

SEQ ID NO: 28263 - RNA, 22 nt, Human
uucugggaugugaaugguuuaa

SEQ ID NO: 28264 - RNA, 22 nt, Human
uucugggcaccaccacagacuu

SEQ ID NO: 28265 - RNA, 20 nt, Human
uucugggcagccauguacuu

SEQ ID NO: 28266 - RNA, 22 nt, Human
uucugggcaggacuggggaccc

SEQ ID NO: 28267 - RNA, 22 nt, Human
uucugggcaguuggaaauuuca

SEQ ID NO: 28268 - RNA, 22 nt, Human
uucugggcccacuguagcaucc

SEQ ID NO: 28269 - RNA, 21 nt, Human
uucugggccggagaaggggcg

SEQ ID NO: 28270 - RNA, 22 nt, Human
uucugggccuccuaggacaggc

SEQ ID NO: 28271 - RNA, 22 nt, Human
uucugggcucucuuucugugug

SEQ ID NO: 28272 - RNA, 22 nt, Human
uucuggggccccaguguccucg

SEQ ID NO: 28273 - RNA, 22 nt, Human
uucugggugcaacucuguucug

SEQ ID NO: 28274 - RNA, 22 nt, Human
uucuggguuuacaucugacuuc

SEQ ID NO: 28275 - RNA, 22 nt, Human
uucugguaugggaaauuucaag

SEQ ID NO: 28276 - RNA, 22 nt, Human
uucuguaauucuguuaguuuca

SEQ ID NO: 28277 - RNA, 22 nt, Human
uucuguaggacuucugccaacu

SEQ ID NO: 28278 - RNA, 22 nt, Human
uucuguaugcucuggguccaga

SEQ ID NO: 28279 - RNA, 22 nt, Human
uucugucaaaugccaguagaga

SEQ ID NO: 28280 - RNA, 22 nt, Human
uucugucacagugcugguauca

SEQ ID NO: 28281 - RNA, 20 nt, Human
uucugucagauuauauggga

SEQ ID NO: 28282 - RNA, 22 nt, Human
uucugucauccuuucuagaugu

SEQ ID NO: 28283 - RNA, 22 nt, Human
uucuguccacugcuggggccuc

SEQ ID NO: 28284 - RNA, 22 nt, Human
uucugucucccugauguagagc

SEQ ID NO: 28285 - RNA, 22 nt, Human
uucugucucuguguuuacauua

SEQ ID NO: 28286 - RNA, 22 nt, Human
uucugucuggaaaaggacauag

SEQ ID NO: 28287 - RNA, 22 nt, Human
uucugugaggacuucucaagga

SEQ ID NO: 28288 - RNA, 22 nt, Human
uucugugcguaggcgaugcagu

SEQ ID NO: 28289 - RNA, 22 nt, Human
uucuguggcugggagccuggcu

SEQ ID NO: 28290 - RNA, 22 nt, Human
uucugugucuucuuguucugug

SEQ ID NO: 28291 - RNA, 22 nt, Human
uucugugugucucagcaagcug

SEQ ID NO: 28292 - RNA, 22 nt, Human
uucuguguucugugcaaugagc

SEQ ID NO: 28293 - RNA, 22 nt, Human
uucuguuaccuuugugaguuuc

SEQ ID NO: 28294 - RNA, 22 nt, Human
uucuguucccuaggaccugggg

SEQ ID NO: 28295 - RNA, 22 nt, Human
uucuguuuacucagaaauacaa

SEQ ID NO: 28296 - RNA, 22 nt, Human
uucuguuuccugccuucccauu

SEQ ID NO: 28297 - RNA, 22 nt, Human
uucuuaacuggaaaaugucaga

SEQ ID NO: 28298 - RNA, 22 nt, Human
uucuuaagaggguuaagugaag

SEQ ID NO: 28299 - RNA, 22 nt, Human
uucuuaaguauuucagagacug

SEQ ID NO: 28300 - RNA, 22 nt, Human
uucuuaagucaguaagaugcaa

SEQ ID NO: 28301 - RNA, 22 nt, Human
uucuuaaucccacaaaucuuca

SEQ ID NO: 28302 - RNA, 22 nt, Human
uggaagauaugcugauucucug

SEQ ID NO: 28303 - RNA, 23 nt, Human
uggaagcaguuccagcacaaaua

SEQ ID NO: 28304 - RNA, 22 nt, Human
uggaagccaggcccgcuccuaa

SEQ ID NO: 28305 - RNA, 22 nt, Human
uggaagcggacguuguggggug

SEQ ID NO: 28306 - RNA, 18 nt, Human
uggaagcuggugagcaga

SEQ ID NO: 28307 - RNA, 22 nt, Human
uggaagcuguggcauaacugag

SEQ ID NO: 28308 - RNA, 22 nt, Human
uggaaggaaagguagcagagaa

SEQ ID NO: 28309 - RNA, 22 nt, Human
uggaaggaagccaaggaagguu

SEQ ID NO: 28310 - RNA, 22 nt, Human
uggaaggagacugggaagugug

SEQ ID NO: 28311 - RNA, 22 nt, Human
uggaaggcagugauauuguuga

SEQ ID NO: 28312 - RNA, 22 nt, Human
uggaaggcuaggugcuaggccc

SEQ ID NO: 28313 - RNA, 22 nt, Human
uggaaggcugugauuacugugc

SEQ ID NO: 28314 - RNA, 22 nt, Human
uggaagggaaaguuuggggucc

SEQ ID NO: 28315 - RNA, 22 nt, Human
uggaaggggagcuggaaagggg

SEQ ID NO: 28316 - RNA, 22 nt, Human
uggaaggggccaggcgcggagu

SEQ ID NO: 28317 - RNA, 20 nt, Human
uggaaggucccagaggaauu

SEQ ID NO: 28318 - RNA, 22 nt, Human
uggaagugaugcugaggugacg

SEQ ID NO: 28319 - RNA, 22 nt, Human
uggaagugcucuucugaccaac

SEQ ID NO: 28320 - RNA, 22 nt, Human
uggaauaacucaccaaggucau

SEQ ID NO: 28321 - RNA, 20 nt, Human
uggaauaaguuaaguuguuu

SEQ ID NO: 28322 - RNA, 23 nt, Human
uggaaucagccuuuuuuccaagg

SEQ ID NO: 28323 - RNA, 18 nt, Human
uggaaucauugucaccau

SEQ ID NO: 28324 - RNA, 22 nt, Human
uggaaucuguauguauguauaa

SEQ ID NO: 28325 - RNA, 23 nt, Human
uggaaucuucgauauugauucag

SEQ ID NO: 28326 - RNA, 22 nt, Human
uggaaugaaaaguacuucagaa

SEQ ID NO: 28327 - RNA, 22 nt, Human
uggaaugaaggagauggccuuu

SEQ ID NO: 28328 - RNA, 22 nt, Human
uggaaugaauuuggcuuccucc

SEQ ID NO: 28329 - RNA, 22 nt, Human
uggaaugacagagagucugaau

SEQ ID NO: 28330 - RNA, 22 nt, Human
uggaaugaucugauguauuuua

SEQ ID NO: 28331 - RNA, 22 nt, Human
uggaaugccgggccaggcuccg

SEQ ID NO: 28332 - RNA, 22 nt, Human
uggaauguaaaccucagguggg

SEQ ID NO: 28333 - RNA, 21 nt, Human
uggaauguaccucccucucuu

SEQ ID NO: 28334 - RNA, 22 nt, Human
uggaauguauuaaguauugagu

SEQ ID NO: 28335 - RNA, 22 nt, Human
uggaaugucagcuacaagaggg

SEQ ID NO: 28336 - RNA, 22 nt, Human
uggaaugugguaucaguagaaa

SEQ ID NO: 28337 - RNA, 22 nt, Human
uggaauguugauaaacauaggc

SEQ ID NO: 28338 - RNA, 22 nt, Human
uggaauguuguguauaggucag

SEQ ID NO: 28339 - RNA, 23 nt, Human
uggaauguuucuuguacugaaug

SEQ ID NO: 28340 - RNA, 22 nt, Human
uggaauuaucugaagugauuug

SEQ ID NO: 28341 - RNA, 22 nt, Human
uggaauucccaaguaacuuuua

SEQ ID NO: 28342 - RNA, 22 nt, Human
uggaauuuuguauuagcuuuga

SEQ ID NO: 28343 - RNA, 22 nt, Human
uggacacaaagaucaaauauug

SEQ ID NO: 28344 - RNA, 22 nt, Human
uggacacacauguaugucagag

SEQ ID NO: 28345 - RNA, 22 nt, Human
uggacacaucacugcagccacu

SEQ ID NO: 28346 - RNA, 22 nt, Human
uggacagaaacccgagugaucu

SEQ ID NO: 28347 - RNA, 22 nt, Human
uggacagcaaacauggagagaa

SEQ ID NO: 28348 - RNA, 22 nt, Human
uggacaggauagugcaguacgc

SEQ ID NO: 28349 - RNA, 22 nt, Human
uggacaggcaagcaagacauac

SEQ ID NO: 28350 - RNA, 22 nt, Human
uggacagggcagagaccgaguc

SEQ ID NO: 28351 - RNA, 18 nt, Human
uggacaggguggagaaaa

SEQ ID NO: 28352 - RNA, 22 nt, Human
uggacaggugcacacagcagcc

SEQ ID NO: 28353 - RNA, 22 nt, Human
uggacagguuugggugccuguu

SEQ ID NO: 28354 - RNA, 22 nt, Human
uggacaguaggaagaguguggg

SEQ ID NO: 28355 - RNA, 23 nt, Human
uggacaguaggguagacagugcc

SEQ ID NO: 28356 - RNA, 21 nt, Human
uggacauuauggagagaguag

SEQ ID NO: 28357 - RNA, 21 nt, Human
uggacauuuacccuucaggga

SEQ ID NO: 28358 - RNA, 22 nt, Human
uggaccaacauucacuggcaua

SEQ ID NO: 28359 - RNA, 20 nt, Human
uggaccacccuccucuuugc

SEQ ID NO: 28360 - RNA, 22 nt, Human
uggacccaggcaggucuguccu

SEQ ID NO: 28361 - RNA, 22 nt, Human
uggaccccagacaagccagggu

SEQ ID NO: 28362 - RNA, 22 nt, Human
uggaccucacugucugcuggua

SEQ ID NO: 28363 - RNA, 19 nt, Human
uggaccugugcccauggcu

SEQ ID NO: 28364 - RNA, 23 nt, Human
uggacgccgacuuuggaggcgcu

SEQ ID NO: 28365 - RNA, 22 nt, Human
uggacucaaguccaaguucacg

SEQ ID NO: 28366 - RNA, 22 nt, Human
uggacucaccuugaguuagcca

SEQ ID NO: 28367 - RNA, 22 nt, Human
uggacucagaguugguggcagu

SEQ ID NO: 28368 - RNA, 22 nt, Human
uggacugaugcucccuauugaa

SEQ ID NO: 28369 - RNA, 22 nt, Human
uggagaaaagguugaauccauc

SEQ ID NO: 28370 - RNA, 22 nt, Human
uggagaauaggggccacuggug

SEQ ID NO: 28371 - RNA, 22 nt, Human
uggagaauggaauguugugcag

SEQ ID NO: 28372 - RNA, 23 nt, Human
uggagaauguguuuacuucgugu

SEQ ID NO: 28373 - RNA, 23 nt, Human
uggagaauucagucuuuguuuug

SEQ ID NO: 28374 - RNA, 23 nt, Human
uggagaauucuuccuuccacugu

SEQ ID NO: 28375 - RNA, 22 nt, Human
uggagaauuuugucaccagaca

SEQ ID NO: 28376 - RNA, 21 nt, Human
uggagacucugguucuuugug

SEQ ID NO: 28377 - RNA, 19 nt, Human
uggagacugagagugagca

SEQ ID NO: 28378 - RNA, 22 nt, Human
uggagagaacagugucugaaag

SEQ ID NO: 28379 - RNA, 22 nt, Human
uggagagcaagucgcagacaug

SEQ ID NO: 28380 - RNA, 22 nt, Human
uggagagcacaguuccugcuuc

SEQ ID NO: 28381 - RNA, 18 nt, Human
uggagagcagcagugggg

SEQ ID NO: 28382 - RNA, 22 nt, Human
uggagagcagggcuggaguuca

SEQ ID NO: 28383 - RNA, 22 nt, Human
uggagagcgugcuuagcacucu

SEQ ID NO: 28384 - RNA, 22 nt, Human
uggagagcuauuuggaccucca

SEQ ID NO: 28385 - RNA, 19 nt, Human
uggagaggaaaugcugcuc

SEQ ID NO: 28386 - RNA, 22 nt, Human
uggagaguggauaugggagcaa

SEQ ID NO: 28387 - RNA, 22 nt, Human
uggagaguuuagccuacuggaa

SEQ ID NO: 28388 - RNA, 22 nt, Human
uggagaugaauauguguaccug

SEQ ID NO: 28389 - RNA, 22 nt, Human
uggagcagcaucacuuugagcu

SEQ ID NO: 28390 - RNA, 22 nt, Human
uggagcagcucuagcgggcgcc

SEQ ID NO: 28391 - RNA, 16 nt, Human
uggagcaggcaggaug

SEQ ID NO: 28392 - RNA, 22 nt, Human
uggagcaggccggaaguggcuu

SEQ ID NO: 28393 - RNA, 22 nt, Human
uggagcagggcaucacugugcg

SEQ ID NO: 28394 - RNA, 22 nt, Human
ugcaggcaguaggccagcucca

SEQ ID NO: 28395 - RNA, 22 nt, Human
ugcaggcauaaccgauguugau

SEQ ID NO: 28396 - RNA, 22 nt, Human
ugcaggccaggguagggacuag

SEQ ID NO: 28397 - RNA, 22 nt, Human
ugcaggcccaguguagaggcuc

SEQ ID NO: 28398 - RNA, 22 nt, Human
ugcaggccuggacugauguggu

SEQ ID NO: 28399 - RNA, 21 nt, Human
ugcaggcuacuucugacucua

SEQ ID NO: 28400 - RNA, 23 nt, Human
ugcaggcuaggaagagagccuuc

SEQ ID NO: 28401 - RNA, 22 nt, Human
ugcaggcuauccuuugcugcaa

SEQ ID NO: 28402 - RNA, 22 nt, Human
ugcaggcuccaugaggacaggc

SEQ ID NO: 28403 - RNA, 22 nt, Human
ugcaggcucucugcugccagau

SEQ ID NO: 28404 - RNA, 22 nt, Human
ugcaggcuggggaggcagacuu

SEQ ID NO: 28405 - RNA, 22 nt, Human
ugcaggcugugucauuuaguga

SEQ ID NO: 28406 - RNA, 22 nt, Human
ugcaggcuuggaucacaucucc

SEQ ID NO: 28407 - RNA, 22 nt, Human
ugcagggaaaguguuggcagca

SEQ ID NO: 28408 - RNA, 22 nt, Human
ugcagggaacuuggacagcuag

SEQ ID NO: 28409 - RNA, 22 nt, Human
ugcagggaaucuguggcuggac

SEQ ID NO: 28410 - RNA, 22 nt, Human
ugcagggagggcccagcaaucu

SEQ ID NO: 28411 - RNA, 17 nt, Human
ugcauuguuggaaauuu

SEQ ID NO: 28412 - RNA, 22 nt, Human
ugcauuuaauagaugcucccug

SEQ ID NO: 28413 - RNA, 22 nt, Human
ugcauuuaccuggaggucauuu

SEQ ID NO: 28414 - RNA, 22 nt, Human
ugcauuuacgguacaacagcag

SEQ ID NO: 28415 - RNA, 22 nt, Human
ugcauuuaguuaugagaaaaac

SEQ ID NO: 28416 - RNA, 22 nt, Human
ugcauuuauggagcaaggcagu

SEQ ID NO: 28417 - RNA, 22 nt, Human
ugcauuuauggaguuaccucau

SEQ ID NO: 28418 - RNA, 22 nt, Human
ugcauuucuuuugaguauaugc

SEQ ID NO: 28419 - RNA, 22 nt, Human
ugcauuugcaauggguacacaa

SEQ ID NO: 28420 - RNA, 22 nt, Human
ugcauuuuacuuaccuguuagu

SEQ ID NO: 28421 - RNA, 22 nt, Human
ugcauuuuuaacaaggcuaauu

SEQ ID NO: 28422 - RNA, 22 nt, Human
ugcauuuuugagguuaacucaa

SEQ ID NO: 28423 - RNA, 22 nt, Human
ugcauuuuugauaacuguguac

SEQ ID NO: 28424 - RNA, 23 nt, Human
ugccaaaguuuaccuaacacugg

SEQ ID NO: 28425 - RNA, 22 nt, Human
ugccaaauugaauuacauaauu

SEQ ID NO: 28426 - RNA, 20 nt, Human
ugccaagcucuuuagaucga

SEQ ID NO: 28427 - RNA, 22 nt, Human
ugccaaguuucucucagggacu

SEQ ID NO: 28428 - RNA, 22 nt, Human
ugccacacagcuguaugaggga

SEQ ID NO: 28429 - RNA, 22 nt, Human
ugccacacauugucagguuagu

SEQ ID NO: 28430 - RNA, 22 nt, Human
ugccacacuccccugcugcagu

SEQ ID NO: 28431 - RNA, 22 nt, Human
ugccagagauuucacacugcua

SEQ ID NO: 28432 - RNA, 22 nt, Human
ugccagaugcaggagguaaggc

SEQ ID NO: 28433 - RNA, 22 nt, Human
ugccagauuguggcauggcacu

SEQ ID NO: 28434 - RNA, 22 nt, Human
ugccagcaagaauagacaguaa

SEQ ID NO: 28435 - RNA, 22 nt, Human
ugccagcacuucuggcugucug

SEQ ID NO: 28436 - RNA, 23 nt, Human
ugccagcagggaaugggaaggac

SEQ ID NO: 28437 - RNA, 22 nt, Human
ugccagcaguagcaguaggcca

SEQ ID NO: 28438 - RNA, 21 nt, Human
ugccagcauguaggcuaguug

SEQ ID NO: 28439 - RNA, 21 nt, Human
ugccagcauuaaacagucauu

SEQ ID NO: 28440 - RNA, 22 nt, Human
ugccagcucccuuuucuccucc

SEQ ID NO: 28441 - RNA, 21 nt, Human
ugccagcugcugcaucugucu

SEQ ID NO: 28442 - RNA, 22 nt, Human
ugccagcuucuuacggcugccu

SEQ ID NO: 28443 - RNA, 19 nt, Human
ugccaggaauacuccagaa

SEQ ID NO: 28444 - RNA, 22 nt, Human
ugccaggaggaggugggacaga

SEQ ID NO: 28445 - RNA, 22 nt, Human
ugccaggauggccagggggcca

SEQ ID NO: 28446 - RNA, 20 nt, Human
ugccaggcacggagugcaug

SEQ ID NO: 28447 - RNA, 22 nt, Human
ugccaggcacgugagaguggcc

SEQ ID NO: 28448 - RNA, 22 nt, Human
ugccaggccaaugaaggcaggg

SEQ ID NO: 28449 - RNA, 21 nt, Human
ugccaggccugagcugggguc

SEQ ID NO: 28450 - RNA, 22 nt, Human
ugccaggcgauugcuaucagca

SEQ ID NO: 28451 - RNA, 22 nt, Human
ugccaggcugucaauucaccca

SEQ ID NO: 28452 - RNA, 22 nt, Human
ugccaggcuuuggucaaaggcu

SEQ ID NO: 28453 - RNA, 20 nt, Human
ugccagggccagcagaggcu

SEQ ID NO: 28454 - RNA, 22 nt, Human
ugccagggcugcuacuggcuga

SEQ ID NO: 28455 - RNA, 22 nt, Human
ugccaggggaccuagggauguc

SEQ ID NO: 28456 - RNA, 22 nt, Human
ugccagggucagcugcagcucu

SEQ ID NO: 28457 - RNA, 22 nt, Human
ugccagggugucaggagagcua

SEQ ID NO: 28458 - RNA, 22 nt, Human
ugccagguacacaaguagccag

SEQ ID NO: 28459 - RNA, 22 nt, Human
ugccagucagugguuuaaaagu

SEQ ID NO: 28460 - RNA, 22 nt, Human
ugccaguugggaaaacagacau

SEQ ID NO: 28461 - RNA, 22 nt, Human
ugccaucacugaacuucugaaa

SEQ ID NO: 28462 - RNA, 22 nt, Human
ugccauccaacaguuccaucuu

SEQ ID NO: 28463 - RNA, 22 nt, Human
ugccauccuugaggaagggcaa

SEQ ID NO: 28464 - RNA, 22 nt, Human
ugccauguuuaaaguugaaggg

SEQ ID NO: 28465 - RNA, 22 nt, Human
ugccauuucucacauauguaug

SEQ ID NO: 28466 - RNA, 22 nt, Human
ugccauuugccccagcacuguc

SEQ ID NO: 28467 - RNA, 22 nt, Human
ugccauuuugagauguuaauga

SEQ ID NO: 28468 - RNA, 22 nt, Human
ugcccaaaccucuccuagcucu

SEQ ID NO: 28469 - RNA, 22 nt, Human
ugcccaagauccuacauccuga

SEQ ID NO: 28470 - RNA, 22 nt, Human
ugcccaagccgagcucucuguu

SEQ ID NO: 28471 - RNA, 22 nt, Human
ugcccaaggucaccuaguuagu

SEQ ID NO: 28472 - RNA, 22 nt, Human
ugcccaaguguuuggcugaguc

SEQ ID NO: 28473 - RNA, 23 nt, Human
ugcccacaaaaguaaagacauuu

SEQ ID NO: 28474 - RNA, 20 nt, Human
ugcccacaauucacaaugcc

SEQ ID NO: 28475 - RNA, 22 nt, Human
ugcccacagauaugugcagucu

SEQ ID NO: 28476 - RNA, 22 nt, Human
ugcccacagcaaagagguagga

SEQ ID NO: 28477 - RNA, 21 nt, Human
ugcccacagcaaaugcagagg

SEQ ID NO: 28478 - RNA, 22 nt, Human
ugcccacagcucagggcugcuc

SEQ ID NO: 28479 - RNA, 22 nt, Human
ugcccacauggugccauggcca

SEQ ID NO: 28480 - RNA, 22 nt, Human
ugcccacauucaaaaggugaug

SEQ ID NO: 28481 - RNA, 21 nt, Human
ugcccaccaagcuccacacug

SEQ ID NO: 28482 - RNA, 18 nt, Human
ugcccaccagaagaggga

SEQ ID NO: 28483 - RNA, 22 nt, Human
ugcccaccuaacaguguuugga

SEQ ID NO: 28484 - RNA, 22 nt, Human
ugcccacuucaaaaucuucauu

SEQ ID NO: 28485 - RNA, 22 nt, Human
ugcccagaauagaugggcugug

SEQ ID NO: 28486 - RNA, 22 nt, Human
ugcccagagccugagaggauua

SEQ ID NO: 28487 - RNA, 20 nt, Human
ugcccagcaagagugcaguu

SEQ ID NO: 28488 - RNA, 22 nt, Human
ugcccagcaauaaaccagaaga

SEQ ID NO: 28489 - RNA, 22 nt, Human
ugcccagccuaaacuuggcaag

SEQ ID NO: 28490 - RNA, 22 nt, Human
ugcccagcugucaaaguagaua

SEQ ID NO: 28491 - RNA, 22 nt, Human
ugcccaggcuccucgcagccuu

SEQ ID NO: 28492 - RNA, 22 nt, Human
ugcccaggguuucuaagagcag

SEQ ID NO: 28493 - RNA, 22 nt, Human
ugcccagguuugagugcccaag

SEQ ID NO: 28494 - RNA, 23 nt, Human
ugcccagugccuuugcccaugca

SEQ ID NO: 28495 - RNA, 23 nt, Human
ugcccagugggugcaggggguau

SEQ ID NO: 28496 - RNA, 22 nt, Human
ugcccauggaccaagcaagggg

SEQ ID NO: 28497 - RNA, 22 nt, Human
ugccccagacucugcucaccuc

SEQ ID NO: 28498 - RNA, 22 nt, Human
ugcccccagacagaauccaguu

SEQ ID NO: 28499 - RNA, 19 nt, Human
ugcccccagcaccucccug

SEQ ID NO: 28500 - RNA, 22 nt, Human
ugccccucgacgcaaugaaggg

SEQ ID NO: 28501 - RNA, 22 nt, Human
ugccccucuaggcccuguucua

SEQ ID NO: 28502 - RNA, 22 nt, Human
ugccccucuccugugauccaag

SEQ ID NO: 28503 - RNA, 22 nt, Human
ugccccucuugagaagcucagc

SEQ ID NO: 28504 - RNA, 22 nt, Human
ugccccugaccucaggcgaagg

SEQ ID NO: 28505 - RNA, 22 nt, Human
ugcccucaagcaacagagagga

SEQ ID NO: 28506 - RNA, 22 nt, Human
ugcccucagcagcagcuccugc

SEQ ID NO: 28507 - RNA, 22 nt, Human
ugcccucagccaccuccaaguu

SEQ ID NO: 28508 - RNA, 22 nt, Human
ugcccucaguuucacaugagug

SEQ ID NO: 28509 - RNA, 22 nt, Human
ugcccugaggcacuccauccau

SEQ ID NO: 28510 - RNA, 19 nt, Human
ugcccugcacgcuguccug

SEQ ID NO: 28511 - RNA, 22 nt, Human
ugcccugcccaucuacccuguc

SEQ ID NO: 28512 - RNA, 22 nt, Human
ugcccugccugagagacaguaa

SEQ ID NO: 28513 - RNA, 22 nt, Human
uuuacauggaauauugucuugu

SEQ ID NO: 28514 - RNA, 22 nt, Human
uuuacaugucaagacuggcagu

SEQ ID NO: 28515 - RNA, 22 nt, Human
uuuacauugcauuagguauuau

SEQ ID NO: 28516 - RNA, 22 nt, Human
uuuaccaaaguacucugaggca

SEQ ID NO: 28517 - RNA, 22 nt, Human
uuuaccaagcuuuaauuacaua

SEQ ID NO: 28518 - RNA, 22 nt, Human
uuuaccagaauugccaccagaa

SEQ ID NO: 28519 - RNA, 22 nt, Human
uuuaccauccucuuuuagaauu

SEQ ID NO: 28520 - RNA, 22 nt, Human
uggcacccugaaguuggucacu

SEQ ID NO: 28521 - RNA, 22 nt, Human
uggcaccuggugcaggguggcc

SEQ ID NO: 28522 - RNA, 22 nt, Human
uggcacguuggauugggaguuc

SEQ ID NO: 28523 - RNA, 22 nt, Human
uggcacugagcagccgcggcag

SEQ ID NO: 28524 - RNA, 21 nt, Human
uggcacugcuuagcagguucc

SEQ ID NO: 28525 - RNA, 22 nt, Human
uggcacuggcgcaggauggcgg

SEQ ID NO: 28526 - RNA, 22 nt, Human
uggcacuguggauuucacaagu

SEQ ID NO: 28527 - RNA, 22 nt, Human
uggcacuuaaugcaugugcuau

SEQ ID NO: 28528 - RNA, 22 nt, Human
uggcacuugcuucagaugaugu

SEQ ID NO: 28529 - RNA, 22 nt, Human
uggcagaaguacacaagcaugc

SEQ ID NO: 28530 - RNA, 22 nt, Human
uggcagaauuuuaaagacagau

SEQ ID NO: 28531 - RNA, 19 nt, Human
uggcagacacaccuucuuc

SEQ ID NO: 28532 - RNA, 22 nt, Human
uggcagacacugucgaagccua

SEQ ID NO: 28533 - RNA, 21 nt, Human
uggcagacuagaguauagaug

SEQ ID NO: 28534 - RNA, 22 nt, Human
uggcagagaauaaaucuugacu

SEQ ID NO: 28535 - RNA, 22 nt, Human
uggcagagacaaggccgggccu

SEQ ID NO: 28536 - RNA, 22 nt, Human
uggcagaggcucugugauguug

SEQ ID NO: 28537 - RNA, 22 nt, Human
uggcagaguuauggguauuuau

SEQ ID NO: 28538 - RNA, 22 nt, Human
uggcagauacccaggcaaaugg

SEQ ID NO: 28539 - RNA, 22 nt, Human
uggcagaugagccgcgcuccaa

SEQ ID NO: 28540 - RNA, 22 nt, Human
uggcagauguauaucacagcuu

SEQ ID NO: 28541 - RNA, 22 nt, Human
uggcagauguggcauagagcau

SEQ ID NO: 28542 - RNA, 22 nt, Human
uggcagaugugguuugagacag

SEQ ID NO: 28543 - RNA, 22 nt, Human
uggcagauuuaacauuggaacu

SEQ ID NO: 28544 - RNA, 22 nt, Human
uggcagcaaguucuugggaggu

SEQ ID NO: 28545 - RNA, 22 nt, Human
uggcagcacaagguggcccaug

SEQ ID NO: 28546 - RNA, 23 nt, Human
uggcagcagaucuuaaagugacc

SEQ ID NO: 28547 - RNA, 22 nt, Human
uggcagcagcuaacuuaggcag

SEQ ID NO: 28548 - RNA, 18 nt, Human
uggcagcaggaagccauu

SEQ ID NO: 28549 - RNA, 22 nt, Human
uggcagcagggccccuggagga

SEQ ID NO: 28550 - RNA, 22 nt, Human
uggcagcaguagccaccccagc

SEQ ID NO: 28551 - RNA, 22 nt, Human
uggcagcauaaagcauuuagcu

SEQ ID NO: 28552 - RNA, 19 nt, Human
uggcagcauugguaccuug

SEQ ID NO: 28553 - RNA, 22 nt, Human
uggcagcauuuuuuccagaaca

SEQ ID NO: 28554 - RNA, 22 nt, Human
uggcagccucagacaaggaccu

SEQ ID NO: 28555 - RNA, 22 nt, Human
uggcagccuggaaucucucagc

SEQ ID NO: 28556 - RNA, 18 nt, Human
uggcagcuagguaaagaa

SEQ ID NO: 28557 - RNA, 22 nt, Human
uggcagcuaucuuuaaugagau

SEQ ID NO: 28558 - RNA, 17 nt, Human
uggcagcugaaagcucu

SEQ ID NO: 28559 - RNA, 22 nt, Human
uggcagcugaauggcuggaugg

SEQ ID NO: 28560 - RNA, 22 nt, Human
uggcagcugaggggaggcuuug

SEQ ID NO: 28561 - RNA, 22 nt, Human
uggcagcugagugcacccccuc

SEQ ID NO: 28562 - RNA, 22 nt, Human
uggcagcugauuagauggugcc

SEQ ID NO: 28563 - RNA, 22 nt, Human
uggcagcuguuaauguuuuguu

SEQ ID NO: 28564 - RNA, 22 nt, Human
uggcaggaaaaagggccagagg

SEQ ID NO: 28565 - RNA, 23 nt, Human
uggcaggaaaugagaauguuccu

SEQ ID NO: 28566 - RNA, 22 nt, Human
uggcaggaaccaggaggcucuc

SEQ ID NO: 28567 - RNA, 22 nt, Human
uggcaggagacacauggcauag

SEQ ID NO: 28568 - RNA, 22 nt, Human
uggcaggagccugcggggaggu

SEQ ID NO: 28569 - RNA, 22 nt, Human
uggcaggcagagagcggccuuu

SEQ ID NO: 28570 - RNA, 22 nt, Human
uggcaggcagugugggagcugg

SEQ ID NO: 28571 - RNA, 22 nt, Human
uggcagggaauacagauguuua

SEQ ID NO: 28572 - RNA, 22 nt, Human
uggcagggccuaccccaauauc

SEQ ID NO: 28573 - RNA, 22 nt, Human
uggcagggccugcucaucaucc

SEQ ID NO: 28574 - RNA, 22 nt, Human
uggcagggugggcuucagcccc

SEQ ID NO: 28575 - RNA, 18 nt, Human
uggcagguagacucaggu

SEQ ID NO: 28576 - RNA, 22 nt, Human
uggcagguagucagaggcgaca

SEQ ID NO: 28577 - RNA, 22 nt, Human
uggcaggugaaguuguuaggga

SEQ ID NO: 28578 - RNA, 22 nt, Human
uggcaggugcacuuuugguuuc

SEQ ID NO: 28579 - RNA, 23 nt, Human
uggcaggugguuagauguuuugu

SEQ ID NO: 28580 - RNA, 22 nt, Human
uggcagguuaacuuacaacugu

SEQ ID NO: 28581 - RNA, 22 nt, Human
uggcagguuaugcgggccacau

SEQ ID NO: 28582 - RNA, 22 nt, Human
uggcaguagagcuggaacuuga

SEQ ID NO: 28583 - RNA, 22 nt, Human
uggcagucccucugguagcacc

SEQ ID NO: 28584 - RNA, 22 nt, Human
uggcaguccucuuccucgggcg

SEQ ID NO: 28585 - RNA, 22 nt, Human
uggcagucgaucauauucagca

SEQ ID NO: 28586 - RNA, 22 nt, Human
uggcagucggacuucuaucuca

SEQ ID NO: 28587 - RNA, 22 nt, Human
uggcagucuucaucaguucugg

SEQ ID NO: 28588 - RNA, 22 nt, Human
uggcaguggcacugcccccaua

SEQ ID NO: 28589 - RNA, 22 nt, Human
uggcaguggcgggacucagggc

SEQ ID NO: 28590 - RNA, 22 nt, Human
uggcaguguauagguggcuccu

SEQ ID NO: 28591 - RNA, 22 nt, Human
uggcagugucuugcuggggcag

SEQ ID NO: 28592 - RNA, 19 nt, Human
uggcaguguggcuuccaga

SEQ ID NO: 28593 - RNA, 22 nt, Human
uggcagugugggaggaagguac

SEQ ID NO: 28594 - RNA, 22 nt, Human
uggcaguucagguuggacucuu

SEQ ID NO: 28595 - RNA, 22 nt, Human
uggcaguucuaauugaccauuu

SEQ ID NO: 28596 - RNA, 22 nt, Human
uggcaguuggggaugaagugag

SEQ ID NO: 28597 - RNA, 22 nt, Human
uggcaguuucaugugauucaac

SEQ ID NO: 28598 - RNA, 23 nt, Human
uggcauagugaggggcacagaga

SEQ ID NO: 28599 - RNA, 22 nt, Human
uggcaucucaaacaggcagauu

SEQ ID NO: 28600 - RNA, 22 nt, Human
uggcaucuccgacagucuugau

SEQ ID NO: 28601 - RNA, 22 nt, Human
uggcaucuuugucccagaagcu

SEQ ID NO: 28602 - RNA, 22 nt, Human
uggcaugauaggaggugcagaa

SEQ ID NO: 28603 - RNA, 19 nt, Human
uggcaugaugauggauggg

SEQ ID NO: 28604 - RNA, 22 nt, Human
uggcaugcaagaggaggcuccc

SEQ ID NO: 28605 - RNA, 21 nt, Human
uggcauggagguagcagugug

SEQ ID NO: 28606 - RNA, 22 nt, Human
uggcauggcguggcaucgugug

SEQ ID NO: 28607 - RNA, 22 nt, Human
uggcauggcuacuggaauggcg

SEQ ID NO: 28608 - RNA, 22 nt, Human
uggcaugggcaaaccagggaaa

SEQ ID NO: 28609 - RNA, 22 nt, Human
uggcaugggccagggagagcug

SEQ ID NO: 28610 - RNA, 22 nt, Human
uggcauguaguaggugcuauaa

SEQ ID NO: 28611 - RNA, 22 nt, Human
uggcauguggcagcugguucag

SEQ ID NO: 28612 - RNA, 22 nt, Human
uggcauguggcuuugagucauc

SEQ ID NO: 28613 - RNA, 22 nt, Human
uggcauguguguguaggauaca

SEQ ID NO: 28614 - RNA, 22 nt, Human
uggcauguugagaggcaagauu

SEQ ID NO: 28615 - RNA, 22 nt, Human
uggcauguuuaauguacuguau

SEQ ID NO: 28616 - RNA, 22 nt, Human
uggcauguuucauggcugcaaa

SEQ ID NO: 28617 - RNA, 19 nt, Human
uggcauguuuggcuaagga

SEQ ID NO: 28618 - RNA, 23 nt, Human
uggcauuucuauacuggcaagug

SEQ ID NO: 28619 - RNA, 22 nt, Human
uggcauuugagcuggaaggaug

SEQ ID NO: 28620 - RNA, 19 nt, Human
uggcauuuggaggcaaccu

SEQ ID NO: 28621 - RNA, 22 nt, Human
uggcauuuguagccacuugccu

SEQ ID NO: 28622 - RNA, 22 nt, Human
uggcauuuucuccuuugaguuu

SEQ ID NO: 28623 - RNA, 22 nt, Human
uggccaaaguagaaaauaauag

SEQ ID NO: 28624 - RNA, 22 nt, Human
uggccaaauuugguguaacuug

SEQ ID NO: 28625 - RNA, 22 nt, Human
uggccaagaaugauaugugaag

SEQ ID NO: 28626 - RNA, 22 nt, Human
uggccacacugcccccacuggg

SEQ ID NO: 28627 - RNA, 22 nt, Human
uggccacauccuuuccuuguca

SEQ ID NO: 28628 - RNA, 22 nt, Human
ugcagggauuguuggcauccau

SEQ ID NO: 28629 - RNA, 22 nt, Human
uuuccaaagcugaguugagcaa

SEQ ID NO: 28630 - RNA, 22 nt, Human
uuuccaaauaaggucacacuca

SEQ ID NO: 28631 - RNA, 22 nt, Human
uuuccaagcugucuuggcccac

SEQ ID NO: 28632 - RNA, 22 nt, Human
ugcucaggcccugggccauccu

SEQ ID NO: 28633 - RNA, 22 nt, Human
ugcucagggacaauggagaggg

SEQ ID NO: 28634 - RNA, 22 nt, Human
ugcucaggucguucugccccuu

SEQ ID NO: 28635 - RNA, 21 nt, Human
ugcucaguaaaugcugaguga

SEQ ID NO: 28636 - RNA, 21 nt, Human
ugcucagucugucuccagcuu

SEQ ID NO: 28637 - RNA, 22 nt, Human
ugcucauuugcccauuagcauc

SEQ ID NO: 28638 - RNA, 22 nt, Human
ugcuccacccucacacucuucc

SEQ ID NO: 28639 - RNA, 22 nt, Human
ugcuccagaaaaacuugagacu

SEQ ID NO: 28640 - RNA, 22 nt, Human
ugcuccagaaccugaccaugcu

SEQ ID NO: 28641 - RNA, 22 nt, Human
ugcuccagcaugacccucaaug

SEQ ID NO: 28642 - RNA, 20 nt, Human
ugcuccaggaacacuggccg

SEQ ID NO: 28643 - RNA, 22 nt, Human
ugcuccaggagcaaccuuugag

SEQ ID NO: 28644 - RNA, 21 nt, Human
ugcuccaggagggggcagucc

SEQ ID NO: 28645 - RNA, 21 nt, Human
ugcuccagggcagcuuccagc

SEQ ID NO: 28646 - RNA, 22 nt, Human
ugcuccaucucucgugguucca

SEQ ID NO: 28647 - RNA, 22 nt, Human
ugcuccauucucuagccagugc

SEQ ID NO: 28648 - RNA, 22 nt, Human
ugcucccaaacgaccuacugug

SEQ ID NO: 28649 - RNA, 22 nt, Human
ugcucccagcuguaggaauguu

SEQ ID NO: 28650 - RNA, 22 nt, Human
ugcuccugagugugcaggagau

SEQ ID NO: 28651 - RNA, 22 nt, Human
ugcuccugauaucuaaugugua

SEQ ID NO: 28652 - RNA, 22 nt, Human
ugcuccugcuggcccucgugcc

SEQ ID NO: 28653 - RNA, 22 nt, Human
ugcuccuguuucaucagcuaua

SEQ ID NO: 28654 - RNA, 22 nt, Human
ugcuccuuccucauccugugca

SEQ ID NO: 28655 - RNA, 22 nt, Human
ugcucgagguccccaccggcuc

SEQ ID NO: 28656 - RNA, 22 nt, Human
ugcucgcgcuguuccagcagcu

SEQ ID NO: 28657 - RNA, 22 nt, Human
ugcucuagccuguaaaacauga

SEQ ID NO: 28658 - RNA, 22 nt, Human
ugcucuccggcuuccguggccu

SEQ ID NO: 28659 - RNA, 22 nt, Human
ugcucuggaaauaaaugauuua

SEQ ID NO: 28660 - RNA, 20 nt, Human
ugcucuggaaauggucugag

SEQ ID NO: 28661 - RNA, 22 nt, Human
ugcucuggaauaguccuaggca

SEQ ID NO: 28662 - RNA, 22 nt, Human
ugcucuggcuggagcaaugacu

SEQ ID NO: 28663 - RNA, 22 nt, Human
ugcucugggauucagcagccug

SEQ ID NO: 28664 - RNA, 22 nt, Human
ugcucugggcucaauggcagcu

SEQ ID NO: 28665 - RNA, 22 nt, Human
ugcucuggggcuccccaccaga

SEQ ID NO: 28666 - RNA, 20 nt, Human
ugcucuggggguggagagac

SEQ ID NO: 28667 - RNA, 21 nt, Human
ugcucugguagaaacucuuuc

SEQ ID NO: 28668 - RNA, 22 nt, Human
ugcucuguaacaaauugacaug

SEQ ID NO: 28669 - RNA, 22 nt, Human
ugcucuguaaggucagaaaagg

SEQ ID NO: 28670 - RNA, 20 nt, Human
ugcucugucuaaaacuuccc

SEQ ID NO: 28671 - RNA, 23 nt, Human
ugcucugugaauaguuggugacu

SEQ ID NO: 28672 - RNA, 22 nt, Human
ugcucugugguccaagauggcu

SEQ ID NO: 28673 - RNA, 17 nt, Human
ugcucuguggucuuuua

SEQ ID NO: 28674 - RNA, 22 nt, Human
ugcucuguucaguguaucuugu

SEQ ID NO: 28675 - RNA, 22 nt, Human
ugcucuuacauuaauucagcau

SEQ ID NO: 28676 - RNA, 22 nt, Human
ugcugaaaaguaaauaggccua

SEQ ID NO: 28677 - RNA, 22 nt, Human
ugcugaaauuagaacauugagg

SEQ ID NO: 28678 - RNA, 22 nt, Human
ugcugaaggcaggggagguggc

SEQ ID NO: 28679 - RNA, 22 nt, Human
ugcugaaguuacuagagacuau

SEQ ID NO: 28680 - RNA, 22 nt, Human
ugcugaaguucuuccccuaaug

SEQ ID NO: 28681 - RNA, 22 nt, Human
ugcugaauaaagauauauuuuc

SEQ ID NO: 28682 - RNA, 22 nt, Human
ugcugaauaaauaaagucuauu

SEQ ID NO: 28683 - RNA, 22 nt, Human
ugcugaauauagagcaagaagu

SEQ ID NO: 28684 - RNA, 22 nt, Human
ugcugaaugcugcaugccguau

SEQ ID NO: 28685 - RNA, 22 nt, Human
ugcugaauucuaccauccauuu

SEQ ID NO: 28686 - RNA, 19 nt, Human
ugcugacacuagaugugca

SEQ ID NO: 28687 - RNA, 22 nt, Human
ugcugagaagagggccgaccca

SEQ ID NO: 28688 - RNA, 22 nt, Human
ugcugagauagcugacuaggca

SEQ ID NO: 28689 - RNA, 22 nt, Human
ugcugagaucugccaguagaug

SEQ ID NO: 28690 - RNA, 22 nt, Human
ugcugagaugaauagggcuguc

SEQ ID NO: 28691 - RNA, 22 nt, Human
ugcugagcgcauccggcggccg

SEQ ID NO: 28692 - RNA, 22 nt, Human
ugcugaggaauaauuguuccug

SEQ ID NO: 28693 - RNA, 22 nt, Human
ugcugaggaauuugguuuaugu

SEQ ID NO: 28694 - RNA, 22 nt, Human
ugcugaggcagaugucugugac

SEQ ID NO: 28695 - RNA, 22 nt, Human
ugcugagggcuguuaaggaagc

SEQ ID NO: 28696 - RNA, 22 nt, Human
ugcugaguauuuguuugaauaa

SEQ ID NO: 28697 - RNA, 22 nt, Human
ugcugagucugaaacagcucag

SEQ ID NO: 28698 - RNA, 22 nt, Human
ugcugaugcuguucuguuagga

SEQ ID NO: 28699 - RNA, 22 nt, Human
ugcugcacaauuggaaaguauc

SEQ ID NO: 28700 - RNA, 22 nt, Human
ugcugcacuuauggcucugagg

SEQ ID NO: 28701 - RNA, 22 nt, Human
ugcugcagaaauucugugagga

SEQ ID NO: 28702 - RNA, 22 nt, Human
ugcugcaggcaauagaaaaccu

SEQ ID NO: 28703 - RNA, 22 nt, Human
ugcugcagggaagucggggggu

SEQ ID NO: 28704 - RNA, 22 nt, Human
ugcugcagggccuucccugcau

SEQ ID NO: 28705 - RNA, 22 nt, Human
ugcugcaguauauauuucuugg

SEQ ID NO: 28706 - RNA, 22 nt, Human
ugcugcauagcagcuccugaaa

SEQ ID NO: 28707 - RNA, 22 nt, Human
ugcugcauucaggagcacaguu

SEQ ID NO: 28708 - RNA, 22 nt, Human
ugcugccacaaauucagcugcc

SEQ ID NO: 28709 - RNA, 22 nt, Human
ugcugccaccccucaccagagc

SEQ ID NO: 28710 - RNA, 22 nt, Human
ugcugccacugguagucucauu

SEQ ID NO: 28711 - RNA, 18 nt, Human
ugcugcccaacucucccc

SEQ ID NO: 28712 - RNA, 22 nt, Human
ugcugcccacuguauuucucca

SEQ ID NO: 28713 - RNA, 22 nt, Human
ugcugcccguaccugugcacuu

SEQ ID NO: 28714 - RNA, 23 nt, Human
ugcugcccugccuucagcucucc

SEQ ID NO: 28715 - RNA, 22 nt, Human
ugcugccucaacugucaggaac

SEQ ID NO: 28716 - RNA, 22 nt, Human
ugcugccucagcuuccugggcu

SEQ ID NO: 28717 - RNA, 22 nt, Human
ugcugccugcuacgagggaaga

SEQ ID NO: 28718 - RNA, 22 nt, Human
ugcugccuuuguggggucacug

SEQ ID NO: 28719 - RNA, 22 nt, Human
ugcugcucacacacagugaaug

SEQ ID NO: 28720 - RNA, 22 nt, Human
ugcugcucucagccaccaggaa

SEQ ID NO: 28721 - RNA, 22 nt, Human
ugcugcugacauuuggggcuug

SEQ ID NO: 28722 - RNA, 22 nt, Human
ugcugcugaggcuaaaguauag

SEQ ID NO: 28723 - RNA, 22 nt, Human
ugcugcugauggcaccuaggca

SEQ ID NO: 28724 - RNA, 20 nt, Human
ugcugcugccuccgccucug

SEQ ID NO: 28725 - RNA, 22 nt, Human
ugcugcugcuucuguacagccu

SEQ ID NO: 28726 - RNA, 22 nt, Human
ugcugcuggguuugacagucac

SEQ ID NO: 28727 - RNA, 22 nt, Human
ugcugcuguaucaugccuucau

SEQ ID NO: 28728 - RNA, 19 nt, Human
ugcugcuguccuugcaggg

SEQ ID NO: 28729 - RNA, 22 nt, Human
ugcugcuguugacggcugucca

SEQ ID NO: 28730 - RNA, 19 nt, Human
ugcugcuuccagcucacuc

SEQ ID NO: 28731 - RNA, 22 nt, Human
ugcugcuuccugguagauagga

SEQ ID NO: 28732 - RNA, 22 nt, Human
ugcugcuuggaaauggggcuga

SEQ ID NO: 28733 - RNA, 22 nt, Human
ugcugcuuguuuuguaaauaaa

SEQ ID NO: 28734 - RNA, 20 nt, Human
ugcuggaaaaagucacucau

SEQ ID NO: 28735 - RNA, 22 nt, Human
ugcuggaacucagugaaucauu

SEQ ID NO: 28736 - RNA, 22 nt, Human
ugcuggaauuugccuucuggaa

SEQ ID NO: 28737 - RNA, 23 nt, Human
ugcuggaauuuguacccuggcag

SEQ ID NO: 28738 - RNA, 22 nt, Human
ugcuggagaugaaagggcccug

SEQ ID NO: 28739 - RNA, 22 nt, Human
ugcuggagcccaggcggccuuu

SEQ ID NO: 28740 - RNA, 22 nt, Human
ugcuggagcggaggugagccag

SEQ ID NO: 28741 - RNA, 22 nt, Human
ugcuggaggccgagaagcagca

SEQ ID NO: 28742 - RNA, 22 nt, Human
ugcuggaggggguaccacucaa

SEQ ID NO: 28743 - RNA, 22 nt, Human
ugcuggagucucuugacccugg

SEQ ID NO: 28744 - RNA, 22 nt, Human
ugcuggagugagugguuucuua

SEQ ID NO: 28745 - RNA, 22 nt, Human
ugcuggagugcaguggcuuaac

SEQ ID NO: 28746 - RNA, 18 nt, Human
ugcuggcaacuacuauug

SEQ ID NO: 28747 - RNA, 22 nt, Human
ugcuggcacgaaagggugucca

SEQ ID NO: 28748 - RNA, 22 nt, Human
ugcuggcacgugacugggaagu

SEQ ID NO: 28749 - RNA, 22 nt, Human
ugcuggcaggcaccuccugggg

SEQ ID NO: 28750 - RNA, 22 nt, Human
ugcuggcaucuuaauguucugu

SEQ ID NO: 28751 - RNA, 22 nt, Human
ugcuggccaagcagaggucaau

SEQ ID NO: 28752 - RNA, 22 nt, Human
ugcuggccggccaggugcugag

SEQ ID NO: 28753 - RNA, 21 nt, Human
ugcuggccucaagggugacuu

SEQ ID NO: 28754 - RNA, 22 nt, Human
ugcuggcuaauggaaaccagau

SEQ ID NO: 28755 - RNA, 22 nt, Human
ugcuggcuacugauggcaggcc

SEQ ID NO: 28756 - RNA, 22 nt, Human
ugcuggcuccaaccuggcaucu

SEQ ID NO: 28757 - RNA, 22 nt, Human
ugcuggcucugggccaagcagg

SEQ ID NO: 28758 - RNA, 21 nt, Human
ugcuggcugaaaggcacagag

SEQ ID NO: 28759 - RNA, 22 nt, Human
ugcuggcugaggccugagcggg

SEQ ID NO: 28760 - RNA, 22 nt, Human
ugcuggcuguucuagggaggcc

SEQ ID NO: 28761 - RNA, 22 nt, Human
ugcuggcuuuaagguuaaagug

SEQ ID NO: 28762 - RNA, 23 nt, Human
ugcuggcuuuuaucuggucccua

SEQ ID NO: 28763 - RNA, 22 nt, Human
ugggaagaugaggugccauggg

SEQ ID NO: 28764 - RNA, 22 nt, Human
ugggaagauggagugacaggca

SEQ ID NO: 28765 - RNA, 22 nt, Human
ugggaagcauuaaugauagggg

SEQ ID NO: 28766 - RNA, 22 nt, Human
ugggaagcugcauuuuaacaag

SEQ ID NO: 28767 - RNA, 22 nt, Human
ugggaaggaacugccuuuagcu

SEQ ID NO: 28768 - RNA, 22 nt, Human
ugggaaggcguggaaguagaag

SEQ ID NO: 28769 - RNA, 22 nt, Human
ugggaagggagaguguccugga

SEQ ID NO: 28770 - RNA, 22 nt, Human
ugggaagggccugcccuuccuc

SEQ ID NO: 28771 - RNA, 22 nt, Human
ugggaaggggagcuggaaagga

SEQ ID NO: 28772 - RNA, 22 nt, Human
ugggaagggucaguuucuucau

SEQ ID NO: 28773 - RNA, 22 nt, Human
ugggaagguacacgggaaagag

SEQ ID NO: 28774 - RNA, 22 nt, Human
ugggaagguguagaaagaacaa

SEQ ID NO: 28775 - RNA, 22 nt, Human
ugggaaguuaggaugccaggga

SEQ ID NO: 28776 - RNA, 22 nt, Human
ugggaauacaaguuauucaccu

SEQ ID NO: 28777 - RNA, 22 nt, Human
ugggaaugcaaggaaagcuguu

SEQ ID NO: 28778 - RNA, 22 nt, Human
ugggaaugcugagcccauguau

SEQ ID NO: 28779 - RNA, 22 nt, Human
ugggaaugggccuagaaggcug

SEQ ID NO: 28780 - RNA, 22 nt, Human
ugggaaugugagcauucauuca

SEQ ID NO: 28781 - RNA, 22 nt, Human
ugggacacaaaccagaccagga

SEQ ID NO: 28782 - RNA, 22 nt, Human
ugggacacagaaaaggcagguu

SEQ ID NO: 28783 - RNA, 22 nt, Human
ugggacaggaggccucuggaga

SEQ ID NO: 28784 - RNA, 22 nt, Human
ugggacagugugccuugcuccu

SEQ ID NO: 28785 - RNA, 22 nt, Human
ugggacaguuguccuccacucu

SEQ ID NO: 28786 - RNA, 22 nt, Human
ugggaccacacuuugaacaaca

SEQ ID NO: 28787 - RNA, 21 nt, Human
ugggaccuauuucaacuggau

SEQ ID NO: 28788 - RNA, 22 nt, Human
ugggaccucucuugagagagca

SEQ ID NO: 28789 - RNA, 22 nt, Human
ugggaccugcuccuggaaugag

SEQ ID NO: 28790 - RNA, 22 nt, Human
ugggaccugcucuuggaaugag

SEQ ID NO: 28791 - RNA, 22 nt, Human
ugggacugugaccuccagggua

SEQ ID NO: 28792 - RNA, 22 nt, Human
ugggagaaacugucucucccac

SEQ ID NO: 28793 - RNA, 22 nt, Human
ugggagaagcagcagccaagug

SEQ ID NO: 28794 - RNA, 21 nt, Human
ugggagaccgccuuccuggga

SEQ ID NO: 28795 - RNA, 22 nt, Human
ugggagagaauucuggugacug

SEQ ID NO: 28796 - RNA, 21 nt, Human
ugggagagcguugcuguccuc

SEQ ID NO: 28797 - RNA, 22 nt, Human
ugggagagcuucaugccuucag

SEQ ID NO: 28798 - RNA, 21 nt, Human
ugggagagggcucagcuaccc

SEQ ID NO: 28799 - RNA, 22 nt, Human
ugggagaguaaccaauuccuuc

SEQ ID NO: 28800 - RNA, 22 nt, Human
ugggagagugcucaaugugcaa

SEQ ID NO: 28801 - RNA, 22 nt, Human
ugggagcagcagggagaugcgg

SEQ ID NO: 28802 - RNA, 22 nt, Human
ugggagcagcuuugcgagggag

SEQ ID NO: 28803 - RNA, 22 nt, Human
ugggagcaggugugcuagggaa

SEQ ID NO: 28804 - RNA, 22 nt, Human
ugggagcucacaggccuggcuc

SEQ ID NO: 28805 - RNA, 22 nt, Human
ugggagcucagaaagggagguc

SEQ ID NO: 28806 - RNA, 22 nt, Human
ugggagcucugagccugcuaug

SEQ ID NO: 28807 - RNA, 22 nt, Human
ugggagcucugagccugcugug

SEQ ID NO: 28808 - RNA, 22 nt, Human
ugggaggagcccucugggaagg

SEQ ID NO: 28809 - RNA, 22 nt, Human
ugggaggaucgcuugagcccag

SEQ ID NO: 28810 - RNA, 22 nt, Human
ugggaggcagguaggugaugau

SEQ ID NO: 28811 - RNA, 22 nt, Human
ugggaggucucuugcggccuag

SEQ ID NO: 28812 - RNA, 20 nt, Human
ugggaguacaaucaugagca

SEQ ID NO: 28813 - RNA, 22 nt, Human
ugggagugauacaguauggaau

SEQ ID NO: 28814 - RNA, 21 nt, Human
ugggauagaaauauggcugcu

SEQ ID NO: 28815 - RNA, 22 nt, Human
ugggauagauugauggauagag

SEQ ID NO: 28816 - RNA, 22 nt, Human
ugggauagggcuauugcucaca

SEQ ID NO: 28817 - RNA, 22 nt, Human
ugggauaguggccaggaccccc

SEQ ID NO: 28818 - RNA, 20 nt, Human
ugggaucgaaucaagucugu

SEQ ID NO: 28819 - RNA, 22 nt, Human
ugggaucugcaguuuaacaaaa

SEQ ID NO: 28820 - RNA, 22 nt, Human
ugggaugagaagugcgaggguu

SEQ ID NO: 28821 - RNA, 22 nt, Human
ugggaugccggcaggaggcaau

SEQ ID NO: 28822 - RNA, 23 nt, Human
ugggauggauucaccagugugcu

SEQ ID NO: 28823 - RNA, 22 nt, Human
ugggcaaacugucaaccauguc

SEQ ID NO: 28824 - RNA, 22 nt, Human
ugggcaaaggcuguaacccauc

SEQ ID NO: 28825 - RNA, 22 nt, Human
ugggcaagcaggagggccucag

SEQ ID NO: 28826 - RNA, 22 nt, Human
ugggcaaggcuggagccugcag

SEQ ID NO: 28827 - RNA, 22 nt, Human
ugggcaagggacaggccuggcu

SEQ ID NO: 28828 - RNA, 22 nt, Human
ugggcaaguaucggacucugag

SEQ ID NO: 28829 - RNA, 18 nt, Human
ugggcacaaugaacagca

SEQ ID NO: 28830 - RNA, 22 nt, Human
ugggcacacugaaucugcuauu

SEQ ID NO: 28831 - RNA, 22 nt, Human
ugggcacagaauagauggccca

SEQ ID NO: 28832 - RNA, 21 nt, Human
ugggcaccaaaaccuaggagu

SEQ ID NO: 28833 - RNA, 20 nt, Human
ugggcaccagaugggaugcc

SEQ ID NO: 28834 - RNA, 22 nt, Human
ugggcacuccuggggacagcug

SEQ ID NO: 28835 - RNA, 22 nt, Human
ugggcagaaugugggauccaga

SEQ ID NO: 28836 - RNA, 22 nt, Human
ugggcagacuaaggucaaagcu

SEQ ID NO: 28837 - RNA, 22 nt, Human
ugggcagaggcucugaagucca

SEQ ID NO: 28838 - RNA, 22 nt, Human
ugggcagaguagcucagaagaa

SEQ ID NO: 28839 - RNA, 22 nt, Human
ugggcagagucguggggaauag

SEQ ID NO: 28840 - RNA, 16 nt, Human
ugggcagaugagaaga

SEQ ID NO: 28841 - RNA, 21 nt, Human
ugggcagauggcaguguggcu

SEQ ID NO: 28842 - RNA, 22 nt, Human
ugggcagauuaaugcaguggcu

SEQ ID NO: 28843 - RNA, 22 nt, Human
ugggcagcauccuccacaguca

SEQ ID NO: 28844 - RNA, 22 nt, Human
ugggcagcuuccacuuaguuag

SEQ ID NO: 28845 - RNA, 22 nt, Human
ugggcaggcaagugaauaccuu

SEQ ID NO: 28846 - RNA, 22 nt, Human
ugggcaggggcccugcuuccgu

SEQ ID NO: 28847 - RNA, 22 nt, Human
uuuguaaaauuagggaauucaa

SEQ ID NO: 28848 - RNA, 22 nt, Human
uuuguaaagucuguucugaguu

SEQ ID NO: 28849 - RNA, 22 nt, Human
uuuguaacaucccaacaaauuu

SEQ ID NO: 28850 - RNA, 22 nt, Human
uuuguaacugagugcucagagc

SEQ ID NO: 28851 - RNA, 22 nt, Human
uuuguaagagcauauguaaagg

SEQ ID NO: 28852 - RNA, 22 nt, Human
uuuguaagcaaguuaacauuuu

SEQ ID NO: 28853 - RNA, 22 nt, Human
uuuguaagcaguguuuuuacag

SEQ ID NO: 28854 - RNA, 22 nt, Human
uuuguaaugauaauguuaaauu

SEQ ID NO: 28855 - RNA, 17 nt, Human
uuuguacaacauuuuaa

SEQ ID NO: 28856 - RNA, 22 nt, Human
uuuguacagugauguuguaugc

SEQ ID NO: 28857 - RNA, 22 nt, Human
uuuguacauauauaaaaucugu

SEQ ID NO: 28858 - RNA, 22 nt, Human
uuuguacauguaagauugcauc

SEQ ID NO: 28859 - RNA, 22 nt, Human
uuuguacuaugguuuuucacua

SEQ ID NO: 28860 - RNA, 22 nt, Human
uuuguacucucagaauucagaa

SEQ ID NO: 28861 - RNA, 22 nt, Human
uuuguacugaccaauuauuuga

SEQ ID NO: 28862 - RNA, 22 nt, Human
uuuguacuggaagaacaugcaa

SEQ ID NO: 28863 - RNA, 22 nt, Human
uuuguagacgucagaaguuacu

SEQ ID NO: 28864 - RNA, 22 nt, Human
uuuguagagaauguuaagcacu

SEQ ID NO: 28865 - RNA, 22 nt, Human
uuuguagauagaaaaaugauua

SEQ ID NO: 28866 - RNA, 22 nt, Human
uuuguauaagaacauucuagca

SEQ ID NO: 28867 - RNA, 22 nt, Human
uuuguaugugauaagacuauuc

SEQ ID NO: 28868 - RNA, 22 nt, Human
uuugucaaaucaaaccacauuc

SEQ ID NO: 28869 - RNA, 22 nt, Human
uuugucaugcuuuccuuaugga

SEQ ID NO: 28870 - RNA, 22 nt, Human
uuuguccuugaaucaauucaca

SEQ ID NO: 28871 - RNA, 22 nt, Human
uuugucuaauugcaaggcaagu

SEQ ID NO: 28872 - RNA, 19 nt, Human
uuugucucugaauaauauu

SEQ ID NO: 28873 - RNA, 22 nt, Human
uuugucugccuugcuggacugu

SEQ ID NO: 28874 - RNA, 20 nt, Human
uuugucuguuaaguguuucu

SEQ ID NO: 28875 - RNA, 22 nt, Human
uuugucuucccccuuuaaucag

SEQ ID NO: 28876 - RNA, 22 nt, Human
uuugucuuguaaguuaaauuca

SEQ ID NO: 28877 - RNA, 19 nt, Human
uuugugaagaaaaugaugc

SEQ ID NO: 28878 - RNA, 22 nt, Human
uuugugaauucuuggaagauug

SEQ ID NO: 28879 - RNA, 22 nt, Human
ugcuggcuuuuccuucaggcag

SEQ ID NO: 28880 - RNA, 22 nt, Human
ugcugggauauagcuucuaggg

SEQ ID NO: 28881 - RNA, 22 nt, Human
ugcugggcacugucuagguacu

SEQ ID NO: 28882 - RNA, 22 nt, Human
ugcugggcagugugcccucgag

SEQ ID NO: 28883 - RNA, 20 nt, Human
ugcugggcaugcaguggaaa

SEQ ID NO: 28884 - RNA, 22 nt, Human
ugcugggccaaagcaggguuuu

SEQ ID NO: 28885 - RNA, 22 nt, Human
ugcugggcccagggagccucug

SEQ ID NO: 28886 - RNA, 22 nt, Human
ugcugggccucuucccuggaua

SEQ ID NO: 28887 - RNA, 22 nt, Human
ugcugggccuuuaccuccaggg

SEQ ID NO: 28888 - RNA, 22 nt, Human
ugcugggcugcacccccagagu

SEQ ID NO: 28889 - RNA, 20 nt, Human
ugcuggggacauacagggug

SEQ ID NO: 28890 - RNA, 22 nt, Human
ugcuggggauccguaccaaccc

SEQ ID NO: 28891 - RNA, 23 nt, Human
ugcugggguaguuuguggcacag

SEQ ID NO: 28892 - RNA, 23 nt, Human
ugcuggguaucagaaucacugag

SEQ ID NO: 28893 - RNA, 22 nt, Human
ugcugggucaggcaucugcaga

SEQ ID NO: 28894 - RNA, 22 nt, Human
ugcugggucagugagagcaggg

SEQ ID NO: 28895 - RNA, 21 nt, Human
ugcuggugagcucauguggcu

SEQ ID NO: 28896 - RNA, 22 nt, Human
ugcuggugagguccuugcugga

SEQ ID NO: 28897 - RNA, 20 nt, Human
ugcuguaagauuagagagcu

SEQ ID NO: 28898 - RNA, 22 nt, Human
ugcuguagggagaaagaguuga

SEQ ID NO: 28899 - RNA, 21 nt, Human
ugcuguagguuucguggcacu

SEQ ID NO: 28900 - RNA, 22 nt, Human
ugcuguagucaaagcaaagcug

SEQ ID NO: 28901 - RNA, 23 nt, Human
ugcuguagucucuacagcugguc

SEQ ID NO: 28902 - RNA, 22 nt, Human
ugcuguauuuauggccacugaa

SEQ ID NO: 28903 - RNA, 22 nt, Human
ugcugucccuaagucucuucaa

SEQ ID NO: 28904 - RNA, 22 nt, Human
ugcugucuuuuucccuuccuaa

SEQ ID NO: 28905 - RNA, 22 nt, Human
ugcugugacccaaaaaagaccu

SEQ ID NO: 28906 - RNA, 22 nt, Human
ugcugugagguugagaaggaag

SEQ ID NO: 28907 - RNA, 22 nt, Human
ugcugugcaucauaguguuugg

SEQ ID NO: 28908 - RNA, 23 nt, Human
ugcugugccuuugucugccucca

SEQ ID NO: 28909 - RNA, 23 nt, Human
ugcuguggauggcagguccuugc

SEQ ID NO: 28910 - RNA, 22 nt, Human
ugcuguggauucagagaugaaa

SEQ ID NO: 28911 - RNA, 22 nt, Human
ugcugugucuuucugugaaaag

SEQ ID NO: 28912 - RNA, 22 nt, Human
ugcuguguucaccaauaugugu

SEQ ID NO: 28913 - RNA, 22 nt, Human
ugcuguuaguaaggaacaugac

SEQ ID NO: 28914 - RNA, 22 nt, Human
ugcuuaaaaagcuccaucaaua

SEQ ID NO: 28915 - RNA, 22 nt, Human
ugcuuaaacccugaucaugugu

SEQ ID NO: 28916 - RNA, 22 nt, Human
ugcuuaaagcugcucaguugua

SEQ ID NO: 28917 - RNA, 22 nt, Human
ugcuuaaauuucagcagcuuaa

SEQ ID NO: 28918 - RNA, 22 nt, Human
ugcuuauauuuauugggcuuag

SEQ ID NO: 28919 - RNA, 22 nt, Human
ugcuuauuaacauguauaucuc

SEQ ID NO: 28920 - RNA, 22 nt, Human
ugcuuauugcuuucaagacugu

SEQ ID NO: 28921 - RNA, 22 nt, Human
ugcuuauuuagguagauauuaa

SEQ ID NO: 28922 - RNA, 22 nt, Human
ugcuuauuuauagucaauagag

SEQ ID NO: 28923 - RNA, 22 nt, Human
ugcuucagaggaaaggcaaaag

SEQ ID NO: 28924 - RNA, 22 nt, Human
ugcuucaggaagaaacgccagg

SEQ ID NO: 28925 - RNA, 17 nt, Human
ugcuucaucccgauccu

SEQ ID NO: 28926 - RNA, 20 nt, Human
ugcuucauuaugugagauag

SEQ ID NO: 28927 - RNA, 22 nt, Human
ugcuuccagcucucuguaaggu

SEQ ID NO: 28928 - RNA, 22 nt, Human
ugcuucccucacuucaccuggc

SEQ ID NO: 28929 - RNA, 22 nt, Human
ugcuucccugcucugcacaccu

SEQ ID NO: 28930 - RNA, 22 nt, Human
ugcuuccgcuaaaaauuaaucc

SEQ ID NO: 28931 - RNA, 22 nt, Human
ugcuuccuauccacacaaugcc

SEQ ID NO: 28932 - RNA, 19 nt, Human
ugcuuccucaccaucuccc

SEQ ID NO: 28933 - RNA, 22 nt, Human
ugcuuccugcuaaggcugccug

SEQ ID NO: 28934 - RNA, 22 nt, Human
ugcuuccuugaucauucccaaa

SEQ ID NO: 28935 - RNA, 22 nt, Human
ugcuucuagacacugcaauuga

SEQ ID NO: 28936 - RNA, 22 nt, Human
ugcuucucaaaaggagguaggu

SEQ ID NO: 28937 - RNA, 22 nt, Human
ugcuucucaaagaagcauaaug

SEQ ID NO: 28938 - RNA, 22 nt, Human
ugcuucugacauguucuugguu

SEQ ID NO: 28939 - RNA, 22 nt, Human
ugcuucugcugauauuuuguga

SEQ ID NO: 28940 - RNA, 22 nt, Human
ugcuucuggaaacaguggcugu

SEQ ID NO: 28941 - RNA, 22 nt, Human
ugcuucuggaguaacaggguga

SEQ ID NO: 28942 - RNA, 22 nt, Human
ugcuucuggcagauugagugag

SEQ ID NO: 28943 - RNA, 22 nt, Human
ugcuucuggcuuaucucgugcc

SEQ ID NO: 28944 - RNA, 22 nt, Human
ugcuucuguuacauaccagaac

SEQ ID NO: 28945 - RNA, 22 nt, Human
ugcuucuuuacuauaggcaauu

SEQ ID NO: 28946 - RNA, 22 nt, Human
ugcuugaagccuacauucguca

SEQ ID NO: 28947 - RNA, 17 nt, Human
ugcuugacucucuuguu

SEQ ID NO: 28948 - RNA, 22 nt, Human
ugcuugacuuugucacagcaug

SEQ ID NO: 28949 - RNA, 22 nt, Human
ugcuugagacacauaugaauuu

SEQ ID NO: 28950 - RNA, 22 nt, Human
ugcuugauggcucuucuuucua

SEQ ID NO: 28951 - RNA, 21 nt, Human
ugcuugcagaacuuucaggcu

SEQ ID NO: 28952 - RNA, 22 nt, Human
ugcuugcuaugcauccugaacu

SEQ ID NO: 28953 - RNA, 22 nt, Human
ugcuugcugaaaggcauuuaga

SEQ ID NO: 28954 - RNA, 22 nt, Human
ugcuugcuggaggcagacagaa

SEQ ID NO: 28955 - RNA, 23 nt, Human
ugcuuggacaagacucuauuaag

SEQ ID NO: 28956 - RNA, 22 nt, Human
uggaauucuuauucugacuuca

SEQ ID NO: 28957 - RNA, 22 nt, Human
uggacaacugguuuuugacaaa

SEQ ID NO: 28958 - RNA, 22 nt, Human
uggacacaauguugccuuaggg

SEQ ID NO: 28959 - RNA, 22 nt, Human
uggacaggaucugagacugaga

SEQ ID NO: 28960 - RNA, 20 nt, Human
uggacaggggcauagguugc

SEQ ID NO: 28961 - RNA, 22 nt, Human
uggacaggugagugacucaggg

SEQ ID NO: 28962 - RNA, 22 nt, Human
uggacauguaaaggcucaaggu

SEQ ID NO: 28963 - RNA, 22 nt, Human
uggaccagcuccucgggagacg

SEQ ID NO: 28964 - RNA, 21 nt, Human
uggaccaggaaggugguggug

SEQ ID NO: 28965 - RNA, 22 nt, Human
uggaccagggucccagaguaug

SEQ ID NO: 28966 - RNA, 22 nt, Human
uggacccuggacugcccuggcc

SEQ ID NO: 28967 - RNA, 22 nt, Human
uggaccgcagggaugcccggca

SEQ ID NO: 28968 - RNA, 22 nt, Human
uggaccugagccuggcccugcc

SEQ ID NO: 28969 - RNA, 22 nt, Human
uggaccugggguggccuccucu

SEQ ID NO: 28970 - RNA, 22 nt, Human
uggacucuaagcagaggaucua

SEQ ID NO: 28971 - RNA, 22 nt, Human
uggacucugaacuggcacugac

SEQ ID NO: 28972 - RNA, 22 nt, Human
uggacugauuuucauuuuaaau

SEQ ID NO: 28973 - RNA, 22 nt, Human
uggacuggaaugcugauccucu

SEQ ID NO: 28974 - RNA, 21 nt, Human
uggacuggugaguuuaggcug

SEQ ID NO: 28975 - RNA, 22 nt, Human
uggacuuucuaggguagaggaa

SEQ ID NO: 28976 - RNA, 22 nt, Human
uggagaagcuguagguggacuc

SEQ ID NO: 28977 - RNA, 22 nt, Human
uggagaaggacagccugagaaa

SEQ ID NO: 28978 - RNA, 22 nt, Human
uggagaaggccggccaggagug

SEQ ID NO: 28979 - RNA, 22 nt, Human
uggagaagucaaagugaacagg

SEQ ID NO: 28980 - RNA, 22 nt, Human
uggagaauauuuccaaaucuaa

SEQ ID NO: 28981 - RNA, 22 nt, Human
uggagaaugauauuccaucauu

SEQ ID NO: 28982 - RNA, 18 nt, Human
uggagacauagacaaugu

SEQ ID NO: 28983 - RNA, 22 nt, Human
uggagacaugggcgaaucuaag

SEQ ID NO: 28984 - RNA, 22 nt, Human
uggagacugauaaaggcuauug

SEQ ID NO: 28985 - RNA, 22 nt, Human
uggagagaaaaaagacaguucu

SEQ ID NO: 28986 - RNA, 22 nt, Human
uggagagagucgggauaguaca

SEQ ID NO: 28987 - RNA, 22 nt, Human
uggagagccuggagucccugau

SEQ ID NO: 28988 - RNA, 22 nt, Human
uggagagcuguugaaaugcaga

SEQ ID NO: 28989 - RNA, 22 nt, Human
uggagaguaaauggcagaauca

SEQ ID NO: 28990 - RNA, 22 nt, Human
uggagaugaggacauggacguc

SEQ ID NO: 28991 - RNA, 23 nt, Human
uggagaugccccacucccugucu

SEQ ID NO: 28992 - RNA, 22 nt, Human
uggagaugggaaaaaggaggua

SEQ ID NO: 28993 - RNA, 22 nt, Human
uggagauggguuaauggagaga

SEQ ID NO: 28994 - RNA, 20 nt, Human
uggcaggaauagggccagag

SEQ ID NO: 28995 - RNA, 20 nt, Human
uggcaggacuggcuccaccc

SEQ ID NO: 28996 - RNA, 22 nt, Human
uggcaggauuugcccggaagga

SEQ ID NO: 28997 - RNA, 22 nt, Human
uggcaggcaaguucagcuccac

SEQ ID NO: 28998 - RNA, 22 nt, Human
uggcaggcauccggcaccuucu

SEQ ID NO: 28999 - RNA, 22 nt, Human
uggcaggcauugaugcgaguuc

SEQ ID NO: 29000 - RNA, 22 nt, Human
uggcaggcggagguugcaguga

SEQ ID NO: 29001 - RNA, 22 nt, Human
uggcaggcucugaguagcaccu

SEQ ID NO: 29002 - RNA, 22 nt, Human
uggcagggccugaaucuuauac

SEQ ID NO: 29003 - RNA, 21 nt, Human
uggcagggguaguaguacagc

SEQ ID NO: 29004 - RNA, 22 nt, Human
uggcagggugccaguugcgagu

SEQ ID NO: 29005 - RNA, 22 nt, Human
uggcaggguuggccaccuuacc

SEQ ID NO: 29006 - RNA, 22 nt, Human
uggcaggucaugaguggccacc

SEQ ID NO: 29007 - RNA, 22 nt, Human
uggcagguccacucacagaucu

SEQ ID NO: 29008 - RNA, 22 nt, Human
uggcaggugccaugggcucaga

SEQ ID NO: 29009 - RNA, 20 nt, Human
uggcagguggccucaguucc

SEQ ID NO: 29010 - RNA, 22 nt, Human
uggcagguggcucuggcauucu

SEQ ID NO: 29011 - RNA, 21 nt, Human
uggcagguucaaaggccuauc

SEQ ID NO: 29012 - RNA, 22 nt, Human
uggcaguaaagcuggaaaagug

SEQ ID NO: 29013 - RNA, 22 nt, Human
uggcaguagauccagucucucu

SEQ ID NO: 29014 - RNA, 22 nt, Human
uggcagucugccucuucaccau

SEQ ID NO: 29015 - RNA, 22 nt, Human
uggcagucuggguuggcaguua

SEQ ID NO: 29016 - RNA, 22 nt, Human
uggcagugaugcggcaggacau

SEQ ID NO: 29017 - RNA, 22 nt, Human
uggcagugaugcuuaugguuug

SEQ ID NO: 29018 - RNA, 22 nt, Human
uggcaguggcaucaccccaaua

SEQ ID NO: 29019 - RNA, 22 nt, Human
uggcagugggaagcuggaaguc

SEQ ID NO: 29020 - RNA, 22 nt, Human
uggcaguuauuaaucaagucuu

SEQ ID NO: 29021 - RNA, 22 nt, Human
uggcaguucaggcugcaaucau

SEQ ID NO: 29022 - RNA, 23 nt, Human
uggcaguuuucuuuugugccagc

SEQ ID NO: 29023 - RNA, 22 nt, Human
uggcaguuuuguauuugagcau

SEQ ID NO: 29024 - RNA, 22 nt, Human
uggcaucauagccaaggugcuu

SEQ ID NO: 29025 - RNA, 22 nt, Human
uggcauccucucuucugagugc

SEQ ID NO: 29026 - RNA, 17 nt, Human
uggcaugaggguguggg

SEQ ID NO: 29027 - RNA, 22 nt, Human
uggcaugaguauaggcuucuca

SEQ ID NO: 29028 - RNA, 22 nt, Human
uggcaugccuugucagacagug

SEQ ID NO: 29029 - RNA, 22 nt, Human
uggcauggacuagugcugaggu

SEQ ID NO: 29030 - RNA, 22 nt, Human
uggcauguauuaguuggcaguu

SEQ ID NO: 29031 - RNA, 22 nt, Human
uggcauguauuuguggugaauu

SEQ ID NO: 29032 - RNA, 22 nt, Human
uggcauguugauaauggagaag

SEQ ID NO: 29033 - RNA, 22 nt, Human
uggcauguuuaaauggcaauaa

SEQ ID NO: 29034 - RNA, 22 nt, Human
uggcauuauguagcagggagca

SEQ ID NO: 29035 - RNA, 22 nt, Human
uggcauugcuucugaaguggag

SEQ ID NO: 29036 - RNA, 22 nt, Human
uggcauuuaguugcguauugca

SEQ ID NO: 29037 - RNA, 22 nt, Human
uggcauuuauaucccaguuuau

SEQ ID NO: 29038 - RNA, 22 nt, Human
uggcauuucaguauuuucauaa

SEQ ID NO: 29039 - RNA, 22 nt, Human
uggcauuucuguuagacucuca

SEQ ID NO: 29040 - RNA, 22 nt, Human
uggcauuugcucccuuguguuc

SEQ ID NO: 29041 - RNA, 21 nt, Human
uggcauuuguacagggacuuu

SEQ ID NO: 29042 - RNA, 22 nt, Human
uggcauuuuagacaugauggug

SEQ ID NO: 29043 - RNA, 21 nt, Human
uggccaaaaccauauuauuaa

SEQ ID NO: 29044 - RNA, 21 nt, Human
uggccaaggaauagaagcucu

SEQ ID NO: 29045 - RNA, 20 nt, Human
uggccaaguauccaacugga

SEQ ID NO: 29046 - RNA, 22 nt, Human
uggccaaucacugacaaaaugc

SEQ ID NO: 29047 - RNA, 22 nt, Human
uggccaauggcuccggccucau

SEQ ID NO: 29048 - RNA, 22 nt, Human
uggccacacccaccuagaggag

SEQ ID NO: 29049 - RNA, 22 nt, Human
uggccacaugcgucugugaggc

SEQ ID NO: 29050 - RNA, 19 nt, Human
uggccaccucugcuguucu

SEQ ID NO: 29051 - RNA, 20 nt, Human
uggccaccugcgucccagcc

SEQ ID NO: 29052 - RNA, 22 nt, Human
uggccaccuucccacuucugcc

SEQ ID NO: 29053 - RNA, 22 nt, Human
uggccagaaccugcaguaggcc

SEQ ID NO: 29054 - RNA, 22 nt, Human
uggccagaagguuuaaaagagg

SEQ ID NO: 29055 - RNA, 22 nt, Human
uggccagcacuuagcccuuacc

SEQ ID NO: 29056 - RNA, 23 nt, Human
uggccagcagaagcaaggggagc

SEQ ID NO: 29057 - RNA, 22 nt, Human
uggccagcagaguucacucucu

SEQ ID NO: 29058 - RNA, 22 nt, Human
uggccagccagaaagaagccuu

SEQ ID NO: 29059 - RNA, 22 nt, Human
uggccagcuguagguugugcag

SEQ ID NO: 29060 - RNA, 22 nt, Human
uggccagcuuugacuguaaacc

SEQ ID NO: 29061 - RNA, 23 nt, Human
uggccaggcauaaaggugggugg

SEQ ID NO: 29062 - RNA, 22 nt, Human
uggccaggccggggacagaacu

SEQ ID NO: 29063 - RNA, 22 nt, Human
uggccaggcuggucuggaacgc

SEQ ID NO: 29064 - RNA, 22 nt, Human
uggccaggggaguuccccucca

SEQ ID NO: 29065 - RNA, 22 nt, Human
uguuuugguagauugauuaugg

SEQ ID NO: 29066 - RNA, 22 nt, Human
uguuuugguuuaaguauaugaa

SEQ ID NO: 29067 - RNA, 22 nt, Human
uguuuugucuaauagggcaggu

SEQ ID NO: 29068 - RNA, 22 nt, Human
uguuuugugcacuucuauagca

SEQ ID NO: 29069 - RNA, 22 nt, Human
uguuuugugcauuuacaacaug

SEQ ID NO: 29070 - RNA, 22 nt, Human
uguuuuguuuaugagagcacag

SEQ ID NO: 29071 - RNA, 22 nt, Human
uguuuuuaaauaaugauagaaa

SEQ ID NO: 29072 - RNA, 22 nt, Human
uguuuuucaaauauugcucugu

SEQ ID NO: 29073 - RNA, 22 nt, Human
uguuuuuguucaaugcuagguc

SEQ ID NO: 29074 - RNA, 22 nt, Human
uuaaaaaccaucuuccuuuccu

SEQ ID NO: 29075 - RNA, 22 nt, Human
uuaaaacagcgugaaucuggca

SEQ ID NO: 29076 - RNA, 22 nt, Human
uuaaaaccaucagcuguaagau

SEQ ID NO: 29077 - RNA, 22 nt, Human
uuaaaaccuagagaucagacag

SEQ ID NO: 29078 - RNA, 22 nt, Human
uuaaaagaauccuguuauccuc

SEQ ID NO: 29079 - RNA, 22 nt, Human
uuaaaagaccuguugagguuag

SEQ ID NO: 29080 - RNA, 22 nt, Human
uuaaaaugcagauuaugacuca

SEQ ID NO: 29081 - RNA, 22 nt, Human
uuaaaaugcagauucugauuca

SEQ ID NO: 29082 - RNA, 23 nt, Human
uuaaacacuaguucgaguagcau

SEQ ID NO: 29083 - RNA, 22 nt, Human
uuaaacacuggggguuaaugca

SEQ ID NO: 29084 - RNA, 22 nt, Human
uuaaacagacaguaaaugaaac

SEQ ID NO: 29085 - RNA, 22 nt, Human
uuaaacagagucugaaauguaa

SEQ ID NO: 29086 - RNA, 22 nt, Human
uuaaacagucccagaggcugac

SEQ ID NO: 29087 - RNA, 22 nt, Human
uuaaacauuuauggaggcagca

SEQ ID NO: 29088 - RNA, 22 nt, Human
uuaaaccaccagaagccauuau

SEQ ID NO: 29089 - RNA, 17 nt, Human
uuaaaccauaaagaagg

SEQ ID NO: 29090 - RNA, 22 nt, Human
uuaaagacaucacagauuacac

SEQ ID NO: 29091 - RNA, 22 nt, Human
uuaaagagaaaguguuugucuu

SEQ ID NO: 29092 - RNA, 22 nt, Human
uuaaagagaacucaaugaauga

SEQ ID NO: 29093 - RNA, 22 nt, Human
uuaaagcaaccaucaauuugga

SEQ ID NO: 29094 - RNA, 22 nt, Human
uuaaagcaaccucagcccucuu

SEQ ID NO: 29095 - RNA, 22 nt, Human
uuaaagcaccuccuuggaugug

SEQ ID NO: 29096 - RNA, 22 nt, Human
uuaaagcacuaaaugaugaggg

SEQ ID NO: 29097 - RNA, 22 nt, Human
uuaaagcauguugcuuaacagg

SEQ ID NO: 29098 - RNA, 22 nt, Human
uuaaagcugagcccucagaagc

SEQ ID NO: 29099 - RNA, 22 nt, Human
uuaaagcuggcguuacaguuug

SEQ ID NO: 29100 - RNA, 22 nt, Human
uuaaaggaauugaguuucuugu

SEQ ID NO: 29101 - RNA, 23 nt, Human
uuaaaggcagauguugaguauua

SEQ ID NO: 29102 - RNA, 22 nt, Human
uuaaaggcgauaaggcaguguu

SEQ ID NO: 29103 - RNA, 22 nt, Human
uuaaaggcuauggcugccuggg

SEQ ID NO: 29104 - RNA, 22 nt, Human
uuaaaggcugaucuuaauauua

SEQ ID NO: 29105 - RNA, 22 nt, Human
uuaaagggccgauuuccaggcc

SEQ ID NO: 29106 - RNA, 22 nt, Human
uuaaaguaugguuuaagggcuu

SEQ ID NO: 29107 - RNA, 19 nt, Human
uuaaagugcgagaagucuu

SEQ ID NO: 29108 - RNA, 22 nt, Human
uuaaaguuugccuauguguugu

SEQ ID NO: 29109 - RNA, 22 nt, Human
uuaaauaguaggucuauuuugg

SEQ ID NO: 29110 - RNA, 22 nt, Human
uuaaauauuuucagcaggguca

SEQ ID NO: 29111 - RNA, 22 nt, Human
uuaaaugaggcugauguagauu

SEQ ID NO: 29112 - RNA, 22 nt, Human
uuaaaugaugcauaucauuuag

SEQ ID NO: 29113 - RNA, 22 nt, Human
uuaaauggagggggaaauacgu

SEQ ID NO: 29114 - RNA, 22 nt, Human
uuaaaugucuguagaugugcug

SEQ ID NO: 29115 - RNA, 22 nt, Human
uuaaaugugauccugguaugca

SEQ ID NO: 29116 - RNA, 22 nt, Human
uuaaauuauuucuagugaggug

SEQ ID NO: 29117 - RNA, 22 nt, Human
uuaacaaagcucuguuccuuuu

SEQ ID NO: 29118 - RNA, 22 nt, Human
uuaacaaaguaacgggaaaaga

SEQ ID NO: 29119 - RNA, 22 nt, Human
uuaacacauauuuaucaauugc

SEQ ID NO: 29120 - RNA, 22 nt, Human
uuaacagacuugggauuuucua

SEQ ID NO: 29121 - RNA, 22 nt, Human
uuaacaggaguaacucuagaaa

SEQ ID NO: 29122 - RNA, 22 nt, Human
uuaacagguuauauuguacagg

SEQ ID NO: 29123 - RNA, 22 nt, Human
uuaacaguuaaacaauuggcua

SEQ ID NO: 29124 - RNA, 22 nt, Human
uuaacuucaacacucucuugua

SEQ ID NO: 29125 - RNA, 20 nt, Human
uuaagaaaagcacauccugc

SEQ ID NO: 29126 - RNA, 22 nt, Human
uuaagaaggcuguuugcuagac

SEQ ID NO: 29127 - RNA, 22 nt, Human
uuaagaagguacucaaagaucu

SEQ ID NO: 29128 - RNA, 22 nt, Human
uuaagaauggaaugaggaauuu

SEQ ID NO: 29129 - RNA, 22 nt, Human
uuaagacauuuuuggagauuau

SEQ ID NO: 29130 - RNA, 22 nt, Human
uuaagagacaggagaaugaugu

SEQ ID NO: 29131 - RNA, 21 nt, Human
uuaagagcuuagcaguaggcc

SEQ ID NO: 29132 - RNA, 22 nt, Human
uuaagauuuucuucaguauuau

SEQ ID NO: 29133 - RNA, 22 nt, Human
uuaagcaacacacauuaauuau

SEQ ID NO: 29134 - RNA, 17 nt, Human
uuaagcauguaaucugc

SEQ ID NO: 29135 - RNA, 22 nt, Human
uuaagcucucauuauuauuauu

SEQ ID NO: 29136 - RNA, 22 nt, Human
uuaaggaaacauuuuuccauag

SEQ ID NO: 29137 - RNA, 22 nt, Human
uuaaggaaccacagcauguuag

SEQ ID NO: 29138 - RNA, 22 nt, Human
uuaaggaaggagucuuaaaugg

SEQ ID NO: 29139 - RNA, 22 nt, Human
uuaaggaaugugcaguuuauau

SEQ ID NO: 29140 - RNA, 23 nt, Human
uuaaggagcuugcacucugggug

SEQ ID NO: 29141 - RNA, 22 nt, Human
uuaaggcauugauauggugcua

SEQ ID NO: 29142 - RNA, 23 nt, Human
uggggagggaagucauuucugua

SEQ ID NO: 29143 - RNA, 22 nt, Human
uggggagguucgggaaucuugu

SEQ ID NO: 29144 - RNA, 22 nt, Human
uggggagucgcugcagagcgau

SEQ ID NO: 29145 - RNA, 17 nt, Human
uggggaugguucaugag

SEQ ID NO: 29146 - RNA, 22 nt, Human
uggggauguaaaugaggugaua

SEQ ID NO: 29147 - RNA, 22 nt, Human
uggggauguagaaaugaacaac

SEQ ID NO: 29148 - RNA, 22 nt, Human
uggggaugucauauaagaggaa

SEQ ID NO: 29149 - RNA, 22 nt, Human
uggggcagcagaccuuucuugg

SEQ ID NO: 29150 - RNA, 22 nt, Human
uggggcaguggcuuuucacccu

SEQ ID NO: 29151 - RNA, 22 nt, Human
uggggcauggaugauaagcugg

SEQ ID NO: 29152 - RNA, 22 nt, Human
uggggccacacaucucuuucua

SEQ ID NO: 29153 - RNA, 22 nt, Human
uggggccagggaggaccagaca

SEQ ID NO: 29154 - RNA, 22 nt, Human
uggggccucaggccuuuuccua

SEQ ID NO: 29155 - RNA, 20 nt, Human
uggggccuguuucugugguu

SEQ ID NO: 29156 - RNA, 22 nt, Human
uggggccuuggccucauuagau

SEQ ID NO: 29157 - RNA, 22 nt, Human
uggggcuaacgagagagcagag

SEQ ID NO: 29158 - RNA, 22 nt, Human
uggggcuccuccuggcaggagg

SEQ ID NO: 29159 - RNA, 23 nt, Human
uggggcugauggagacggaccag

SEQ ID NO: 29160 - RNA, 22 nt, Human
uggggcuggcuauugucucccu

SEQ ID NO: 29161 - RNA, 22 nt, Human
uggggcuggggaucuugagccu

SEQ ID NO: 29162 - RNA, 22 nt, Human
uggggcugugagacuacaggau

SEQ ID NO: 29163 - RNA, 21 nt, Human
ugggggagaauugguugcuuu

SEQ ID NO: 29164 - RNA, 22 nt, Human
ugggggagauugugcaucucua

SEQ ID NO: 29165 - RNA, 22 nt, Human
ugggggaguauagucuggccuc

SEQ ID NO: 29166 - RNA, 22 nt, Human
ugggggcagaggauucaggaau

SEQ ID NO: 29167 - RNA, 22 nt, Human
ugggggcagccaggcugucaag

SEQ ID NO: 29168 - RNA, 17 nt, Human
ugggggcccuguguaga

SEQ ID NO: 29169 - RNA, 22 nt, Human
ugggggcuccaggcuccaggga

SEQ ID NO: 29170 - RNA, 18 nt, Human
uggggggcuugucugaag

SEQ ID NO: 29171 - RNA, 21 nt, Human
ugggggugaggccuaggaauc

SEQ ID NO: 29172 - RNA, 22 nt, Human
ugggggugcccuaugaggaagc

SEQ ID NO: 29173 - RNA, 22 nt, Human
ugggggugguucuugccuccag

SEQ ID NO: 29174 - RNA, 22 nt, Human
ugggguagggaaaagaagucga

SEQ ID NO: 29175 - RNA, 22 nt, Human
ugggguccagugccaccccaag

SEQ ID NO: 29176 - RNA, 22 nt, Human
ugggguccagugccuggcaagg

SEQ ID NO: 29177 - RNA, 22 nt, Human
uggggucccaacucugauugau

SEQ ID NO: 29178 - RNA, 20 nt, Human
ugggguccuggaggggaucc

SEQ ID NO: 29179 - RNA, 18 nt, Human
uggggucucucagguaag

SEQ ID NO: 29180 - RNA, 22 nt, Human
uggggucuggaguugcccauga

SEQ ID NO: 29181 - RNA, 22 nt, Human
uggggugacagugcagugguca

SEQ ID NO: 29182 - RNA, 22 nt, Human
uggggugccgacagggagggca

SEQ ID NO: 29183 - RNA, 22 nt, Human
ugggguggaacccuucugcugg

SEQ ID NO: 29184 - RNA, 22 nt, Human
uggggugugagaaguagaggga

SEQ ID NO: 29185 - RNA, 22 nt, Human
uggggugugcucagagcagggg

SEQ ID NO: 29186 - RNA, 23 nt, Human
ugggguugaauuguagcugugcc

SEQ ID NO: 29187 - RNA, 22 nt, Human
uggguaaauauccuuugugaaa

SEQ ID NO: 29188 - RNA, 22 nt, Human
uggguaagaauugggggcucug

SEQ ID NO: 29189 - RNA, 22 nt, Human
uggguaagguacuguagaucug

SEQ ID NO: 29190 - RNA, 22 nt, Human
uggguagaggaauugggcuacc

SEQ ID NO: 29191 - RNA, 22 nt, Human
uggguagaguggagggauaaga

SEQ ID NO: 29192 - RNA, 22 nt, Human
uggguaggaaucgaguguaugg

SEQ ID NO: 29193 - RNA, 22 nt, Human
uggguagggccugcgccugugc

SEQ ID NO: 29194 - RNA, 22 nt, Human
ugggucagacagccagugggcc

SEQ ID NO: 29195 - RNA, 22 nt, Human
ugggucagagcugugcugccca

SEQ ID NO: 29196 - RNA, 22 nt, Human
ugggucagauugagccccuggu

SEQ ID NO: 29197 - RNA, 23 nt, Human
ugggucagcugccuccaggacaa

SEQ ID NO: 29198 - RNA, 22 nt, Human
uggguccacaaacaucagauau

SEQ ID NO: 29199 - RNA, 22 nt, Human
uggguccagugcagcugcgcgu

SEQ ID NO: 29200 - RNA, 22 nt, Human
ugggucccaaacuccuagaggu

SEQ ID NO: 29201 - RNA, 22 nt, Human
ugggucccaaucugaaauguca

SEQ ID NO: 29202 - RNA, 22 nt, Human
uggguccucuggagcagcagca

SEQ ID NO: 29203 - RNA, 22 nt, Human
uggguccuugcuaacuucuaug

SEQ ID NO: 29204 - RNA, 22 nt, Human
uggguccuugcugauugcugag

SEQ ID NO: 29205 - RNA, 22 nt, Human
uggguccuugcuggcuucaaag

SEQ ID NO: 29206 - RNA, 22 nt, Human
uggguccuuuuuggacuucuuc

SEQ ID NO: 29207 - RNA, 22 nt, Human
ugggucuccugugccugggagg

SEQ ID NO: 29208 - RNA, 23 nt, Human
ugggucucuaguacaggcaggca

SEQ ID NO: 29209 - RNA, 22 nt, Human
ugggugacagacaccucucugu

SEQ ID NO: 29210 - RNA, 22 nt, Human
ugggugaggagaggcugucuaa

SEQ ID NO: 29211 - RNA, 22 nt, Human
ugggugagugggaaaagcccag

SEQ ID NO: 29212 - RNA, 23 nt, Human
ugggugcuaaucugcucugugga

SEQ ID NO: 29213 - RNA, 22 nt, Human
ugggugcucugcgaccguaggg

SEQ ID NO: 29214 - RNA, 22 nt, Human
uggguggcggccugguucugag

SEQ ID NO: 29215 - RNA, 16 nt, Human
ugggugggaggagcgg

SEQ ID NO: 29216 - RNA, 22 nt, Human
ugggugguccaggcucagcaga

SEQ ID NO: 29217 - RNA, 22 nt, Human
ugggugucaaugucacacgauu

SEQ ID NO: 29218 - RNA, 22 nt, Human
uggguguguccauauuuugacu

SEQ ID NO: 29219 - RNA, 22 nt, Human
uggguuaauagaaucauuaacu

SEQ ID NO: 29220 - RNA, 22 nt, Human
uggguucagaucccagcucugu

SEQ ID NO: 29221 - RNA, 22 nt, Human
uggguucuagagggaccagaac

SEQ ID NO: 29222 - RNA, 22 nt, Human
ugguaaaaaccgcaauuacauu

SEQ ID NO: 29223 - RNA, 22 nt, Human
ugguaaaaacugcaauuacuuu

SEQ ID NO: 29224 - RNA, 22 nt, Human
ugguaagaauaggggcuuugga

SEQ ID NO: 29225 - RNA, 22 nt, Human
ugguaaggcccagcuggagucc

SEQ ID NO: 29226 - RNA, 22 nt, Human
ugguaagggguggaaccagagc

SEQ ID NO: 29227 - RNA, 22 nt, Human
ugguaaggguauuauuucaucc

SEQ ID NO: 29228 - RNA, 22 nt, Human
ugguaaggucuucacucagauu

SEQ ID NO: 29229 - RNA, 22 nt, Human
ugguaaugguucucuugcuaua

SEQ ID NO: 29230 - RNA, 22 nt, Human
ugguaauuaauuugauagguuc

SEQ ID NO: 29231 - RNA, 22 nt, Human
ugguaauuuacgcauuucugua

SEQ ID NO: 29232 - RNA, 22 nt, Human
ugguaauuuccgaagugaguaa

SEQ ID NO: 29233 - RNA, 19 nt, Human
ugguacaaaccaagagaga

SEQ ID NO: 29234 - RNA, 21 nt, Human
ugguacaccuugccugucaga

SEQ ID NO: 29235 - RNA, 21 nt, Human
ugguacagaggaggugaagug

SEQ ID NO: 29236 - RNA, 22 nt, Human
ugguaccagggguuauuucugc

SEQ ID NO: 29237 - RNA, 22 nt, Human
ugguaccauuucccaggagugu

SEQ ID NO: 29238 - RNA, 22 nt, Human
ugguaggaaugauuacgacuuu

SEQ ID NO: 29239 - RNA, 22 nt, Human
ugguaggagauauggucuccga

SEQ ID NO: 29240 - RNA, 22 nt, Human
ugguagggacacuaugcagaaa

SEQ ID NO: 29241 - RNA, 22 nt, Human
ugguauaaaacuuuuuauugaa

SEQ ID NO: 29242 - RNA, 22 nt, Human
ugguauaaaagaguaaacuaug

SEQ ID NO: 29243 - RNA, 22 nt, Human
ugguauaagcugugucagagcc

SEQ ID NO: 29244 - RNA, 20 nt, Human
ugguaucaauuacuagauug

SEQ ID NO: 29245 - RNA, 22 nt, Human
ugguaugcuuauuaucuucaac

SEQ ID NO: 29246 - RNA, 22 nt, Human
ugguauggaugguguggcuuuc

SEQ ID NO: 29247 - RNA, 22 nt, Human
ugguauggccuggagaaugcag

SEQ ID NO: 29248 - RNA, 22 nt, Human
ugguauuacagcauuccauauu

SEQ ID NO: 29249 - RNA, 22 nt, Human
ugguauuuccucauucugcuuu

SEQ ID NO: 29250 - RNA, 22 nt, Human
ugguauuucugugcccagcuca

SEQ ID NO: 29251 - RNA, 22 nt, Human
uggucaaaccaguuaucuguaa

SEQ ID NO: 29252 - RNA, 22 nt, Human
uggucaacaggcagggaugaaa

SEQ ID NO: 29253 - RNA, 22 nt, Human
uggucaaggcuuggagauagua

SEQ ID NO: 29254 - RNA, 22 nt, Human
uggucacccacugggacugcgg

SEQ ID NO: 29255 - RNA, 18 nt, Human
uggucacuguggauagug

SEQ ID NO: 29256 - RNA, 22 nt, Human
uggucagacaaaggagaauguu

SEQ ID NO: 29257 - RNA, 19 nt, Human
uggucagcauuaggauuug

SEQ ID NO: 29258 - RNA, 22 nt, Human
uggucaggggcuucugagcugu

SEQ ID NO: 29259 - RNA, 22 nt, Human
uggucaguugcaucagagaagu

SEQ ID NO: 29260 - RNA, 22 nt, Human
uggucaguugugacuagaacac

SEQ ID NO: 29261 - RNA, 22 nt, Human
uggucauuaauucuuaccuuua

SEQ ID NO: 29262 - RNA, 22 nt, Human
ugguccaagugagguggccucu

SEQ ID NO: 29263 - RNA, 22 nt, Human
uguaaguacauugaaacaucuu

SEQ ID NO: 29264 - RNA, 22 nt, Human
uguaaguagaacaacauaaucu

SEQ ID NO: 29265 - RNA, 22 nt, Human
uguaagucuggcuuauagcuuu

SEQ ID NO: 29266 - RNA, 22 nt, Human
uguaauauaagcauuaauaguu

SEQ ID NO: 29267 - RNA, 22 nt, Human
uguaauauauauaacugugugc

SEQ ID NO: 29268 - RNA, 22 nt, Human
uguaaucaugcaucaguuaguu

SEQ ID NO: 29269 - RNA, 22 nt, Human
uguaaugagaaagagagugaau

SEQ ID NO: 29270 - RNA, 22 nt, Human
uguaaugauguacuuagaagga

SEQ ID NO: 29271 - RNA, 18 nt, Human
uguaaugcagcggguggc

SEQ ID NO: 29272 - RNA, 22 nt, Human
uguaauggaagugggauugcau

SEQ ID NO: 29273 - RNA, 22 nt, Human
uguaauuuucucaaguuucuac

SEQ ID NO: 29274 - RNA, 22 nt, Human
uguacaaagccagaacucccaa

SEQ ID NO: 29275 - RNA, 22 nt, Human
uguacaaauucaguucuagggu

SEQ ID NO: 29276 - RNA, 22 nt, Human
uguacaaauucauugaacugua

SEQ ID NO: 29277 - RNA, 17 nt, Human
uguacaacaguaccuuc

SEQ ID NO: 29278 - RNA, 22 nt, Human
uguacaaucugaugauguaugg

SEQ ID NO: 29279 - RNA, 22 nt, Human
uguacaauggcuauaauacccu

SEQ ID NO: 29280 - RNA, 22 nt, Human
uguacacacacguguguaucua

SEQ ID NO: 29281 - RNA, 20 nt, Human
uguacacaguacuuuacaau

SEQ ID NO: 29282 - RNA, 22 nt, Human
uguacacaguaugaggcaucuu

SEQ ID NO: 29283 - RNA, 22 nt, Human
uggucucccagagcagggacgc

SEQ ID NO: 29284 - RNA, 23 nt, Human
uggucugaagccucagguuccuc

SEQ ID NO: 29285 - RNA, 22 nt, Human
uggucugaagguggauuugaga

SEQ ID NO: 29286 - RNA, 22 nt, Human
uggucugauagucugaaaauga

SEQ ID NO: 29287 - RNA, 22 nt, Human
uggucuggaacuccuggcuuca

SEQ ID NO: 29288 - RNA, 22 nt, Human
uggucugggcaaauccuucuga

SEQ ID NO: 29289 - RNA, 22 nt, Human
uggucuggggaccgaggguuac

SEQ ID NO: 29290 - RNA, 22 nt, Human
uggucuguucaagguggcugau

SEQ ID NO: 29291 - RNA, 22 nt, Human
uggugacaccccaucucuaaag

SEQ ID NO: 29292 - RNA, 22 nt, Human
uggugacugggacuggauauga

SEQ ID NO: 29293 - RNA, 22 nt, Human
uggugagaaguuuugagauucu

SEQ ID NO: 29294 - RNA, 22 nt, Human
uggugagaccuuguuccuuaug

SEQ ID NO: 29295 - RNA, 22 nt, Human
uggugagcgaugcugcauguuc

SEQ ID NO: 29296 - RNA, 22 nt, Human
uggugagcucuggcagucugug

SEQ ID NO: 29297 - RNA, 22 nt, Human
uggugaggucauagagaacugu

SEQ ID NO: 29298 - RNA, 22 nt, Human
uggugcaaaacuaauugcgguu

SEQ ID NO: 29299 - RNA, 22 nt, Human
uggugcagagagggaucuaggg

SEQ ID NO: 29300 - RNA, 22 nt, Human
uggugcagauagugguguagua

SEQ ID NO: 29301 - RNA, 22 nt, Human
uggugcagucauuggcccaggg

SEQ ID NO: 29302 - RNA, 22 nt, Human
uggugcaguccaaagggagcag

SEQ ID NO: 29303 - RNA, 22 nt, Human
uggugccaagcaugaggacucu

SEQ ID NO: 29304 - RNA, 22 nt, Human
uggugccaucauagcucacugc

SEQ ID NO: 29305 - RNA, 22 nt, Human
uggugccauuagcccugcuguu

SEQ ID NO: 29306 - RNA, 22 nt, Human
uggugcccacucuggacccagc

SEQ ID NO: 29307 - RNA, 22 nt, Human
uggugcccauguaucccuucac

SEQ ID NO: 29308 - RNA, 22 nt, Human
uggugccuccagcugcuucucc

SEQ ID NO: 29309 - RNA, 22 nt, Human
uggugcucccuggaguugugca

SEQ ID NO: 29310 - RNA, 19 nt, Human
uggugcuggccucccaugg

SEQ ID NO: 29311 - RNA, 22 nt, Human
uggugcuggugccacgccccuu

SEQ ID NO: 29312 - RNA, 22 nt, Human
ugguggcaaaagaggcaaagug

SEQ ID NO: 29313 - RNA, 22 nt, Human
ugguggcaaaguacaaagugac

SEQ ID NO: 29314 - RNA, 22 nt, Human
ugguggcaaaucaggacacuuc

SEQ ID NO: 29315 - RNA, 22 nt, Human
ugguggcaauguccuggagaag

SEQ ID NO: 29316 - RNA, 22 nt, Human
ugguggcaauucaaagacagca

SEQ ID NO: 29317 - RNA, 22 nt, Human
ugguggcagcugggacagaggu

SEQ ID NO: 29318 - RNA, 22 nt, Human
ugguggcagugagaaggagagg

SEQ ID NO: 29319 - RNA, 22 nt, Human
ugguggcaucacucagccuccc

SEQ ID NO: 29320 - RNA, 22 nt, Human
ugguggcuaccagguccugggg

SEQ ID NO: 29321 - RNA, 22 nt, Human
uggugggagugagggcaugcca

SEQ ID NO: 29322 - RNA, 22 nt, Human
uggugggcacagugcccaggcu

SEQ ID NO: 29323 - RNA, 22 nt, Human
uggugggcugagucucaucgga

SEQ ID NO: 29324 - RNA, 16 nt, Human
ugguggggaggacagc

SEQ ID NO: 29325 - RNA, 22 nt, Human
ugguggggccagacuucagcuc

SEQ ID NO: 29326 - RNA, 23 nt, Human
ugguggucagcccuuucuggagg

SEQ ID NO: 29327 - RNA, 18 nt, Human
ugguggugacagggucau

SEQ ID NO: 29328 - RNA, 22 nt, Human
uggugucaggcacuagcaugca

SEQ ID NO: 29329 - RNA, 22 nt, Human
ugguguggggauaagcacucug

SEQ ID NO: 29330 - RNA, 22 nt, Human
ugguguguacauuuuugcuucu

SEQ ID NO: 29331 - RNA, 22 nt, Human
ugguguguuagagcucagggca

SEQ ID NO: 29332 - RNA, 21 nt, Human
ugguuaaaguugugucauccc

SEQ ID NO: 29333 - RNA, 22 nt, Human
ugguuaaaugcuccgaucuugg

SEQ ID NO: 29334 - RNA, 22 nt, Human
ugguuaaguccagaaaggaagc

SEQ ID NO: 29335 - RNA, 22 nt, Human
ugguuacagagauuuuuaagau

SEQ ID NO: 29336 - RNA, 22 nt, Human
ugguuagacucaccuuauaguu

SEQ ID NO: 29337 - RNA, 22 nt, Human
ugguuaguguauauuuggacug

SEQ ID NO: 29338 - RNA, 22 nt, Human
ugguucagauauggagcuggga

SEQ ID NO: 29339 - RNA, 22 nt, Human
ugguucaguugcacaggcuguu

SEQ ID NO: 29340 - RNA, 22 nt, Human
ugguuccaaucgcacuggcuca

SEQ ID NO: 29341 - RNA, 22 nt, Human
ugguuccacuaaccugagagcc

SEQ ID NO: 29342 - RNA, 22 nt, Human
ugguuccugguucacuuggcag

SEQ ID NO: 29343 - RNA, 22 nt, Human
ugguucuaaaggacuauacaga

SEQ ID NO: 29344 - RNA, 22 nt, Human
ugguucuaggcuuugucuuuug

SEQ ID NO: 29345 - RNA, 17 nt, Human
ugguucuuuucauuccc

SEQ ID NO: 29346 - RNA, 22 nt, Human
ugguugaauaagauaguuuuau

SEQ ID NO: 29347 - RNA, 22 nt, Human
ugguugaauguagcauuuaugg

SEQ ID NO: 29348 - RNA, 22 nt, Human
ugguugcauuaacugagagggg

SEQ ID NO: 29349 - RNA, 22 nt, Human
ugguugugagcgauggauggag

SEQ ID NO: 29350 - RNA, 22 nt, Human
ugguuuaauuuccauuuccuug

SEQ ID NO: 29351 - RNA, 22 nt, Human
ugguuucuggguuugucuagga

SEQ ID NO: 29352 - RNA, 22 nt, Human
ugguuugacaaugaggacuggu

SEQ ID NO: 29353 - RNA, 22 nt, Human
ugguuuguauauguuugugaga

SEQ ID NO: 29354 - RNA, 22 nt, Human
ugguuugucuaaaugaguaaua

SEQ ID NO: 29355 - RNA, 22 nt, Human
ugguuuuaaaaacaugcugcau

SEQ ID NO: 29356 - RNA, 22 nt, Human
ugguuuuauuuauguugaguca

SEQ ID NO: 29357 - RNA, 22 nt, Human
ugguuuugcuccaguauaaaua

SEQ ID NO: 29358 - RNA, 23 nt, Human
uguaaaagcauuugucagccugg

SEQ ID NO: 29359 - RNA, 22 nt, Human
uguaaacagccccauggagagc

SEQ ID NO: 29360 - RNA, 22 nt, Human
uguaaacaugcugaggcuggag

SEQ ID NO: 29361 - RNA, 22 nt, Human
uguaaagaaagacgcagaguua

SEQ ID NO: 29362 - RNA, 22 nt, Human
uguaaagacagauaaaacagca

SEQ ID NO: 29363 - RNA, 22 nt, Human
uguaaagacgcuuauagcuugc

SEQ ID NO: 29364 - RNA, 22 nt, Human
uguaaagagaagaaacgugagc

SEQ ID NO: 29365 - RNA, 23 nt, Human
uguaaagaucaagugacugauuu

SEQ ID NO: 29366 - RNA, 22 nt, Human
uguaaagguaggugcaaaauga

SEQ ID NO: 29367 - RNA, 22 nt, Human
uguaaaguaucugugagcucuc

SEQ ID NO: 29368 - RNA, 22 nt, Human
uguaaaguccaagaucaaagag

SEQ ID NO: 29369 - RNA, 22 nt, Human
uguaaaguuacuuuugaaagga

SEQ ID NO: 29370 - RNA, 22 nt, Human
uguaaaucacugaacuaaauga

SEQ ID NO: 29371 - RNA, 23 nt, Human
uguaacaauuucauauacaugca

SEQ ID NO: 29372 - RNA, 23 nt, Human
uguaacagagcacugauugacaa

SEQ ID NO: 29373 - RNA, 22 nt, Human
uguaacaguaagccugugagcu

SEQ ID NO: 29374 - RNA, 22 nt, Human
uguaacaguagauaaggucuug

SEQ ID NO: 29375 - RNA, 22 nt, Human
uguaaccaugaugagcagguau

SEQ ID NO: 29376 - RNA, 22 nt, Human
uguaacugcuuagaagguuuua

SEQ ID NO: 29377 - RNA, 22 nt, Human
uguaacuggacaagauauucau

SEQ ID NO: 29378 - RNA, 22 nt, Human
uguaacugguuauaauuuuuga

SEQ ID NO: 29379 - RNA, 22 nt, Human
uguaagaaaaguaaauagugac

SEQ ID NO: 29380 - RNA, 22 nt, Human
uuauucucaucucccuacuuag

SEQ ID NO: 29381 - RNA, 22 nt, Human
uuauucuguuguucaggguugg

SEQ ID NO: 29382 - RNA, 19 nt, Human
uuauucuuaaaguagcuua

SEQ ID NO: 29383 - RNA, 22 nt, Human
uuauugacuuguuuguccuggu

SEQ ID NO: 29384 - RNA, 22 nt, Human
uuauugagagcuguuuuauggc

SEQ ID NO: 29385 - RNA, 16 nt, Human
uuauugaggccaagga

SEQ ID NO: 29386 - RNA, 22 nt, Human
uuauugaguaucugcuuggugu

SEQ ID NO: 29387 - RNA, 22 nt, Human
uuauugaguuguaagagcucuu

SEQ ID NO: 29388 - RNA, 22 nt, Human
uuauugcaaaggaagagcuuga

SEQ ID NO: 29389 - RNA, 22 nt, Human
uuauugcaacuccuaaauagag

SEQ ID NO: 29390 - RNA, 22 nt, Human
uuauugcaccaugccucaguuu

SEQ ID NO: 29391 - RNA, 22 nt, Human
uuauugcagccgcagggcgcug

SEQ ID NO: 29392 - RNA, 22 nt, Human
uguuuaagugcugguaggguug

SEQ ID NO: 29393 - RNA, 22 nt, Human
uguuuaaguucugcuccuuauu

SEQ ID NO: 29394 - RNA, 22 nt, Human
uguuuaauuuuucaugagccaa

SEQ ID NO: 29395 - RNA, 22 nt, Human
uguuuacagaaggcagacuucc

SEQ ID NO: 29396 - RNA, 22 nt, Human
uguuuacaugcauaagcuuaag

SEQ ID NO: 29397 - RNA, 22 nt, Human
uguuuacauggagguuuucagc

SEQ ID NO: 29398 - RNA, 22 nt, Human
uguuuacuggaccagggagggg

SEQ ID NO: 29399 - RNA, 22 nt, Human
uguuuacuggcuccugugguuc

SEQ ID NO: 29400 - RNA, 22 nt, Human
uguuuacuucuuuccauggcuu

SEQ ID NO: 29401 - RNA, 22 nt, Human
uguuuacuuuccuucucacagg

SEQ ID NO: 29402 - RNA, 22 nt, Human
uguuuacuuuuaauuaccuguc

SEQ ID NO: 29403 - RNA, 22 nt, Human
uguuuagaaucauucaaaaguu

SEQ ID NO: 29404 - RNA, 22 nt, Human
uguuuaguaggaguuuaauacu

SEQ ID NO: 29405 - RNA, 22 nt, Human
uguuuauaaauuuucuugccau

SEQ ID NO: 29406 - RNA, 22 nt, Human
uguuuauaauaugcagugagca

SEQ ID NO: 29407 - RNA, 22 nt, Human
uguuuauagauggccacaauga

SEQ ID NO: 29408 - RNA, 22 nt, Human
uguuuaugugugugcauauaua

SEQ ID NO: 29409 - RNA, 22 nt, Human
uguuuauuacaguucuuggaau

SEQ ID NO: 29410 - RNA, 18 nt, Human
uguuuauucuccugacag

SEQ ID NO: 29411 - RNA, 22 nt, Human
uguuuauugagugccuacuaua

SEQ ID NO: 29412 - RNA, 22 nt, Human
uguuucaaagaaagaaaauaua

SEQ ID NO: 29413 - RNA, 22 nt, Human
uguuucaugaagucuggauauc

SEQ ID NO: 29414 - RNA, 22 nt, Human
uguuucaugauugcugucauuu

SEQ ID NO: 29415 - RNA, 21 nt, Human
uguuucaugcuauuuucuugu

SEQ ID NO: 29416 - RNA, 22 nt, Human
uguuucauuaguacugacaaua

SEQ ID NO: 29417 - RNA, 22 nt, Human
uguuuccauggugacagcagcu

SEQ ID NO: 29418 - RNA, 22 nt, Human
uguuucccuaaggucuggcucu

SEQ ID NO: 29419 - RNA, 22 nt, Human
uguuuccuuucuggugagcaua

SEQ ID NO: 29420 - RNA, 22 nt, Human
uguuucuuacguuuuuagaggc

SEQ ID NO: 29421 - RNA, 22 nt, Human
uguuucuugagaguauuacccu

SEQ ID NO: 29422 - RNA, 22 nt, Human
uguuugaaacuuugaucacuaa

SEQ ID NO: 29423 - RNA, 22 nt, Human
uguuugaaagcaccuacauuuu

SEQ ID NO: 29424 - RNA, 22 nt, Human
uguuugacaacaggcucacaga

SEQ ID NO: 29425 - RNA, 22 nt, Human
uguuugcauuaauuagaaggua

SEQ ID NO: 29426 - RNA, 22 nt, Human
uguuugcuaggguugguauuua

SEQ ID NO: 29427 - RNA, 22 nt, Human
uguuugcuauauccuacuucau

SEQ ID NO: 29428 - RNA, 22 nt, Human
uguuugcuuacuuguaugcugc

SEQ ID NO: 29429 - RNA, 22 nt, Human
uguuuggaaacacuggcagaaa

SEQ ID NO: 29430 - RNA, 22 nt, Human
uguuuguccccaucccucagca

SEQ ID NO: 29431 - RNA, 22 nt, Human
uguuugugagaugugagguacg

SEQ ID NO: 29432 - RNA, 22 nt, Human
uguuugugcugccuggugggca

SEQ ID NO: 29433 - RNA, 22 nt, Human
uguuuguggaauauucuuuaag

SEQ ID NO: 29434 - RNA, 22 nt, Human
uguuuuaagagcgcacuuuaua

SEQ ID NO: 29435 - RNA, 22 nt, Human
uguuuuaagcucuagaagggga

SEQ ID NO: 29436 - RNA, 22 nt, Human
uguuuuaaucucccauugcucu

SEQ ID NO: 29437 - RNA, 22 nt, Human
uguuuuauauaagcagagcggu

SEQ ID NO: 29438 - RNA, 22 nt, Human
uguuuuaucaagauggcauguc

SEQ ID NO: 29439 - RNA, 22 nt, Human
uguuuuaugagccauauaaccu

SEQ ID NO: 29440 - RNA, 22 nt, Human
uguuuucaagucaaggccaaau

SEQ ID NO: 29441 - RNA, 22 nt, Human
uuccaggaauucagcucucagu

SEQ ID NO: 29442 - RNA, 22 nt, Human
uuccaggagacuuccagaaaua

SEQ ID NO: 29443 - RNA, 22 nt, Human
uuccaggaggagguacuagagg

SEQ ID NO: 29444 - RNA, 22 nt, Human
uuccaggcaugucagacauagg

SEQ ID NO: 29445 - RNA, 22 nt, Human
uuccagucaaguaagaauaucu

SEQ ID NO: 29446 - RNA, 22 nt, Human
uuccagucuggccugugcuuag

SEQ ID NO: 29447 - RNA, 22 nt, Human
uuccagugaaacaugaggugug

SEQ ID NO: 29448 - RNA, 22 nt, Human
uuccagugaccauagaguaugg

SEQ ID NO: 29449 - RNA, 22 nt, Human
uuccagugacuaagcuucugcu

SEQ ID NO: 29450 - RNA, 22 nt, Human
uuccaguucaaauuggccaaua

SEQ ID NO: 29451 - RNA, 22 nt, Human
uuccaguucacuccauuucugg

SEQ ID NO: 29452 - RNA, 22 nt, Human
uuccaguucuggcuuugccacu

SEQ ID NO: 29453 - RNA, 22 nt, Human
uuccaguucuucuguaagcacu

SEQ ID NO: 29454 - RNA, 22 nt, Human
uuccauaaaggugauaguauac

SEQ ID NO: 29455 - RNA, 22 nt, Human
uuccauaaucaccuuauucuuu

SEQ ID NO: 29456 - RNA, 18 nt, Human
uuccauaauguauguaac

SEQ ID NO: 29457 - RNA, 22 nt, Human
uuccauaugaaaaagcuguugc

SEQ ID NO: 29458 - RNA, 22 nt, Human
uuccaucacaucacugaagaca

SEQ ID NO: 29459 - RNA, 22 nt, Human
uuccaucuuucagcuuuguugg

SEQ ID NO: 29460 - RNA, 22 nt, Human
uuccaugaaauguguuaugcuu

SEQ ID NO: 29461 - RNA, 22 nt, Human
uuccaugacaccgagggaaguc

SEQ ID NO: 29462 - RNA, 22 nt, Human
uuccaugccucuauuuagaauu

SEQ ID NO: 29463 - RNA, 22 nt, Human
uucccaaaauauaacaguuaac

SEQ ID NO: 29464 - RNA, 22 nt, Human
uucccaagucuccaauguggga

SEQ ID NO: 29465 - RNA, 22 nt, Human
uucccacaacagaucuguauua

SEQ ID NO: 29466 - RNA, 22 nt, Human
uucccacaggaugagagcugag

SEQ ID NO: 29467 - RNA, 23 nt, Human
uucccacaucuuccacagcuaug

SEQ ID NO: 29468 - RNA, 22 nt, Human
uucccagagaaggaugaaaaag

SEQ ID NO: 29469 - RNA, 22 nt, Human
uucccagaggagauuugcuuau

SEQ ID NO: 29470 - RNA, 22 nt, Human
uucccagucaaacgaaggacuu

SEQ ID NO: 29471 - RNA, 22 nt, Human
uucccaugccuggccccuaucc

SEQ ID NO: 29472 - RNA, 22 nt, Human
uuccccaggcggcuuuuucagc

SEQ ID NO: 29473 - RNA, 22 nt, Human
uuccccaggcuggagugcagug

SEQ ID NO: 29474 - RNA, 22 nt, Human
uuccccaguagugacaaucaaa

SEQ ID NO: 29475 - RNA, 17 nt, Human
uuccccugaccaagccu

SEQ ID NO: 29476 - RNA, 22 nt, Human
uuccccugucacagugguucuc

SEQ ID NO: 29477 - RNA, 22 nt, Human
uucccgucuuugcuaugccugc

SEQ ID NO: 29478 - RNA, 22 nt, Human
uucccuaaugucuaacgcuauu

SEQ ID NO: 29479 - RNA, 22 nt, Human
uucccucuccaggagcccugag

SEQ ID NO: 29480 - RNA, 22 nt, Human
uucccucuccuacucaggaaag

SEQ ID NO: 29481 - RNA, 22 nt, Human
uucccucucuccagggcugccu

SEQ ID NO: 29482 - RNA, 22 nt, Human
uucccucugcgcauugaauuuc

SEQ ID NO: 29483 - RNA, 22 nt, Human
uucccucuuucacugugauuuu

SEQ ID NO: 29484 - RNA, 22 nt, Human
uucccugaagaccucaugugac

SEQ ID NO: 29485 - RNA, 22 nt, Human
uucccugaucacgugucaggag

SEQ ID NO: 29486 - RNA, 20 nt, Human
uucccuggaaggagaagcag

SEQ ID NO: 29487 - RNA, 22 nt, Human
uucccuggcccuggcacgcucu

SEQ ID NO: 29488 - RNA, 22 nt, Human
uuccuaacaagucuaucuuuga

SEQ ID NO: 29489 - RNA, 22 nt, Human
uuccuaacucuggcaccuaguc

SEQ ID NO: 29490 - RNA, 22 nt, Human
uuccuaaucacgaacauuauuu

SEQ ID NO: 29491 - RNA, 22 nt, Human
uuccuaauggcaaaacauguuu

SEQ ID NO: 29492 - RNA, 22 nt, Human
uuccuaaugucuacuuuaguuc

SEQ ID NO: 29493 - RNA, 18 nt, Human
uuccuaggaacuaagcuu

SEQ ID NO: 29494 - RNA, 22 nt, Human
uuccuagggcagagccgcuggg

SEQ ID NO: 29495 - RNA, 22 nt, Human
uuccuaugaauaaauauugagc

SEQ ID NO: 29496 - RNA, 22 nt, Human
uuccucacacucccccauucga

SEQ ID NO: 29497 - RNA, 22 nt, Human
uuccucagccaaggcugggauc

SEQ ID NO: 29498 - RNA, 22 nt, Human
uuccucagccagcacuuagggg

SEQ ID NO: 29499 - RNA, 22 nt, Human
uuccucagcucagcgagagaga

SEQ ID NO: 29500 - RNA, 22 nt, Human
uuccucagcuguguccuggcga

SEQ ID NO: 29501 - RNA, 22 nt, Human
uucuaccuccuagaaaaucugg

SEQ ID NO: 29502 - RNA, 19 nt, Human
uucuacuuuguuucccccu

SEQ ID NO: 29503 - RNA, 21 nt, Human
uucuagaaaaguaugggacug

SEQ ID NO: 29504 - RNA, 22 nt, Human
uucuagaaacuggagcaaacag

SEQ ID NO: 29505 - RNA, 19 nt, Human
uucuagaacuguucucuca

SEQ ID NO: 29506 - RNA, 22 nt, Human
uucuagaagugucuaugucugu

SEQ ID NO: 29507 - RNA, 22 nt, Human
uucuagaauccuugucuacuuu

SEQ ID NO: 29508 - RNA, 22 nt, Human
uucuagacuguguacagauuca

SEQ ID NO: 29509 - RNA, 22 nt, Human
uucuagacuucaggcauucucc

SEQ ID NO: 29510 - RNA, 22 nt, Human
uucuagaugcuuauaggcauau

SEQ ID NO: 29511 - RNA, 22 nt, Human
uucuagcacaagauaugaaagu

SEQ ID NO: 29512 - RNA, 22 nt, Human
uucuaggaugcugaugagaccc

SEQ ID NO: 29513 - RNA, 19 nt, Human
uucuaggcuaugaagcagu

SEQ ID NO: 29514 - RNA, 22 nt, Human
uucuaguuaaaguauguauuag

SEQ ID NO: 29515 - RNA, 22 nt, Human
uucuaguuacagaagccuugcu

SEQ ID NO: 29516 - RNA, 22 nt, Human
uucuaguuacucuuaaaugcug

SEQ ID NO: 29517 - RNA, 22 nt, Human
uucuaguucauauucucaaaga

SEQ ID NO: 29518 - RNA, 22 nt, Human
uucuaguucuuagagaauuggu

SEQ ID NO: 29519 - RNA, 22 nt, Human
uucuaguugagggagacaaaua

SEQ ID NO: 29520 - RNA, 22 nt, Human
uucuaguuuagggcucuucaac

SEQ ID NO: 29521 - RNA, 22 nt, Human
uucuaguuuucaguccaccagg

SEQ ID NO: 29522 - RNA, 22 nt, Human
uucuauaaaugaauguguauau

SEQ ID NO: 29523 - RNA, 20 nt, Human
uucuauacauaucacugaaa

SEQ ID NO: 29524 - RNA, 22 nt, Human
uucuauaugacuucuaggcagg

SEQ ID NO: 29525 - RNA, 22 nt, Human
uucuaucucauauguguucuag

SEQ ID NO: 29526 - RNA, 22 nt, Human
uucuauguaccuagcguuguau

SEQ ID NO: 29527 - RNA, 22 nt, Human
uucuaugugaacguuauaguuu

SEQ ID NO: 29528 - RNA, 22 nt, Human
uucuauugaaugauaaucuaua

SEQ ID NO: 29529 - RNA, 22 nt, Human
uucuauuguaccuuuucucuca

SEQ ID NO: 29530 - RNA, 22 nt, Human
uucucaaagaaagcugucauua

SEQ ID NO: 29531 - RNA, 19 nt, Human
uucucagagcuugcagcac

SEQ ID NO: 29532 - RNA, 22 nt, Human
uucucagaggagucgggagcug

SEQ ID NO: 29533 - RNA, 22 nt, Human
uucucagaggcugcuaagugca

SEQ ID NO: 29534 - RNA, 22 nt, Human
uucucagauauuuacugagcau

SEQ ID NO: 29535 - RNA, 22 nt, Human
uucucaggcucugagacccuau

SEQ ID NO: 29536 - RNA, 22 nt, Human
uucucagggucuggauggccug

SEQ ID NO: 29537 - RNA, 22 nt, Human
uucucaggguuggccucaaauc

SEQ ID NO: 29538 - RNA, 22 nt, Human
uucucagguagugcugaugcug

SEQ ID NO: 29539 - RNA, 23 nt, Human
uucucaguccugcccagggaggc

SEQ ID NO: 29540 - RNA, 22 nt, Human
uucucauagagacaugauuaua

SEQ ID NO: 29541 - RNA, 22 nt, Human
uucuccaacacaagcaugaugu

SEQ ID NO: 29542 - RNA, 18 nt, Human
uucuccagaaaacauagc

SEQ ID NO: 29543 - RNA, 22 nt, Human
uucuccagacaggcagagggaa

SEQ ID NO: 29544 - RNA, 22 nt, Human
uucuccagagggcucugcagga

SEQ ID NO: 29545 - RNA, 22 nt, Human
uucuccagagguggcuagaguu

SEQ ID NO: 29546 - RNA, 22 nt, Human
uucuccagaguuucucucacug

SEQ ID NO: 29547 - RNA, 22 nt, Human
uucuccaggggaggguucucca

SEQ ID NO: 29548 - RNA, 22 nt, Human
uucucccacuccgugcuucagu

SEQ ID NO: 29549 - RNA, 22 nt, Human
uucucccagaccaaaggcagca

SEQ ID NO: 29550 - RNA, 22 nt, Human
uucuccccgucucucugaggcc

SEQ ID NO: 29551 - RNA, 22 nt, Human
uucuccgcuaaguucucugcag

SEQ ID NO: 29552 - RNA, 21 nt, Human
uucuccuccaaguugcuccug

SEQ ID NO: 29553 - RNA, 17 nt, Human
uucuccucuguguccuu

SEQ ID NO: 29554 - RNA, 22 nt, Human
uucuccucuguuaccuugcaaa

SEQ ID NO: 29555 - RNA, 22 nt, Human
uucuccugcgcaggcccaggga

SEQ ID NO: 29556 - RNA, 22 nt, Human
uucuccugggagggguugccca

SEQ ID NO: 29557 - RNA, 21 nt, Human
uucuccuucuugauccaagca

SEQ ID NO: 29558 - RNA, 22 nt, Human
uucuccuugguuuaugggacau

SEQ ID NO: 29559 - RNA, 22 nt, Human
uuacaauguaaggcaugguucu

SEQ ID NO: 29560 - RNA, 22 nt, Human
uuacacaaacacauuccagaua

SEQ ID NO: 29561 - RNA, 22 nt, Human
uuacacaaagcuccccaaauag

SEQ ID NO: 29562 - RNA, 22 nt, Human
uuacacaaguucuuuaaccuau

SEQ ID NO: 29563 - RNA, 22 nt, Human
uuacacacaauuagcauaguaa

SEQ ID NO: 29564 - RNA, 22 nt, Human
uuacacagaaacacuguucaga

SEQ ID NO: 29565 - RNA, 22 nt, Human
uuacacagaaauuuuauugccu

SEQ ID NO: 29566 - RNA, 22 nt, Human
uuacacagcuucuauccuugaa

SEQ ID NO: 29567 - RNA, 17 nt, Human
uuacacaggagagcucu

SEQ ID NO: 29568 - RNA, 22 nt, Human
uuacacagugcacaagcagagu

SEQ ID NO: 29569 - RNA, 22 nt, Human
uuacacaugcuuuguguguaug

SEQ ID NO: 29570 - RNA, 22 nt, Human
uuacacuaugaaugagaauaua

SEQ ID NO: 29571 - RNA, 22 nt, Human
uuacacucauauugcacuuacc

SEQ ID NO: 29572 - RNA, 19 nt, Human
uuacacuccugggcagugg

SEQ ID NO: 29573 - RNA, 22 nt, Human
uuacacucugguugugggccuu

SEQ ID NO: 29574 - RNA, 22 nt, Human
uuacacuuaccuguccauugaa

SEQ ID NO: 29575 - RNA, 22 nt, Human
uuacacuuggguguggauuuua

SEQ ID NO: 29576 - RNA, 20 nt, Human
uuacacuuuguagcauuuuu

SEQ ID NO: 29577 - RNA, 22 nt, Human
uuacagaaaagggguuguccuu

SEQ ID NO: 29578 - RNA, 22 nt, Human
uuacagaaaauguguuuuaacu

SEQ ID NO: 29579 - RNA, 22 nt, Human
uuacagaaagguugugggauag

SEQ ID NO: 29580 - RNA, 23 nt, Human
uuacagaaaguaugcuuuuguuu

SEQ ID NO: 29581 - RNA, 22 nt, Human
uuacagaaaguuucccaugccg

SEQ ID NO: 29582 - RNA, 22 nt, Human
uuacagaagaguaacuuggcaa

SEQ ID NO: 29583 - RNA, 22 nt, Human
uuacagaaggaacacuacucag

SEQ ID NO: 29584 - RNA, 22 nt, Human
uuacagaaguauugagagaucc

SEQ ID NO: 29585 - RNA, 22 nt, Human
uuacagaagugaaggccuuuaa

SEQ ID NO: 29586 - RNA, 22 nt, Human
uuacagaaguuucagcguuuua

SEQ ID NO: 29587 - RNA, 22 nt, Human
uuacagagcuggguggagagag

SEQ ID NO: 29588 - RNA, 22 nt, Human
uuacagaggcuuccagggccca

SEQ ID NO: 29589 - RNA, 22 nt, Human
uuacagaguagugcagaacuca

SEQ ID NO: 29590 - RNA, 22 nt, Human
uuacagaguucgcaccuggugg

SEQ ID NO: 29591 - RNA, 22 nt, Human
uuacagauggaucuagcaaaau

SEQ ID NO: 29592 - RNA, 22 nt, Human
uuacagauuaaaaugcugaggu

SEQ ID NO: 29593 - RNA, 21 nt, Human
uuacagcaauguuagcaggaa

SEQ ID NO: 29594 - RNA, 23 nt, Human
uuacagcuaacugcuguuauuag

SEQ ID NO: 29595 - RNA, 22 nt, Human
uuacaggaggugcuagguguuu

SEQ ID NO: 29596 - RNA, 22 nt, Human
uuacaggucugugucaucaucu

SEQ ID NO: 29597 - RNA, 22 nt, Human
uuacagguguggaaauugagua

SEQ ID NO: 29598 - RNA, 22 nt, Human
uuacaguaacauuuucagucug

SEQ ID NO: 29599 - RNA, 22 nt, Human
uuacaguaaucgaguguugugg

SEQ ID NO: 29600 - RNA, 22 nt, Human
uuacaguaauguauuauuuaac

SEQ ID NO: 29601 - RNA, 22 nt, Human
uuacaguaccuguauggccacu

SEQ ID NO: 29602 - RNA, 22 nt, Human
uuacaguagauacaaugaguaa

SEQ ID NO: 29603 - RNA, 22 nt, Human
uuacaguagauuuugaaugugg

SEQ ID NO: 29604 - RNA, 22 nt, Human
uuacaguagcuuuauuuggagu

SEQ ID NO: 29605 - RNA, 23 nt, Human
uuacaguaggaguuggaaaacca

SEQ ID NO: 29606 - RNA, 22 nt, Human
uuacaguauuggucacguuugu

SEQ ID NO: 29607 - RNA, 22 nt, Human
uuacaguauuguuaaacucuuu

SEQ ID NO: 29608 - RNA, 22 nt, Human
uuacaguggcagaguuggguag

SEQ ID NO: 29609 - RNA, 22 nt, Human
uuacaguuaaugugacuaacca

SEQ ID NO: 29610 - RNA, 22 nt, Human
uguacacauuuuuauguuaaca

SEQ ID NO: 29611 - RNA, 22 nt, Human
uguacagauugaucauggagag

SEQ ID NO: 29612 - RNA, 22 nt, Human
uguacagucaugcuuucuguuc

SEQ ID NO: 29613 - RNA, 22 nt, Human
uguacaguggaaaauggauucg

SEQ ID NO: 29614 - RNA, 22 nt, Human
uguacaguguaaauaaguggau

SEQ ID NO: 29615 - RNA, 22 nt, Human
uguacaguuuuaacucugaggg

SEQ ID NO: 29616 - RNA, 22 nt, Human
uguacauauauguauguacgca

SEQ ID NO: 29617 - RNA, 22 nt, Human
uguacaugaauaaaagaucuug

SEQ ID NO: 29618 - RNA, 22 nt, Human
uguacauugucacucaucaagu

SEQ ID NO: 29619 - RNA, 22 nt, Human
uguacauuuucucagaguuuau

SEQ ID NO: 29620 - RNA, 22 nt, Human
uguaccaaacccaucauaacua

SEQ ID NO: 29621 - RNA, 22 nt, Human
uguaccacucuacuaaggguuc

SEQ ID NO: 29622 - RNA, 23 nt, Human
uguaccaggaguuucagcagacu

SEQ ID NO: 29623 - RNA, 22 nt, Human
uguaccauaggucuaucauucu

SEQ ID NO: 29624 - RNA, 22 nt, Human
uguaccauauagaugguaccuu

SEQ ID NO: 29625 - RNA, 22 nt, Human
uguaccaugugacuggagucuu

SEQ ID NO: 29626 - RNA, 22 nt, Human
uguaccgccuugugggguuggg

SEQ ID NO: 29627 - RNA, 22 nt, Human
uguacuaaugcauuuaacuaac

SEQ ID NO: 29628 - RNA, 22 nt, Human
uguacuuaugagauccuagucg

SEQ ID NO: 29629 - RNA, 22 nt, Human
uguacuuauuuuaugucagcac

SEQ ID NO: 29630 - RNA, 22 nt, Human
uguacuuccccaaugacagcac

SEQ ID NO: 29631 - RNA, 22 nt, Human
uguagaaagcucuucugaaauc

SEQ ID NO: 29632 - RNA, 22 nt, Human
uguagauuuuggagucuacaag

SEQ ID NO: 29633 - RNA, 22 nt, Human
uguagcagaguaucucuguuuu

SEQ ID NO: 29634 - RNA, 22 nt, Human
uguagcagugucuaccacauua

SEQ ID NO: 29635 - RNA, 23 nt, Human
uguagcaucucuuauuucucagc

SEQ ID NO: 29636 - RNA, 23 nt, Human
uguagcugucugagcagacacug

SEQ ID NO: 29637 - RNA, 17 nt, Human
uguagcuucuccuucuc

SEQ ID NO: 29638 - RNA, 22 nt, Human
uguaggaauuccagugacuuca

SEQ ID NO: 29639 - RNA, 22 nt, Human
uguaggauguaaggcaggcauc

SEQ ID NO: 29640 - RNA, 22 nt, Human
uguaggcugaagaugaagugga

SEQ ID NO: 29641 - RNA, 22 nt, Human
uguagguaaaagcaucuagugu

SEQ ID NO: 29642 - RNA, 22 nt, Human
uguaggucaaguccauugugcu

SEQ ID NO: 29643 - RNA, 22 nt, Human
uguaguagcauucacgaagugu

SEQ ID NO: 29644 - RNA, 22 nt, Human
uguaguccaggaauugugucug

SEQ ID NO: 29645 - RNA, 22 nt, Human
uguaguuaggcugggaauuggc

SEQ ID NO: 29646 - RNA, 21 nt, Human
uguauaacuucucucccucag

SEQ ID NO: 29647 - RNA, 22 nt, Human
uguauacaggcauaagagauac

SEQ ID NO: 29648 - RNA, 22 nt, Human
uguauacauacauaugugugug

SEQ ID NO: 29649 - RNA, 22 nt, Human
uguauauacauacacacaugaa

SEQ ID NO: 29650 - RNA, 22 nt, Human
uguauauauuucuuucauucua

SEQ ID NO: 29651 - RNA, 22 nt, Human
uguauaugagucugaguguaca

SEQ ID NO: 29652 - RNA, 22 nt, Human
uguauauguguauuuuaugaca

SEQ ID NO: 29653 - RNA, 22 nt, Human
uguauauugccugagucuuucc

SEQ ID NO: 29654 - RNA, 22 nt, Human
uguaucuguaaucccagaucaa

SEQ ID NO: 29655 - RNA, 22 nt, Human
uguaucugugauguagggguuu

SEQ ID NO: 29656 - RNA, 22 nt, Human
uggccugccccgagauccuggc

SEQ ID NO: 29657 - RNA, 22 nt, Human
uggccugcuuucauuugaugcu

SEQ ID NO: 29658 - RNA, 22 nt, Human
uggccuggaaccuggcagggac

SEQ ID NO: 29659 - RNA, 18 nt, Human
uggccuggagacaacucu

SEQ ID NO: 29660 - RNA, 22 nt, Human
uggccuggccacauccagcagg

SEQ ID NO: 29661 - RNA, 22 nt, Human
uggccuggcucacagugagauu

SEQ ID NO: 29662 - RNA, 22 nt, Human
uggccugggccggcagauauac

SEQ ID NO: 29663 - RNA, 22 nt, Human
uggccuggggaagaccaugggc

SEQ ID NO: 29664 - RNA, 22 nt, Human
uggccugguuauauugcuauca

SEQ ID NO: 29665 - RNA, 22 nt, Human
uggccuguguggcuuccuggga

SEQ ID NO: 29666 - RNA, 22 nt, Human
uggccuugauaacuggggagag

SEQ ID NO: 29667 - RNA, 22 nt, Human
uggccuugggcagguggccugc

SEQ ID NO: 29668 - RNA, 20 nt, Human
uggccuuggggagcucacac

SEQ ID NO: 29669 - RNA, 22 nt, Human
uggccuuggucacaaugcaaac

SEQ ID NO: 29670 - RNA, 20 nt, Human
uggccuuuaaauaguauucc

SEQ ID NO: 29671 - RNA, 20 nt, Human
uggccuuuuggcuuggagcu

SEQ ID NO: 29672 - RNA, 22 nt, Human
uggcggugacggcggcgccugg

SEQ ID NO: 29673 - RNA, 22 nt, Human
uggcgugcccuccagacuuggc

SEQ ID NO: 29674 - RNA, 22 nt, Human
uggcuaaacccuaguaaauuaa

SEQ ID NO: 29675 - RNA, 22 nt, Human
uggcuaacaaacaagacauuag

SEQ ID NO: 29676 - RNA, 22 nt, Human
uggcuaagcaugcuccagcugc

SEQ ID NO: 29677 - RNA, 22 nt, Human
uggcuaaucuuaaggcuuuugc

SEQ ID NO: 29678 - RNA, 19 nt, Human
uggcuaauuuuauagaggc

SEQ ID NO: 29679 - RNA, 22 nt, Human
uggcuacaucacagagaauucc

SEQ ID NO: 29680 - RNA, 22 nt, Human
uggcuagauuuauugcugagca

SEQ ID NO: 29681 - RNA, 22 nt, Human
uggcuagcaacucaacuguuaa

SEQ ID NO: 29682 - RNA, 22 nt, Human
uggcuaggaauccaugacucuc

SEQ ID NO: 29683 - RNA, 22 nt, Human
uggcuagguagcuuucugcugu

SEQ ID NO: 29684 - RNA, 22 nt, Human
uggcuauugagugaucucuaga

SEQ ID NO: 29685 - RNA, 22 nt, Human
uggcucaagugauccuccugcc

SEQ ID NO: 29686 - RNA, 22 nt, Human
uggcucacaggacucucugggc

SEQ ID NO: 29687 - RNA, 22 nt, Human
uggcucagaacuacuucuaguu

SEQ ID NO: 29688 - RNA, 22 nt, Human
uggcucagaagaaaagguaaac

SEQ ID NO: 29689 - RNA, 22 nt, Human
uggcucagauaauucaaggggc

SEQ ID NO: 29690 - RNA, 18 nt, Human
uggcucagauggcuuuaa

SEQ ID NO: 29691 - RNA, 22 nt, Human
uggcucagauuuuuguaggcuu

SEQ ID NO: 29692 - RNA, 22 nt, Human
uggcucagcaagacauugaccu

SEQ ID NO: 29693 - RNA, 22 nt, Human
uggcucagcugacucggcuucu

SEQ ID NO: 29694 - RNA, 22 nt, Human
uggcucagcugucacagccugg

SEQ ID NO: 29695 - RNA, 22 nt, Human
uggcucaggcuugaaaauagau

SEQ ID NO: 29696 - RNA, 22 nt, Human
uggcucaggggucuggcucugu

SEQ ID NO: 29697 - RNA, 22 nt, Human
uggcucaggguccccaaauggu

SEQ ID NO: 29698 - RNA, 22 nt, Human
uggcucaguaaucgagucuccu

SEQ ID NO: 29699 - RNA, 22 nt, Human
uggcucagucauggaugaguaa

SEQ ID NO: 29700 - RNA, 22 nt, Human
uggcucagugacauuccuccca

SEQ ID NO: 29701 - RNA, 22 nt, Human
uggcucaguggcagccgcagcu

SEQ ID NO: 29702 - RNA, 21 nt, Human
uggcucaguugcugggcacag

SEQ ID NO: 29703 - RNA, 22 nt, Human
uggcucaguuuagcagcucagu

SEQ ID NO: 29704 - RNA, 22 nt, Human
uggcucaguuucugcccagcug

SEQ ID NO: 29705 - RNA, 22 nt, Human
uggcucaguuugggggauugaa

SEQ ID NO: 29706 - RNA, 22 nt, Human
uggcucaucuaucagaaagucc

SEQ ID NO: 29707 - RNA, 22 nt, Human
uggcucaugccuguaaucuuag

SEQ ID NO: 29708 - RNA, 22 nt, Human
uggcucauucuacucucccugg

SEQ ID NO: 29709 - RNA, 22 nt, Human
uggcuccaccgccgcggagcuc

SEQ ID NO: 29710 - RNA, 22 nt, Human
uggcuccagaucugucuccugu

SEQ ID NO: 29711 - RNA, 22 nt, Human
uggcuccagcccugagcaagcu

SEQ ID NO: 29712 - RNA, 22 nt, Human
uggcuccaggggacacgcagua

SEQ ID NO: 29713 - RNA, 23 nt, Human
uggcuccaugaaaauuacgagga

SEQ ID NO: 29714 - RNA, 22 nt, Human
uggcuccauucuuuaugaguug

SEQ ID NO: 29715 - RNA, 21 nt, Human
uggcucccuugaauugucugu

SEQ ID NO: 29716 - RNA, 22 nt, Human
uggcuccugcauuugugcuaac

SEQ ID NO: 29717 - RNA, 18 nt, Human
uggcuccugccuccugca

SEQ ID NO: 29718 - RNA, 19 nt, Human
uggcuccugccugccuucu

SEQ ID NO: 29719 - RNA, 22 nt, Human
uguaucuucaguuugucuuucc

SEQ ID NO: 29720 - RNA, 22 nt, Human
uguaugaagccagaaucuguuu

SEQ ID NO: 29721 - RNA, 22 nt, Human
uguaugaaucucauuuguuuaa

SEQ ID NO: 29722 - RNA, 22 nt, Human
uguaugcacauggauaaguaug

SEQ ID NO: 29723 - RNA, 22 nt, Human
uguaugcaucuuugauaaauag

SEQ ID NO: 29724 - RNA, 22 nt, Human
uguaugcuuuccaaaaaugcug

SEQ ID NO: 29725 - RNA, 22 nt, Human
uguaugcuuuccuucuuucugg

SEQ ID NO: 29726 - RNA, 22 nt, Human
uguauguaugcaucuuuuaugu

SEQ ID NO: 29727 - RNA, 22 nt, Human
uguaugugcuugagaagguggg

SEQ ID NO: 29728 - RNA, 23 nt, Human
uguauuacagaugcaucagugau

SEQ ID NO: 29729 - RNA, 22 nt, Human
uguauuagagcaguagaauuau

SEQ ID NO: 29730 - RNA, 22 nt, Human
uguauuagaucugagaacuucu

SEQ ID NO: 29731 - RNA, 22 nt, Human
uguauuaugauuguuguucaug

SEQ ID NO: 29732 - RNA, 22 nt, Human
uguauucagggacauauaugua

SEQ ID NO: 29733 - RNA, 22 nt, Human
uguauucagugccuagcauaug

SEQ ID NO: 29734 - RNA, 22 nt, Human
uguauucuuaguuuuaaucaga

SEQ ID NO: 29735 - RNA, 20 nt, Human
uguauucuucuccuuccucc

SEQ ID NO: 29736 - RNA, 20 nt, Human
uguauucuuugcucuccacu

SEQ ID NO: 29737 - RNA, 22 nt, Human
uguauuugaaacagugcauggg

SEQ ID NO: 29738 - RNA, 22 nt, Human
ugucaaaaccagcaauuuuguu

SEQ ID NO: 29739 - RNA, 22 nt, Human
ugucaaaaccuuggaggcaagg

SEQ ID NO: 29740 - RNA, 22 nt, Human
ugucaaagccugaaucacauag

SEQ ID NO: 29741 - RNA, 22 nt, Human
ugucaaaguaucagucucuggc

SEQ ID NO: 29742 - RNA, 22 nt, Human
ugucaaauuuuuauugcaguau

SEQ ID NO: 29743 - RNA, 22 nt, Human
ugucaacaggcuuucuaaggca

SEQ ID NO: 29744 - RNA, 22 nt, Human
ugucaacauuggcugacaguug

SEQ ID NO: 29745 - RNA, 22 nt, Human
ugucaaccagguauuuuggucu

SEQ ID NO: 29746 - RNA, 22 nt, Human
ugucaagucuaguugcuggcuu

SEQ ID NO: 29747 - RNA, 22 nt, Human
ugucaagugauuagccauaaug

SEQ ID NO: 29748 - RNA, 22 nt, Human
ugucaaguuguggcaugucuaa

SEQ ID NO: 29749 - RNA, 22 nt, Human
ugucaauaacauuuacuucuau

SEQ ID NO: 29750 - RNA, 22 nt, Human
ugucaauaucaggcagaccuaa

SEQ ID NO: 29751 - RNA, 22 nt, Human
ugucaaugaagauaugaauaau

SEQ ID NO: 29752 - RNA, 22 nt, Human
ugucaauguguacaggagcuca

SEQ ID NO: 29753 - RNA, 22 nt, Human
ugucaauuaugugacacaucuu

SEQ ID NO: 29754 - RNA, 22 nt, Human
ugucacaacagaggaacugaau

SEQ ID NO: 29755 - RNA, 22 nt, Human
ugucacagaucguuuuugagcu

SEQ ID NO: 29756 - RNA, 22 nt, Human
ugucacauaauuuaucuguagg

SEQ ID NO: 29757 - RNA, 22 nt, Human
ugucacaucaggugguggcugu

SEQ ID NO: 29758 - RNA, 22 nt, Human
ugucacaugaaacuugcucauc

SEQ ID NO: 29759 - RNA, 22 nt, Human
ugucacaugaagccaacauagc

SEQ ID NO: 29760 - RNA, 22 nt, Human
ugucacauuauaugugaggaua

SEQ ID NO: 29761 - RNA, 23 nt, Human
ugucacauuuaguuggcauuguu

SEQ ID NO: 29762 - RNA, 22 nt, Human
ugucaccaguuccaggaaauaa

SEQ ID NO: 29763 - RNA, 22 nt, Human
ugucaccucuuuggcugcagcu

SEQ ID NO: 29764 - RNA, 22 nt, Human
ugucaccuugcucauccucgga

SEQ ID NO: 29765 - RNA, 22 nt, Human
ugucacuucaguuuugaaacaa

SEQ ID NO: 29766 - RNA, 21 nt, Human
ugucagagcuuguaggacauu

SEQ ID NO: 29767 - RNA, 22 nt, Human
ugucagcagcugguuugcuguu

SEQ ID NO: 29768 - RNA, 22 nt, Human
ugucagcaugucagccaaagau

SEQ ID NO: 29769 - RNA, 22 nt, Human
ugucagcauugcgucacugagc

SEQ ID NO: 29770 - RNA, 22 nt, Human
ugucagcauuuaaggaguaagg

SEQ ID NO: 29771 - RNA, 22 nt, Human
ugucagcucccagucagagaga

SEQ ID NO: 29772 - RNA, 22 nt, Human
ugucaggaggguccagagaaaa

SEQ ID NO: 29773 - RNA, 22 nt, Human
ugucaggcaaaggaagguauuu

SEQ ID NO: 29774 - RNA, 22 nt, Human
ugucaggucucugugaugguaa

SEQ ID NO: 29775 - RNA, 22 nt, Human
ugucaguagauuauuacaauaa

SEQ ID NO: 29776 - RNA, 22 nt, Human
ugucagugacagauuuaugauc

SEQ ID NO: 29777 - RNA, 22 nt, Human
ugucagugcacagaugguugau

SEQ ID NO: 29778 - RNA, 22 nt, Human
ugucagugccaacuuugcuggu

SEQ ID NO: 29779 - RNA, 22 nt, Human
ugggccaggggccucuucugau

SEQ ID NO: 29780 - RNA, 22 nt, Human
ugggccaggucugcggucauuu

SEQ ID NO: 29781 - RNA, 22 nt, Human
ugggccaggucugugucagcug

SEQ ID NO: 29782 - RNA, 22 nt, Human
ugggccaggugcagugcuuuag

SEQ ID NO: 29783 - RNA, 21 nt, Human
ugggccaguagaaaggaaggc

SEQ ID NO: 29784 - RNA, 17 nt, Human
ugggccaguagaaggga

SEQ ID NO: 29785 - RNA, 22 nt, Human
ugggccaguagcuacucgcaag

SEQ ID NO: 29786 - RNA, 22 nt, Human
ugggccaguccagccccaggga

SEQ ID NO: 29787 - RNA, 22 nt, Human
ugggccaguccugccuaaggug

SEQ ID NO: 29788 - RNA, 22 nt, Human
ugggccaguuauuucaccucug

SEQ ID NO: 29789 - RNA, 22 nt, Human
ugggccaguuucucauugaaau

SEQ ID NO: 29790 - RNA, 22 nt, Human
ugggccccagcacgucugggga

SEQ ID NO: 29791 - RNA, 22 nt, Human
ugggccguggagcacucugaga

SEQ ID NO: 29792 - RNA, 19 nt, Human
ugggccucacaaugcuccc

SEQ ID NO: 29793 - RNA, 22 nt, Human
ugggccucaguuugcuuaaugu

SEQ ID NO: 29794 - RNA, 22 nt, Human
ugggccuccgcauggcccagcg

SEQ ID NO: 29795 - RNA, 22 nt, Human
ugggccuccuggaagaaugugg

SEQ ID NO: 29796 - RNA, 22 nt, Human
ugggccucggagcacaggagac

SEQ ID NO: 29797 - RNA, 19 nt, Human
ugggccucucauaucugcc

SEQ ID NO: 29798 - RNA, 22 nt, Human
ugggccugaaauucccauuuua

SEQ ID NO: 29799 - RNA, 22 nt, Human
ugggccugaaggagcugcgccc

SEQ ID NO: 29800 - RNA, 22 nt, Human
ugggccugacacuuacuaggga

SEQ ID NO: 29801 - RNA, 22 nt, Human
ugggccugacucaccugccucc

SEQ ID NO: 29802 - RNA, 22 nt, Human
ugggccugauucuugaauccug

SEQ ID NO: 29803 - RNA, 22 nt, Human
ugggccuggaguuuguccagag

SEQ ID NO: 29804 - RNA, 22 nt, Human
ugggccuggcccuguggaggag

SEQ ID NO: 29805 - RNA, 22 nt, Human
ugggccugggagggcagacgcu

SEQ ID NO: 29806 - RNA, 22 nt, Human
ugggccugggcuggacagccug

SEQ ID NO: 29807 - RNA, 22 nt, Human
ugggccuguggcuuggcucuag

SEQ ID NO: 29808 - RNA, 22 nt, Human
ugggccuucuaaucuggucccu

SEQ ID NO: 29809 - RNA, 22 nt, Human
ugggccuucucaaugcacugga

SEQ ID NO: 29810 - RNA, 22 nt, Human
ugggccuuggaucgcuaagcug

SEQ ID NO: 29811 - RNA, 22 nt, Human
ugggccuuguccccucagcugu

SEQ ID NO: 29812 - RNA, 23 nt, Human
ugggcggggcuuuucacucugcc

SEQ ID NO: 29813 - RNA, 22 nt, Human
ugggcucaaacuggagguuguu

SEQ ID NO: 29814 - RNA, 21 nt, Human
ugggcucagccccagcccugc

SEQ ID NO: 29815 - RNA, 22 nt, Human
ugggcuccagcaccugugcucu

SEQ ID NO: 29816 - RNA, 22 nt, Human
ugggcucucagucagacuggca

SEQ ID NO: 29817 - RNA, 22 nt, Human
ugggcucuccuggaggacaaca

SEQ ID NO: 29818 - RNA, 22 nt, Human
ugggcucugaagggucccggau

SEQ ID NO: 29819 - RNA, 22 nt, Human
ugggcucugcaucagugcccau

SEQ ID NO: 29820 - RNA, 22 nt, Human
ugggcucugcugcguaccaguu

SEQ ID NO: 29821 - RNA, 22 nt, Human
ugggcucuggggaaacugugau

SEQ ID NO: 29822 - RNA, 22 nt, Human
ugggcucugguuuccuggcugg

SEQ ID NO: 29823 - RNA, 22 nt, Human
ugggcucuuccuauaguuuaua

SEQ ID NO: 29824 - RNA, 21 nt, Human
ugggcucuuuaacccaggcac

SEQ ID NO: 29825 - RNA, 22 nt, Human
ugggcugagaguaccuuauaaa

SEQ ID NO: 29826 - RNA, 20 nt, Human
ugggcugaggaucaggugcc

SEQ ID NO: 29827 - RNA, 22 nt, Human
ugggcugaggggccuugaugac

SEQ ID NO: 29828 - RNA, 22 nt, Human
ugggcugaguguggaacuaguu

SEQ ID NO: 29829 - RNA, 22 nt, Human
ugggcugcaccuuuguaaaucu

SEQ ID NO: 29830 - RNA, 22 nt, Human
ugggcugcagggguugagagcu

SEQ ID NO: 29831 - RNA, 22 nt, Human
ugggcugcccugaugguccuca

SEQ ID NO: 29832 - RNA, 22 nt, Human
ugggcugcggauaggccucgga

SEQ ID NO: 29833 - RNA, 22 nt, Human
ugggcugcugagaaugagagag

SEQ ID NO: 29834 - RNA, 22 nt, Human
ugggcugcuguuacaggggcug

SEQ ID NO: 29835 - RNA, 22 nt, Human
ugggcugcuuccucagcugaga

SEQ ID NO: 29836 - RNA, 22 nt, Human
ugggcugcuucuauuggugguc

SEQ ID NO: 29837 - RNA, 22 nt, Human
ugggcuguggagcaccuuugca

SEQ ID NO: 29838 - RNA, 22 nt, Human
ugggcuuaggucggaggcggcc

SEQ ID NO: 29839 - RNA, 22 nt, Human
ugggcuucauaauugguccuag

SEQ ID NO: 29840 - RNA, 18 nt, Human
ugggcuugaaagcaaggu

SEQ ID NO: 29841 - RNA, 20 nt, Human
uggggaaagccaucgaugag

SEQ ID NO: 29842 - RNA, 22 nt, Human
uggggaaaggaaaguuaaccug

SEQ ID NO: 29843 - RNA, 22 nt, Human
uggggaaaggagagcauuauuu

SEQ ID NO: 29844 - RNA, 22 nt, Human
uggggaagacagcagacacugu

SEQ ID NO: 29845 - RNA, 22 nt, Human
uggggaaggaucaccacaaucu

SEQ ID NO: 29846 - RNA, 22 nt, Human
uggggaaggcggagcuugcagc

SEQ ID NO: 29847 - RNA, 22 nt, Human
uggggagagaccggaauguuuc

SEQ ID NO: 29848 - RNA, 22 nt, Human
uggggagcccacucaccucccc

SEQ ID NO: 29849 - RNA, 22 nt, Human
uggggaggauaugugaguuauu

SEQ ID NO: 29850 - RNA, 22 nt, Human
ugugugcacgcugggagcugga

SEQ ID NO: 29851 - RNA, 22 nt, Human
ugugugcacguacauacuguau

SEQ ID NO: 29852 - RNA, 22 nt, Human
ugugugcacuuaaugcaaucau

SEQ ID NO: 29853 - RNA, 22 nt, Human
ugugugcagcugaaaagcgcug

SEQ ID NO: 29854 - RNA, 22 nt, Human
ugugugcauucacaugcaugcc

SEQ ID NO: 29855 - RNA, 22 nt, Human
ugugugccagggcaugcacagg

SEQ ID NO: 29856 - RNA, 19 nt, Human
ugugugcccucaccacaua

SEQ ID NO: 29857 - RNA, 22 nt, Human
ugugugcuaauguaugcucuaa

SEQ ID NO: 29858 - RNA, 20 nt, Human
ugugugcuaggacuacagug

SEQ ID NO: 29859 - RNA, 22 nt, Human
ugugugcucuaaugccuaguac

SEQ ID NO: 29860 - RNA, 19 nt, Human
ugugugcugacugccagag

SEQ ID NO: 29861 - RNA, 22 nt, Human
uguguggcguugcguggcuagg

SEQ ID NO: 29862 - RNA, 22 nt, Human
uguguggguacagaugauuguu

SEQ ID NO: 29863 - RNA, 19 nt, Human
uguguggguuuagaguagu

SEQ ID NO: 29864 - RNA, 19 nt, Human
ugugugguuggugaaacuc

SEQ ID NO: 29865 - RNA, 22 nt, Human
uguguguaauguuucucucuuc

SEQ ID NO: 29866 - RNA, 21 nt, Human
uguguguaugcacacacaugc

SEQ ID NO: 29867 - RNA, 22 nt, Human
uguguguauguuuacuuuuccu

SEQ ID NO: 29868 - RNA, 22 nt, Human
ugugugucacugaaagaaaucu

SEQ ID NO: 29869 - RNA, 22 nt, Human
ugugugucuggaagcucaggga

SEQ ID NO: 29870 - RNA, 22 nt, Human
ugugugucuuugccuccucuca

SEQ ID NO: 29871 - RNA, 22 nt, Human
ugugugugacucauacuagaac

SEQ ID NO: 29872 - RNA, 22 nt, Human
ugugugugaguccuggcuuucc

SEQ ID NO: 29873 - RNA, 22 nt, Human
ugugugugcaggagagcaggug

SEQ ID NO: 29874 - RNA, 21 nt, Human
ugugugugcaggcacacacac

SEQ ID NO: 29875 - RNA, 22 nt, Human
uguguguggggaggcagcagau

SEQ ID NO: 29876 - RNA, 22 nt, Human
uguguguguaaaagcauuuaua

SEQ ID NO: 29877 - RNA, 22 nt, Human
ugugugugugcgcgcacgcaua

SEQ ID NO: 29878 - RNA, 22 nt, Human
uguguguguuccuccucagcua

SEQ ID NO: 29879 - RNA, 22 nt, Human
uguguguguuuauaaaucuaaa

SEQ ID NO: 29880 - RNA, 22 nt, Human
uguguguuaacuuauuuaaugu

SEQ ID NO: 29881 - RNA, 22 nt, Human
uguguuaauuuucccuuucucu

SEQ ID NO: 29882 - RNA, 22 nt, Human
uguguucaguaugacauucaca

SEQ ID NO: 29883 - RNA, 23 nt, Human
uguguucagucaaggaucagagu

SEQ ID NO: 29884 - RNA, 22 nt, Human
uguguucaucaugauaucaggu

SEQ ID NO: 29885 - RNA, 22 nt, Human
uguguucauuucucucugcugu

SEQ ID NO: 29886 - RNA, 22 nt, Human
uguguuccugccuggcucuggu

SEQ ID NO: 29887 - RNA, 22 nt, Human
uguguuggcuugccuguuaggc

SEQ ID NO: 29888 - RNA, 23 nt, Human
uguguuuaccugaggaucuuguu

SEQ ID NO: 29889 - RNA, 22 nt, Human
uguguuuagagagcacauucag

SEQ ID NO: 29890 - RNA, 22 nt, Human
uguguuuauaguguaucuucca

SEQ ID NO: 29891 - RNA, 22 nt, Human
uguguuugaguccucacagugc

SEQ ID NO: 29892 - RNA, 22 nt, Human
uguguuugggggagaugcauuu

SEQ ID NO: 29893 - RNA, 22 nt, Human
uguguuuguuagacuaauguua

SEQ ID NO: 29894 - RNA, 22 nt, Human
uguguuuuccagaaugguguuu

SEQ ID NO: 29895 - RNA, 22 nt, Human
uguuaaaccaguuuugcaucau

SEQ ID NO: 29896 - RNA, 22 nt, Human
uguuaaacucguagguuaggcu

SEQ ID NO: 29897 - RNA, 18 nt, Human
uguuaaaugaagauuugc

SEQ ID NO: 29898 - RNA, 22 nt, Human
uguuaaauguuuugcuaguguc

SEQ ID NO: 29899 - RNA, 22 nt, Human
uguuaacacaauucuggagaga

SEQ ID NO: 29900 - RNA, 22 nt, Human
uguuaacagccagauuugguga

SEQ ID NO: 29901 - RNA, 15 nt, Human
uguuaacagcuggga

SEQ ID NO: 29902 - RNA, 22 nt, Human
uguuaacauaguggcgcaucug

SEQ ID NO: 29903 - RNA, 22 nt, Human
uguuaacaucuuggacucguga

SEQ ID NO: 29904 - RNA, 22 nt, Human
uguuaacauguguauuguauga

SEQ ID NO: 29905 - RNA, 22 nt, Human
uguuaagagaagcucucucuga

SEQ ID NO: 29906 - RNA, 22 nt, Human
uguuaaggggauauagcagggc

SEQ ID NO: 29907 - RNA, 23 nt, Human
uguuaauacaucugccacucauu

SEQ ID NO: 29908 - RNA, 22 nt, Human
uguuaauggcugaagacauccu

SEQ ID NO: 29909 - RNA, 17 nt, Human
uguuaauuccaaugaua

SEQ ID NO: 29910 - RNA, 22 nt, Human
uguuacaaaugcggaguuugug

SEQ ID NO: 29911 - RNA, 22 nt, Human
uguuacaagucuugagguacuu

SEQ ID NO: 29912 - RNA, 22 nt, Human
uguuacaauauuaucaacugag

SEQ ID NO: 29913 - RNA, 22 nt, Human
uucuccuuuguaauucucaucc

SEQ ID NO: 29914 - RNA, 22 nt, Human
uucuccuuuuccaguucccagu

SEQ ID NO: 29915 - RNA, 22 nt, Human
uucucuaaaauuaagugaggua

SEQ ID NO: 29916 - RNA, 22 nt, Human
uucucuaaacauauuggaucug

SEQ ID NO: 29917 - RNA, 22 nt, Human
uucucuaaagaguuaggccaag

SEQ ID NO: 29918 - RNA, 22 nt, Human
uucucuaaggcuuggcuucccu

SEQ ID NO: 29919 - RNA, 22 nt, Human
uucucuaauggugaugauuaga

SEQ ID NO: 29920 - RNA, 22 nt, Human
uucucuacuugagauuuuaaug

SEQ ID NO: 29921 - RNA, 22 nt, Human
uucucuagguuuuagaugaaga

SEQ ID NO: 29922 - RNA, 22 nt, Human
uucucuaguuuugacgaggauu

SEQ ID NO: 29923 - RNA, 22 nt, Human
uucucuauguguguuguaguuu

SEQ ID NO: 29924 - RNA, 19 nt, Human
uucucuauuaugucuucuc

SEQ ID NO: 29925 - RNA, 22 nt, Human
uucucucaguuaaacuuuguga

SEQ ID NO: 29926 - RNA, 22 nt, Human
uucucuccagacugcagugggu

SEQ ID NO: 29927 - RNA, 22 nt, Human
uucucuccaguccuggauucug

SEQ ID NO: 29928 - RNA, 21 nt, Human
uucucuccauaugcccagccc

SEQ ID NO: 29929 - RNA, 17 nt, Human
uucucugagcuguauug

SEQ ID NO: 29930 - RNA, 22 nt, Human
uucucugcauuguaaagagcca

SEQ ID NO: 29931 - RNA, 22 nt, Human
uucucugccucacaggucuaag

SEQ ID NO: 29932 - RNA, 22 nt, Human
uucucugccucuagcuauauuc

SEQ ID NO: 29933 - RNA, 22 nt, Human
uucucuggacagugaagagagg

SEQ ID NO: 29934 - RNA, 22 nt, Human
uucucuggagaguaucuucuua

SEQ ID NO: 29935 - RNA, 22 nt, Human
uucucuggagggcugcccggcc

SEQ ID NO: 29936 - RNA, 22 nt, Human
uucucuggauguuucucaguca

SEQ ID NO: 29937 - RNA, 22 nt, Human
uucucuggccauagcuggcuag

SEQ ID NO: 29938 - RNA, 21 nt, Human
uucucuggcuucuguagcugg

SEQ ID NO: 29939 - RNA, 22 nt, Human
uucucugggacaggaacaguuu

SEQ ID NO: 29940 - RNA, 22 nt, Human
uucucugguuugcuguuucuga

SEQ ID NO: 29941 - RNA, 22 nt, Human
uucucuguuuuccccucgaugu

SEQ ID NO: 29942 - RNA, 22 nt, Human
uucucuuagcacuuuguguuac

SEQ ID NO: 29943 - RNA, 22 nt, Human
uucucuucacagggaucauccu

SEQ ID NO: 29944 - RNA, 22 nt, Human
uucucuucccacuuucuguauu

SEQ ID NO: 29945 - RNA, 22 nt, Human
uucucuugacuaccaguuagga

SEQ ID NO: 29946 - RNA, 22 nt, Human
uucucuugugccaaguuguugc

SEQ ID NO: 29947 - RNA, 22 nt, Human
uucucuuuucaccaguugcuaa

SEQ ID NO: 29948 - RNA, 22 nt, Human
uucugaaaccacugaccaacua

SEQ ID NO: 29949 - RNA, 22 nt, Human
uucugaaaccuucaguaugaag

SEQ ID NO: 29950 - RNA, 22 nt, Human
uucugaaaggcaugucagguag

SEQ ID NO: 29951 - RNA, 22 nt, Human
uucugaaauuucaacuuuacua

SEQ ID NO: 29952 - RNA, 22 nt, Human
uucugaagcucccuuuuguagu

SEQ ID NO: 29953 - RNA, 22 nt, Human
uucugacaauucaguaacagca

SEQ ID NO: 29954 - RNA, 22 nt, Human
uucugagaaauggguucacaua

SEQ ID NO: 29955 - RNA, 22 nt, Human
uucugagacagcaaagauucuu

SEQ ID NO: 29956 - RNA, 22 nt, Human
uucugagagcugaagaaauguu

SEQ ID NO: 29957 - RNA, 20 nt, Human
uucugagaguucacagcccc

SEQ ID NO: 29958 - RNA, 22 nt, Human
uucugagcaagcuggacagucu

SEQ ID NO: 29959 - RNA, 22 nt, Human
uguucuaggcaaaagcugauuu

SEQ ID NO: 29960 - RNA, 21 nt, Human
uguucuaucagcucagguguc

SEQ ID NO: 29961 - RNA, 22 nt, Human
uguucucaguaauucuauuuua

SEQ ID NO: 29962 - RNA, 22 nt, Human
uguucucaucuggaucucagga

SEQ ID NO: 29963 - RNA, 22 nt, Human
uguucucuuccacggcgcucgg

SEQ ID NO: 29964 - RNA, 22 nt, Human
uguucucuucucauugaacaug

SEQ ID NO: 29965 - RNA, 22 nt, Human
uguucugagugcagcuuaauaa

SEQ ID NO: 29966 - RNA, 22 nt, Human
uguucugcaagcccugccaccu

SEQ ID NO: 29967 - RNA, 22 nt, Human
uguucuguuuuaugguagggaa

SEQ ID NO: 29968 - RNA, 22 nt, Human
uguucuuaacuuuuguguauau

SEQ ID NO: 29969 - RNA, 22 nt, Human
uguucuuagcaggagcaucuau

SEQ ID NO: 29970 - RNA, 22 nt, Human
uguucuucuagauugccuuuua

SEQ ID NO: 29971 - RNA, 22 nt, Human
uguucuuuagcagaccauguug

SEQ ID NO: 29972 - RNA, 22 nt, Human
uguucuuucaguuagacacagu

SEQ ID NO: 29973 - RNA, 22 nt, Human
uguucuuugcuguugauguaga

SEQ ID NO: 29974 - RNA, 22 nt, Human
uguucuuuggcuuccuuuccgu

SEQ ID NO: 29975 - RNA, 23 nt, Human
uguugaaguaacuguuacauaga

SEQ ID NO: 29976 - RNA, 22 nt, Human
uguugaaucagaaguccuggcu

SEQ ID NO: 29977 - RNA, 22 nt, Human
uguugacugguaacuuuaaaca

SEQ ID NO: 29978 - RNA, 22 nt, Human
uguugacuugaaccaaaguguu

SEQ ID NO: 29979 - RNA, 20 nt, Human
uguugauuggugucaucuca

SEQ ID NO: 29980 - RNA, 22 nt, Human
uguugcacggccuucacagagc

SEQ ID NO: 29981 - RNA, 22 nt, Human
uguugcagagcuggggagggug

SEQ ID NO: 29982 - RNA, 22 nt, Human
uguugcugacaagagaggagca

SEQ ID NO: 29983 - RNA, 22 nt, Human
uguuggaaaagaauuaacuagg

SEQ ID NO: 29984 - RNA, 22 nt, Human
uguuggaaggcaagcagcaauu

SEQ ID NO: 29985 - RNA, 22 nt, Human
uguuggcagauugucuaggguu

SEQ ID NO: 29986 - RNA, 22 nt, Human
uguugggaagcucugccagggg

SEQ ID NO: 29987 - RNA, 22 nt, Human
uguuuaaccaccauucuauucu

SEQ ID NO: 29988 - RNA, 15 nt, Human
uguuuaagccacauu

SEQ ID NO: 29989 - RNA, 22 nt, Human
uguuuaaucuauaaaauggaga

SEQ ID NO: 29990 - RNA, 22 nt, Human
uguuuaaugaagaugguuuuuc

SEQ ID NO: 29991 - RNA, 22 nt, Human
uguuuaaugcauugaccuuggg

SEQ ID NO: 29992 - RNA, 22 nt, Human
uguuuaauuucacaaaguugac

SEQ ID NO: 29993 - RNA, 22 nt, Human
uguuuacaaaaccgugguacug

SEQ ID NO: 29994 - RNA, 22 nt, Human
uguuuacacuucaagguuaagg

SEQ ID NO: 29995 - RNA, 22 nt, Human
uguuuacagcugaucaggcauc

SEQ ID NO: 29996 - RNA, 22 nt, Human
uguuuacaguuuuuaguacccu

SEQ ID NO: 29997 - RNA, 22 nt, Human
uguuuacauaguagcugcccug

SEQ ID NO: 29998 - RNA, 22 nt, Human
uguuuacucacuguauccacaa

SEQ ID NO: 29999 - RNA, 22 nt, Human
uguuuacuccagcugauggaac

SEQ ID NO: 30000 - RNA, 20 nt, Human
uguuuacucuagaggguaga

SEQ ID NO: 30001 - RNA, 22 nt, Human
uguuuacuucaucgaguacuuc

SEQ ID NO: 30002 - RNA, 22 nt, Human
uguuuagacucaaaauugaaag

SEQ ID NO: 30003 - RNA, 22 nt, Human
uguuuagaggaacuggaaucag

SEQ ID NO: 30004 - RNA, 22 nt, Human
uguuuagaucucauucuuccca

SEQ ID NO: 30005 - RNA, 22 nt, Human
uguuuagcauaaagauuuucca

SEQ ID NO: 30006 - RNA, 22 nt, Human
uguuuauaccugcaaccuguca

SEQ ID NO: 30007 - RNA, 22 nt, Human
uguuuauaccuugguauaacca

SEQ ID NO: 30008 - RNA, 22 nt, Human
uguuuaucaggguaaaguguag

SEQ ID NO: 30009 - RNA, 22 nt, Human
uguuuaugcaucguuaauacca

SEQ ID NO: 30010 - RNA, 22 nt, Human
uguuuauugcugcaauugugcc

SEQ ID NO: 30011 - RNA, 22 nt, Human
uguuucaaaauaacaagagggu

SEQ ID NO: 30012 - RNA, 22 nt, Human
uguuucaagcaauagcauuuca

SEQ ID NO: 30013 - RNA, 22 nt, Human
uguuucacuaagcagaaauaua

SEQ ID NO: 30014 - RNA, 22 nt, Human
uguuucaggcuucugggauuuu

SEQ ID NO: 30015 - RNA, 20 nt, Human
uguuucauaagcuguccuau

SEQ ID NO: 30016 - RNA, 18 nt, Human
uguuuccuccuggaggcu

SEQ ID NO: 30017 - RNA, 20 nt, Human
uguuucugacgguaggagag

SEQ ID NO: 30018 - RNA, 22 nt, Human
uguuucugucuguuuucuacau

SEQ ID NO: 30019 - RNA, 22 nt, Human
uguuucuuauccaaguggucug

SEQ ID NO: 30020 - RNA, 22 nt, Human
uguuucuucucacacaaacuca

SEQ ID NO: 30021 - RNA, 22 nt, Human
uguuucuuuguagauauucuuu

SEQ ID NO: 30022 - RNA, 22 nt, Human
uguuugaaguucuucugugacu

SEQ ID NO: 30023 - RNA, 22 nt, Human
uguuugaauuuugcuaacgugu

SEQ ID NO: 30024 - RNA, 22 nt, Human
uguuugacaccucaguguuucu

SEQ ID NO: 30025 - RNA, 22 nt, Human
uguuugaguucuagcgcauuua

SEQ ID NO: 30026 - RNA, 22 nt, Human
uguuugcaacaacuagauggag

SEQ ID NO: 30027 - RNA, 22 nt, Human
uguuugcacauucguuucaaua

SEQ ID NO: 30028 - RNA, 22 nt, Human
uguuugcuuggucaguaaguag

SEQ ID NO: 30029 - RNA, 22 nt, Human
uguuuguaaagcagagccagua

SEQ ID NO: 30030 - RNA, 22 nt, Human
uguuuguaucucucucuguggc

SEQ ID NO: 30031 - RNA, 22 nt, Human
uguuugucaucauugugagaga

SEQ ID NO: 30032 - RNA, 22 nt, Human
uguuugugguuauaauaaguau

SEQ ID NO: 30033 - RNA, 23 nt, Human
uguuuguuucuaugagagauagc

SEQ ID NO: 30034 - RNA, 22 nt, Human
uguuuuaaagccauugccuuuc

SEQ ID NO: 30035 - RNA, 22 nt, Human
uguuuuaguucugucuugcaug

SEQ ID NO: 30036 - RNA, 22 nt, Human
uguuuuauuucuccaagaggga

SEQ ID NO: 30037 - RNA, 22 nt, Human
uguuuucagaugcagggacaca

SEQ ID NO: 30038 - RNA, 22 nt, Human
uguuuucaucacagaauguaac

SEQ ID NO: 30039 - RNA, 17 nt, Human
uguuuucauucauugcu

SEQ ID NO: 30040 - RNA, 21 nt, Human
uguuuuccaccuugaggcaag

SEQ ID NO: 30041 - RNA, 22 nt, Human
uguuuucuagaaacaaugccua

SEQ ID NO: 30042 - RNA, 22 nt, Human
uguuuucuggguggaagguacu

SEQ ID NO: 30043 - RNA, 22 nt, Human
uguuuucuucuguaccgugcca

SEQ ID NO: 30044 - RNA, 22 nt, Human
uguuuugguuuucaccgagucc

SEQ ID NO: 30045 - RNA, 22 nt, Human
uguuuugucuaaucuaaauucu

SEQ ID NO: 30046 - RNA, 19 nt, Human
uguuuuguuaaagcagucc

SEQ ID NO: 30047 - RNA, 23 nt, Human
uguuuuucauucacaugggcugu

SEQ ID NO: 30048 - RNA, 20 nt, Human
uuaaaaagagucacaggaga

SEQ ID NO: 30049 - RNA, 22 nt, Human
uuaaaagagacuuccuuuguuu

SEQ ID NO: 30050 - RNA, 22 nt, Human
uuaaaaggguaagcagcaacuu

SEQ ID NO: 30051 - RNA, 22 nt, Human
uuaaaaucgcuguugcuucugu

SEQ ID NO: 30052 - RNA, 22 nt, Human
uuaaacaccaagugcaaaccac

SEQ ID NO: 30053 - RNA, 22 nt, Human
uuaaacacuggagcuggguguu

SEQ ID NO: 30054 - RNA, 22 nt, Human
uuaaacaguauaucugagcaag

SEQ ID NO: 30055 - RNA, 22 nt, Human
uuaaacaguguuucaugugggg

SEQ ID NO: 30056 - RNA, 22 nt, Human
uuaaagaggcagguuaaauaau

SEQ ID NO: 30057 - RNA, 22 nt, Human
uuaaagagggaaagacuucaga

SEQ ID NO: 30058 - RNA, 22 nt, Human
uuaaagaguaaucauaggucaa

SEQ ID NO: 30059 - RNA, 22 nt, Human
uuaaagcaggcaucauuccuca

SEQ ID NO: 30060 - RNA, 22 nt, Human
uuaaagcccagcauauacuagg

SEQ ID NO: 30061 - RNA, 22 nt, Human
uuaaagcuugauucgaagcuua

SEQ ID NO: 30062 - RNA, 22 nt, Human
uuaaaggaucuuugucauuaau

SEQ ID NO: 30063 - RNA, 22 nt, Human
uuaaaggcaugguuagacaugg

SEQ ID NO: 30064 - RNA, 22 nt, Human
uuaaaguauagaggacaaaaac

SEQ ID NO: 30065 - RNA, 22 nt, Human
uuaaagucccugccuuaauucc

SEQ ID NO: 30066 - RNA, 22 nt, Human
uuaaaucaggcaucauuucagu

SEQ ID NO: 30067 - RNA, 22 nt, Human
uuaaaucaguaggcuacuccuu

SEQ ID NO: 30068 - RNA, 22 nt, Human
uuaaaucuguucucaugucugu

SEQ ID NO: 30069 - RNA, 22 nt, Human
uuaaaugacuuuuauuauucuc

SEQ ID NO: 30070 - RNA, 22 nt, Human
uuaaauuagucaagcuucucug

SEQ ID NO: 30071 - RNA, 22 nt, Human
uuaaauuccagccucauaauag

SEQ ID NO: 30072 - RNA, 22 nt, Human
uuaaauugucauuugagcaaug

SEQ ID NO: 30073 - RNA, 22 nt, Human
uuaaauuucuacgugauccagg

SEQ ID NO: 30074 - RNA, 22 nt, Human
uuaacaauagaguuucuucagg

SEQ ID NO: 30075 - RNA, 22 nt, Human
uuaacaaucauaggaccauuua

SEQ ID NO: 30076 - RNA, 22 nt, Human
uuaacacugauuguagagacac

SEQ ID NO: 30077 - RNA, 22 nt, Human
uuaacagacauauauauuugua

SEQ ID NO: 30078 - RNA, 22 nt, Human
uuaacagaggacacaucaaacu

SEQ ID NO: 30079 - RNA, 22 nt, Human
uuaacagcuuugggucugauau

SEQ ID NO: 30080 - RNA, 19 nt, Human
uuaacagucaccaaggaga

SEQ ID NO: 30081 - RNA, 22 nt, Human
uuaacaugucuugacuucaucu

SEQ ID NO: 30082 - RNA, 22 nt, Human
uuaacauuaaaagcagcauuuu

SEQ ID NO: 30083 - RNA, 22 nt, Human
uuaacauuucuuuuccacucau

SEQ ID NO: 30084 - RNA, 22 nt, Human
uuaacauuugugaagcauuuag

SEQ ID NO: 30085 - RNA, 22 nt, Human
uuaaccuguaaaaugggagaag

SEQ ID NO: 30086 - RNA, 22 nt, Human
uuaacuggggaagcauuucaug

SEQ ID NO: 30087 - RNA, 22 nt, Human
uuaacuugucagaaaauacagu

SEQ ID NO: 30088 - RNA, 22 nt, Human
uuaagaagugauuuuccucauu

SEQ ID NO: 30089 - RNA, 22 nt, Human
uuaagacuaaaugaggucauaa

SEQ ID NO: 30090 - RNA, 23 nt, Human
uuaagacuggcugaacuuaguag

SEQ ID NO: 30091 - RNA, 22 nt, Human
uuaagagcaacauauggugaca

SEQ ID NO: 30092 - RNA, 18 nt, Human
uuaagagcugaaagggga

SEQ ID NO: 30093 - RNA, 22 nt, Human
uuaagcauuuauuaugugccag

SEQ ID NO: 30094 - RNA, 22 nt, Human
uuaagcuaauuaguuccagcau

SEQ ID NO: 30095 - RNA, 22 nt, Human
uuaaggaaggugaauuucuugg

SEQ ID NO: 30096 - RNA, 22 nt, Human
uuaaggaauuuauaguuguacu

SEQ ID NO: 30097 - RNA, 22 nt, Human
uuaaggagcagaaugcuuggac

SEQ ID NO: 30098 - RNA, 22 nt, Human
uuaaggcacagagagguuaagu

SEQ ID NO: 30099 - RNA, 21 nt, Human
uuaaggucacuucugagccua

SEQ ID NO: 30100 - RNA, 22 nt, Human
uuaaggugcuuuauuuagcucu

SEQ ID NO: 30101 - RNA, 22 nt, Human
uuaagguucagaaaucaauacc

SEQ ID NO: 30102 - RNA, 22 nt, Human
uuaagguugagcucacuuuuau

SEQ ID NO: 30103 - RNA, 22 nt, Human
uuaaguaacuuguccaaaugag

SEQ ID NO: 30104 - RNA, 22 nt, Human
uuaagugcaaaaaugaaaguau

SEQ ID NO: 30105 - RNA, 22 nt, Human
uuaauaaaguaugaauuggaaa

SEQ ID NO: 30106 - RNA, 22 nt, Human
uuaauaacauuguguaucaccc

SEQ ID NO: 30107 - RNA, 22 nt, Human
uuaauaaguaguaguuauuguu

SEQ ID NO: 30108 - RNA, 22 nt, Human
uuaauaauaaugagcccauuuu

SEQ ID NO: 30109 - RNA, 22 nt, Human
uuaaucacagauauuaaacaug

SEQ ID NO: 30110 - RNA, 21 nt, Human
uuaaucagucucccugucucc

SEQ ID NO: 30111 - RNA, 22 nt, Human
uuaauccaauauccuggcuauu

SEQ ID NO: 30112 - RNA, 22 nt, Human
uuaauccggggugaauuuaauu

SEQ ID NO: 30113 - RNA, 22 nt, Human
uuaaugaauaugacaggagagg

SEQ ID NO: 30114 - RNA, 22 nt, Human
uuaaugacaucauaggugaagu

SEQ ID NO: 30115 - RNA, 22 nt, Human
uuaaugauaccuauguuaauuu

SEQ ID NO: 30116 - RNA, 18 nt, Human
uuaauguggcuuacuaug

SEQ ID NO: 30117 - RNA, 22 nt, Human
uuaauuaacuagccaaccacua

SEQ ID NO: 30118 - RNA, 22 nt, Human
uuaauuguaaaguuugccuguu

SEQ ID NO: 30119 - RNA, 22 nt, Human
uuaauugucugugaguaccuga

SEQ ID NO: 30120 - RNA, 21 nt, Human
uuaauuuauucaugauagcua

SEQ ID NO: 30121 - RNA, 22 nt, Human
uuaauuuuaaccuguuuguguc

SEQ ID NO: 30122 - RNA, 22 nt, Human
uuaauuuucucaucugugaaau

SEQ ID NO: 30123 - RNA, 22 nt, Human
uuacaaacaagaucuuauucuu

SEQ ID NO: 30124 - RNA, 22 nt, Human
uuacaaacugucauauaguauu

SEQ ID NO: 30125 - RNA, 20 nt, Human
uuacaaagaggcaucgcuuu

SEQ ID NO: 30126 - RNA, 22 nt, Human
uuacaaagugcugcaccauuuu

SEQ ID NO: 30127 - RNA, 22 nt, Human
uuacaacagacacauauucuaa

SEQ ID NO: 30128 - RNA, 22 nt, Human
uuacaaggaggauagcauuucc

SEQ ID NO: 30129 - RNA, 22 nt, Human
uuacaagguaaguuguuaaguc

SEQ ID NO: 30130 - RNA, 22 nt, Human
uuacaaguucagauuuucucau

SEQ ID NO: 30131 - RNA, 23 nt, Human
uuacaaguucugaaauuuccuuc

SEQ ID NO: 30132 - RNA, 22 nt, Human
uuacaaguuucuggcuucaucc

SEQ ID NO: 30133 - RNA, 22 nt, Human
uuacaaucaucuaggauaaaga

SEQ ID NO: 30134 - RNA, 22 nt, Human
uuacaaucugauugucucaucu

SEQ ID NO: 30135 - RNA, 22 nt, Human
uuacaaugggagcccuuggacu

SEQ ID NO: 30136 - RNA, 22 nt, Human
uuacacaaaaauaagauauggc

SEQ ID NO: 30137 - RNA, 22 nt, Human
uuacacaaaagcaagugugugu

SEQ ID NO: 30138 - RNA, 22 nt, Human
uuacacaauauaugguacuugg

SEQ ID NO: 30139 - RNA, 23 nt, Human
uucuggguugcugugcuuggaau

SEQ ID NO: 30140 - RNA, 19 nt, Human
uucuggucuggaaucaagg

SEQ ID NO: 30141 - RNA, 22 nt, Human
uucugguuacauuguuacagcu

SEQ ID NO: 30142 - RNA, 22 nt, Human
uucuguacccucgcgauucucc

SEQ ID NO: 30143 - RNA, 22 nt, Human
uucuguacucuuugagaagaau

SEQ ID NO: 30144 - RNA, 22 nt, Human
uucuguacuucaggggcucugu

SEQ ID NO: 30145 - RNA, 22 nt, Human
uucuguaggcacacaguuucaa

SEQ ID NO: 30146 - RNA, 22 nt, Human
uucuguaugccaauggguuuuu

SEQ ID NO: 30147 - RNA, 22 nt, Human
uucuguauggaaacauccucca

SEQ ID NO: 30148 - RNA, 22 nt, Human
uucuguauuucaaugucuuuau

SEQ ID NO: 30149 - RNA, 22 nt, Human
uucugucacuuaggaggucaua

SEQ ID NO: 30150 - RNA, 22 nt, Human
uucugucacuuuuuuggaaucu

SEQ ID NO: 30151 - RNA, 22 nt, Human
uucugucauuuagcauugucau

SEQ ID NO: 30152 - RNA, 22 nt, Human
uucuguccgcuuguuuguuaga

SEQ ID NO: 30153 - RNA, 22 nt, Human
uucugucugauggugccagaac

SEQ ID NO: 30154 - RNA, 22 nt, Human
uucugugacuccucagagauuu

SEQ ID NO: 30155 - RNA, 22 nt, Human
uucugugauuccuccagccagc

SEQ ID NO: 30156 - RNA, 22 nt, Human
uucugugcccauuuuaaaaugg

SEQ ID NO: 30157 - RNA, 22 nt, Human
uucuguggucucccaugucugu

SEQ ID NO: 30158 - RNA, 22 nt, Human
uucugugugcuuacugguguuc

SEQ ID NO: 30159 - RNA, 22 nt, Human
uucuguuacuguuggucauaac

SEQ ID NO: 30160 - RNA, 22 nt, Human
uucuguuagaauuuugaaaaua

SEQ ID NO: 30161 - RNA, 22 nt, Human
uucuguuaucauuaagcauuau

SEQ ID NO: 30162 - RNA, 22 nt, Human
uucuguucugauacuuguuucu

SEQ ID NO: 30163 - RNA, 22 nt, Human
uucuguucuuuauuuaccauau

SEQ ID NO: 30164 - RNA, 22 nt, Human
uucuguuuauuccuaggagcuc

SEQ ID NO: 30165 - RNA, 22 nt, Human
uucuguuugccauauauaguag

SEQ ID NO: 30166 - RNA, 21 nt, Human
uucuguuuuuuguaccagggc

SEQ ID NO: 30167 - RNA, 22 nt, Human
uucuuaaaauucaagcuagguu

SEQ ID NO: 30168 - RNA, 20 nt, Human
uucuuaaagaccucacuuug

SEQ ID NO: 30169 - RNA, 22 nt, Human
uucuuaacucaaauauauaucc

SEQ ID NO: 30170 - RNA, 22 nt, Human
uucuuaagaaaccaucacauuc

SEQ ID NO: 30171 - RNA, 22 nt, Human
uucuuaagcguaugauaaugaa

SEQ ID NO: 30172 - RNA, 22 nt, Human
uucuuaagugagaaagcaggag

SEQ ID NO: 30173 - RNA, 22 nt, Human
uucuuacaaacaagaucauuga

SEQ ID NO: 30174 - RNA, 22 nt, Human
uucuuacacucuuaaaaaucau

SEQ ID NO: 30175 - RNA, 22 nt, Human
uucuuacagaguuuacagagcc

SEQ ID NO: 30176 - RNA, 22 nt, Human
uucuuacauauuuucauauggu

SEQ ID NO: 30177 - RNA, 22 nt, Human
uugaagaggacuuugcagcugu

SEQ ID NO: 30178 - RNA, 22 nt, Human
uugaagaguagaaaaugcaaau

SEQ ID NO: 30179 - RNA, 22 nt, Human
uugaagaguguccuuguaaaaa

SEQ ID NO: 30180 - RNA, 22 nt, Human
uugaagaguuugauagaguuga

SEQ ID NO: 30181 - RNA, 22 nt, Human
uugaagauaggccaggaugagc

SEQ ID NO: 30182 - RNA, 22 nt, Human
uugaagaucuuugcauugcagg

SEQ ID NO: 30183 - RNA, 22 nt, Human
uugaagaugcugucucuuccag

SEQ ID NO: 30184 - RNA, 22 nt, Human
uugaagauucuuuuuguuagua

SEQ ID NO: 30185 - RNA, 21 nt, Human
uugaagcaaggguggcucuga

SEQ ID NO: 30186 - RNA, 22 nt, Human
uugaagcagagaaauacuugaa

SEQ ID NO: 30187 - RNA, 22 nt, Human
uugaagcauuucuuugagcuuc

SEQ ID NO: 30188 - RNA, 22 nt, Human
uugaagcuaggcugugcauaug

SEQ ID NO: 30189 - RNA, 22 nt, Human
uugaagcuccgguguauaggaa

SEQ ID NO: 30190 - RNA, 22 nt, Human
uugaagcugccguuuuucucca

SEQ ID NO: 30191 - RNA, 21 nt, Human
uugaaggaucacuucuguacc

SEQ ID NO: 30192 - RNA, 22 nt, Human
uugaagguaaauuauauugauc

SEQ ID NO: 30193 - RNA, 23 nt, Human
uugaagucucaguuuucucauag

SEQ ID NO: 30194 - RNA, 22 nt, Human
uugaaguucuaagccccaguac

SEQ ID NO: 30195 - RNA, 22 nt, Human
uugaaguugcacauuauaauuu

SEQ ID NO: 30196 - RNA, 22 nt, Human
uugaauaauuaauuacacucag

SEQ ID NO: 30197 - RNA, 22 nt, Human
uugaauaggacucagcagugau

SEQ ID NO: 30198 - RNA, 22 nt, Human
uugaaucuauguauucagugua

SEQ ID NO: 30199 - RNA, 22 nt, Human
uugaaucucaucccaauguugu

SEQ ID NO: 30200 - RNA, 22 nt, Human
uugaaugaggaagagcacuggc

SEQ ID NO: 30201 - RNA, 22 nt, Human
uugaauggcuucuagguucucc

SEQ ID NO: 30202 - RNA, 22 nt, Human
uugaauuauuuguuugcaagcu

SEQ ID NO: 30203 - RNA, 22 nt, Human
uugaauuggcaaaacugcagcu

SEQ ID NO: 30204 - RNA, 21 nt, Human
uugaauuguaugauuaaacug

SEQ ID NO: 30205 - RNA, 22 nt, Human
uugaauuuagauuguauguuga

SEQ ID NO: 30206 - RNA, 22 nt, Human
uugacaaaaaccucauuucacc

SEQ ID NO: 30207 - RNA, 22 nt, Human
uugacaaaggcugagaggaaaa

SEQ ID NO: 30208 - RNA, 22 nt, Human
uugacaaguggagauauuuaag

SEQ ID NO: 30209 - RNA, 22 nt, Human
uugacacaauguauauuuucaa

SEQ ID NO: 30210 - RNA, 22 nt, Human
uugacacuaagauuuccaaaca

SEQ ID NO: 30211 - RNA, 22 nt, Human
uugacagaauguuacauauaga

SEQ ID NO: 30212 - RNA, 22 nt, Human
uugacagaugugaaagugagca

SEQ ID NO: 30213 - RNA, 22 nt, Human
uugacaggauauaaagacauaa

SEQ ID NO: 30214 - RNA, 23 nt, Human
uugacaguaggugguuuucauug

SEQ ID NO: 30215 - RNA, 22 nt, Human
uugacaguugaggguugucuaa

SEQ ID NO: 30216 - RNA, 22 nt, Human
uugaccacugaaugguucugaa

SEQ ID NO: 30217 - RNA, 22 nt, Human
uugacccagcuuuccccacaau

SEQ ID NO: 30218 - RNA, 22 nt, Human
uugacccgaguccuucuugggg

SEQ ID NO: 30219 - RNA, 22 nt, Human
uugaccuauguuucuucaucug

SEQ ID NO: 30220 - RNA, 20 nt, Human
uugaccugcaagucaucauu

SEQ ID NO: 30221 - RNA, 22 nt, Human
uugacucauaccugccugaccc

SEQ ID NO: 30222 - RNA, 22 nt, Human
uugacuguacaaccuuuuguag

SEQ ID NO: 30223 - RNA, 22 nt, Human
uugacuucagccuguacuugua

SEQ ID NO: 30224 - RNA, 22 nt, Human
uugacuucccagacuuguguuu

SEQ ID NO: 30225 - RNA, 22 nt, Human
uugacuuuaaagcuuugucucu

SEQ ID NO: 30226 - RNA, 22 nt, Human
uugacuuuauguguauguuuac

SEQ ID NO: 30227 - RNA, 18 nt, Human
uugagaaauaagcacuaa

SEQ ID NO: 30228 - RNA, 22 nt, Human
uugagaacaggaguguucuuuu

SEQ ID NO: 30229 - RNA, 22 nt, Human
uugagaacuagcauggucuauc

SEQ ID NO: 30230 - RNA, 22 nt, Human
uugagaagguggucauuugcaa

SEQ ID NO: 30231 - RNA, 22 nt, Human
uugagaauaaauuagcagacau

SEQ ID NO: 30232 - RNA, 22 nt, Human
uugagaaugaugagauucuucc

SEQ ID NO: 30233 - RNA, 22 nt, Human
uugagacagugggguguugccg

SEQ ID NO: 30234 - RNA, 22 nt, Human
uugagauauucaguuccauuga

SEQ ID NO: 30235 - RNA, 22 nt, Human
uugagauggagucucacucugu

SEQ ID NO: 30236 - RNA, 22 nt, Human
uugagcaagaguaggaacugaa

SEQ ID NO: 30237 - RNA, 20 nt, Human
uugagcaaucaguaaaggau

SEQ ID NO: 30238 - RNA, 22 nt, Human
uugagcaaugcugcaaagagau

SEQ ID NO: 30239 - RNA, 22 nt, Human
uugagcaauuaggaaauaaaga

SEQ ID NO: 30240 - RNA, 22 nt, Human
uugagcacaggugaacagcauc

SEQ ID NO: 30241 - RNA, 22 nt, Human
uugagcccuaccucagacuuuc

SEQ ID NO: 30242 - RNA, 23 nt, Human
uugagcucaguagcucugcuggu

SEQ ID NO: 30243 - RNA, 22 nt, Human
uugagcucccgcuucuucuuug

SEQ ID NO: 30244 - RNA, 22 nt, Human
uugagcuguauaccuaugacug

SEQ ID NO: 30245 - RNA, 22 nt, Human
uugaggaaagagugcaaagagg

SEQ ID NO: 30246 - RNA, 23 nt, Human
uugaggacaauuuacaugguguu

SEQ ID NO: 30247 - RNA, 22 nt, Human
uugaggagcaggaugggaggcu

SEQ ID NO: 30248 - RNA, 22 nt, Human
uugaggaggacagaaacauuua

SEQ ID NO: 30249 - RNA, 22 nt, Human
uugaggaggccuuucagggcuu

SEQ ID NO: 30250 - RNA, 22 nt, Human
uugaggagguccuggguuuacu

SEQ ID NO: 30251 - RNA, 22 nt, Human
uugaggaguacaaagcaugcuu

SEQ ID NO: 30252 - RNA, 23 nt, Human
uugaggagugcuuuuucuaucca

SEQ ID NO: 30253 - RNA, 22 nt, Human
uugaggaguguuuagggugagg

SEQ ID NO: 30254 - RNA, 22 nt, Human
uuacacaauuacucacuccugg

SEQ ID NO: 30255 - RNA, 22 nt, Human
uuacacaauuuuauugaccuaa

SEQ ID NO: 30256 - RNA, 22 nt, Human
uuacacagacauggcaucauga

SEQ ID NO: 30257 - RNA, 22 nt, Human
uuacacaguauccaagguucuu

SEQ ID NO: 30258 - RNA, 22 nt, Human
uuacacaucuagacccauuuuu

SEQ ID NO: 30259 - RNA, 22 nt, Human
uuacacaugucucaguggaaau

SEQ ID NO: 30260 - RNA, 22 nt, Human
uuacacguguguguaucuguau

SEQ ID NO: 30261 - RNA, 18 nt, Human
uuacacuagccuugguuc

SEQ ID NO: 30262 - RNA, 22 nt, Human
uuacacuucuaaaaaaagcagg

SEQ ID NO: 30263 - RNA, 22 nt, Human
uuacacuuguaaauggcaugua

SEQ ID NO: 30264 - RNA, 22 nt, Human
uuacagaaucuacucgugguga

SEQ ID NO: 30265 - RNA, 22 nt, Human
uuacagagaggugauugugaag

SEQ ID NO: 30266 - RNA, 22 nt, Human
uuacagagguauguaugucucu

SEQ ID NO: 30267 - RNA, 22 nt, Human
uuacagaguagggaauugaagu

SEQ ID NO: 30268 - RNA, 22 nt, Human
uuacagaguggucuggcuaugu

SEQ ID NO: 30269 - RNA, 22 nt, Human
uuacagauacuuuguaggcaag

SEQ ID NO: 30270 - RNA, 22 nt, Human
uuacagaucaucaagguauaau

SEQ ID NO: 30271 - RNA, 22 nt, Human
uuacagcuagccaauuauuuag

SEQ ID NO: 30272 - RNA, 22 nt, Human
uuacaggggacauuggggacau

SEQ ID NO: 30273 - RNA, 22 nt, Human
uuacaggugagaaaacugaggc

SEQ ID NO: 30274 - RNA, 22 nt, Human
uuacaggugggaaaacuaagcu

SEQ ID NO: 30275 - RNA, 22 nt, Human
uuacagguuguguauucaguga

SEQ ID NO: 30276 - RNA, 22 nt, Human
uuacagucaggcaugaauucag

SEQ ID NO: 30277 - RNA, 22 nt, Human
uuacagucagugaauggaaggg

SEQ ID NO: 30278 - RNA, 22 nt, Human
uuacaguccuuuguauuguuua

SEQ ID NO: 30279 - RNA, 22 nt, Human
uuacagugaagauucagguucc

SEQ ID NO: 30280 - RNA, 22 nt, Human
uuacagugaaguaccauuaaaa

SEQ ID NO: 30281 - RNA, 22 nt, Human
uuacaguguuacuugaugucca

SEQ ID NO: 30282 - RNA, 21 nt, Human
uuacaguugauggaguauucc

SEQ ID NO: 30283 - RNA, 22 nt, Human
uuacaguugcccccagccucgc

SEQ ID NO: 30284 - RNA, 22 nt, Human
uuacaguuguagaaagugguug

SEQ ID NO: 30285 - RNA, 22 nt, Human
uuacaguuuaagaggaaacaaa

SEQ ID NO: 30286 - RNA, 22 nt, Human
uugggggcauauugaguagugg

SEQ ID NO: 30287 - RNA, 22 nt, Human
uugggggguugaggaguagaua

SEQ ID NO: 30288 - RNA, 22 nt, Human
uugggguaaggaaauauggcuu

SEQ ID NO: 30289 - RNA, 22 nt, Human
uugggguaaguuugucaagcug

SEQ ID NO: 30290 - RNA, 22 nt, Human
uuggggucccacaggcugccug

SEQ ID NO: 30291 - RNA, 22 nt, Human
uugggguggaagugaggaucau

SEQ ID NO: 30292 - RNA, 22 nt, Human
uugggugcugucauggggcacg

SEQ ID NO: 30293 - RNA, 22 nt, Human
uugggugguggggagaguucag

SEQ ID NO: 30294 - RNA, 22 nt, Human
uuggguuuucccuugaaacuga

SEQ ID NO: 30295 - RNA, 22 nt, Human
uugguaaaaucauagugguaac

SEQ ID NO: 30296 - RNA, 22 nt, Human
uugguaaauaacaaucacagug

SEQ ID NO: 30297 - RNA, 22 nt, Human
uugguaaauguugauuguggcu

SEQ ID NO: 30298 - RNA, 22 nt, Human
uugguccacugugaaauuggga

SEQ ID NO: 30299 - RNA, 22 nt, Human
uuggucuguaguuuucuuaugu

SEQ ID NO: 30300 - RNA, 22 nt, Human
uuggucuugaguggcuuguuaa

SEQ ID NO: 30301 - RNA, 22 nt, Human
uuggugaauugagaccauuugu

SEQ ID NO: 30302 - RNA, 22 nt, Human
uuggugacuccccaccaugaug

SEQ ID NO: 30303 - RNA, 22 nt, Human
uuggugaguauggacacagaga

SEQ ID NO: 30304 - RNA, 22 nt, Human
uuggugcaaauuccuguaagag

SEQ ID NO: 30305 - RNA, 22 nt, Human
uugguggagucauuggcauaug

SEQ ID NO: 30306 - RNA, 22 nt, Human
uuggugucuuuuuuauacaugu

SEQ ID NO: 30307 - RNA, 22 nt, Human
uuggugugacuaaggcagugug

SEQ ID NO: 30308 - RNA, 22 nt, Human
uugguuacaaguuugcucugcc

SEQ ID NO: 30309 - RNA, 22 nt, Human
uugguucaggacauauuugagu

SEQ ID NO: 30310 - RNA, 22 nt, Human
uugguucauuuucucaucuaga

SEQ ID NO: 30311 - RNA, 22 nt, Human
uugguuccuucugaaaguauug

SEQ ID NO: 30312 - RNA, 22 nt, Human
uugguuuaucuguggaucucuu

SEQ ID NO: 30313 - RNA, 22 nt, Human
uugguuuucuaauguauuaagg

SEQ ID NO: 30314 - RNA, 22 nt, Human
uugguuuucucagcuggaccau

SEQ ID NO: 30315 - RNA, 23 nt, Human
uuguaaaacagugugacgguucc

SEQ ID NO: 30316 - RNA, 22 nt, Human
uuguaaacugcugcaggagugc

SEQ ID NO: 30317 - RNA, 22 nt, Human
uuguaaagcuuugagacuacau

SEQ ID NO: 30318 - RNA, 21 nt, Human
uuguaaagguuuagaagaaug

SEQ ID NO: 30319 - RNA, 22 nt, Human
uuguaacaggcacucugugcca

SEQ ID NO: 30320 - RNA, 22 nt, Human
uuguaaggguuacaagaaaaca

SEQ ID NO: 30321 - RNA, 22 nt, Human
uuguaauuaauggcagcaauua

SEQ ID NO: 30322 - RNA, 22 nt, Human
uuguaauuugcaaauguauugu

SEQ ID NO: 30323 - RNA, 22 nt, Human
uuguacaaagauuucacagcuc

SEQ ID NO: 30324 - RNA, 22 nt, Human
uuguacaaaugcauauuccugg

SEQ ID NO: 30325 - RNA, 22 nt, Human
uuguacaacguuuuaaauuuga

SEQ ID NO: 30326 - RNA, 22 nt, Human
uuguacaaguauuaugugaaca

SEQ ID NO: 30327 - RNA, 22 nt, Human
uuguacaauggaugccagauga

SEQ ID NO: 30328 - RNA, 22 nt, Human
uuguacacacaggaacaaacgu

SEQ ID NO: 30329 - RNA, 22 nt, Human
uuguacagaaacugcauuugga

SEQ ID NO: 30330 - RNA, 22 nt, Human
uuguacagguuccuagggugga

SEQ ID NO: 30331 - RNA, 22 nt, Human
uuguacauaaugaaaggaggcu

SEQ ID NO: 30332 - RNA, 22 nt, Human
uuguacauucugaaucuguccu

SEQ ID NO: 30333 - RNA, 22 nt, Human
uuguacauuuguucaguucuga

SEQ ID NO: 30334 - RNA, 22 nt, Human
uuguacuagaaaauuauucuuu

SEQ ID NO: 30335 - RNA, 22 nt, Human
uuguacuuaaauaugcaaauag

SEQ ID NO: 30336 - RNA, 22 nt, Human
uuguacuugccauagaacaaca

SEQ ID NO: 30337 - RNA, 22 nt, Human
uuguagaacaugcagcacaaug

SEQ ID NO: 30338 - RNA, 22 nt, Human
uuguagaauuuggaucucggca

SEQ ID NO: 30339 - RNA, 18 nt, Human
uuguagcaaauggcagug

SEQ ID NO: 30340 - RNA, 22 nt, Human
uuguagcauuuuaaaugagcau

SEQ ID NO: 30341 - RNA, 21 nt, Human
uuguagcuuguuagaccaugu

SEQ ID NO: 30342 - RNA, 22 nt, Human
uuguauauauucuuaaagaugu

SEQ ID NO: 30343 - RNA, 22 nt, Human
uuguaucaguuagcuauugcug

SEQ ID NO: 30344 - RNA, 21 nt, Human
uuguaugcauacauacacaca

SEQ ID NO: 30345 - RNA, 22 nt, Human
uuguaugcuguaggcaugcauu

SEQ ID NO: 30346 - RNA, 22 nt, Human
uuguauuagcuguaaauuuucu

SEQ ID NO: 30347 - RNA, 22 nt, Human
uuguauucuuccuuagcaguac

SEQ ID NO: 30348 - RNA, 22 nt, Human
uuguauuggcaaagaacuugag

SEQ ID NO: 30349 - RNA, 22 nt, Human
uuguauuuccuauaaccuuucu

SEQ ID NO: 30350 - RNA, 22 nt, Human
uuguauuuggguaguauagaga

SEQ ID NO: 30351 - RNA, 22 nt, Human
uugucaagauugagagaugacu

SEQ ID NO: 30352 - RNA, 22 nt, Human
uugucacacccuuuuuuauacc

SEQ ID NO: 30353 - RNA, 22 nt, Human
uugucacauucaaguuuuauau

SEQ ID NO: 30354 - RNA, 22 nt, Human
uugucauauuuauaaaauguaa

SEQ ID NO: 30355 - RNA, 22 nt, Human
uugucauugggguuauuuguua

SEQ ID NO: 30356 - RNA, 22 nt, Human
uuguccaaggucccacaguuag

SEQ ID NO: 30357 - RNA, 22 nt, Human
uuguccagagccaggcugucgg

SEQ ID NO: 30358 - RNA, 22 nt, Human
uugucccaggacuugcauagau

SEQ ID NO: 30359 - RNA, 23 nt, Human
uuguccucuggaucgguuugguu

SEQ ID NO: 30360 - RNA, 22 nt, Human
uuguccugcaaccucacauggc

SEQ ID NO: 30361 - RNA, 22 nt, Human
uuguccugucaggcugggggcu

SEQ ID NO: 30362 - RNA, 22 nt, Human
uuguccuuggaugaagcuggga

SEQ ID NO: 30363 - RNA, 22 nt, Human
uuguccuuuaauguuuaguauu

SEQ ID NO: 30364 - RNA, 22 nt, Human
uugucuaaugagcuccacuuca

SEQ ID NO: 30365 - RNA, 22 nt, Human
uugucucucauuccugcaacuc

SEQ ID NO: 30366 - RNA, 22 nt, Human
uugucugaaaagguaaauauuu

SEQ ID NO: 30367 - RNA, 22 nt, Human
uugucugaaccaucucccuggc

SEQ ID NO: 30368 - RNA, 22 nt, Human
uugucugaauauguauguaucc

SEQ ID NO: 30369 - RNA, 22 nt, Human
uugucugagaaagugaguugcu

SEQ ID NO: 30370 - RNA, 22 nt, Human
uugucugcauuguuucuauggg

SEQ ID NO: 30371 - RNA, 22 nt, Human
uugucugcuccucccagccuca

SEQ ID NO: 30372 - RNA, 22 nt, Human
uugucuuaaauggauggacaau

SEQ ID NO: 30373 - RNA, 22 nt, Human
uugucuuauuuuaucauaagca

SEQ ID NO: 30374 - RNA, 22 nt, Human
uugugaaguguucugagacagg

SEQ ID NO: 30375 - RNA, 22 nt, Human
uugugaaugcuuaauauguuuc

SEQ ID NO: 30376 - RNA, 22 nt, Human
uugugagaugauuugaaagugu

SEQ ID NO: 30377 - RNA, 22 nt, Human
uugugauaaaacauuagacauu

SEQ ID NO: 30378 - RNA, 22 nt, Human
uugugauacugagcuuggcauu

SEQ ID NO: 30379 - RNA, 22 nt, Human
uugugcaaaggggguuaaucau

SEQ ID NO: 30380 - RNA, 22 nt, Human
uugugcauauuagguacaugcu

SEQ ID NO: 30381 - RNA, 22 nt, Human
uugugcauuucucugagugugu

SEQ ID NO: 30382 - RNA, 22 nt, Human
uugugcccucaaagggugcguc

SEQ ID NO: 30383 - RNA, 22 nt, Human
uugugccuuugcuuuuacaagu

SEQ ID NO: 30384 - RNA, 22 nt, Human
uugugcuagaaccaguacagaa

SEQ ID NO: 30385 - RNA, 22 nt, Human
uucaacaagucuuuuuucacug

SEQ ID NO: 30386 - RNA, 22 nt, Human
uucaacaaugcacuugaguaua

SEQ ID NO: 30387 - RNA, 22 nt, Human
uucaacacugaucguuuacaca

SEQ ID NO: 30388 - RNA, 22 nt, Human
uucaacagacccuucuuucuuu

SEQ ID NO: 30389 - RNA, 22 nt, Human
uucaacagauauuuauugagca

SEQ ID NO: 30390 - RNA, 22 nt, Human
uucaacaggaaagcacuuuaca

SEQ ID NO: 30391 - RNA, 22 nt, Human
uucaacagggcaugaugagacg

SEQ ID NO: 30392 - RNA, 22 nt, Human
uucaacaucauuguaagccucu

SEQ ID NO: 30393 - RNA, 23 nt, Human
uucaacauuuauugagcguccgu

SEQ ID NO: 30394 - RNA, 22 nt, Human
uucaacuuuaugcauauguauu

SEQ ID NO: 30395 - RNA, 22 nt, Human
uucaagaagguacauuuacauc

SEQ ID NO: 30396 - RNA, 22 nt, Human
uucaagacugcgacuaaugccc

SEQ ID NO: 30397 - RNA, 18 nt, Human
uucaagaguuucucuagg

SEQ ID NO: 30398 - RNA, 22 nt, Human
uucaagauccagcacaacagug

SEQ ID NO: 30399 - RNA, 22 nt, Human
uucaagaucuggguuuucagcu

SEQ ID NO: 30400 - RNA, 22 nt, Human
uucaagaucuuccaaaggauac

SEQ ID NO: 30401 - RNA, 22 nt, Human
uucaaggaagaaguggcuuuga

SEQ ID NO: 30402 - RNA, 22 nt, Human
uucaaggagauuggagucuacu

SEQ ID NO: 30403 - RNA, 22 nt, Human
uucaaggcagaguguaguuaaa

SEQ ID NO: 30404 - RNA, 22 nt, Human
uucaagguaaguaugagaaagc

SEQ ID NO: 30405 - RNA, 22 nt, Human
uucaaguaacacaaaugcaccc

SEQ ID NO: 30406 - RNA, 22 nt, Human
uucaaguaaugcuacuccuaug

SEQ ID NO: 30407 - RNA, 22 nt, Human
uucaagucagagcaagccaagu

SEQ ID NO: 30408 - RNA, 22 nt, Human
uucaagucugcccagagucagc

SEQ ID NO: 30409 - RNA, 22 nt, Human
uucaagucuuccaugguauucu

SEQ ID NO: 30410 - RNA, 22 nt, Human
uucaaguuaacucuccuuguac

SEQ ID NO: 30411 - RNA, 22 nt, Human
uucaaguuaaugauucugguuu

SEQ ID NO: 30412 - RNA, 22 nt, Human
uucaaguucuguggagagcugu

SEQ ID NO: 30413 - RNA, 22 nt, Human
uucaaguuuugccuccccaucc

SEQ ID NO: 30414 - RNA, 22 nt, Human
uucaauacaaagaaaggaauuu

SEQ ID NO: 30415 - RNA, 22 nt, Human
uucaauacaccauaggaauagu

SEQ ID NO: 30416 - RNA, 22 nt, Human
uucaauaggaugcaugauauaa

SEQ ID NO: 30417 - RNA, 20 nt, Human
uucaauaugacccuggggag

SEQ ID NO: 30418 - RNA, 22 nt, Human
uucaaucauuccaacacuuuaa

SEQ ID NO: 30419 - RNA, 22 nt, Human
uucaaugagcccaagaacguga

SEQ ID NO: 30420 - RNA, 22 nt, Human
uucaaugaggauagaacuggau

SEQ ID NO: 30421 - RNA, 17 nt, Human
uucaaugauuaaugcau

SEQ ID NO: 30422 - RNA, 22 nt, Human
uucaaugccuuucucuaagcuc

SEQ ID NO: 30423 - RNA, 22 nt, Human
uucaaugugguuauaauaacua

SEQ ID NO: 30424 - RNA, 22 nt, Human
uucaauguuaagaagaauaugu

SEQ ID NO: 30425 - RNA, 22 nt, Human
uucaauucugaugaaggcaaua

SEQ ID NO: 30426 - RNA, 22 nt, Human
uucaauuugugcuaaggcaccg

SEQ ID NO: 30427 - RNA, 22 nt, Human
uucacaaaacacuauuuucugg

SEQ ID NO: 30428 - RNA, 22 nt, Human
uucacaaaaugguuuguugaug

SEQ ID NO: 30429 - RNA, 22 nt, Human
uucacaaacuucaugauggcac

SEQ ID NO: 30430 - RNA, 22 nt, Human
uucacaagugugaaggcagagc

SEQ ID NO: 30431 - RNA, 22 nt, Human
uucacaaugccuuguugauggu

SEQ ID NO: 30432 - RNA, 22 nt, Human
uucacaauuaacuuuauacuua

SEQ ID NO: 30433 - RNA, 22 nt, Human
uucacagaauggcaaguuaugg

SEQ ID NO: 30434 - RNA, 22 nt, Human
uucacagaguuauuuuuaugcu

SEQ ID NO: 30435 - RNA, 22 nt, Human
uucacagaugccugaugugugg

SEQ ID NO: 30436 - RNA, 22 nt, Human
uucacagauuucccugcacaug

SEQ ID NO: 30437 - RNA, 22 nt, Human
uucacagccucugccccaggca

SEQ ID NO: 30438 - RNA, 22 nt, Human
uucacagcucauacuguucuca

SEQ ID NO: 30439 - RNA, 22 nt, Human
uucacagcuuaauaaggcucag

SEQ ID NO: 30440 - RNA, 22 nt, Human
uucacaggaggguggaugcaug

SEQ ID NO: 30441 - RNA, 22 nt, Human
uucacagggcagaucauuucug

SEQ ID NO: 30442 - RNA, 22 nt, Human
uucacagggcagcagcugagcc

SEQ ID NO: 30443 - RNA, 22 nt, Human
uucacagguucuuuuuaaggcu

SEQ ID NO: 30444 - RNA, 22 nt, Human
uucacagugagcuaugucuugu

SEQ ID NO: 30445 - RNA, 21 nt, Human
uucacaguggauaacuuucug

SEQ ID NO: 30446 - RNA, 22 nt, Human
uucacaguggcugugccauuug

SEQ ID NO: 30447 - RNA, 22 nt, Human
uucacaguuugcugggacagga

SEQ ID NO: 30448 - RNA, 22 nt, Human
uucacauaaauagaucacauca

SEQ ID NO: 30449 - RNA, 22 nt, Human
uucacauaaucugcagcaagcg

SEQ ID NO: 30450 - RNA, 22 nt, Human
uucacauuagccaagagaugga

SEQ ID NO: 30451 - RNA, 22 nt, Human
uucacauuauaaucaguucugc

SEQ ID NO: 30452 - RNA, 22 nt, Human
uucacauucucacaagaggaaa

SEQ ID NO: 30453 - RNA, 22 nt, Human
uucacauugugcagauuauggu

SEQ ID NO: 30454 - RNA, 22 nt, Human
uucacauuuacugguuuguccg

SEQ ID NO: 30455 - RNA, 22 nt, Human
uucacauuucucugcuguuuga

SEQ ID NO: 30456 - RNA, 22 nt, Human
uucaccagaccugugagcuucc

SEQ ID NO: 30457 - RNA, 22 nt, Human
uucaccagcagcucacuaguca

SEQ ID NO: 30458 - RNA, 18 nt, Human
uucaccagguagauaggg

SEQ ID NO: 30459 - RNA, 22 nt, Human
uucaccauaaugcaaaguggga

SEQ ID NO: 30460 - RNA, 22 nt, Human
uucaccauguaaaccauguggc

SEQ ID NO: 30461 - RNA, 22 nt, Human
uucaccauuacauacaaagaug

SEQ ID NO: 30462 - RNA, 22 nt, Human
uucaccauuucccacuaaacca

SEQ ID NO: 30463 - RNA, 22 nt, Human
uucacccaauauaacuagagga

SEQ ID NO: 30464 - RNA, 22 nt, Human
uucacguuguugaagaaaauac

SEQ ID NO: 30465 - RNA, 19 nt, Human
uucacuaauuguaagauuu

SEQ ID NO: 30466 - RNA, 22 nt, Human
uucacuaugcuuggaaacuucu

SEQ ID NO: 30467 - RNA, 22 nt, Human
uucacugaaguuucuuccaugu

SEQ ID NO: 30468 - RNA, 22 nt, Human
uucacuguccugcaacucuaga

SEQ ID NO: 30469 - RNA, 22 nt, Human
uucacuguuaugaagcucuggg

SEQ ID NO: 30470 - RNA, 22 nt, Human
uucacuuaacauuuaccaagga

SEQ ID NO: 30471 - RNA, 22 nt, Human
uucagaaagguuaaucuggauu

SEQ ID NO: 30472 - RNA, 22 nt, Human
uucagaaaucccucuucuaccc

SEQ ID NO: 30473 - RNA, 22 nt, Human
uucagaaaugaauauugguauu

SEQ ID NO: 30474 - RNA, 22 nt, Human
uucagaagguaggaaugucccu

SEQ ID NO: 30475 - RNA, 22 nt, Human
uucagaaguagcuaagcaguca

SEQ ID NO: 30476 - RNA, 21 nt, Human
uucagaaguugagggcagguu

SEQ ID NO: 30477 - RNA, 22 nt, Human
uucagaauaauguguuagagaa

SEQ ID NO: 30478 - RNA, 22 nt, Human
uucagaaucuaugugccagcuc

SEQ ID NO: 30479 - RNA, 22 nt, Human
uucagaaugcuauuucugaaau

SEQ ID NO: 30480 - RNA, 22 nt, Human
uucagaauguacugauagaaca

SEQ ID NO: 30481 - RNA, 22 nt, Human
uucagacacagcgcugggaaau

SEQ ID NO: 30482 - RNA, 22 nt, Human
uucagacaggcagcugggcugg

SEQ ID NO: 30483 - RNA, 22 nt, Human
uucagacaguuuucagauucau

SEQ ID NO: 30484 - RNA, 22 nt, Human
uucagacuagacacauuucaag

SEQ ID NO: 30485 - RNA, 22 nt, Human
uucagacuucuugacuggcuuu

SEQ ID NO: 30486 - RNA, 22 nt, Human
uucagagaaacugagguuuaga

SEQ ID NO: 30487 - RNA, 22 nt, Human
uucagagaaagcagauuuacuc

SEQ ID NO: 30488 - RNA, 22 nt, Human
uucagagacagcaaccaggaca

SEQ ID NO: 30489 - RNA, 22 nt, Human
uucagagaguuugugaguccuu

SEQ ID NO: 30490 - RNA, 22 nt, Human
uucagagauggaaggcagaaug

SEQ ID NO: 30491 - RNA, 22 nt, Human
uucagaggacaaccagccaucu

SEQ ID NO: 30492 - RNA, 22 nt, Human
uucagaggggcuaaguacuugc

SEQ ID NO: 30493 - RNA, 20 nt, Human
uucagaguuuacucaaacug

SEQ ID NO: 30494 - RNA, 22 nt, Human
uucagcaaaauaucucagauag

SEQ ID NO: 30495 - RNA, 22 nt, Human
uucagcaacauuuguugagugc

SEQ ID NO: 30496 - RNA, 22 nt, Human
uucuagaaugauaugagguacu

SEQ ID NO: 30497 - RNA, 20 nt, Human
uucuagaaugcccagggaca

SEQ ID NO: 30498 - RNA, 22 nt, Human
uucuagacaaauguguucauuc

SEQ ID NO: 30499 - RNA, 22 nt, Human
uucuagagccagggcagcugca

SEQ ID NO: 30500 - RNA, 22 nt, Human
uucuagauagagugcaaauuau

SEQ ID NO: 30501 - RNA, 20 nt, Human
uucuagcauacuuacaagga

SEQ ID NO: 30502 - RNA, 22 nt, Human
uucuaggaagggaagcauggca

SEQ ID NO: 30503 - RNA, 22 nt, Human
uucuaggggacauaauaugaaa

SEQ ID NO: 30504 - RNA, 22 nt, Human
uuguggcuucuacgcccacagg

SEQ ID NO: 30505 - RNA, 22 nt, Human
uuguguacacgccuuuaaauga

SEQ ID NO: 30506 - RNA, 22 nt, Human
uuguguacucaccagcacauac

SEQ ID NO: 30507 - RNA, 22 nt, Human
uuguguauuuccugaagguaag

SEQ ID NO: 30508 - RNA, 22 nt, Human
uuguguauuuuuugauacuaac

SEQ ID NO: 30509 - RNA, 22 nt, Human
uuguguccccuguucuaccugu

SEQ ID NO: 30510 - RNA, 22 nt, Human
uugugucccugcggcugaggag

SEQ ID NO: 30511 - RNA, 22 nt, Human
uugugucccuguaagacaaagc

SEQ ID NO: 30512 - RNA, 22 nt, Human
uuguguccuaacaucuaguuaa

SEQ ID NO: 30513 - RNA, 23 nt, Human
uugugucuacuuccuaucuaggg

SEQ ID NO: 30514 - RNA, 22 nt, Human
uugugucuaugguuugagcauc

SEQ ID NO: 30515 - RNA, 22 nt, Human
uugugucugggggagugacauc

SEQ ID NO: 30516 - RNA, 22 nt, Human
uugugugauaagucucuugugc

SEQ ID NO: 30517 - RNA, 22 nt, Human
uugugugcugagggccugcugu

SEQ ID NO: 30518 - RNA, 22 nt, Human
uuguguggauaauauuacuuga

SEQ ID NO: 30519 - RNA, 17 nt, Human
uuguguguaguucugau

SEQ ID NO: 30520 - RNA, 19 nt, Human
uugugugucagucagaguu

SEQ ID NO: 30521 - RNA, 22 nt, Human
uuguguuuucuuauggcauaaa

SEQ ID NO: 30522 - RNA, 22 nt, Human
uuguuaaaaugcauauucuggu

SEQ ID NO: 30523 - RNA, 22 nt, Human
uuguuaaggguuaugcagcuuu

SEQ ID NO: 30524 - RNA, 21 nt, Human
uuguuacaaugcaagaguaug

SEQ ID NO: 30525 - RNA, 22 nt, Human
uuguuacacauaauaacauuuu

SEQ ID NO: 30526 - RNA, 22 nt, Human
uuguuaguuuauauaauguagu

SEQ ID NO: 30527 - RNA, 22 nt, Human
uuguuauuauuacuaagucuuc

SEQ ID NO: 30528 - RNA, 22 nt, Human
uuguuauuuacaacaauccuau

SEQ ID NO: 30529 - RNA, 22 nt, Human
uuguucacuaugaagagguugg

SEQ ID NO: 30530 - RNA, 22 nt, Human
uuguucauaaagacaguucaga

SEQ ID NO: 30531 - RNA, 22 nt, Human
uuguucaucaggugacacauac

SEQ ID NO: 30532 - RNA, 22 nt, Human
uuguucuuccaucaucccucag

SEQ ID NO: 30533 - RNA, 22 nt, Human
uuguucuuggagcaggcagaga

SEQ ID NO: 30534 - RNA, 22 nt, Human
uuguugauguggacgucuggaa

SEQ ID NO: 30535 - RNA, 22 nt, Human
uuguugcaagccuggaaucugg

SEQ ID NO: 30536 - RNA, 22 nt, Human
uuguugcagagaugaaugacau

SEQ ID NO: 30537 - RNA, 22 nt, Human
uuguugguggaauugaugcuag

SEQ ID NO: 30538 - RNA, 22 nt, Human
uuguuuaaaauguagcaagaaa

SEQ ID NO: 30539 - RNA, 22 nt, Human
uuguuuaaagaacuucugacuu

SEQ ID NO: 30540 - RNA, 20 nt, Human
uuguuuaaaggugaagaggc

SEQ ID NO: 30541 - RNA, 22 nt, Human
uuguuuaaugccucauacaucu

SEQ ID NO: 30542 - RNA, 22 nt, Human
uuguuuaucgcuugcucacaua

SEQ ID NO: 30543 - RNA, 22 nt, Human
uuguuuauggauuguagaaacu

SEQ ID NO: 30544 - RNA, 22 nt, Human
uuguuuauuagcaauuauccug

SEQ ID NO: 30545 - RNA, 22 nt, Human
uuguuuccagcaaauaguccau

SEQ ID NO: 30546 - RNA, 22 nt, Human
uuguuuccauugcagacugugu

SEQ ID NO: 30547 - RNA, 22 nt, Human
uuguuucccuggaucuagagcu

SEQ ID NO: 30548 - RNA, 22 nt, Human
uuguuucuggaaaaggcgagaa

SEQ ID NO: 30549 - RNA, 22 nt, Human
uuguuugaauaacagacaaauu

SEQ ID NO: 30550 - RNA, 22 nt, Human
uuguuuuaguagguacacugag

SEQ ID NO: 30551 - RNA, 22 nt, Human
uuguuuuaucuuucuacagacu

SEQ ID NO: 30552 - RNA, 22 nt, Human
uuguuuuauucugcaauuuccc

SEQ ID NO: 30553 - RNA, 22 nt, Human
uuguuuucagggugucauucac

SEQ ID NO: 30554 - RNA, 22 nt, Human
uuguuuuuagagaagcccugaa

SEQ ID NO: 30555 - RNA, 22 nt, Human
uuguuuuuaugaacauccagga

SEQ ID NO: 30556 - RNA, 22 nt, Human
uuuaaaaccaaagaaagccucu

SEQ ID NO: 30557 - RNA, 22 nt, Human
uuuaaaaguuaucaucugucca

SEQ ID NO: 30558 - RNA, 22 nt, Human
uuuaaacaaauaggauugccua

SEQ ID NO: 30559 - RNA, 22 nt, Human
uuuaaacuaacaguacacguug

SEQ ID NO: 30560 - RNA, 19 nt, Human
uuuaaagugacugguauuu

SEQ ID NO: 30561 - RNA, 22 nt, Human
uuuaaaguuuuugcacauucug

SEQ ID NO: 30562 - RNA, 22 nt, Human
uuuaaauguuuauagagaguac

SEQ ID NO: 30563 - RNA, 22 nt, Human
uuuaaauuuagaagaaacacug

SEQ ID NO: 30564 - RNA, 22 nt, Human
uuuaacagauaguuucuucugu

SEQ ID NO: 30565 - RNA, 22 nt, Human
uuuaacccaaauaaccacagga

SEQ ID NO: 30566 - RNA, 22 nt, Human
uuuaaccucuaauuuaguucuc

SEQ ID NO: 30567 - RNA, 22 nt, Human
uuuaacuccuaguguguauuag

SEQ ID NO: 30568 - RNA, 20 nt, Human
uuuaacuggccuucuggcuc

SEQ ID NO: 30569 - RNA, 22 nt, Human
uuuaacuggucuccugcugcuu

SEQ ID NO: 30570 - RNA, 23 nt, Human
uuuaacuuuccaauaauucauug

SEQ ID NO: 30571 - RNA, 22 nt, Human
uuuaagaaguuauguuauaaau

SEQ ID NO: 30572 - RNA, 22 nt, Human
uuuaagacagugcaagcugaau

SEQ ID NO: 30573 - RNA, 22 nt, Human
uuuaagacuuagauuuauuggg

SEQ ID NO: 30574 - RNA, 22 nt, Human
uuuaagagcauuugcaauuuau

SEQ ID NO: 30575 - RNA, 22 nt, Human
uuuaagagccuguacaaauauu

SEQ ID NO: 30576 - RNA, 22 nt, Human
uuuaagagcuaguaugucauuu

SEQ ID NO: 30577 - RNA, 22 nt, Human
uuuaagaucauuuguauuaucc

SEQ ID NO: 30578 - RNA, 22 nt, Human
uuuaagcagagaaaugauguau

SEQ ID NO: 30579 - RNA, 22 nt, Human
uuuaaguuccuuuucaacaacu

SEQ ID NO: 30580 - RNA, 22 nt, Human
uuuaauacagaacuugucaggg

SEQ ID NO: 30581 - RNA, 22 nt, Human
uuuaauagggcccaaugagacu

SEQ ID NO: 30582 - RNA, 22 nt, Human
uuuaauauucugcauucuccuu

SEQ ID NO: 30583 - RNA, 22 nt, Human
uuuaaucaggcaaagcauaaua

SEQ ID NO: 30584 - RNA, 22 nt, Human
uuuaaucauaagaaggaaaaua

SEQ ID NO: 30585 - RNA, 22 nt, Human
uuuaaucuauucccuaaacacc

SEQ ID NO: 30586 - RNA, 22 nt, Human
uuuaauguuaaauuuguagaug

SEQ ID NO: 30587 - RNA, 22 nt, Human
uuuaauuauguuaagccacuga

SEQ ID NO: 30588 - RNA, 22 nt, Human
uuuaauuguuguggguacauag

SEQ ID NO: 30589 - RNA, 21 nt, Human
uuuaauuugcauguaugacgc

SEQ ID NO: 30590 - RNA, 22 nt, Human
uuuacaacccaaguccagagag

SEQ ID NO: 30591 - RNA, 22 nt, Human
uuuacaaggcagaacugauuaa

SEQ ID NO: 30592 - RNA, 22 nt, Human
uuuacaaggcaguuauuuuccu

SEQ ID NO: 30593 - RNA, 22 nt, Human
uuuacaagucagggacuguucu

SEQ ID NO: 30594 - RNA, 22 nt, Human
uuuacaagucuguugaucccaa

SEQ ID NO: 30595 - RNA, 22 nt, Human
uuuacaauucucuaccaguguu

SEQ ID NO: 30596 - RNA, 22 nt, Human
uuuacaauugguuuucucuaau

SEQ ID NO: 30597 - RNA, 22 nt, Human
uuuacacaaaagauagcacacc

SEQ ID NO: 30598 - RNA, 22 nt, Human
uuuacaccaaaaugacacagag

SEQ ID NO: 30599 - RNA, 22 nt, Human
uuuacaccauuagaagcuacuu

SEQ ID NO: 30600 - RNA, 22 nt, Human
uuuacacuugaggaaacugagg

SEQ ID NO: 30601 - RNA, 22 nt, Human
uuuacagaagagaaggaugcuu

SEQ ID NO: 30602 - RNA, 22 nt, Human
uuuacagaauguugaauuuggg

SEQ ID NO: 30603 - RNA, 22 nt, Human
uuuacagcaacagugcagaggu

SEQ ID NO: 30604 - RNA, 22 nt, Human
uuuacagcauugcugaaaguuc

SEQ ID NO: 30605 - RNA, 22 nt, Human
uuuacagcuacuguccuauuuc

SEQ ID NO: 30606 - RNA, 22 nt, Human
uuuacagcuucuauacuaugug

SEQ ID NO: 30607 - RNA, 22 nt, Human
uuuacagggaauauuuuggcuu

SEQ ID NO: 30608 - RNA, 22 nt, Human
uuuacaggguucaagaaugaaa

SEQ ID NO: 30609 - RNA, 22 nt, Human
uuuacaguaagguggaugguac

SEQ ID NO: 30610 - RNA, 22 nt, Human
uuuacagucaccaaacuuugcu

SEQ ID NO: 30611 - RNA, 22 nt, Human
uucugccuucaguccucugacu

SEQ ID NO: 30612 - RNA, 18 nt, Human
uucugcggugacagauau

SEQ ID NO: 30613 - RNA, 22 nt, Human
uucccucuuuuccaacaguugu

SEQ ID NO: 30614 - RNA, 22 nt, Human
uucccuggcaugaguguaagau

SEQ ID NO: 30615 - RNA, 22 nt, Human
uucccuggggaaggugaccuuu

SEQ ID NO: 30616 - RNA, 21 nt, Human
uucuucuuggacuguuuuggc

SEQ ID NO: 30617 - RNA, 22 nt, Human
uucuucuugucugcccucacau

SEQ ID NO: 30618 - RNA, 22 nt, Human
uucuucuuucccccugugguac

SEQ ID NO: 30619 - RNA, 19 nt, Human
uucuugaacauguuucuca

SEQ ID NO: 30620 - RNA, 22 nt, Human
uucuugaaggggauauaaauag

SEQ ID NO: 30621 - RNA, 20 nt, Human
uucuugaauacccaacccca

SEQ ID NO: 30622 - RNA, 22 nt, Human
uucuugaauagggauugauaaa

SEQ ID NO: 30623 - RNA, 22 nt, Human
uucuugaugaaugcuaagaacu

SEQ ID NO: 30624 - RNA, 22 nt, Human
uucuugauucuuccuugaagga

SEQ ID NO: 30625 - RNA, 22 nt, Human
uucuugcaucaagacagccugu

SEQ ID NO: 30626 - RNA, 22 nt, Human
uucuugccauauuucagcccuu

SEQ ID NO: 30627 - RNA, 22 nt, Human
uucuugccugcccugugucgua

SEQ ID NO: 30628 - RNA, 22 nt, Human
uucuuggaaauacauucaauaa

SEQ ID NO: 30629 - RNA, 22 nt, Human
uucuuggcaaugguauucaucc

SEQ ID NO: 30630 - RNA, 22 nt, Human
uucuuguacuggagauacauga

SEQ ID NO: 30631 - RNA, 22 nt, Human
uucuuguuuauuaagauauaaa

SEQ ID NO: 30632 - RNA, 22 nt, Human
uucuuuacaguggguuuugaau

SEQ ID NO: 30633 - RNA, 22 nt, Human
uucuuuaccacuacucuuccaa

SEQ ID NO: 30634 - RNA, 22 nt, Human
uucuuuagcaacuuggauuuag

SEQ ID NO: 30635 - RNA, 22 nt, Human
uucuuuagguagauccaguuuu

SEQ ID NO: 30636 - RNA, 23 nt, Human
uucuuuauaaaucaaugggaugu

SEQ ID NO: 30637 - RNA, 22 nt, Human
uucuuuauguuaaugaaucuau

SEQ ID NO: 30638 - RNA, 22 nt, Human
uucuuuauuaguuuagugagcu

SEQ ID NO: 30639 - RNA, 22 nt, Human
uucuuuauugagacuucauugu

SEQ ID NO: 30640 - RNA, 22 nt, Human
uucuuuccaaccagauauuggu

SEQ ID NO: 30641 - RNA, 19 nt, Human
uucuuuccacaucuucucu

SEQ ID NO: 30642 - RNA, 21 nt, Human
uucuuuccccagaggacuaaa

SEQ ID NO: 30643 - RNA, 22 nt, Human
uucuuuccuugccucagugaag

SEQ ID NO: 30644 - RNA, 22 nt, Human
uucuuucucacucuuuaggaag

SEQ ID NO: 30645 - RNA, 22 nt, Human
uucuuucugucaugguguacug

SEQ ID NO: 30646 - RNA, 22 nt, Human
uucuuucuguccauaaugagac

SEQ ID NO: 30647 - RNA, 22 nt, Human
uucuuuggaauaagucaagcug

SEQ ID NO: 30648 - RNA, 22 nt, Human
uucuuugggauuguagcugucu

SEQ ID NO: 30649 - RNA, 22 nt, Human
uucuuuggugggagauugaggu

SEQ ID NO: 30650 - RNA, 22 nt, Human
uucuuugugcauccaauuuucu

SEQ ID NO: 30651 - RNA, 22 nt, Human
uucuuuguugagcaaguaggac

SEQ ID NO: 30652 - RNA, 22 nt, Human
uucuuuuaauagagauccugug

SEQ ID NO: 30653 - RNA, 22 nt, Human
uucuuuuagucauucagggaag

SEQ ID NO: 30654 - RNA, 20 nt, Human
uucuuuugauaagcuugaca

SEQ ID NO: 30655 - RNA, 22 nt, Human
uucuuuuuaucuucccauaaga

SEQ ID NO: 30656 - RNA, 22 nt, Human
uugaaaaaauugguagaggaug

SEQ ID NO: 30657 - RNA, 22 nt, Human
uugaaaagcaaaugauggguag

SEQ ID NO: 30658 - RNA, 17 nt, Human
uugaaaaguaagcuccc

SEQ ID NO: 30659 - RNA, 22 nt, Human
uugaaacauaaaauauuuccug

SEQ ID NO: 30660 - RNA, 22 nt, Human
uugaaacauuaccuguauuucc

SEQ ID NO: 30661 - RNA, 22 nt, Human
uugaaacugaguguguuugggg

SEQ ID NO: 30662 - RNA, 22 nt, Human
uugaaacuuagaaauugagcug

SEQ ID NO: 30663 - RNA, 22 nt, Human
uugaaacuuuucuuggagaaac

SEQ ID NO: 30664 - RNA, 23 nt, Human
uugaaagauugcuaaguaaaaau

SEQ ID NO: 30665 - RNA, 22 nt, Human
uugaaaggugcugugugcugau

SEQ ID NO: 30666 - RNA, 22 nt, Human
uugaaagugauggggaagaugg

SEQ ID NO: 30667 - RNA, 22 nt, Human
uugaaaguuuauggagucugca

SEQ ID NO: 30668 - RNA, 22 nt, Human
uugaaauacugcauuguucagu

SEQ ID NO: 30669 - RNA, 22 nt, Human
uugaaauauuugggaguguuug

SEQ ID NO: 30670 - RNA, 22 nt, Human
uugaaaugagcaaacugucagc

SEQ ID NO: 30671 - RNA, 22 nt, Human
uugaaaugcaucaucauuuaga

SEQ ID NO: 30672 - RNA, 20 nt, Human
uugaaauuggaugguagcua

SEQ ID NO: 30673 - RNA, 19 nt, Human
uugaaauuguuugauaugg

SEQ ID NO: 30674 - RNA, 19 nt, Human
uugaacacuuucuucaagg

SEQ ID NO: 30675 - RNA, 22 nt, Human
uugaacagcuguuacauuguua

SEQ ID NO: 30676 - RNA, 22 nt, Human
uugaacaguccuaagagacccu

SEQ ID NO: 30677 - RNA, 17 nt, Human
uugaacugcugagucag

SEQ ID NO: 30678 - RNA, 22 nt, Human
uugaagaaccaucugugccacu

SEQ ID NO: 30679 - RNA, 22 nt, Human
uugaagaauuaggacgugagua

SEQ ID NO: 30680 - RNA, 22 nt, Human
uugaagacaagggcagggguuc

SEQ ID NO: 30681 - RNA, 22 nt, Human
uugaagagacaauuuggaaagc

SEQ ID NO: 30682 - RNA, 20 nt, Human
uugaagaggauauaucgcuc

SEQ ID NO: 30683 - RNA, 20 nt, Human
uugaagagucagguagggcc

SEQ ID NO: 30684 - RNA, 22 nt, Human
uugaagauggaucgccacucuc

SEQ ID NO: 30685 - RNA, 22 nt, Human
uugaagauuauucuauuaaaag

SEQ ID NO: 30686 - RNA, 22 nt, Human
uugaagcaaggcgaaucuugug

SEQ ID NO: 30687 - RNA, 22 nt, Human
uugaagcacaaugucuuuuauc

SEQ ID NO: 30688 - RNA, 22 nt, Human
uugaagcugucuuucagaauca

SEQ ID NO: 30689 - RNA, 22 nt, Human
uugaaggacauccuauuucuag

SEQ ID NO: 30690 - RNA, 23 nt, Human
uugaaggagaaagcuuucuuggu

SEQ ID NO: 30691 - RNA, 22 nt, Human
uugaaggaggcuccuuuuuaaa

SEQ ID NO: 30692 - RNA, 22 nt, Human
uugaaggugacauaucuggagc

SEQ ID NO: 30693 - RNA, 22 nt, Human
uugaaguccuagccccugguaa

SEQ ID NO: 30694 - RNA, 22 nt, Human
uugaaguccuugccucuugcac

SEQ ID NO: 30695 - RNA, 22 nt, Human
uugaaguuguaguucagugaag

SEQ ID NO: 30696 - RNA, 22 nt, Human
uugaauaaaugagcagugaauu

SEQ ID NO: 30697 - RNA, 22 nt, Human
uugaauaauauguucaggagga

SEQ ID NO: 30698 - RNA, 22 nt, Human
uugaauaauguguauguuguua

SEQ ID NO: 30699 - RNA, 22 nt, Human
uugaauaguuuuggauagcaua

SEQ ID NO: 30700 - RNA, 22 nt, Human
uugaaucuauaauuucaguauu

SEQ ID NO: 30701 - RNA, 22 nt, Human
uugaaucuuagcucugccacuu

SEQ ID NO: 30702 - RNA, 22 nt, Human
uugaaugaauaguugcuagaag

SEQ ID NO: 30703 - RNA, 22 nt, Human
uugaaugaaugguccauauaga

SEQ ID NO: 30704 - RNA, 22 nt, Human
uugaauuagacuuugcuacagg

SEQ ID NO: 30705 - RNA, 18 nt, Human
uugaauucuucuacaugu

SEQ ID NO: 30706 - RNA, 23 nt, Human
uugaauuucucuugcaauauuua

SEQ ID NO: 30707 - RNA, 22 nt, Human
uugacaaaggaauugaaucucu

SEQ ID NO: 30708 - RNA, 22 nt, Human
uugacaagcgaaguaccauaau

SEQ ID NO: 30709 - RNA, 22 nt, Human
uugacaaguaauacuuaaauua

SEQ ID NO: 30710 - RNA, 22 nt, Human
uugacaaucccuguuagaagug

SEQ ID NO: 30711 - RNA, 22 nt, Human
uugacacaaacagugauguagu

SEQ ID NO: 30712 - RNA, 22 nt, Human
uugacacagaucaauauucaac

SEQ ID NO: 30713 - RNA, 22 nt, Human
uugacacagucaacuugauuuu

SEQ ID NO: 30714 - RNA, 22 nt, Human
uugacacaguuuucucauuaag

SEQ ID NO: 30715 - RNA, 22 nt, Human
uugacagaaauguauuugcaug

SEQ ID NO: 30716 - RNA, 22 nt, Human
uugacagagaaaagugugacuu

SEQ ID NO: 30717 - RNA, 22 nt, Human
uugacagcuauuuugcuuugau

SEQ ID NO: 30718 - RNA, 22 nt, Human
uugacaggaaaaaguuuaggau

SEQ ID NO: 30719 - RNA, 21 nt, Human
uugacaggaaagaggggagau

SEQ ID NO: 30720 - RNA, 22 nt, Human
uugacagggccaagaauggacc

SEQ ID NO: 30721 - RNA, 22 nt, Human
uugacaguauagcuuuaccuau

SEQ ID NO: 30722 - RNA, 22 nt, Human
uugacauaagacuuagaguauu

SEQ ID NO: 30723 - RNA, 22 nt, Human
uugacaucaaauagauaucuuu

SEQ ID NO: 30724 - RNA, 22 nt, Human
uugacauuuugucauauugaca

SEQ ID NO: 30725 - RNA, 22 nt, Human
uugacccaguuguaaaagagcu

SEQ ID NO: 30726 - RNA, 22 nt, Human
uugaccugggcacagugagcau

SEQ ID NO: 30727 - RNA, 22 nt, Human
uucccuuucuuaaagaguuagg

SEQ ID NO: 30728 - RNA, 22 nt, Human
uuccgagucuccaagggguugu

SEQ ID NO: 30729 - RNA, 22 nt, Human
uuccgcuggggccgccuggcgg

SEQ ID NO: 30730 - RNA, 22 nt, Human
uuccggacgcccgucuuccagc

SEQ ID NO: 30731 - RNA, 22 nt, Human
uuccggggauaguguuucccau

SEQ ID NO: 30732 - RNA, 22 nt, Human
uuccuaacaagggguauucauc

SEQ ID NO: 30733 - RNA, 22 nt, Human
uuccuaacacaguguaagcaag

SEQ ID NO: 30734 - RNA, 22 nt, Human
uuccuaacgccaguauuuucau

SEQ ID NO: 30735 - RNA, 22 nt, Human
uuccuaacuggccuuuauggau

SEQ ID NO: 30736 - RNA, 22 nt, Human
uuccuacauuugccucacuccc

SEQ ID NO: 30737 - RNA, 22 nt, Human
uuccuagaaugguuagaaaaua

SEQ ID NO: 30738 - RNA, 22 nt, Human
uuccuaggauggugaagcagga

SEQ ID NO: 30739 - RNA, 19 nt, Human
uuccuaguagacugugugu

SEQ ID NO: 30740 - RNA, 22 nt, Human
uuccuaugugggcagagacaca

SEQ ID NO: 30741 - RNA, 22 nt, Human
uuccuauuuccaugaaacacaa

SEQ ID NO: 30742 - RNA, 22 nt, Human
uuccucagacccucauugugag

SEQ ID NO: 30743 - RNA, 22 nt, Human
uuccucagcuggccugauuggg

SEQ ID NO: 30744 - RNA, 22 nt, Human
uuccucagcuuuagacuaugaa

SEQ ID NO: 30745 - RNA, 22 nt, Human
uuccucaugggguuccuucaga

SEQ ID NO: 30746 - RNA, 22 nt, Human
uuccuccagaagcuguagggga

SEQ ID NO: 30747 - RNA, 22 nt, Human
uuccuccuuguccuaguuacug

SEQ ID NO: 30748 - RNA, 22 nt, Human
uuccucucaacaugccugccgg

SEQ ID NO: 30749 - RNA, 22 nt, Human
uuccucucucuugccagaaugu

SEQ ID NO: 30750 - RNA, 21 nt, Human
uuccucugcaacugaugcuca

SEQ ID NO: 30751 - RNA, 22 nt, Human
uuccucuguaguugcugaugaa

SEQ ID NO: 30752 - RNA, 22 nt, Human
uuccucuuauauagccuuggcc

SEQ ID NO: 30753 - RNA, 22 nt, Human
uuccucuuuagggcuggccagg

SEQ ID NO: 30754 - RNA, 22 nt, Human
uuccugaaugcuguugugcugu

SEQ ID NO: 30755 - RNA, 22 nt, Human
uuccugaauugagcuuuagaaa

SEQ ID NO: 30756 - RNA, 22 nt, Human
uuccugagaaauuuguaccugg

SEQ ID NO: 30757 - RNA, 22 nt, Human
uuccugagacccucacagugau

SEQ ID NO: 30758 - RNA, 22 nt, Human
uuccugagcaccagacacugca

SEQ ID NO: 30759 - RNA, 22 nt, Human
uuccugaggaggaccaggacca

SEQ ID NO: 30760 - RNA, 22 nt, Human
uuccugaggcucaucggagucg

SEQ ID NO: 30761 - RNA, 22 nt, Human
uuccugagggacuuuugagauu

SEQ ID NO: 30762 - RNA, 22 nt, Human
uuccugagggccccagaggagg

SEQ ID NO: 30763 - RNA, 22 nt, Human
uuccugauagaacacuuuccaa

SEQ ID NO: 30764 - RNA, 22 nt, Human
uuccugaucccccaggacaaag

SEQ ID NO: 30765 - RNA, 22 nt, Human
uuccugaugcacacagucauuu

SEQ ID NO: 30766 - RNA, 22 nt, Human
uuccugcaggccauagagccug

SEQ ID NO: 30767 - RNA, 22 nt, Human
uuccuggcacccuggacccggc

SEQ ID NO: 30768 - RNA, 22 nt, Human
uuccuggcaugaaaaauaucac

SEQ ID NO: 30769 - RNA, 22 nt, Human
uuccuggccagcuguggugagu

SEQ ID NO: 30770 - RNA, 22 nt, Human
uuccuggccccauccaucuuca

SEQ ID NO: 30771 - RNA, 22 nt, Human
uuccuggccucuuccaccacca

SEQ ID NO: 30772 - RNA, 22 nt, Human
uuccuggcucacagcagugggg

SEQ ID NO: 30773 - RNA, 22 nt, Human
uuccuggcuucauacuuuguac

SEQ ID NO: 30774 - RNA, 22 nt, Human
uuccugggacuggagcagccca

SEQ ID NO: 30775 - RNA, 22 nt, Human
uuccugggagcuagccacaucu

SEQ ID NO: 30776 - RNA, 20 nt, Human
uuccuggggaaugauagaag

SEQ ID NO: 30777 - RNA, 21 nt, Human
uuccuggggacuuccguggga

SEQ ID NO: 30778 - RNA, 22 nt, Human
uuccugggguacuggagaaaau

SEQ ID NO: 30779 - RNA, 22 nt, Human
uuccugguaaauuauguccagg

SEQ ID NO: 30780 - RNA, 22 nt, Human
uuccuggugaccucacugguag

SEQ ID NO: 30781 - RNA, 22 nt, Human
uuccuggugagauuucguucug

SEQ ID NO: 30782 - RNA, 22 nt, Human
uuccuggugguggugacagcac

SEQ ID NO: 30783 - RNA, 22 nt, Human
uuccuguauuuugcgaauuuuc

SEQ ID NO: 30784 - RNA, 22 nt, Human
uuccuguccgcaauggccuggg

SEQ ID NO: 30785 - RNA, 22 nt, Human
uuccuguggcugucacuccugg

SEQ ID NO: 30786 - RNA, 17 nt, Human
uuccugugguuugaucu

SEQ ID NO: 30787 - RNA, 22 nt, Human
uuccuguguccuauuucgacuu

SEQ ID NO: 30788 - RNA, 22 nt, Human
uuccuguuagccauuauuagcu

SEQ ID NO: 30789 - RNA, 22 nt, Human
uuccuuagugacuucuagcuac

SEQ ID NO: 30790 - RNA, 22 nt, Human
uuccuucagcaaguccugagca

SEQ ID NO: 30791 - RNA, 22 nt, Human
uuccuucaguucagggaacccu

SEQ ID NO: 30792 - RNA, 22 nt, Human
uuccuuccacuucaggauuuug

SEQ ID NO: 30793 - RNA, 22 nt, Human
uuccuuccucuuucacaacagc

SEQ ID NO: 30794 - RNA, 22 nt, Human
uuccuucuagcccaaguauugg

SEQ ID NO: 30795 - RNA, 22 nt, Human
uuccuucuauucagcuccaaga

SEQ ID NO: 30796 - RNA, 22 nt, Human
uuccuucuuccagaggcugccc

SEQ ID NO: 30797 - RNA, 22 nt, Human
uuccuugagaaaggcacaaguu

SEQ ID NO: 30798 - RNA, 22 nt, Human
uuccuuggagucaaacagggag

SEQ ID NO: 30799 - RNA, 20 nt, Human
uuccuuggauugugucuuga

SEQ ID NO: 30800 - RNA, 22 nt, Human
uuccuugggaaaugcucguuua

SEQ ID NO: 30801 - RNA, 22 nt, Human
uuccuuggguucugauguguuu

SEQ ID NO: 30802 - RNA, 22 nt, Human
uuccuugguagagagaauauuu

SEQ ID NO: 30803 - RNA, 22 nt, Human
uuccuuggugcgccugcugcag

SEQ ID NO: 30804 - RNA, 22 nt, Human
uuccuugguguaacugcuccua

SEQ ID NO: 30805 - RNA, 22 nt, Human
uuccuuguaagaccuauuuuug

SEQ ID NO: 30806 - RNA, 22 nt, Human
uuccuuguggaaacuauggacg

SEQ ID NO: 30807 - RNA, 22 nt, Human
uuccuuucccuugcuucugugc

SEQ ID NO: 30808 - RNA, 22 nt, Human
uuccuuucugucagccugagug

SEQ ID NO: 30809 - RNA, 22 nt, Human
uuccuuuucuuaaacauaugug

SEQ ID NO: 30810 - RNA, 22 nt, Human
uuccuuuucuuaugcaucauua

SEQ ID NO: 30811 - RNA, 22 nt, Human
uucgacucugugccugaagagc

SEQ ID NO: 30812 - RNA, 22 nt, Human
uucgcuuugcccguugucauuu

SEQ ID NO: 30813 - RNA, 22 nt, Human
uucggcauauuaauggugggug

SEQ ID NO: 30814 - RNA, 22 nt, Human
uucggcuuggguauuucucagg

SEQ ID NO: 30815 - RNA, 22 nt, Human
uucggcuuuccaguuugucucg

SEQ ID NO: 30816 - RNA, 22 nt, Human
uucguauuuauauucucaauac

SEQ ID NO: 30817 - RNA, 18 nt, Human
uucuaaauucuguuuuua

SEQ ID NO: 30818 - RNA, 22 nt, Human
uucuaaauuuuggaagaugcag

SEQ ID NO: 30819 - RNA, 20 nt, Human
uucuaacuacucucccuuug

SEQ ID NO: 30820 - RNA, 22 nt, Human
uucuaacucuguuauguguuuc

SEQ ID NO: 30821 - RNA, 21 nt, Human
uucuaacugggugggccuuga

SEQ ID NO: 30822 - RNA, 22 nt, Human
uucuaacuuaacacuccuguga

SEQ ID NO: 30823 - RNA, 22 nt, Human
uucuaagaaugcuuugcaaaau

SEQ ID NO: 30824 - RNA, 22 nt, Human
uucuaagagaguacaagcaauu

SEQ ID NO: 30825 - RNA, 22 nt, Human
uucuaagcucugaaauaaaucu

SEQ ID NO: 30826 - RNA, 22 nt, Human
uucuaagucacucagauuuugg

SEQ ID NO: 30827 - RNA, 21 nt, Human
uucuaaguguuaccuuuucuu

SEQ ID NO: 30828 - RNA, 22 nt, Human
uucuaaguuucucaguuucagu

SEQ ID NO: 30829 - RNA, 22 nt, Human
uucuaauacacgguaugacuuu

SEQ ID NO: 30830 - RNA, 22 nt, Human
uucuaauccugacucagcugcu

SEQ ID NO: 30831 - RNA, 22 nt, Human
uugcaaaucuuugccagaaggc

SEQ ID NO: 30832 - RNA, 22 nt, Human
uugcaaaugaccauugccacau

SEQ ID NO: 30833 - RNA, 22 nt, Human
uugcaaaugggcaaagcagauc

SEQ ID NO: 30834 - RNA, 22 nt, Human
uugcaaaugugaauaauuacac

SEQ ID NO: 30835 - RNA, 22 nt, Human
uugcaaauuauuuuagucccuu

SEQ ID NO: 30836 - RNA, 22 nt, Human
uugcaaauuccaauccaauauu

SEQ ID NO: 30837 - RNA, 22 nt, Human
uugcaaauucgucacuguuaaa

SEQ ID NO: 30838 - RNA, 22 nt, Human
uugcaacacaaaguuugauucc

SEQ ID NO: 30839 - RNA, 22 nt, Human
uugcaagacacuuggaagcaca

SEQ ID NO: 30840 - RNA, 20 nt, Human
uugcaagcuuucaagauagc

SEQ ID NO: 30841 - RNA, 22 nt, Human
uugcaagggauaccauacuaag

SEQ ID NO: 30842 - RNA, 23 nt, Human
uuuauucucagauacauaggucu

SEQ ID NO: 30843 - RNA, 22 nt, Human
uuuauucucuaguuggucagau

SEQ ID NO: 30844 - RNA, 22 nt, Human
uuuauugaauuguaacccuauu

SEQ ID NO: 30845 - RNA, 22 nt, Human
uuuauugacccaaagcgagagu

SEQ ID NO: 30846 - RNA, 22 nt, Human
uuuauugacuucagugagucuu

SEQ ID NO: 30847 - RNA, 22 nt, Human
uuuauugcuggccaccuguagc

SEQ ID NO: 30848 - RNA, 22 nt, Human
uuuauugcuguguuagggacag

SEQ ID NO: 30849 - RNA, 22 nt, Human
uuuauugucaaucuauucccag

SEQ ID NO: 30850 - RNA, 22 nt, Human
uuuauuguugggucuuaagcug

SEQ ID NO: 30851 - RNA, 22 nt, Human
uuuauuguuuagaagggggcug

SEQ ID NO: 30852 - RNA, 21 nt, Human
uuuauuuauauaggacacaug

SEQ ID NO: 30853 - RNA, 22 nt, Human
uuuauuuauccuucuggauugc

SEQ ID NO: 30854 - RNA, 22 nt, Human
uuuauuucacucuccggauacu

SEQ ID NO: 30855 - RNA, 22 nt, Human
uuuauuuggcauccagggagaa

SEQ ID NO: 30856 - RNA, 15 nt, Human
uuucaaaaugaggcc

SEQ ID NO: 30857 - RNA, 22 nt, Human
uuucaaacauaucuucauuacu

SEQ ID NO: 30858 - RNA, 22 nt, Human
uuucaaacauuccugggagacu

SEQ ID NO: 30859 - RNA, 22 nt, Human
uuucaaagagaggcagaaggaa

SEQ ID NO: 30860 - RNA, 22 nt, Human
uuucaaagcaacugaaaaggaa

SEQ ID NO: 30861 - RNA, 20 nt, Human
uuucaaaggcaccuaugaag

SEQ ID NO: 30862 - RNA, 22 nt, Human
uuucaaagucaagaaggauacu

SEQ ID NO: 30863 - RNA, 22 nt, Human
uuucaaagucaauaucauuacc

SEQ ID NO: 30864 - RNA, 22 nt, Human
uuucaaauaccauaaaccuaau

SEQ ID NO: 30865 - RNA, 22 nt, Human
uuucaaaugcaugucuuuccuc

SEQ ID NO: 30866 - RNA, 22 nt, Human
uuucaacguguaaucuuauuua

SEQ ID NO: 30867 - RNA, 22 nt, Human
uuucaacuagccccuaaguccu

SEQ ID NO: 30868 - RNA, 22 nt, Human
uuucaagaacagcagcauucca

SEQ ID NO: 30869 - RNA, 22 nt, Human
uuucaagagggaacugaacaca

SEQ ID NO: 30870 - RNA, 22 nt, Human
uuucaagcagcgugaaaaacga

SEQ ID NO: 30871 - RNA, 22 nt, Human
uuucaagcauaacugggaagag

SEQ ID NO: 30872 - RNA, 22 nt, Human
uuucaaggauguuauauaaaug

SEQ ID NO: 30873 - RNA, 22 nt, Human
uuucaaggccuucugguucagu

SEQ ID NO: 30874 - RNA, 22 nt, Human
uuucaaggcuaguuuuaauuag

SEQ ID NO: 30875 - RNA, 22 nt, Human
uuucaagggaauaugaaauuca

SEQ ID NO: 30876 - RNA, 23 nt, Human
uuucaaggugucuguaccacuga

SEQ ID NO: 30877 - RNA, 22 nt, Human
uuucaagucauucuauaauauc

SEQ ID NO: 30878 - RNA, 22 nt, Human
uuucaaguguccugauuaaugg

SEQ ID NO: 30879 - RNA, 20 nt, Human
uuucaaguuguaagguauca

SEQ ID NO: 30880 - RNA, 22 nt, Human
uuucaaguuuaguguguucaaa

SEQ ID NO: 30881 - RNA, 22 nt, Human
uuucaauaacaaagcucauuuu

SEQ ID NO: 30882 - RNA, 22 nt, Human
uuucaaucaccauaaagcaacu

SEQ ID NO: 30883 - RNA, 19 nt, Human
uuucaauggcuuagagaaa

SEQ ID NO: 30884 - RNA, 22 nt, Human
uuucaauguaacauuuccaggc

SEQ ID NO: 30885 - RNA, 22 nt, Human
uuucacaaaugucuuuaacuug

SEQ ID NO: 30886 - RNA, 22 nt, Human
uuucacaacguuguggugagag

SEQ ID NO: 30887 - RNA, 22 nt, Human
uuucacaagacagcuacuguug

SEQ ID NO: 30888 - RNA, 22 nt, Human
uuucacaaucaaauggugaaau

SEQ ID NO: 30889 - RNA, 22 nt, Human
uuucacacaacgugaauauacu

SEQ ID NO: 30890 - RNA, 22 nt, Human
uuucacagaaaggauaacauua

SEQ ID NO: 30891 - RNA, 23 nt, Human
uuucacagaaggauuguagggcc

SEQ ID NO: 30892 - RNA, 22 nt, Human
uuucacagagaaauauaacagg

SEQ ID NO: 30893 - RNA, 22 nt, Human
uuucacagaggaggaagcugag

SEQ ID NO: 30894 - RNA, 22 nt, Human
uuucacagauguuuuggagucu

SEQ ID NO: 30895 - RNA, 22 nt, Human
uuucacagcaacacugucugca

SEQ ID NO: 30896 - RNA, 22 nt, Human
uuucacagcauauagguguacu

SEQ ID NO: 30897 - RNA, 22 nt, Human
uuucacagcgucuuucucuugc

SEQ ID NO: 30898 - RNA, 23 nt, Human
uuucacagcuuuuauucugcauc

SEQ ID NO: 30899 - RNA, 22 nt, Human
uuucacaggauucugauguagu

SEQ ID NO: 30900 - RNA, 22 nt, Human
uuucacagguacaaacacuccu

SEQ ID NO: 30901 - RNA, 22 nt, Human
uuucacauauaggggaagcuac

SEQ ID NO: 30902 - RNA, 22 nt, Human
uuucacaucaugggauggaagc

SEQ ID NO: 30903 - RNA, 22 nt, Human
uuucacaugcagcagggaagug

SEQ ID NO: 30904 - RNA, 22 nt, Human
uuucacauggaagcucucgaga

SEQ ID NO: 30905 - RNA, 22 nt, Human
uuucacauucucugguuaucga

SEQ ID NO: 30906 - RNA, 22 nt, Human
uuucacauucuucugaaucuac

SEQ ID NO: 30907 - RNA, 22 nt, Human
uuucacauuuaggcgugaauug

SEQ ID NO: 30908 - RNA, 22 nt, Human
uuucacauuuguuuuaagaagu

SEQ ID NO: 30909 - RNA, 20 nt, Human
uuucacuguggugcuggaga

SEQ ID NO: 30910 - RNA, 22 nt, Human
uuucacuguguuggucaggccg

SEQ ID NO: 30911 - RNA, 22 nt, Human
uuucagaaacgauuaugaacac

SEQ ID NO: 30912 - RNA, 22 nt, Human
uuucagaaaucaaaaccagggu

SEQ ID NO: 30913 - RNA, 22 nt, Human
uuucagaaauuguuauuauucu

SEQ ID NO: 30914 - RNA, 22 nt, Human
uuucagaaccaagagagacauc

SEQ ID NO: 30915 - RNA, 22 nt, Human
uuucagaaccgcuaaaauaaau

SEQ ID NO: 30916 - RNA, 22 nt, Human
uuucagaauagcaaagcaagcu

SEQ ID NO: 30917 - RNA, 22 nt, Human
uuucagacaggcucagagccgu

SEQ ID NO: 30918 - RNA, 21 nt, Human
uuucagaccuaucuuugaagg

SEQ ID NO: 30919 - RNA, 22 nt, Human
uuucagaccugcugugcuaucu

SEQ ID NO: 30920 - RNA, 22 nt, Human
uuucagagaaagcccaaagacu

SEQ ID NO: 30921 - RNA, 22 nt, Human
uuucagagaacugaguccuugc

SEQ ID NO: 30922 - RNA, 22 nt, Human
uuucagaggagagcuggaccaa

SEQ ID NO: 30923 - RNA, 22 nt, Human
uuucagaggugcuuggaaugcu

SEQ ID NO: 30924 - RNA, 20 nt, Human
uuucagagugucuuuccauu

SEQ ID NO: 30925 - RNA, 22 nt, Human
uuucagaguuaguagagcaugu

SEQ ID NO: 30926 - RNA, 22 nt, Human
uuucagaguugucuucuugacc

SEQ ID NO: 30927 - RNA, 22 nt, Human
uuucagaugaaauguguauauu

SEQ ID NO: 30928 - RNA, 22 nt, Human
uuucagauuaucucaacuuugg

SEQ ID NO: 30929 - RNA, 23 nt, Human
uuucagcauucuaguucagguuc

SEQ ID NO: 30930 - RNA, 22 nt, Human
uuucaggaaacauuuaauggca

SEQ ID NO: 30931 - RNA, 22 nt, Human
uuucaggacaccuuuaaaaacg

SEQ ID NO: 30932 - RNA, 22 nt, Human
uuucaggauuaguuuaagcagg

SEQ ID NO: 30933 - RNA, 22 nt, Human
uuucaggcagguggaaugagua

SEQ ID NO: 30934 - RNA, 22 nt, Human
uuucagggagccuagaagagcu

SEQ ID NO: 30935 - RNA, 22 nt, Human
uuucagguaagaaaacuaagaa

SEQ ID NO: 30936 - RNA, 20 nt, Human
uuucagugguuugugccuag

SEQ ID NO: 30937 - RNA, 21 nt, Human
uuucaguguaugacagugaaa

SEQ ID NO: 30938 - RNA, 22 nt, Human
uuucagugucaguaaugcagca

SEQ ID NO: 30939 - RNA, 22 nt, Human
uuucaguucaccugggaacccg

SEQ ID NO: 30940 - RNA, 22 nt, Human
uuuguaugggcagaaauuagau

SEQ ID NO: 30941 - RNA, 22 nt, Human
uuuguauuccauaucaugccau

SEQ ID NO: 30942 - RNA, 22 nt, Human
uuugucaaucccuugaaaaccu

SEQ ID NO: 30943 - RNA, 22 nt, Human
uuugucaggaauugaaaaguuu

SEQ ID NO: 30944 - RNA, 22 nt, Human
uuugucagggaucagaucggua

SEQ ID NO: 30945 - RNA, 22 nt, Human
uuugucagucaugucugcuuuu

SEQ ID NO: 30946 - RNA, 22 nt, Human
uuugucauaacucugcugcaag

SEQ ID NO: 30947 - RNA, 22 nt, Human
uuugucauauugaaggugcuua

SEQ ID NO: 30948 - RNA, 22 nt, Human
uuugucaucaguuauuaauaug

SEQ ID NO: 30949 - RNA, 22 nt, Human
uuugucauucuguguauuuaaa

SEQ ID NO: 30950 - RNA, 18 nt, Human
uuuguccuguggcagcug

SEQ ID NO: 30951 - RNA, 22 nt, Human
uuugucuugaggcuggggaagu

SEQ ID NO: 30952 - RNA, 22 nt, Human
uuugugaacacugcgcagaacu

SEQ ID NO: 30953 - RNA, 22 nt, Human
uuugugaagggaacagaagugu

SEQ ID NO: 30954 - RNA, 22 nt, Human
uuugugacuugcuucucagaau

SEQ ID NO: 30955 - RNA, 22 nt, Human
uuugugaucuccucccucuaga

SEQ ID NO: 30956 - RNA, 22 nt, Human
uuugugcacuucuguagcugcc

SEQ ID NO: 30957 - RNA, 22 nt, Human
uuugugcagugguuaagaccau

SEQ ID NO: 30958 - RNA, 22 nt, Human
uuuguggaacucucuucuugca

SEQ ID NO: 30959 - RNA, 22 nt, Human
uuugugugaaaauauuuaaguu

SEQ ID NO: 30960 - RNA, 22 nt, Human
uuugugugcaacgcauggaguc

SEQ ID NO: 30961 - RNA, 22 nt, Human
uuuguguggauggaaggcagua

SEQ ID NO: 30962 - RNA, 22 nt, Human
uuugugugggggaaacaaggua

SEQ ID NO: 30963 - RNA, 22 nt, Human
uuuguguuaaauguuaaauuca

SEQ ID NO: 30964 - RNA, 22 nt, Human
uuuguuaauucuuauguuagag

SEQ ID NO: 30965 - RNA, 22 nt, Human
uuuguucaaggaauaguaaaug

SEQ ID NO: 30966 - RNA, 22 nt, Human
uuuguucacaugucauguacaa

SEQ ID NO: 30967 - RNA, 22 nt, Human
uuuguucauuuugagcucauca

SEQ ID NO: 30968 - RNA, 22 nt, Human
uuuguucugaaaacucaagucc

SEQ ID NO: 30969 - RNA, 22 nt, Human
uuuguugaguuacagagaugaa

SEQ ID NO: 30970 - RNA, 22 nt, Human
uuuguugugaacagaauaauau

SEQ ID NO: 30971 - RNA, 22 nt, Human
uuuguuugaaagucucuacagc

SEQ ID NO: 30972 - RNA, 22 nt, Human
uuuguuuugaacuagcucagaa

SEQ ID NO: 30973 - RNA, 22 nt, Human
uugucuguaaagacggccacca

SEQ ID NO: 30974 - RNA, 22 nt, Human
uugucuuagagugaaaacuuua

SEQ ID NO: 30975 - RNA, 22 nt, Human
uugucuuuggaaauuuaauguu

SEQ ID NO: 30976 - RNA, 22 nt, Human
uugugaaacauucauggauuug

SEQ ID NO: 30977 - RNA, 21 nt, Human
uugugaaaguccaggaacaac

SEQ ID NO: 30978 - RNA, 18 nt, Human
uugugaaauauuggaguc

SEQ ID NO: 30979 - RNA, 22 nt, Human
uugugaaauguuucaaaauagu

SEQ ID NO: 30980 - RNA, 22 nt, Human
uugugaauagugccacaauaaa

SEQ ID NO: 30981 - RNA, 22 nt, Human
uugugacauugauuaaacuaug

SEQ ID NO: 30982 - RNA, 19 nt, Human
uugugacuggcucugcaua

SEQ ID NO: 30983 - RNA, 22 nt, Human
uugugagcauuuuggugagcuu

SEQ ID NO: 30984 - RNA, 22 nt, Human
uugugaguagugccgcaauaaa

SEQ ID NO: 30985 - RNA, 22 nt, Human
uugugaucuguguugauggccu

SEQ ID NO: 30986 - RNA, 22 nt, Human
uugugcaagaauuggaaagcaa

SEQ ID NO: 30987 - RNA, 22 nt, Human
uugugcaaggcucuuggaaugu

SEQ ID NO: 30988 - RNA, 22 nt, Human
uugugcaauccccucauuuuau

SEQ ID NO: 30989 - RNA, 22 nt, Human
uugugcaauuuaaaaucuuccu

SEQ ID NO: 30990 - RNA, 22 nt, Human
uugugcagcuauaaagaaaugg

SEQ ID NO: 30991 - RNA, 22 nt, Human
uugugcauauagaguuagaugg

SEQ ID NO: 30992 - RNA, 22 nt, Human
uugugccaugaacuguaugaag

SEQ ID NO: 30993 - RNA, 22 nt, Human
uugugcucuaaggucagggcga

SEQ ID NO: 30994 - RNA, 22 nt, Human
uugugcugcugacuuaagauau

SEQ ID NO: 30995 - RNA, 22 nt, Human
uuguggcucaucuucagcuccc

SEQ ID NO: 30996 - RNA, 22 nt, Human
uugugggaucucccuguugcuc

SEQ ID NO: 30997 - RNA, 23 nt, Human
uugugggcagauuccauggggag

SEQ ID NO: 30998 - RNA, 22 nt, Human
uugugguuaaccgcacauuuuu

SEQ ID NO: 30999 - RNA, 22 nt, Human
uuguguaaaugucugucuuucu

SEQ ID NO: 31000 - RNA, 22 nt, Human
uuguguacuacaguaugccaca

SEQ ID NO: 31001 - RNA, 22 nt, Human
uuguguacuguugguugauauu

SEQ ID NO: 31002 - RNA, 20 nt, Human
uuguguaggucuaaugcaua

SEQ ID NO: 31003 - RNA, 22 nt, Human
uugugucaggggcccauacuca

SEQ ID NO: 31004 - RNA, 22 nt, Human
uugugucauguuccauugaaaa

SEQ ID NO: 31005 - RNA, 22 nt, Human
uuguguccauuugagucaugug

SEQ ID NO: 31006 - RNA, 22 nt, Human
uuguguccuauaugcauguucu

SEQ ID NO: 31007 - RNA, 22 nt, Human
uuguguccugauuugacacaau

SEQ ID NO: 31008 - RNA, 22 nt, Human
uugugucuaaauaaggagaccu

SEQ ID NO: 31009 - RNA, 22 nt, Human
uugugugcauaaauucugaugu

SEQ ID NO: 31010 - RNA, 22 nt, Human
uuguguguacugguuaugggca

SEQ ID NO: 31011 - RNA, 21 nt, Human
uuguguuuccccagucacuuu

SEQ ID NO: 31012 - RNA, 22 nt, Human
uuguuaaaaauagauuuccagg

SEQ ID NO: 31013 - RNA, 22 nt, Human
uuguuaaaaugaggucauucug

SEQ ID NO: 31014 - RNA, 22 nt, Human
uuguuaaaauuggagccgagag

SEQ ID NO: 31015 - RNA, 22 nt, Human
uuguuaaagaugcagauuccau

SEQ ID NO: 31016 - RNA, 22 nt, Human
uuguuaacggaaaacuguuuuc

SEQ ID NO: 31017 - RNA, 22 nt, Human
uuguuacagcagcaauagaaaa

SEQ ID NO: 31018 - RNA, 22 nt, Human
uuguuacauggacaacuguaug

SEQ ID NO: 31019 - RNA, 22 nt, Human
uuguuacuaagccuuuaaauag

SEQ ID NO: 31020 - RNA, 22 nt, Human
uuguuacuguucuacauacagu

SEQ ID NO: 31021 - RNA, 22 nt, Human
uuguuagauauuucuuagaaga

SEQ ID NO: 31022 - RNA, 22 nt, Human
uuguuagugcaauguuugguga

SEQ ID NO: 31023 - RNA, 22 nt, Human
uuguuauaaagacuaaauaugu

SEQ ID NO: 31024 - RNA, 22 nt, Human
uuguuaucaaugaaucaaaacu

SEQ ID NO: 31025 - RNA, 22 nt, Human
uuguucauccaacacaagguug

SEQ ID NO: 31026 - RNA, 19 nt, Human
uuguucguuccugacaggc

SEQ ID NO: 31027 - RNA, 22 nt, Human
uuguucuagccuccuguuuuga

SEQ ID NO: 31028 - RNA, 22 nt, Human
uuguucuauggugaggcagcca

SEQ ID NO: 31029 - RNA, 21 nt, Human
uuguucuuccagaagcaaagu

SEQ ID NO: 31030 - RNA, 22 nt, Human
uuguucuugccaagacaugaag

SEQ ID NO: 31031 - RNA, 20 nt, Human
uuguugagcucuucaaagaa

SEQ ID NO: 31032 - RNA, 22 nt, Human
uuguugcugcucaaccucuaua

SEQ ID NO: 31033 - RNA, 22 nt, Human
uuguuggaaaugagaggcuagg

SEQ ID NO: 31034 - RNA, 22 nt, Human
uuguugggcaugcaguggcugu

SEQ ID NO: 31035 - RNA, 22 nt, Human
uuguugucauuguagaggauuu

SEQ ID NO: 31036 - RNA, 22 nt, Human
uuguuuaauccuuguacccaug

SEQ ID NO: 31037 - RNA, 22 nt, Human
uuguuuacacugcagaauuggg

SEQ ID NO: 31038 - RNA, 22 nt, Human
uuguuuauguguugucuauggc

SEQ ID NO: 31039 - RNA, 22 nt, Human
uuguuuccauaauuaaguguga

SEQ ID NO: 31040 - RNA, 21 nt, Human
uuguuuccucccaaaaugcca

SEQ ID NO: 31041 - RNA, 22 nt, Human
uuguuucugaguuuucauguau

SEQ ID NO: 31042 - RNA, 22 nt, Human
uuguuucuucaggcuuuuagga

SEQ ID NO: 31043 - RNA, 22 nt, Human
uuguuucuuugaaguuucuaga

SEQ ID NO: 31044 - RNA, 23 nt, Human
uuguuucuuuguauugucucuau

SEQ ID NO: 31045 - RNA, 22 nt, Human
uuguuugucauaauaucauuac

SEQ ID NO: 31046 - RNA, 22 nt, Human
uuguuugugcuauuuaauguag

SEQ ID NO: 31047 - RNA, 20 nt, Human
uuguuuuaaauccuggauga

SEQ ID NO: 31048 - RNA, 22 nt, Human
uuguuuucacagcuuugcccgg

SEQ ID NO: 31049 - RNA, 21 nt, Human
uugcugcccucccuuuccuca

SEQ ID NO: 31050 - RNA, 22 nt, Human
uugcugccugaggagcaacacu

SEQ ID NO: 31051 - RNA, 20 nt, Human
uugcugggaccuuuuucaac

SEQ ID NO: 31052 - RNA, 22 nt, Human
uugcugggcucuucaacacaca

SEQ ID NO: 31053 - RNA, 22 nt, Human
uugcuguaccaaagauuccuga

SEQ ID NO: 31054 - RNA, 22 nt, Human
uugcuguuuaaugaugucuuau

SEQ ID NO: 31055 - RNA, 22 nt, Human
uugcuuaauucugaaaauauag

SEQ ID NO: 31056 - RNA, 22 nt, Human
uugcuuagcgacuccccuuccu

SEQ ID NO: 31057 - RNA, 21 nt, Human
uugcuuauggcacugcuuugc

SEQ ID NO: 31058 - RNA, 22 nt, Human
uugcuuauuugauuaaaugucu

SEQ ID NO: 31059 - RNA, 22 nt, Human
uugcuucagucagugcugccca

SEQ ID NO: 31060 - RNA, 22 nt, Human
uugcuucauuaaguucucacag

SEQ ID NO: 31061 - RNA, 22 nt, Human
uugcuucccccuguucuaguuc

SEQ ID NO: 31062 - RNA, 22 nt, Human
uugcuuccuccuagccacuugc

SEQ ID NO: 31063 - RNA, 22 nt, Human
uugcuugcagacuuagcaaauu

SEQ ID NO: 31064 - RNA, 22 nt, Human
uugcuuuaacuaguaaaugggg

SEQ ID NO: 31065 - RNA, 22 nt, Human
uugcuuuacauguucugguaaa

SEQ ID NO: 31066 - RNA, 22 nt, Human
uugcuuuacggcaaggccccag

SEQ ID NO: 31067 - RNA, 22 nt, Human
uugcuuuagaaucugcuucugg

SEQ ID NO: 31068 - RNA, 22 nt, Human
uugcuuuaggauuuaaguggca

SEQ ID NO: 31069 - RNA, 20 nt, Human
uugcuuuaucagacaugaua

SEQ ID NO: 31070 - RNA, 22 nt, Human
uugcuuuauucacaucuauauu

SEQ ID NO: 31071 - RNA, 22 nt, Human
uugcuuuauuuggcaugccacu

SEQ ID NO: 31072 - RNA, 22 nt, Human
uugcuuucccaaggcagaacau

SEQ ID NO: 31073 - RNA, 22 nt, Human
uugcuuugccaccagaagucua

SEQ ID NO: 31074 - RNA, 22 nt, Human
uugcuuugguagcagcuauaga

SEQ ID NO: 31075 - RNA, 22 nt, Human
uugcuuuguggugguucuucca

SEQ ID NO: 31076 - RNA, 22 nt, Human
uugcuuuuuaauuaggaggcag

SEQ ID NO: 31077 - RNA, 22 nt, Human
uuggaaaaauugccugaugucu

SEQ ID NO: 31078 - RNA, 22 nt, Human
uuggaaaacuuacacagagcug

SEQ ID NO: 31079 - RNA, 22 nt, Human
uuggaaaagugaaacuagaugc

SEQ ID NO: 31080 - RNA, 22 nt, Human
uuggaaaauguauuucuagaag

SEQ ID NO: 31081 - RNA, 22 nt, Human
uuggaaagaagggcugagcaag

SEQ ID NO: 31082 - RNA, 22 nt, Human
uuggaaagcaagcuggacauac

SEQ ID NO: 31083 - RNA, 22 nt, Human
uuggaaagggauaucuguacuu

SEQ ID NO: 31084 - RNA, 22 nt, Human
uuggaaagucucacccaguuga

SEQ ID NO: 31085 - RNA, 22 nt, Human
uuggaaaugcaaauauauugaa

SEQ ID NO: 31086 - RNA, 22 nt, Human
uuuacaacguuccuggugcuaa

SEQ ID NO: 31087 - RNA, 22 nt, Human
uuuacaacuuucuguucuguau

SEQ ID NO: 31088 - RNA, 22 nt, Human
uuuacaaguacaccuaacagcu

SEQ ID NO: 31089 - RNA, 19 nt, Human
uuuacaaguucuuuguaug

SEQ ID NO: 31090 - RNA, 22 nt, Human
uuuacacaaaauguuaguagau

SEQ ID NO: 31091 - RNA, 22 nt, Human
uuuacacggcauuaucuucaug

SEQ ID NO: 31092 - RNA, 22 nt, Human
uuuacacuccuggaaaugauau

SEQ ID NO: 31093 - RNA, 22 nt, Human
uuuacacugugaaacagguauc

SEQ ID NO: 31094 - RNA, 22 nt, Human
uuuacacuuauuaugaagcuuu

SEQ ID NO: 31095 - RNA, 22 nt, Human
uuuacagaucuguugauuuguu

SEQ ID NO: 31096 - RNA, 22 nt, Human
uuuacagaugaggauacugagg

SEQ ID NO: 31097 - RNA, 22 nt, Human
uuuacagauguggaaagugagc

SEQ ID NO: 31098 - RNA, 22 nt, Human
uuuacagcagcaugauuuauaa

SEQ ID NO: 31099 - RNA, 22 nt, Human
uuuacaguauaguaggacucau

SEQ ID NO: 31100 - RNA, 22 nt, Human
uuuacagugagagcuuagugag

SEQ ID NO: 31101 - RNA, 22 nt, Human
uuuacaucucaccagauucaua

SEQ ID NO: 31102 - RNA, 22 nt, Human
uuuacauguccuucaagagcag

SEQ ID NO: 31103 - RNA, 22 nt, Human
uuuaccaaaugagacuauuguu

SEQ ID NO: 31104 - RNA, 22 nt, Human
uuuaccaagauagcaucugguu

SEQ ID NO: 31105 - RNA, 22 nt, Human
uuuaccacaauuuuaaacaaug

SEQ ID NO: 31106 - RNA, 22 nt, Human
uuuaccaguguuaaacaccagc

SEQ ID NO: 31107 - RNA, 22 nt, Human
uuuaccauuauuaaaauuaagu

SEQ ID NO: 31108 - RNA, 22 nt, Human
uuuacccauucagacucacuug

SEQ ID NO: 31109 - RNA, 22 nt, Human
uuuaccuaguauaaugcaaccu

SEQ ID NO: 31110 - RNA, 22 nt, Human
uuuaccuuuugcuaugguggaa

SEQ ID NO: 31111 - RNA, 22 nt, Human
uuuacgaauggggugacaacuu

SEQ ID NO: 31112 - RNA, 22 nt, Human
uuuacuacuucauugacuuacg

SEQ ID NO: 31113 - RNA, 22 nt, Human
uuuacuguguccaucugugacu

SEQ ID NO: 31114 - RNA, 22 nt, Human
uuuacuguuacaccuaccuucu

SEQ ID NO: 31115 - RNA, 22 nt, Human
uuuacuguucaacuugcaagua

SEQ ID NO: 31116 - RNA, 22 nt, Human
uuuacuguuuuauauuguccag

SEQ ID NO: 31117 - RNA, 22 nt, Human
uuuacuuucucaaguauauagg

SEQ ID NO: 31118 - RNA, 22 nt, Human
uuuacuuugugucaagucaaga

SEQ ID NO: 31119 - RNA, 22 nt, Human
uuuagaagacagaugcacagcc

SEQ ID NO: 31120 - RNA, 22 nt, Human
uuuagaaggacuacagugugau

SEQ ID NO: 31121 - RNA, 22 nt, Human
uuuagaagggcuggucagaaau

SEQ ID NO: 31122 - RNA, 22 nt, Human
uuuagaaguucacacauuuaaa

SEQ ID NO: 31123 - RNA, 22 nt, Human
uuuagacaagauccuucugaau

SEQ ID NO: 31124 - RNA, 22 nt, Human
uuuagacacacuuuguauauuu

SEQ ID NO: 31125 - RNA, 22 nt, Human
uuuagacacuagggaugcagug

SEQ ID NO: 31126 - RNA, 22 nt, Human
uuuagacauuugugguuugcaa

SEQ ID NO: 31127 - RNA, 22 nt, Human
uuuagagaaguuaggaaauaaa

SEQ ID NO: 31128 - RNA, 22 nt, Human
uuuagagaauuagaacaguacu

SEQ ID NO: 31129 - RNA, 22 nt, Human
uuuagagacacacuggcauuug

SEQ ID NO: 31130 - RNA, 22 nt, Human
uuuagagagaauuuucaaagug

SEQ ID NO: 31131 - RNA, 22 nt, Human
uuuagaggcaucuugcuuuucu

SEQ ID NO: 31132 - RNA, 22 nt, Human
uuuagaguaaaaacugugaccu

SEQ ID NO: 31133 - RNA, 22 nt, Human
uuuagagucccuuucucaccac

SEQ ID NO: 31134 - RNA, 22 nt, Human
uuuagaguugguccccugugag

SEQ ID NO: 31135 - RNA, 22 nt, Human
uuuagaguuucuaaauggaauu

SEQ ID NO: 31136 - RNA, 22 nt, Human
uuuagcaaaacauuaugucugu

SEQ ID NO: 31137 - RNA, 22 nt, Human
uuuagcaaauauuucuguugau

SEQ ID NO: 31138 - RNA, 22 nt, Human
uuuagcaagguagguccaugga

SEQ ID NO: 31139 - RNA, 22 nt, Human
uuuagcaauuagaauccagcau

SEQ ID NO: 31140 - RNA, 22 nt, Human
uuuagcaauuauuaaggguuga

SEQ ID NO: 31141 - RNA, 20 nt, Human
uuuagcacauuguacaaaac

SEQ ID NO: 31142 - RNA, 22 nt, Human
uuuagcagaucuauguauguga

SEQ ID NO: 31143 - RNA, 22 nt, Human
uuuagcagcaaauaaguagugc

SEQ ID NO: 31144 - RNA, 22 nt, Human
uuuagcauauccuauaaaacua

SEQ ID NO: 31145 - RNA, 22 nt, Human
uuuagcauccaagguuaugacu

SEQ ID NO: 31146 - RNA, 23 nt, Human
uuuagcaugaagcagcuggagaa

SEQ ID NO: 31147 - RNA, 22 nt, Human
uuuagcauguuccuuucauaga

SEQ ID NO: 31148 - RNA, 22 nt, Human
uuuagcauuaagcuuuucaaau

SEQ ID NO: 31149 - RNA, 22 nt, Human
uuuagcuucaguucuagcuucu

SEQ ID NO: 31150 - RNA, 23 nt, Human
uuuagcuucccuuuaguuagggg

SEQ ID NO: 31151 - RNA, 22 nt, Human
uuuagcuucuucagcuuguuca

SEQ ID NO: 31152 - RNA, 22 nt, Human
uuuagcuuguuggaacaauuga

SEQ ID NO: 31153 - RNA, 22 nt, Human
uuuaggaagaucugaaggaaga

SEQ ID NO: 31154 - RNA, 22 nt, Human
uuuaggaaugugguuuuugagc

SEQ ID NO: 31155 - RNA, 22 nt, Human
uuuaggagucaaauguuuuagg

SEQ ID NO: 31156 - RNA, 22 nt, Human
uuuaggcaauagauggcagugu

SEQ ID NO: 31157 - RNA, 22 nt, Human
uuuaggcauacuuuugggagaa

SEQ ID NO: 31158 - RNA, 22 nt, Human
uuggccaacauggugaaacccc

SEQ ID NO: 31159 - RNA, 22 nt, Human
uuggccaagucacugguuaaug

SEQ ID NO: 31160 - RNA, 22 nt, Human
uuggccaauggugauucccggc

SEQ ID NO: 31161 - RNA, 22 nt, Human
uuggccagacacuaccccccuu

SEQ ID NO: 31162 - RNA, 22 nt, Human
uuggccagagaccagagcaggg

SEQ ID NO: 31163 - RNA, 22 nt, Human
uuggccagagguuucucucaug

SEQ ID NO: 31164 - RNA, 22 nt, Human
uuggccagguccauuucuccau

SEQ ID NO: 31165 - RNA, 22 nt, Human
uuggccagugaaccaggccugg

SEQ ID NO: 31166 - RNA, 22 nt, Human
uuggccaguggaaagaggagga

SEQ ID NO: 31167 - RNA, 22 nt, Human
uuggcccacaguaccaugcugu

SEQ ID NO: 31168 - RNA, 22 nt, Human
uuggcccagacucggggacuga

SEQ ID NO: 31169 - RNA, 22 nt, Human
uuggcccuagacucuaaguccg

SEQ ID NO: 31170 - RNA, 22 nt, Human
uuggcccuccaccuggcugugc

SEQ ID NO: 31171 - RNA, 22 nt, Human
uuggccguuucacugggcaguu

SEQ ID NO: 31172 - RNA, 22 nt, Human
uuggccucauggacagcucauc

SEQ ID NO: 31173 - RNA, 22 nt, Human
uuggccuucccuaccugggcca

SEQ ID NO: 31174 - RNA, 22 nt, Human
uuggccuuguacaucauauuaa

SEQ ID NO: 31175 - RNA, 22 nt, Human
uuggccuuguuaaggaggcccu

SEQ ID NO: 31176 - RNA, 22 nt, Human
uuggccuuugcugggcuguuga

SEQ ID NO: 31177 - RNA, 22 nt, Human
uuggcuaaccuggguuaucagc

SEQ ID NO: 31178 - RNA, 22 nt, Human
uuggcucaggaccccugugacu

SEQ ID NO: 31179 - RNA, 22 nt, Human
uuggcucagugugagggagaug

SEQ ID NO: 31180 - RNA, 20 nt, Human
uuggcucugaucaguggagc

SEQ ID NO: 31181 - RNA, 22 nt, Human
uuggcucugugucuccacucaa

SEQ ID NO: 31182 - RNA, 22 nt, Human
uuggcucuuuccucacacagga

SEQ ID NO: 31183 - RNA, 22 nt, Human
uuggcugacaaauggaaucucu

SEQ ID NO: 31184 - RNA, 22 nt, Human
uuggcugcauuuuggguucguu

SEQ ID NO: 31185 - RNA, 21 nt, Human
uuggcugccugagauuagaau

SEQ ID NO: 31186 - RNA, 22 nt, Human
uuggcugccuucaccccuggcc

SEQ ID NO: 31187 - RNA, 22 nt, Human
uuggcuggcuucucgacuuguu

SEQ ID NO: 31188 - RNA, 22 nt, Human
uuggcugucacugucaguucag

SEQ ID NO: 31189 - RNA, 22 nt, Human
uuggcugugagggguugcacag

SEQ ID NO: 31190 - RNA, 22 nt, Human
uuggcuuccaggggcuuuuaca

SEQ ID NO: 31191 - RNA, 22 nt, Human
uuggcuucuguuuuggcucugu

SEQ ID NO: 31192 - RNA, 22 nt, Human
uuggcuucuuauaaugcaauag

SEQ ID NO: 31193 - RNA, 22 nt, Human
uuggcuucuucgcacagcagua

SEQ ID NO: 31194 - RNA, 22 nt, Human
uuggcuucuugugaaaucugag

SEQ ID NO: 31195 - RNA, 22 nt, Human
uuggcuucuuuucuagacagaa

SEQ ID NO: 31196 - RNA, 22 nt, Human
uuggcuugaugacuggcagugu

SEQ ID NO: 31197 - RNA, 22 nt, Human
uugggaaagccacaaauuggag

SEQ ID NO: 31198 - RNA, 23 nt, Human
uugggaaauaguuaagacaugag

SEQ ID NO: 31199 - RNA, 22 nt, Human
uuuuaaagagaugcugugcaua

SEQ ID NO: 31200 - RNA, 22 nt, Human
uuuuaaaggauagcucugguug

SEQ ID NO: 31201 - RNA, 21 nt, Human
uuuuaacaaggauuucccuag

SEQ ID NO: 31202 - RNA, 22 nt, Human
uuuuaacacucagcacuaucuc

SEQ ID NO: 31203 - RNA, 22 nt, Human
uuuuaacuuaaaauacauagau

SEQ ID NO: 31204 - RNA, 22 nt, Human
uuuuaaguuaauauaauugagg

SEQ ID NO: 31205 - RNA, 22 nt, Human
uuuuaauacugcuauuguagga

SEQ ID NO: 31206 - RNA, 22 nt, Human
uuuuaauccaucugguaaaccu

SEQ ID NO: 31207 - RNA, 22 nt, Human
uuuuaauucaaagugaauagug

SEQ ID NO: 31208 - RNA, 23 nt, Human
uuuuaauuuggacauaagaagau

SEQ ID NO: 31209 - RNA, 22 nt, Human
uuuuaauuuuagcccuucuggu

SEQ ID NO: 31210 - RNA, 22 nt, Human
uuuuacaaaugaggagcuggag

SEQ ID NO: 31211 - RNA, 21 nt, Human
uuuuacagaugaggggaaggg

SEQ ID NO: 31212 - RNA, 22 nt, Human
uuuuacaggugaaaaaugaaga

SEQ ID NO: 31213 - RNA, 22 nt, Human
uuuuacaguuccaugcaaagcg

SEQ ID NO: 31214 - RNA, 22 nt, Human
uuuuacuuuggauacaguacuu

SEQ ID NO: 31215 - RNA, 22 nt, Human
uuuuagaaguucacuuggguuu

SEQ ID NO: 31216 - RNA, 22 nt, Human
uuuuagauaguuuaacugcacu

SEQ ID NO: 31217 - RNA, 22 nt, Human
uuuuagcacacuuucuuuagcg

SEQ ID NO: 31218 - RNA, 22 nt, Human
uuuuagcacuaagugauaugcu

SEQ ID NO: 31219 - RNA, 22 nt, Human
uuuuagcuguugauuguucccc

SEQ ID NO: 31220 - RNA, 22 nt, Human
uuuuagugccugauuaaugggu

SEQ ID NO: 31221 - RNA, 22 nt, Human
uuuuaguuguacugucaacagu

SEQ ID NO: 31222 - RNA, 20 nt, Human
uuuuauauguaggguauaug

SEQ ID NO: 31223 - RNA, 22 nt, Human
uuuuaucuaccuaugcucauuu

SEQ ID NO: 31224 - RNA, 22 nt, Human
uuuuaucuucauuccuaucuac

SEQ ID NO: 31225 - RNA, 22 nt, Human
uuuuaugagaaugcgccacuug

SEQ ID NO: 31226 - RNA, 21 nt, Human
uuuuaugcauaggaaauauau

SEQ ID NO: 31227 - RNA, 22 nt, Human
uuuuaugugucaaagcaguggu

SEQ ID NO: 31228 - RNA, 22 nt, Human
uuuuaugugugaaaugcugucu

SEQ ID NO: 31229 - RNA, 22 nt, Human
uuuuauguuccucuuuaugcga

SEQ ID NO: 31230 - RNA, 22 nt, Human
uuuuauguuccugaagcuaucu

SEQ ID NO: 31231 - RNA, 22 nt, Human
uuuuauuggagugauaccaagc

SEQ ID NO: 31232 - RNA, 22 nt, Human
uuuuauugggaguccucuacug

SEQ ID NO: 31233 - RNA, 22 nt, Human
uuuuauugguaaugauaaaagu

SEQ ID NO: 31234 - RNA, 22 nt, Human
uuuuauugucucccaguucugg

SEQ ID NO: 31235 - RNA, 22 nt, Human
uuuucaaagacuggaggcugau

SEQ ID NO: 31236 - RNA, 22 nt, Human
uuuucaagagaguguucuaugu

SEQ ID NO: 31237 - RNA, 22 nt, Human
uuuucaagggcagggaaaucau

SEQ ID NO: 31238 - RNA, 22 nt, Human
uuuucaauuuugaggcaguggu

SEQ ID NO: 31239 - RNA, 22 nt, Human
uuuucacacaaggugauaaguu

SEQ ID NO: 31240 - RNA, 19 nt, Human
uuuucacauacuggauccu

SEQ ID NO: 31241 - RNA, 22 nt, Human
uuuucacaugcuuggggacuua

SEQ ID NO: 31242 - RNA, 22 nt, Human
uuuucagugguaucuuuguaaa

SEQ ID NO: 31243 - RNA, 22 nt, Human
uuuucaugucauguccuugagg

SEQ ID NO: 31244 - RNA, 22 nt, Human
uuuucauuguaaaucaggaaac

SEQ ID NO: 31245 - RNA, 22 nt, Human
uuuucauuguuccucgagcauu

SEQ ID NO: 31246 - RNA, 22 nt, Human
uuuuccacuuuagugcaauaac

SEQ ID NO: 31247 - RNA, 20 nt, Human
uuuuccagaaaguaucauug

SEQ ID NO: 31248 - RNA, 19 nt, Human
uuuucccacccuuuagaau

SEQ ID NO: 31249 - RNA, 22 nt, Human
uuuuccuauaugcaaagaaugc

SEQ ID NO: 31250 - RNA, 22 nt, Human
uuuuccucuguauuugaaaugc

SEQ ID NO: 31251 - RNA, 22 nt, Human
uuuuccucuguuauuaguguga

SEQ ID NO: 31252 - RNA, 22 nt, Human
uuuuccugccuuugcucaggga

SEQ ID NO: 31253 - RNA, 20 nt, Human
uuuuccugugguuugauaug

SEQ ID NO: 31254 - RNA, 22 nt, Human
uuuuccuuagcuucucugcgag

SEQ ID NO: 31255 - RNA, 19 nt, Human
uuuuccuucuccucuuaau

SEQ ID NO: 31256 - RNA, 22 nt, Human
uuuuccuucugauacuccauuu

SEQ ID NO: 31257 - RNA, 22 nt, Human
uuuuccuuugaaaggugagggc

SEQ ID NO: 31258 - RNA, 22 nt, Human
uuuucuaacuuuacacucgaaa

SEQ ID NO: 31259 - RNA, 22 nt, Human
uuuucuauucauugucuauggu

SEQ ID NO: 31260 - RNA, 19 nt, Human
uuuucucagcuucuagcgg

SEQ ID NO: 31261 - RNA, 22 nt, Human
uuuucuccuuucaagauagcau

SEQ ID NO: 31262 - RNA, 22 nt, Human
uuuucucuauauugucugugaa

SEQ ID NO: 31263 - RNA, 22 nt, Human
uuuucugacucuauugagguau

SEQ ID NO: 31264 - RNA, 22 nt, Human
uuuucuggucacauguuauuaa

SEQ ID NO: 31265 - RNA, 22 nt, Human
uuuucuguauuauugugcuuca

SEQ ID NO: 31266 - RNA, 22 nt, Human
uuuucugugauucugagguugg

SEQ ID NO: 31267 - RNA, 22 nt, Human
uuucacauacaguguauaguag

SEQ ID NO: 31268 - RNA, 22 nt, Human
uuucacauaucaacucuauccu

SEQ ID NO: 31269 - RNA, 22 nt, Human
uuucacaucccgcgcgcccuua

SEQ ID NO: 31270 - RNA, 20 nt, Human
uuucacaucugucccuuuaa

SEQ ID NO: 31271 - RNA, 22 nt, Human
uuucacauggacuuuuuguucu

SEQ ID NO: 31272 - RNA, 22 nt, Human
uuucacauguauauaggcauua

SEQ ID NO: 31273 - RNA, 22 nt, Human
uuucacaugugcuguugucaau

SEQ ID NO: 31274 - RNA, 22 nt, Human
uuucacauucagauauagacuu

SEQ ID NO: 31275 - RNA, 22 nt, Human
uuucacuagaacguucuuguuu

SEQ ID NO: 31276 - RNA, 22 nt, Human
uuucacucagcucucauugucu

SEQ ID NO: 31277 - RNA, 22 nt, Human
uuucacuggaauuuuaacauuu

SEQ ID NO: 31278 - RNA, 22 nt, Human
uuucagaaaacuuaucaucagu

SEQ ID NO: 31279 - RNA, 22 nt, Human
uuucagaaagcugaacauauga

SEQ ID NO: 31280 - RNA, 22 nt, Human
uuucagaaauuauauuagaugc

SEQ ID NO: 31281 - RNA, 22 nt, Human
uuucagaagucaacuagguaaa

SEQ ID NO: 31282 - RNA, 22 nt, Human
uuucagaagucacaguugacug

SEQ ID NO: 31283 - RNA, 22 nt, Human
uuucagacagauucuucucagu

SEQ ID NO: 31284 - RNA, 22 nt, Human
uuucagacaguggguccaucca

SEQ ID NO: 31285 - RNA, 22 nt, Human
uuucagacauagccugauucug

SEQ ID NO: 31286 - RNA, 19 nt, Human
uuucagacauuucaaauuu

SEQ ID NO: 31287 - RNA, 22 nt, Human
uuucagacucagaacuuagcaa

SEQ ID NO: 31288 - RNA, 19 nt, Human
uuucagacucaucuccagc

SEQ ID NO: 31289 - RNA, 22 nt, Human
uuucagacuccaaauucauaag

SEQ ID NO: 31290 - RNA, 22 nt, Human
uuucagagaauuagaagcugau

SEQ ID NO: 31291 - RNA, 22 nt, Human
uuucagagagaucaacauagcu

SEQ ID NO: 31292 - RNA, 22 nt, Human
uuucagagaugcagaauucagg

SEQ ID NO: 31293 - RNA, 22 nt, Human
uuucagaguuauguaagaaaau

SEQ ID NO: 31294 - RNA, 22 nt, Human
uuucagaguuggggaaaagcag

SEQ ID NO: 31295 - RNA, 22 nt, Human
uuucagaucacuuucaggaaag

SEQ ID NO: 31296 - RNA, 22 nt, Human
uuucagcuuuaccauuccauga

SEQ ID NO: 31297 - RNA, 22 nt, Human
uuucaggagagaccagaaauga

SEQ ID NO: 31298 - RNA, 22 nt, Human
uuucaggaucaaaugaaaucgu

SEQ ID NO: 31299 - RNA, 22 nt, Human
uuucaggauuuuaugagauagu

SEQ ID NO: 31300 - RNA, 22 nt, Human
uuucagugcacguaguuuauuu

SEQ ID NO: 31301 - RNA, 22 nt, Human
uuucaguggagugacaugaucu

SEQ ID NO: 31302 - RNA, 22 nt, Human
uuucaguggcaucgauuacccu

SEQ ID NO: 31303 - RNA, 22 nt, Human
uuucaguggguuuauuucaugu

SEQ ID NO: 31304 - RNA, 22 nt, Human
uuucaguguaagguuuccagga

SEQ ID NO: 31305 - RNA, 22 nt, Human
uuucaguguaucuuccaaaagc

SEQ ID NO: 31306 - RNA, 22 nt, Human
uuucaguguguaaauugaaaua

SEQ ID NO: 31307 - RNA, 22 nt, Human
uuucaguguuaugacuuucauu

SEQ ID NO: 31308 - RNA, 22 nt, Human
uuucaguuaaguggcuaguccc

SEQ ID NO: 31309 - RNA, 22 nt, Human
uuucaguuacugcuauaucauu

SEQ ID NO: 31310 - RNA, 22 nt, Human
uuucaguuagcugagacccagg

SEQ ID NO: 31311 - RNA, 22 nt, Human
uuucaguucaguuuauuauauc

SEQ ID NO: 31312 - RNA, 22 nt, Human
uuucaguucaucugugaagauu

SEQ ID NO: 31313 - RNA, 23 nt, Human
uuucaguuccagaaaaggggagc

SEQ ID NO: 31314 - RNA, 22 nt, Human
uuuuugcaccaaccuaauagaa

SEQ ID NO: 31315 - RNA, 22 nt, Human
uuuuugcuaauccccagccacu

SEQ ID NO: 31316 - RNA, 22 nt, Human
uuuuugcugauaagcagaauuc

SEQ ID NO: 31317 - RNA, 22 nt, Human
uuuuugucaucuauuucuggug

SEQ ID NO: 31318 - RNA, 22 nt, Human
uuuuugugguauauugcaacaa

SEQ ID NO: 31319 - RNA, 22 nt, Human
uuuuuguggugcagacuaaagc

SEQ ID NO: 31320 - RNA, 22 nt, Human
uuuuuuauaucaacugaagucu

SEQ ID NO: 31321 - RNA, 22 nt, Human
uuuuuuccaacuuaagacuuca

SEQ ID NO: 31322 - RNA, 22 nt, Human
uuuuuuccagcuucuagaggcc

SEQ ID NO: 31323 - RNA, 22 nt, Human
uuuuuuccaggaagccacugga

SEQ ID NO: 31324 - RNA, 22 nt, Human
uuuuuuccugagccuugugguc

SEQ ID NO: 31325 - RNA, 21 nt, Human
uuuuuucuugcgugaggccug

SEQ ID NO: 31326 - RNA, 22 nt, Human
uuuuuugucccagagagccugg

SEQ ID NO: 31327 - RNA, 22 nt, Human
uuuuuugucuugaagaaauggu

SEQ ID NO: 31328 - RNA, 23 nt, Human
uuuuuugucuugcuaggcugccc

SEQ ID NO: 31329 - RNA, 22 nt, Human
acaguguaauucauggcugaaa

SEQ ID NO: 31330 - RNA, 22 nt, Human
acaguguagugugaugucaaaa

SEQ ID NO: 31331 - RNA, 22 nt, Human
acaguguaugauauuucacagu

SEQ ID NO: 31332 - RNA, 22 nt, Human
acagugucaucaguuucucaac

SEQ ID NO: 31333 - RNA, 22 nt, Human
acagugucucacugcugaaauc

SEQ ID NO: 31334 - RNA, 22 nt, Human
acaguguggaaagucaacuuga

SEQ ID NO: 31335 - RNA, 22 nt, Human
acagugugguuguuucugguua

SEQ ID NO: 31336 - RNA, 22 nt, Human
acagugugguuugagcacuggg

SEQ ID NO: 31337 - RNA, 22 nt, Human
acagugugugcuuucccuuacg

SEQ ID NO: 31338 - RNA, 22 nt, Human
acagugugugggaaaugugacu

SEQ ID NO: 31339 - RNA, 22 nt, Human
acaguguguuggaggagacugu

SEQ ID NO: 31340 - RNA, 22 nt, Human
acaguguucucuuccuguauag

SEQ ID NO: 31341 - RNA, 22 nt, Human
acaguguucugaaaguugaggg

SEQ ID NO: 31342 - RNA, 22 nt, Human
acaguguuguauuuaguuugau

SEQ ID NO: 31343 - RNA, 22 nt, Human
acaguguuuaaaauaauaugcu

SEQ ID NO: 31344 - RNA, 22 nt, Human
acaguguuuaagagauggcauu

SEQ ID NO: 31345 - RNA, 22 nt, Human
acaguguuucacuuaaccguuu

SEQ ID NO: 31346 - RNA, 22 nt, Human
acaguguuuugucuggcagggc

SEQ ID NO: 31347 - RNA, 22 nt, Human
acaguuaauuguuguugggugu

SEQ ID NO: 31348 - RNA, 22 nt, Human
acaguuacaugauucuugugag

SEQ ID NO: 31349 - RNA, 22 nt, Human
acaguuacucauagaagcacuu

SEQ ID NO: 31350 - RNA, 22 nt, Human
acaguuagguccuaaaauucug

SEQ ID NO: 31351 - RNA, 22 nt, Human
acaguuauauacauguagcugu

SEQ ID NO: 31352 - RNA, 22 nt, Human
acaguuauuuacugcauaaacu

SEQ ID NO: 31353 - RNA, 22 nt, Human
acaguuauuuucccagcauuua

SEQ ID NO: 31354 - RNA, 22 nt, Human
acgggccuucucuucaggcgag

SEQ ID NO: 31355 - RNA, 22 nt, Human
acguagauuccuccaugcgcag

SEQ ID NO: 31356 - RNA, 22 nt, Human
acguauauugaaauaucaugag

SEQ ID NO: 31357 - RNA, 22 nt, Human
acgucuucguuggcagagauuu

SEQ ID NO: 31358 - RNA, 22 nt, Human
acgugauauauuuacuucccca

SEQ ID NO: 31359 - RNA, 22 nt, Human
acgugcaggaucugguuggcga

SEQ ID NO: 31360 - RNA, 22 nt, Human
acgugcuggagaagagcucgcc

SEQ ID NO: 31361 - RNA, 18 nt, Human
acgugcugugccuuuugc

SEQ ID NO: 31362 - RNA, 22 nt, Human
acguggagagaauagggcacca

SEQ ID NO: 31363 - RNA, 22 nt, Human
acguggagccacagauggagca

SEQ ID NO: 31364 - RNA, 20 nt, Human
acgugugugugcacgcgcgc

SEQ ID NO: 31365 - RNA, 22 nt, Human
acguuagaaaagcaggagcuca

SEQ ID NO: 31366 - RNA, 22 nt, Human
acguuauaucugaaaaaaguga

SEQ ID NO: 31367 - RNA, 22 nt, Human
acguuuucagugacugugcuuc

SEQ ID NO: 31368 - RNA, 22 nt, Human
acguuuucuagagaauaugcag

SEQ ID NO: 31369 - RNA, 22 nt, Human
acuaaacugaagcaugaaaagg

SEQ ID NO: 31370 - RNA, 22 nt, Human
acuaaauagccucugguaguug

SEQ ID NO: 31371 - RNA, 22 nt, Human
acuaaaugcugcauaaaugcuu

SEQ ID NO: 31372 - RNA, 22 nt, Human
acuaacauguuaaucaaaagaa

SEQ ID NO: 31373 - RNA, 22 nt, Human
acuaacuugcugagugaccaug

SEQ ID NO: 31374 - RNA, 22 nt, Human
acuaagaccuagauacuagggg

SEQ ID NO: 31375 - RNA, 22 nt, Human
acuaaguuguagucacacaucc

SEQ ID NO: 31376 - RNA, 22 nt, Human
acuaauagagacaaacauagau

SEQ ID NO: 31377 - RNA, 22 nt, Human
acuacagaagucuuauuagaga

SEQ ID NO: 31378 - RNA, 23 nt, Human
acuacagauacuccugcuguuug

SEQ ID NO: 31379 - RNA, 22 nt, Human
acuacagucccucauauguugg

SEQ ID NO: 31380 - RNA, 22 nt, Human
acuacagugugauaagaggggc

SEQ ID NO: 31381 - RNA, 22 nt, Human
acuacauuugcagagaagcaau

SEQ ID NO: 31382 - RNA, 22 nt, Human
acuacuuugggccauuuguuua

SEQ ID NO: 31383 - RNA, 22 nt, Human
acuagaaacuaauggauuauua

SEQ ID NO: 31384 - RNA, 22 nt, Human
acuagaaagcaaaagccauuuc

SEQ ID NO: 31385 - RNA, 22 nt, Human
acuagaaauguauugguagcug

SEQ ID NO: 31386 - RNA, 22 nt, Human
acuagauaauuauaaaagguag

SEQ ID NO: 31387 - RNA, 19 nt, Human
acuagauacaacaugcaga

SEQ ID NO: 31388 - RNA, 22 nt, Human
acuagauuuuggccauuauaca

SEQ ID NO: 31389 - RNA, 22 nt, Human
acuagcagggauguuauuacuu

SEQ ID NO: 31390 - RNA, 22 nt, Human
acuagccaaguuuuacgacuaa

SEQ ID NO: 31391 - RNA, 22 nt, Human
acuaggaaggcauaugggcaga

SEQ ID NO: 31392 - RNA, 22 nt, Human
acuaggaaguggcaaaacugga

SEQ ID NO: 31393 - RNA, 22 nt, Human
acuagggaaaguuauguucaca

SEQ ID NO: 31394 - RNA, 22 nt, Human
acuaguauaauugcccuaaccu

SEQ ID NO: 31395 - RNA, 22 nt, Human
acuagugcacauuguuucucaa

SEQ ID NO: 31396 - RNA, 22 nt, Human
acuaguuuaugcucagaugucu

SEQ ID NO: 31397 - RNA, 22 nt, Human
acuaguuugaaaauaucugauu

SEQ ID NO: 31398 - RNA, 22 nt, Human
acuauacaagauuagggauuug

SEQ ID NO: 31399 - RNA, 22 nt, Human
acuauacauugaauguuaaggu

SEQ ID NO: 31400 - RNA, 20 nt, Human
acuaugaaguuagcccucca

SEQ ID NO: 31401 - RNA, 22 nt, Human
acuaugaauagccagauaguga

SEQ ID NO: 31402 - RNA, 21 nt, Human
acuaugucauuuaagucacug

SEQ ID NO: 31403 - RNA, 22 nt, Human
acuauucaccuuucaugcagga

SEQ ID NO: 31404 - RNA, 22 nt, Human
acuauucauguuuccuaacuau

SEQ ID NO: 31405 - RNA, 22 nt, Human
acuauuuacucaaaugagguug

SEQ ID NO: 31406 - RNA, 22 nt, Human
acucaaauagcaacggugagaa

SEQ ID NO: 31407 - RNA, 22 nt, Human
acucacagcagacuaugaggga

SEQ ID NO: 31408 - RNA, 22 nt, Human
acucacaggacucugcauauag

SEQ ID NO: 31409 - RNA, 22 nt, Human
acucacagggccucaguuuucc

SEQ ID NO: 31410 - RNA, 22 nt, Human
acucaccacacccuugcacuug

SEQ ID NO: 31411 - RNA, 22 nt, Human
acucacugcacuuugaaaugug

SEQ ID NO: 31412 - RNA, 22 nt, Human
acucacuuuccauucaagcacc

SEQ ID NO: 31413 - RNA, 22 nt, Human
acucagaagauauaaugacuca

SEQ ID NO: 31414 - RNA, 22 nt, Human
acucagaagauguggguagaua

SEQ ID NO: 31415 - RNA, 22 nt, Human
acucagaaugacugaugcugug

SEQ ID NO: 31416 - RNA, 22 nt, Human
acucagagaacuggauuagagg

SEQ ID NO: 31417 - RNA, 22 nt, Human
acucagagauauggugguugau

SEQ ID NO: 31418 - RNA, 22 nt, Human
acucagagcagagcagccugag

SEQ ID NO: 31419 - RNA, 22 nt, Human
acucagaggaaacccuccuagg

SEQ ID NO: 31420 - RNA, 22 nt, Human
acucagagucaauguuaauggc

SEQ ID NO: 31421 - RNA, 22 nt, Human
acucagcacagcacugggaacc

SEQ ID NO: 31422 - RNA, 22 nt, Human
acucagcuugcacacaucaaug

SEQ ID NO: 31423 - RNA, 22 nt, Human
acucaggaaaugaagacugguu

SEQ ID NO: 31424 - RNA, 18 nt, Human
acucaggaaaugaugaca

SEQ ID NO: 31425 - RNA, 22 nt, Human
acucaggagggaucagcuauca

SEQ ID NO: 31426 - RNA, 22 nt, Human
acucaggccccaucgcccaucu

SEQ ID NO: 31427 - RNA, 22 nt, Human
acucaggccuccuucuguccuu

SEQ ID NO: 31428 - RNA, 22 nt, Human
acucaggcuagggaaaaagugg

SEQ ID NO: 31429 - RNA, 22 nt, Human
acucaggcuguuuuuuccuugu

SEQ ID NO: 31430 - RNA, 22 nt, Human
acucagugaauuuucaucaaau

SEQ ID NO: 31431 - RNA, 22 nt, Human
acucaucaacuguuacaaaugu

SEQ ID NO: 31432 - RNA, 23 nt, Human
acucaucuucugguauccacagu

SEQ ID NO: 31433 - RNA, 21 nt, Human
acucaucuuuuuggagaccag

SEQ ID NO: 31434 - RNA, 22 nt, Human
acucauguccuaggaguaaagc

SEQ ID NO: 31435 - RNA, 22 nt, Human
acucauguuuucucuagcugga

SEQ ID NO: 31436 - RNA, 22 nt, Human
acucauugaaacuuaagaucua

SEQ ID NO: 31437 - RNA, 22 nt, Human
acucauugggaaagugcucucu

SEQ ID NO: 31438 - RNA, 22 nt, Human
acuuuagauauuccucuguaca

SEQ ID NO: 31439 - RNA, 22 nt, Human
acuuuaugauacagggaagggu

SEQ ID NO: 31440 - RNA, 23 nt, Human
acuuuauugaccccaggucaguu

SEQ ID NO: 31441 - RNA, 22 nt, Human
acuuucaaauaucaugauucua

SEQ ID NO: 31442 - RNA, 22 nt, Human
acuuucaugcucugagcacugg

SEQ ID NO: 31443 - RNA, 22 nt, Human
acuuucauggaucucuguucag

SEQ ID NO: 31444 - RNA, 22 nt, Human
acuuucuaaaauugcuagcacu

SEQ ID NO: 31445 - RNA, 22 nt, Human
acuuucuauucccacagagaua

SEQ ID NO: 31446 - RNA, 22 nt, Human
acuuucuauuguuuagauucug

SEQ ID NO: 31447 - RNA, 22 nt, Human
acuuucucaaaucagacuuuaa

SEQ ID NO: 31448 - RNA, 22 nt, Human
acuuucuccagaaaaccaagga

SEQ ID NO: 31449 - RNA, 20 nt, Human
acuuucucgguuucucaccu

SEQ ID NO: 31450 - RNA, 21 nt, Human
acuuucuguggguucaagcau

SEQ ID NO: 31451 - RNA, 22 nt, Human
acuuucugugguuaccagggag

SEQ ID NO: 31452 - RNA, 22 nt, Human
acuuucuucuuaugcauuaagg

SEQ ID NO: 31453 - RNA, 22 nt, Human
acuuugaaauguguaagagaga

SEQ ID NO: 31454 - RNA, 22 nt, Human
acuuugaaucucagauaaccaa

SEQ ID NO: 31455 - RNA, 22 nt, Human
acuuugcacuucaauauaacuu

SEQ ID NO: 31456 - RNA, 22 nt, Human
acuuugcagcugaggacauuuc

SEQ ID NO: 31457 - RNA, 21 nt, Human
acuuugcaucuaccuuggguu

SEQ ID NO: 31458 - RNA, 22 nt, Human
acuuugcccuacagcagcucug

SEQ ID NO: 31459 - RNA, 22 nt, Human
acuuugccuucuuacuguguug

SEQ ID NO: 31460 - RNA, 22 nt, Human
acuuuggaauaagcuauauaac

SEQ ID NO: 31461 - RNA, 22 nt, Human
acuuuggggaucuacggcugga

SEQ ID NO: 31462 - RNA, 22 nt, Human
acuuuguaaauuguugugacuc

SEQ ID NO: 31463 - RNA, 22 nt, Human
acuuuguaggaaaaagucacaa

SEQ ID NO: 31464 - RNA, 22 nt, Human
acuuuguagguuucagugaaac

SEQ ID NO: 31465 - RNA, 22 nt, Human
acuuuguugaagaauauguuag

SEQ ID NO: 31466 - RNA, 22 nt, Human
acuuuguugaugaaauaguuuu

SEQ ID NO: 31467 - RNA, 23 nt, Human
acuuuucaauuagcuaugcuuaa

SEQ ID NO: 31468 - RNA, 22 nt, Human
acuuuucuaagcaauggucuug

SEQ ID NO: 31469 - RNA, 22 nt, Human
acuuuucugcagaugaucucuu

SEQ ID NO: 31470 - RNA, 22 nt, Human
acuuuugaagaauuaugcaaaa

SEQ ID NO: 31471 - RNA, 22 nt, Human
acuuuugguucuguaacuguga

SEQ ID NO: 31472 - RNA, 22 nt, Human
acuuuuuacaggguguauacca

SEQ ID NO: 31473 - RNA, 22 nt, Human
acuuuuucucagaaggauuggu

SEQ ID NO: 31474 - RNA, 22 nt, Human
agaaaaagaaaguggauuuguc

SEQ ID NO: 31475 - RNA, 20 nt, Human
agaaaaaguguggaaauuuc

SEQ ID NO: 31476 - RNA, 22 nt, Human
agaaaacagaaagucauuggug

SEQ ID NO: 31477 - RNA, 22 nt, Human
agaaaacauaggagacaggaaa

SEQ ID NO: 31478 - RNA, 22 nt, Human
agaaaacauuacauaggugugu

SEQ ID NO: 31479 - RNA, 22 nt, Human
agaaaacuugucacagcucuca

SEQ ID NO: 31480 - RNA, 23 nt, Human
agaaaaguucauaccuuuuuaac

SEQ ID NO: 31481 - RNA, 22 nt, Human
agaaaaguuuaaaucuuggcac

SEQ ID NO: 31482 - RNA, 22 nt, Human
agaaaaguuuucugagacugac

SEQ ID NO: 31483 - RNA, 21 nt, Human
agaaaauggcguuuuagauuu

SEQ ID NO: 31484 - RNA, 20 nt, Human
agaaacagcacaauucuguu

SEQ ID NO: 31485 - RNA, 22 nt, Human
agaaacauccugcuuuccauuu

SEQ ID NO: 31486 - RNA, 22 nt, Human
agaaacaucuuggcaacuggaa

SEQ ID NO: 31487 - RNA, 22 nt, Human
agaaaccugugugcugugauga

SEQ ID NO: 31488 - RNA, 22 nt, Human
agaaacuaaagccaagggcucu

SEQ ID NO: 31489 - RNA, 21 nt, Human
agaaacugacuccuagaggca

SEQ ID NO: 31490 - RNA, 17 nt, Human
agaaacugaggcucagu

SEQ ID NO: 31491 - RNA, 22 nt, Human
agaaagaacgcacuugugcugc

SEQ ID NO: 31492 - RNA, 22 nt, Human
agaaagagaugaaugcuuuaag

SEQ ID NO: 31493 - RNA, 22 nt, Human
agaaagcacgggccccaggcuc

SEQ ID NO: 31494 - RNA, 22 nt, Human
agaaagcaucuccauuguaggu

SEQ ID NO: 31495 - RNA, 22 nt, Human
agaaagcccaggagaacagauu

SEQ ID NO: 31496 - RNA, 22 nt, Human
agaaagcuccccaugagaugau

SEQ ID NO: 31497 - RNA, 22 nt, Human
agaaagcuggaagagcugggau

SEQ ID NO: 31498 - RNA, 22 nt, Human
agaaagcuuaugaaugggcaag

SEQ ID NO: 31499 - RNA, 22 nt, Human
agaaagggaugagguagcugcu

SEQ ID NO: 31500 - RNA, 22 nt, Human
agaaaguacagaugagacacuu

SEQ ID NO: 31501 - RNA, 22 nt, Human
agaaagugaacguguucaguuu

SEQ ID NO: 31502 - RNA, 22 nt, Human
agaaagugaccuugaaaacugg

SEQ ID NO: 31503 - RNA, 22 nt, Human
agaaagugccucccuugggagc

SEQ ID NO: 31504 - RNA, 20 nt, Human
agacacccccugacagggaa

SEQ ID NO: 31505 - RNA, 22 nt, Human
agacacugaaauguauugaaga

SEQ ID NO: 31506 - RNA, 22 nt, Human
agacacugaaucagagggacau

SEQ ID NO: 31507 - RNA, 22 nt, Human
agacacugaauguuuggugguc

SEQ ID NO: 31508 - RNA, 22 nt, Human
agacacuggugaagaaaucagg

SEQ ID NO: 31509 - RNA, 22 nt, Human
agacacuucauguaaguggaau

SEQ ID NO: 31510 - RNA, 21 nt, Human
agacagaacaacugcucucca

SEQ ID NO: 31511 - RNA, 22 nt, Human
agacagacagagaauuuaaaua

SEQ ID NO: 31512 - RNA, 18 nt, Human
agacagacagguuugugc

SEQ ID NO: 31513 - RNA, 22 nt, Human
agacagacauagaaauuaguaa

SEQ ID NO: 31514 - RNA, 22 nt, Human
agacagacauucuagagccacc

SEQ ID NO: 31515 - RNA, 17 nt, Human
agacagaccucugcauc

SEQ ID NO: 31516 - RNA, 22 nt, Human
agacagacggcuuuauacacag

SEQ ID NO: 31517 - RNA, 19 nt, Human
agacagagacugaaauaga

SEQ ID NO: 31518 - RNA, 21 nt, Human
agacagcagauagucgaaagg

SEQ ID NO: 31519 - RNA, 22 nt, Human
agacagcagcagaggggcuccc

SEQ ID NO: 31520 - RNA, 22 nt, Human
agacagcaugagccugcugaug

SEQ ID NO: 31521 - RNA, 22 nt, Human
agacagcaugauacaugaugcu

SEQ ID NO: 31522 - RNA, 22 nt, Human
agacagcauggagcugauaaca

SEQ ID NO: 31523 - RNA, 22 nt, Human
agacagcauuucccggaaccgc

SEQ ID NO: 31524 - RNA, 22 nt, Human
agacagcauuucuagcaccagg

SEQ ID NO: 31525 - RNA, 22 nt, Human
agacagcuaauaaaugagugug

SEQ ID NO: 31526 - RNA, 22 nt, Human
agacagcuccaagugucucugu

SEQ ID NO: 31527 - RNA, 19 nt, Human
agacagcucuauuauuuug

SEQ ID NO: 31528 - RNA, 22 nt, Human
agacagcuguuccuucauguuu

SEQ ID NO: 31529 - RNA, 21 nt, Human
agacagcuuuaaagacacagg

SEQ ID NO: 31530 - RNA, 22 nt, Human
agacaggcagggcauggaaaaa

SEQ ID NO: 31531 - RNA, 22 nt, Human
agacagggagggagcgcggcug

SEQ ID NO: 31532 - RNA, 22 nt, Human
agacagguagcaggacagauau

SEQ ID NO: 31533 - RNA, 22 nt, Human
agacaggugcucgcccaagucc

SEQ ID NO: 31534 - RNA, 17 nt, Human
agacagugagugccuug

SEQ ID NO: 31535 - RNA, 22 nt, Human
agacagugauguaagcaggagu

SEQ ID NO: 31536 - RNA, 22 nt, Human
agacagugauucuucacauuuc

SEQ ID NO: 31537 - RNA, 22 nt, Human
agacagugcaagaagagcaggc

SEQ ID NO: 31538 - RNA, 19 nt, Human
agacaguggcuaggacuua

SEQ ID NO: 31539 - RNA, 22 nt, Human
agacaguguaauguaauuguua

SEQ ID NO: 31540 - RNA, 22 nt, Human
agacagugugaguucagggugg

SEQ ID NO: 31541 - RNA, 22 nt, Human
agacagugugguuggugguucc

SEQ ID NO: 31542 - RNA, 22 nt, Human
agacaguguguguauauauggu

SEQ ID NO: 31543 - RNA, 22 nt, Human
agacaguugauauacuauaaaa

SEQ ID NO: 31544 - RNA, 22 nt, Human
agacauaagccagucacucacu

SEQ ID NO: 31545 - RNA, 22 nt, Human
agacauagaaaaucauuaggaa

SEQ ID NO: 31546 - RNA, 22 nt, Human
agacauauauugcaauucacug

SEQ ID NO: 31547 - RNA, 22 nt, Human
agagaugagaacaugcuuggau

SEQ ID NO: 31548 - RNA, 22 nt, Human
agagaugcaggguacauggaau

SEQ ID NO: 31549 - RNA, 22 nt, Human
agagaugcaucucuuaaaauug

SEQ ID NO: 31550 - RNA, 19 nt, Human
agagaugcuaagagucuuu

SEQ ID NO: 31551 - RNA, 22 nt, Human
agagaugcuguggguagaggca

SEQ ID NO: 31552 - RNA, 22 nt, Human
agagauggcgucucagagccug

SEQ ID NO: 31553 - RNA, 22 nt, Human
agagaugggcgggggcuucugc

SEQ ID NO: 31554 - RNA, 20 nt, Human
agagaugggguaucaccgua

SEQ ID NO: 31555 - RNA, 22 nt, Human
agagaugguagaacagucauaa

SEQ ID NO: 31556 - RNA, 22 nt, Human
agagaugucgccuugcccaggg

SEQ ID NO: 31557 - RNA, 22 nt, Human
agagauugcuagcuggcuuuaa

SEQ ID NO: 31558 - RNA, 22 nt, Human
agagauuuacacaugccuuuuc

SEQ ID NO: 31559 - RNA, 22 nt, Human
agagcacacugacgucagucug

SEQ ID NO: 31560 - RNA, 22 nt, Human
agagcacaguaucugcacauca

SEQ ID NO: 31561 - RNA, 22 nt, Human
agagcaccaaggugguuuggac

SEQ ID NO: 31562 - RNA, 22 nt, Human
agagcacggccaccauuuacaa

SEQ ID NO: 31563 - RNA, 22 nt, Human
agagcacugcugauuuacaguc

SEQ ID NO: 31564 - RNA, 22 nt, Human
agagcagagggcucugggacaa

SEQ ID NO: 31565 - RNA, 22 nt, Human
agagcagauggccagggggccu

SEQ ID NO: 31566 - RNA, 22 nt, Human
agagcagcacguuguccccaca

SEQ ID NO: 31567 - RNA, 18 nt, Human
agagcagcggcaucacac

SEQ ID NO: 31568 - RNA, 22 nt, Human
agagcagcuggcugcaucuaga

SEQ ID NO: 31569 - RNA, 22 nt, Human
agagcagguggcaacucuggga

SEQ ID NO: 31570 - RNA, 22 nt, Human
agagcagucaggcuaggacacu

SEQ ID NO: 31571 - RNA, 22 nt, Human
agagccaaggcugagagcuauu

SEQ ID NO: 31572 - RNA, 22 nt, Human
agagccaaucuucagagcagag

SEQ ID NO: 31573 - RNA, 22 nt, Human
agagccacaguggauaggagcc

SEQ ID NO: 31574 - RNA, 22 nt, Human
agagccacuccaggacucaggg

SEQ ID NO: 31575 - RNA, 22 nt, Human
agagccagaccauugccgugca

SEQ ID NO: 31576 - RNA, 22 nt, Human
agagccagauggagccgugugu

SEQ ID NO: 31577 - RNA, 22 nt, Human
agagccagcaacucuagcccug

SEQ ID NO: 31578 - RNA, 22 nt, Human
agagccagccuucucagcuuac

SEQ ID NO: 31579 - RNA, 22 nt, Human
agagccaggaaguggcgugggg

SEQ ID NO: 31580 - RNA, 22 nt, Human
agagccaggaucuguuuugggg

SEQ ID NO: 31581 - RNA, 22 nt, Human
agagcccugcaguucuucagga

SEQ ID NO: 31582 - RNA, 22 nt, Human
agagcccugccaauggaugagg

SEQ ID NO: 31583 - RNA, 22 nt, Human
agagcccuggagggcagucccg

SEQ ID NO: 31584 - RNA, 22 nt, Human
agagcccuguggacugucaagu

SEQ ID NO: 31585 - RNA, 22 nt, Human
agagcccuugcccucagucacc

SEQ ID NO: 31586 - RNA, 23 nt, Human
agagccugaaagacuucuggcac

SEQ ID NO: 31587 - RNA, 20 nt, Human
agagccuggaaaaagacauc

SEQ ID NO: 31588 - RNA, 22 nt, Human
agagccuggagguucugcugaa

SEQ ID NO: 31589 - RNA, 22 nt, Human
agagccugggaauuugcauguu

SEQ ID NO: 31590 - RNA, 22 nt, Human
agagccugucugccuuucuacc

SEQ ID NO: 31591 - RNA, 22 nt, Human
agagccuguucggaggcgcccc

SEQ ID NO: 31592 - RNA, 22 nt, Human
agagccuugcucuaaauuucuc

SEQ ID NO: 31593 - RNA, 22 nt, Human
agagccuuuggagcugcuauua

SEQ ID NO: 31594 - RNA, 23 nt, Human
agagccuuuucacacuucaaugu

SEQ ID NO: 31595 - RNA, 22 nt, Human
agagcgagucuggggcucggau

SEQ ID NO: 31596 - RNA, 22 nt, Human
agagcuagaaggaagcauuucu

SEQ ID NO: 31597 - RNA, 22 nt, Human
agagcucaagacgcucacagua

SEQ ID NO: 31598 - RNA, 21 nt, Human
agagcucaaggcaaaaauaau

SEQ ID NO: 31599 - RNA, 22 nt, Human
agagcucucuucauaacggccu

SEQ ID NO: 31600 - RNA, 17 nt, Human
agagcucuucacuguga

SEQ ID NO: 31601 - RNA, 22 nt, Human
agagcugaauuuggguggugga

SEQ ID NO: 31602 - RNA, 22 nt, Human
agagcugagaauguggcuuccu

SEQ ID NO: 31603 - RNA, 22 nt, Human
agagcugauuugauuacagugc

SEQ ID NO: 31604 - RNA, 22 nt, Human
agagcugcaggguggacccagg

SEQ ID NO: 31605 - RNA, 22 nt, Human
agagcugccgagcuggggccau

SEQ ID NO: 31606 - RNA, 22 nt, Human
agagcugcucagaugucacugc

SEQ ID NO: 31607 - RNA, 22 nt, Human
agagcuggacgucugagcccua

SEQ ID NO: 31608 - RNA, 22 nt, Human
agagcuggauggucaagauggc

SEQ ID NO: 31609 - RNA, 22 nt, Human
agagcuggccagggaucacucu

SEQ ID NO: 31610 - RNA, 22 nt, Human
agagcuggcugguagcccugau

SEQ ID NO: 31611 - RNA, 20 nt, Human
agagcugggaagcucccuau

SEQ ID NO: 31612 - RNA, 21 nt, Human
agagcugggacuugccugaga

SEQ ID NO: 31613 - RNA, 22 nt, Human
agagcuggggcauaaaugccac

SEQ ID NO: 31614 - RNA, 22 nt, Human
agagcuggggcucuggguuuaa

SEQ ID NO: 31615 - RNA, 22 nt, Human
agagcuggguggacuuguaguu

SEQ ID NO: 31616 - RNA, 22 nt, Human
agagcuguauccccuuaccagu

SEQ ID NO: 31617 - RNA, 22 nt, Human
agagcuguguccugugcacuag

SEQ ID NO: 31618 - RNA, 22 nt, Human
agagcuguguuaagaacaggcc

SEQ ID NO: 31619 - RNA, 22 nt, Human
agagcuguucagcagccagguu

SEQ ID NO: 31620 - RNA, 22 nt, Human
agaaaguuaaacagugauaaga

SEQ ID NO: 31621 - RNA, 22 nt, Human
agaaaguuuauuucuugaugga

SEQ ID NO: 31622 - RNA, 22 nt, Human
agaaaguuuggggcugggcacg

SEQ ID NO: 31623 - RNA, 23 nt, Human
agaaaguuugugccuugugacac

SEQ ID NO: 31624 - RNA, 22 nt, Human
agaaaguuuguuuuuauccaua

SEQ ID NO: 31625 - RNA, 22 nt, Human
agaaauacuaggaauauucaua

SEQ ID NO: 31626 - RNA, 22 nt, Human
agaaauacuuaaucuuugcagg

SEQ ID NO: 31627 - RNA, 19 nt, Human
agaaauagccuuccuuguc

SEQ ID NO: 31628 - RNA, 22 nt, Human
agaaaucacaggaggcagaagg

SEQ ID NO: 31629 - RNA, 22 nt, Human
agaaaucacuuaaugaacguag

SEQ ID NO: 31630 - RNA, 22 nt, Human
agaaaucacuuagaggaaguga

SEQ ID NO: 31631 - RNA, 22 nt, Human
agaaaucagaacccugaaguuc

SEQ ID NO: 31632 - RNA, 22 nt, Human
agaaaucaugacuaagagcagu

SEQ ID NO: 31633 - RNA, 22 nt, Human
agaaaucuaagaugcucaagga

SEQ ID NO: 31634 - RNA, 22 nt, Human
agaaaucuauuauuucagaguu

SEQ ID NO: 31635 - RNA, 19 nt, Human
agaaaucucgagauuuguu

SEQ ID NO: 31636 - RNA, 22 nt, Human
agaaaucuuuccugaaguguuu

SEQ ID NO: 31637 - RNA, 22 nt, Human
agaaaugaagagagucaagguu

SEQ ID NO: 31638 - RNA, 22 nt, Human
agaaauggaaauccaagcaacu

SEQ ID NO: 31639 - RNA, 22 nt, Human
agaaauggugagugagagcccc

SEQ ID NO: 31640 - RNA, 22 nt, Human
agaaaugucaggaaagaagucc

SEQ ID NO: 31641 - RNA, 22 nt, Human
agaaauguggaggaacagggcu

SEQ ID NO: 31642 - RNA, 22 nt, Human
agaaauguggaucguuuuaaaa

SEQ ID NO: 31643 - RNA, 22 nt, Human
agaaauuaggaaaguaacacuu

SEQ ID NO: 31644 - RNA, 22 nt, Human
agaaauuauuagugaauagucu

SEQ ID NO: 31645 - RNA, 22 nt, Human
agaaauucaauucuaauuagcu

SEQ ID NO: 31646 - RNA, 22 nt, Human
agaacaaggcuguuuccaaugc

SEQ ID NO: 31647 - RNA, 22 nt, Human
agaacacauagagaaguuuuau

SEQ ID NO: 31648 - RNA, 22 nt, Human
agaacacugcuaguauaaucac

SEQ ID NO: 31649 - RNA, 22 nt, Human
agaacagaggccuuauguuuca

SEQ ID NO: 31650 - RNA, 22 nt, Human
agaacagcaacaucagacaaag

SEQ ID NO: 31651 - RNA, 22 nt, Human
agaacagcagcacgucaagcug

SEQ ID NO: 31652 - RNA, 22 nt, Human
agaacagcugcaaaacuuaauc

SEQ ID NO: 31653 - RNA, 22 nt, Human
agaacagggacuggaggcuuca

SEQ ID NO: 31654 - RNA, 23 nt, Human
agaacagugacuaauauagagag

SEQ ID NO: 31655 - RNA, 22 nt, Human
agaacaguuuguuggagacugu

SEQ ID NO: 31656 - RNA, 22 nt, Human
agauauauuuccugcccaaggc

SEQ ID NO: 31657 - RNA, 22 nt, Human
agauaucuccagugaugcucgu

SEQ ID NO: 31658 - RNA, 22 nt, Human
agauaucugaugaaaauacucu

SEQ ID NO: 31659 - RNA, 22 nt, Human
agauauggccucauacagacau

SEQ ID NO: 31660 - RNA, 22 nt, Human
agaagagaguccuaccccauac

SEQ ID NO: 31661 - RNA, 22 nt, Human
agaagagcccuuuaagggggaa

SEQ ID NO: 31662 - RNA, 20 nt, Human
agaagaggauacaaccaggc

SEQ ID NO: 31663 - RNA, 22 nt, Human
agaagaugacuuuggaguugga

SEQ ID NO: 31664 - RNA, 22 nt, Human
agaagauuaugaauuagagcag

SEQ ID NO: 31665 - RNA, 22 nt, Human
agaagcaccugucagcuacaug

SEQ ID NO: 31666 - RNA, 22 nt, Human
agaagcacgguuuugucuagca

SEQ ID NO: 31667 - RNA, 22 nt, Human
agaagcagaaaagggcacuuuu

SEQ ID NO: 31668 - RNA, 22 nt, Human
agaagcaggccucacagaucug

SEQ ID NO: 31669 - RNA, 22 nt, Human
agaagccaaaggggccagauau

SEQ ID NO: 31670 - RNA, 22 nt, Human
agaagccaaucagcucucugcu

SEQ ID NO: 31671 - RNA, 22 nt, Human
agaagccaccagcugaggaaga

SEQ ID NO: 31672 - RNA, 18 nt, Human
agaagccacgaggagucc

SEQ ID NO: 31673 - RNA, 22 nt, Human
agaagccacugcucccagugag

SEQ ID NO: 31674 - RNA, 22 nt, Human
agaagccacuggagguugagau

SEQ ID NO: 31675 - RNA, 22 nt, Human
agaagccagccuugccuccuuu

SEQ ID NO: 31676 - RNA, 22 nt, Human
agaagccauagucugggaggca

SEQ ID NO: 31677 - RNA, 22 nt, Human
agaagccaugguaugcaacuac

SEQ ID NO: 31678 - RNA, 19 nt, Human
agaagcccagaucccagcc

SEQ ID NO: 31679 - RNA, 18 nt, Human
agaagccugccucaaugc

SEQ ID NO: 31680 - RNA, 21 nt, Human
agaagccuggggaauguggcu

SEQ ID NO: 31681 - RNA, 22 nt, Human
agaagcuacugggauauuaauu

SEQ ID NO: 31682 - RNA, 22 nt, Human
agaagcuaggcuagacaaguga

SEQ ID NO: 31683 - RNA, 20 nt, Human
agaagcugauacugauggaa

SEQ ID NO: 31684 - RNA, 22 nt, Human
agaagcuggaggaagacuaagc

SEQ ID NO: 31685 - RNA, 22 nt, Human
agaaggaaggcugagugcugau

SEQ ID NO: 31686 - RNA, 22 nt, Human
agaaggcaccguggccaauauu

SEQ ID NO: 31687 - RNA, 22 nt, Human
agaaggcagaaaguccagguau

SEQ ID NO: 31688 - RNA, 20 nt, Human
agaaggcauuccucauucuu

SEQ ID NO: 31689 - RNA, 22 nt, Human
agaaggccaauagggugcacug

SEQ ID NO: 31690 - RNA, 22 nt, Human
agaaggccagauggacggggcu

SEQ ID NO: 31691 - RNA, 22 nt, Human
agaaggccuagaguaagacauu

SEQ ID NO: 31692 - RNA, 22 nt, Human
agaaggcugaagaagauccguu

SEQ ID NO: 31693 - RNA, 22 nt, Human
agaaggcuggccauggugcccu

SEQ ID NO: 31694 - RNA, 22 nt, Human
agaaggcuggcccuggguggcc

SEQ ID NO: 31695 - RNA, 22 nt, Human
agaaggcuuuaaguacuggcau

SEQ ID NO: 31696 - RNA, 22 nt, Human
agaagggaacucagagaugauu

SEQ ID NO: 31697 - RNA, 22 nt, Human
agaagggccagcuggacaccug

SEQ ID NO: 31698 - RNA, 22 nt, Human
agaagggcuacacgggcucucc

SEQ ID NO: 31699 - RNA, 22 nt, Human
agaaggggagaagcuaccagga

SEQ ID NO: 31700 - RNA, 22 nt, Human
agaaggguaguuguaagaguga

SEQ ID NO: 31701 - RNA, 23 nt, Human
agaaggguccuuggcagcgacag

SEQ ID NO: 31702 - RNA, 22 nt, Human
agaaguaggcagggcuguauca

SEQ ID NO: 31703 - RNA, 22 nt, Human
agaaguaguccaguggaaagua

SEQ ID NO: 31704 - RNA, 22 nt, Human
agaaguauaaagaauguuuaug

SEQ ID NO: 31705 - RNA, 22 nt, Human
agaaguaucaggaagauucuca

SEQ ID NO: 31706 - RNA, 22 nt, Human
agaaguauucugcauguacuga

SEQ ID NO: 31707 - RNA, 22 nt, Human
agaagucugguugcaaagcgcu

SEQ ID NO: 31708 - RNA, 22 nt, Human
agaagugagacucaguugauga

SEQ ID NO: 31709 - RNA, 22 nt, Human
agaagugaggaaauccucuuua

SEQ ID NO: 31710 - RNA, 22 nt, Human
agaaguggucugucuuccagau

SEQ ID NO: 31711 - RNA, 22 nt, Human
agaagugguguguggccgagcu

SEQ ID NO: 31712 - RNA, 22 nt, Human
agaaguuguagguuugcauauu

SEQ ID NO: 31713 - RNA, 22 nt, Human
agaaguuugguccuauaaacuc

SEQ ID NO: 31714 - RNA, 22 nt, Human
agaauaaaucaaauguccugag

SEQ ID NO: 31715 - RNA, 22 nt, Human
agaauaaaugcuaccuaucaca

SEQ ID NO: 31716 - RNA, 22 nt, Human
agaauacaguaggagccugggc

SEQ ID NO: 31717 - RNA, 22 nt, Human
agaauaccauaauauagaaaga

SEQ ID NO: 31718 - RNA, 22 nt, Human
agaauacccaucccuucaacuc

SEQ ID NO: 31719 - RNA, 22 nt, Human
agaauacuugggaauggguuaa

SEQ ID NO: 31720 - RNA, 22 nt, Human
agaauaguggcaaugacugcac

SEQ ID NO: 31721 - RNA, 22 nt, Human
agaauauaugacugcaagacua

SEQ ID NO: 31722 - RNA, 22 nt, Human
agaauaugaggaaacugugaau

SEQ ID NO: 31723 - RNA, 22 nt, Human
agaauaugaucggaauacagau

SEQ ID NO: 31724 - RNA, 22 nt, Human
agaauaugaugguuggagaauu

SEQ ID NO: 31725 - RNA, 22 nt, Human
agaaucaaggugaagcccacag

SEQ ID NO: 31726 - RNA, 22 nt, Human
agaaucaggaagacagccuggc

SEQ ID NO: 31727 - RNA, 22 nt, Human
agaaucaggaccuguggcuguc

SEQ ID NO: 31728 - RNA, 21 nt, Human
agaaucauuuuucccuucucu

SEQ ID NO: 31729 - RNA, 21 nt, Human
agaauccauucagaccuucuc

SEQ ID NO: 31730 - RNA, 22 nt, Human
agaauccgcuugacuuugaagu

SEQ ID NO: 31731 - RNA, 22 nt, Human
agaauccuugacucaggcugag

SEQ ID NO: 31732 - RNA, 22 nt, Human
agaaucuaaguacacagacaga

SEQ ID NO: 31733 - RNA, 22 nt, Human
agaaucuacauuuuaacaagau

SEQ ID NO: 31734 - RNA, 20 nt, Human
agaaucugacccagagagac

SEQ ID NO: 31735 - RNA, 22 nt, Human
agaaucugcauuuuaacaagcc

SEQ ID NO: 31736 - RNA, 22 nt, Human
agaaucuucagaugauuuguca

SEQ ID NO: 31737 - RNA, 22 nt, Human
agaaucuucagucuaauuccua

SEQ ID NO: 31738 - RNA, 22 nt, Human
agaaucuuucugaaugacugug

SEQ ID NO: 31739 - RNA, 22 nt, Human
agaaugauacucuaugccaaau

SEQ ID NO: 31740 - RNA, 22 nt, Human
agaaugauagcuaguauuuacu

SEQ ID NO: 31741 - RNA, 22 nt, Human
agaaugcaguuugaaauaaggu

SEQ ID NO: 31742 - RNA, 22 nt, Human
agaaugcaucuaaaagcagaga

SEQ ID NO: 31743 - RNA, 22 nt, Human
agaaugugaagauuuugaauua

SEQ ID NO: 31744 - RNA, 22 nt, Human
agaaugugggggaaaagagugu

SEQ ID NO: 31745 - RNA, 22 nt, Human
agaaugugugauugaagcucuu

SEQ ID NO: 31746 - RNA, 21 nt, Human
agaauuaaauuggauuugugu

SEQ ID NO: 31747 - RNA, 22 nt, Human
agaauuagaggccauguacuug

SEQ ID NO: 31748 - RNA, 22 nt, Human
agaauucagaaugcauuucuaa

SEQ ID NO: 31749 - RNA, 22 nt, Human
agaauucucuuccauugaaaca

SEQ ID NO: 31750 - RNA, 22 nt, Human
agaauugcuaacucuccuccug

SEQ ID NO: 31751 - RNA, 18 nt, Human
agaauugcugcuucuucu

SEQ ID NO: 31752 - RNA, 23 nt, Human
agaauuguuguuagggaaaagua

SEQ ID NO: 31753 - RNA, 19 nt, Human
agaauuguuuuaugucuuc

SEQ ID NO: 31754 - RNA, 22 nt, Human
agaauuucaaauggaaguuuua

SEQ ID NO: 31755 - RNA, 22 nt, Human
agaauuuccuaugagagauucc

SEQ ID NO: 31756 - RNA, 22 nt, Human
agaauuucuggaagauugcaag

SEQ ID NO: 31757 - RNA, 18 nt, Human
agacaaacuucuucugcc

SEQ ID NO: 31758 - RNA, 22 nt, Human
agacaaaggauuaaugaugaug

SEQ ID NO: 31759 - RNA, 22 nt, Human
agacaacaccaaaugcuagugu

SEQ ID NO: 31760 - RNA, 22 nt, Human
agacaacugcagagcaaagaau

SEQ ID NO: 31761 - RNA, 22 nt, Human
agacaagaaacugggagucucu

SEQ ID NO: 31762 - RNA, 22 nt, Human
agacaagacuaggcaguuguug

SEQ ID NO: 31763 - RNA, 22 nt, Human
agacaagagcugaggacauauu

SEQ ID NO: 31764 - RNA, 22 nt, Human
agacaaggcuggaguuuaggca

SEQ ID NO: 31765 - RNA, 20 nt, Human
agcaaaaugcaagauuuuca

SEQ ID NO: 31766 - RNA, 22 nt, Human
agcaaacaguuucuggggaucu

SEQ ID NO: 31767 - RNA, 22 nt, Human
agcaaagaaggguucuucauua

SEQ ID NO: 31768 - RNA, 18 nt, Human
agcaaagcaagagaucac

SEQ ID NO: 31769 - RNA, 20 nt, Human
agcaaagccuuuagaguuug

SEQ ID NO: 31770 - RNA, 22 nt, Human
agcaaagcuaccaauuauugag

SEQ ID NO: 31771 - RNA, 22 nt, Human
agcaaaguggcuuuccaaacca

SEQ ID NO: 31772 - RNA, 22 nt, Human
agcaaaguuaagguuucucuuu

SEQ ID NO: 31773 - RNA, 22 nt, Human
agcaaauggguuuauauuugac

SEQ ID NO: 31774 - RNA, 18 nt, Human
agcaacagaaacauaugg

SEQ ID NO: 31775 - RNA, 22 nt, Human
agcaacagguuuauuaucuuau

SEQ ID NO: 31776 - RNA, 22 nt, Human
agcaacaguguauaucauaggc

SEQ ID NO: 31777 - RNA, 19 nt, Human
agcaaccugucagagaugc

SEQ ID NO: 31778 - RNA, 22 nt, Human
agcaacuuuauuccacugggca

SEQ ID NO: 31779 - RNA, 22 nt, Human
agcugaacgugcuucugcagca

SEQ ID NO: 31780 - RNA, 22 nt, Human
agcugaagaccucaaguaagag

SEQ ID NO: 31781 - RNA, 22 nt, Human
agcugaagcagucaguucagcu

SEQ ID NO: 31782 - RNA, 22 nt, Human
agcugaagcucagcccaguagu

SEQ ID NO: 31783 - RNA, 22 nt, Human
agcugaagggaggauauguaca

SEQ ID NO: 31784 - RNA, 22 nt, Human
agcugaaguucaguccagagaa

SEQ ID NO: 31785 - RNA, 22 nt, Human
agcugaccaaaugccuacaguu

SEQ ID NO: 31786 - RNA, 17 nt, Human
agcugaccagauggacu

SEQ ID NO: 31787 - RNA, 22 nt, Human
agcugagagguggcaagcugua

SEQ ID NO: 31788 - RNA, 22 nt, Human
agcugagauuaugcucuucuca

SEQ ID NO: 31789 - RNA, 22 nt, Human
agcugagcacauucaaacaggu

SEQ ID NO: 31790 - RNA, 17 nt, Human
agcugagcuggccaggg

SEQ ID NO: 31791 - RNA, 22 nt, Human
agcugaggaggaaugaugggua

SEQ ID NO: 31792 - RNA, 22 nt, Human
agcugaggcaugaugcuaucag

SEQ ID NO: 31793 - RNA, 22 nt, Human
agcugaggccugauuucgccgu

SEQ ID NO: 31794 - RNA, 22 nt, Human
agcugaggcucugagagggaag

SEQ ID NO: 31795 - RNA, 18 nt, Human
agcugaggggacugaaga

SEQ ID NO: 31796 - RNA, 21 nt, Human
agcugagguaaggcaagagag

SEQ ID NO: 31797 - RNA, 21 nt, Human
agcugcaaaaacauacaguuc

SEQ ID NO: 31798 - RNA, 20 nt, Human
agcugcaacagacuguaugg

SEQ ID NO: 31799 - RNA, 22 nt, Human
agcugcaaccuuagcuauaggc

SEQ ID NO: 31800 - RNA, 23 nt, Human
agcugcaagacucccugucugag

SEQ ID NO: 31801 - RNA, 22 nt, Human
agcugcaaguccaaaggaauua

SEQ ID NO: 31802 - RNA, 22 nt, Human
agcugcaccggcuggaccacug

SEQ ID NO: 31803 - RNA, 20 nt, Human
agcugcagaacccacuggac

SEQ ID NO: 31804 - RNA, 19 nt, Human
agcugcagaccagaagugc

SEQ ID NO: 31805 - RNA, 18 nt, Human
agcugcagaccaggaggu

SEQ ID NO: 31806 - RNA, 22 nt, Human
agcugcagagaaaagaggcugg

SEQ ID NO: 31807 - RNA, 22 nt, Human
agcugcagauaggauguuauuu

SEQ ID NO: 31808 - RNA, 17 nt, Human
agcugcagaugaaguug

SEQ ID NO: 31809 - RNA, 23 nt, Human
agcugcagaugcucagcgggcag

SEQ ID NO: 31810 - RNA, 22 nt, Human
agcugcagauucucuacuucau

SEQ ID NO: 31811 - RNA, 22 nt, Human
agcugcagcccuccugcauggc

SEQ ID NO: 31812 - RNA, 22 nt, Human
agcugcaggagucgccuaggau

SEQ ID NO: 31813 - RNA, 22 nt, Human
agcugcaguaugaggcuggugg

SEQ ID NO: 31814 - RNA, 22 nt, Human
agcugcauuucagugaaauauu

SEQ ID NO: 31815 - RNA, 22 nt, Human
agcugccaaguuucucaguuua

SEQ ID NO: 31816 - RNA, 22 nt, Human
agcugccacagagccuggccag

SEQ ID NO: 31817 - RNA, 21 nt, Human
agcugccacccuagcuucuga

SEQ ID NO: 31818 - RNA, 22 nt, Human
agcugccacugagggugcacag

SEQ ID NO: 31819 - RNA, 22 nt, Human
agcugccagaugacagugcuau

SEQ ID NO: 31820 - RNA, 22 nt, Human
agcugccaucugaagaacugca

SEQ ID NO: 31821 - RNA, 22 nt, Human
agcugcccagcuaggaagaagg

SEQ ID NO: 31822 - RNA, 22 nt, Human
agcugcccagguucauugggcc

SEQ ID NO: 31823 - RNA, 22 nt, Human
agcugccccaugagaggcaggu

SEQ ID NO: 31824 - RNA, 22 nt, Human
agcugcccccagggcugugcuu

SEQ ID NO: 31825 - RNA, 22 nt, Human
agcugccccucauuuucaccac

SEQ ID NO: 31826 - RNA, 20 nt, Human
agcugccccugggcacugcc

SEQ ID NO: 31827 - RNA, 22 nt, Human
agcugcccucgcuggggccaga

SEQ ID NO: 31828 - RNA, 22 nt, Human
agcugccucagcaacacagacc

SEQ ID NO: 31829 - RNA, 22 nt, Human
agcugccuccauggucaaagau

SEQ ID NO: 31830 - RNA, 22 nt, Human
agcugccugggcuuguacaccu

SEQ ID NO: 31831 - RNA, 22 nt, Human
agcugccuguaaaaugugugau

SEQ ID NO: 31832 - RNA, 20 nt, Human
agcugccuucauuuucuaga

SEQ ID NO: 31833 - RNA, 22 nt, Human
agcugccuucccucucauuagg

SEQ ID NO: 31834 - RNA, 22 nt, Human
agcugcuaugacaacaccagcc

SEQ ID NO: 31835 - RNA, 22 nt, Human
agcugcucaggagagccagguc

SEQ ID NO: 31836 - RNA, 22 nt, Human
agcugcucauucccagcacaug

SEQ ID NO: 31837 - RNA, 22 nt, Human
agcugcuccaacccagcgggcu

SEQ ID NO: 31838 - RNA, 22 nt, Human
agcugcuccuuggcugugguuc

SEQ ID NO: 31839 - RNA, 22 nt, Human
agcugcucugggaaacagaagu

SEQ ID NO: 31840 - RNA, 22 nt, Human
agcugcugagagucugccgggc

SEQ ID NO: 31841 - RNA, 22 nt, Human
agcugcugccucacuggucugu

SEQ ID NO: 31842 - RNA, 21 nt, Human
agcugcuucaccuggacaaca

SEQ ID NO: 31843 - RNA, 21 nt, Human
agcugcuuucagcuccuagag

SEQ ID NO: 31844 - RNA, 22 nt, Human
agcuggaacuggguuuguugga

SEQ ID NO: 31845 - RNA, 22 nt, Human
agcuggaagugcauuucucacu

SEQ ID NO: 31846 - RNA, 22 nt, Human
agcuggagaauguggaugaucc

SEQ ID NO: 31847 - RNA, 22 nt, Human
agcuggcaccaaauauaguaaa

SEQ ID NO: 31848 - RNA, 19 nt, Human
agcuggcacuagaauccag

SEQ ID NO: 31849 - RNA, 22 nt, Human
agcuggcagcucucagggguac

SEQ ID NO: 31850 - RNA, 22 nt, Human
agcuggcagggguucacacugc

SEQ ID NO: 31851 - RNA, 22 nt, Human
agcuggcaguaugacuggugac

SEQ ID NO: 31852 - RNA, 22 nt, Human
agcuggcagucauccuagugag

SEQ ID NO: 31853 - RNA, 22 nt, Human
agcuggcauucuccuuguuauu

SEQ ID NO: 31854 - RNA, 22 nt, Human
agcuggcauugaagaaugguua

SEQ ID NO: 31855 - RNA, 22 nt, Human
agcuggccucacugcagaaugc

SEQ ID NO: 31856 - RNA, 20 nt, Human
agcuggccuguccuaggccu

SEQ ID NO: 31857 - RNA, 22 nt, Human
agcuggccuguuagagcugagu

SEQ ID NO: 31858 - RNA, 22 nt, Human
agcuggccuucggugucacugg

SEQ ID NO: 31859 - RNA, 22 nt, Human
agcuggcuauacuugaaaaguc

SEQ ID NO: 31860 - RNA, 22 nt, Human
agcuggcucagccggguggucu

SEQ ID NO: 31861 - RNA, 22 nt, Human
agcuggcuccagaaggagucgu

SEQ ID NO: 31862 - RNA, 22 nt, Human
agcuggcugccuucuccuuagg

SEQ ID NO: 31863 - RNA, 22 nt, Human
agcuggcugggugccagucucc

SEQ ID NO: 31864 - RNA, 22 nt, Human
agcuggcuucucugcagacauu

SEQ ID NO: 31865 - RNA, 22 nt, Human
agcuggcuuuaugguuggcuaa

SEQ ID NO: 31866 - RNA, 22 nt, Human
agcugggaagaguuuucugcag

SEQ ID NO: 31867 - RNA, 20 nt, Human
agcugggcaauuaugacuau

SEQ ID NO: 31868 - RNA, 22 nt, Human
agcugggcaccccgcugcgucu

SEQ ID NO: 31869 - RNA, 19 nt, Human
agcugggcuuacucacucg

SEQ ID NO: 31870 - RNA, 19 nt, Human
agcuggggcgguguguguu

SEQ ID NO: 31871 - RNA, 22 nt, Human
agcuggggcugcagagaacagg

SEQ ID NO: 31872 - RNA, 22 nt, Human
agcugggguugcacacauuuug

SEQ ID NO: 31873 - RNA, 22 nt, Human
agcugggucuugggccaggaga

SEQ ID NO: 31874 - RNA, 22 nt, Human
agcuggguggccucuccucggg

SEQ ID NO: 31875 - RNA, 22 nt, Human
agagacaagaaauaccugggac

SEQ ID NO: 31876 - RNA, 19 nt, Human
agagacacagguaaguagg

SEQ ID NO: 31877 - RNA, 22 nt, Human
agagacagacacaucgggcugc

SEQ ID NO: 31878 - RNA, 18 nt, Human
agagacagcagcaaaaga

SEQ ID NO: 31879 - RNA, 22 nt, Human
agagacaggauaucugcucaug

SEQ ID NO: 31880 - RNA, 22 nt, Human
agagacaggguuuugucguguu

SEQ ID NO: 31881 - RNA, 22 nt, Human
agagacaugcaguuguugugaa

SEQ ID NO: 31882 - RNA, 23 nt, Human
agagacauuuggauacagaaaca

SEQ ID NO: 31883 - RNA, 22 nt, Human
agagacccauugccggaaucac

SEQ ID NO: 31884 - RNA, 22 nt, Human
agagacugcaaaucauaagaau

SEQ ID NO: 31885 - RNA, 22 nt, Human
agagacugcgugucagcgcugg

SEQ ID NO: 31886 - RNA, 22 nt, Human
agagacuguacguggcaaguau

SEQ ID NO: 31887 - RNA, 21 nt, Human
agagacugucacugcaguacc

SEQ ID NO: 31888 - RNA, 22 nt, Human
agagagaagcaaucaguggcca

SEQ ID NO: 31889 - RNA, 17 nt, Human
agagagagcaugccacc

SEQ ID NO: 31890 - RNA, 20 nt, Human
agagagagguaaauugagca

SEQ ID NO: 31891 - RNA, 23 nt, Human
agagagaguuugugucagguacc

SEQ ID NO: 31892 - RNA, 22 nt, Human
agagagccugaguggcagcuau

SEQ ID NO: 31893 - RNA, 22 nt, Human
agagagcucuggcugggugacc

SEQ ID NO: 31894 - RNA, 22 nt, Human
agagccuugccuggggcccugu

SEQ ID NO: 31895 - RNA, 21 nt, Human
agagcggcggggcgcgucugc

SEQ ID NO: 31896 - RNA, 22 nt, Human
agagcuaagaaacagaauugcu

SEQ ID NO: 31897 - RNA, 22 nt, Human
agagcuauaacagcacuguaca

SEQ ID NO: 31898 - RNA, 22 nt, Human
agagcuauauacagauuauuga

SEQ ID NO: 31899 - RNA, 22 nt, Human
agagcuauuucuuaaaagcugu

SEQ ID NO: 31900 - RNA, 22 nt, Human
agagcucaguguguuaugguua

SEQ ID NO: 31901 - RNA, 22 nt, Human
agagcugaaaaagcugacccgg

SEQ ID NO: 31902 - RNA, 22 nt, Human
agagcugaauucaagugcuggc

SEQ ID NO: 31903 - RNA, 22 nt, Human
agagcugcccacacagcagauu

SEQ ID NO: 31904 - RNA, 22 nt, Human
agagcuggaaaaguuguuuuaa

SEQ ID NO: 31905 - RNA, 22 nt, Human
agagcuggaaucagaccucagg

SEQ ID NO: 31906 - RNA, 22 nt, Human
agagcuggcagcagcuucuccu

SEQ ID NO: 31907 - RNA, 21 nt, Human
agagcuggccugccaggcccu

SEQ ID NO: 31908 - RNA, 22 nt, Human
agagcuggcugcugcggugcuu

SEQ ID NO: 31909 - RNA, 22 nt, Human
agagcugggaccgucuggaagu

SEQ ID NO: 31910 - RNA, 22 nt, Human
agagcuggggcccguaaagcca

SEQ ID NO: 31911 - RNA, 21 nt, Human
agagcugguagguagguaggu

SEQ ID NO: 31912 - RNA, 22 nt, Human
agagcuguagcuuccuagagcc

SEQ ID NO: 31913 - RNA, 22 nt, Human
agagcugucacauagagccaga

SEQ ID NO: 31914 - RNA, 22 nt, Human
agagcugucagcguuuuggcca

SEQ ID NO: 31915 - RNA, 22 nt, Human
agagcugugcuuugcaccacgu

SEQ ID NO: 31916 - RNA, 22 nt, Human
agagcuguucaacguagcaaug

SEQ ID NO: 31917 - RNA, 22 nt, Human
agagcuguuuggacaucugagu

SEQ ID NO: 31918 - RNA, 22 nt, Human
agagcuuuagcugcuggucugg

SEQ ID NO: 31919 - RNA, 22 nt, Human
agagcuuuuacuuacauucuau

SEQ ID NO: 31920 - RNA, 22 nt, Human
agagcuuuugggaauucaggua

SEQ ID NO: 31921 - RNA, 22 nt, Human
agaggaaacauagguuuuuaaa

SEQ ID NO: 31922 - RNA, 21 nt, Human
agaggaagaagaguguauuau

SEQ ID NO: 31923 - RNA, 22 nt, Human
agaggaagccauugcuuacuga

SEQ ID NO: 31924 - RNA, 22 nt, Human
agaggaauuucuggaaggaggc

SEQ ID NO: 31925 - RNA, 22 nt, Human
agaggacagcccccuugucugg

SEQ ID NO: 31926 - RNA, 22 nt, Human
agaggaggaagagcuuuaaaau

SEQ ID NO: 31927 - RNA, 22 nt, Human
agaggaggauuuguaaaggucu

SEQ ID NO: 31928 - RNA, 22 nt, Human
agaggaggccaggcccacaccu

SEQ ID NO: 31929 - RNA, 22 nt, Human
agaggaggcucugggaucgucc

SEQ ID NO: 31930 - RNA, 22 nt, Human
agaggagguggugaugcuuuaa

SEQ ID NO: 31931 - RNA, 22 nt, Human
agaggaucaucuaguuugacuc

SEQ ID NO: 31932 - RNA, 18 nt, Human
agaggaugcaucuaagag

SEQ ID NO: 31933 - RNA, 22 nt, Human
agaggauguucuaggcacucau

SEQ ID NO: 31934 - RNA, 22 nt, Human
agaggauuguuacugauuagcu

SEQ ID NO: 31935 - RNA, 22 nt, Human
agaggauuuuaaaagcauaugu

SEQ ID NO: 31936 - RNA, 22 nt, Human
agaggcaaggcaggauucuucu

SEQ ID NO: 31937 - RNA, 22 nt, Human
agaggcacaaacuggaaaggac

SEQ ID NO: 31938 - RNA, 22 nt, Human
agaggcacaacagucccauugu

SEQ ID NO: 31939 - RNA, 22 nt, Human
agaggcacagaggcaguccccu

SEQ ID NO: 31940 - RNA, 22 nt, Human
agaggcacccaguuaagcugca

SEQ ID NO: 31941 - RNA, 22 nt, Human
agaggcacggaggcugcaugga

SEQ ID NO: 31942 - RNA, 22 nt, Human
agaggcagccguauuucaaagg

SEQ ID NO: 31943 - RNA, 23 nt, Human
agaggccaacuucuugccccucc

SEQ ID NO: 31944 - RNA, 22 nt, Human
agaggccaagccagacugugca

SEQ ID NO: 31945 - RNA, 22 nt, Human
agaggccaauaguagguggcau

SEQ ID NO: 31946 - RNA, 22 nt, Human
agaggccacaccagccucccgu

SEQ ID NO: 31947 - RNA, 22 nt, Human
agaggccaccacugucagggac

SEQ ID NO: 31948 - RNA, 22 nt, Human
agaggccaccuucucuugagaa

SEQ ID NO: 31949 - RNA, 22 nt, Human
agaggccacuuugccugugaug

SEQ ID NO: 31950 - RNA, 22 nt, Human
agaggccagaaaguaugccacc

SEQ ID NO: 31951 - RNA, 22 nt, Human
agaggccagaaggcgcaccccg

SEQ ID NO: 31952 - RNA, 22 nt, Human
agaggccagcaaccacaguaaa

SEQ ID NO: 31953 - RNA, 22 nt, Human
agaggccagcagugccuaucug

SEQ ID NO: 31954 - RNA, 22 nt, Human
agaggccagggacacugcucaa

SEQ ID NO: 31955 - RNA, 20 nt, Human
agaggccaguuaggagucua

SEQ ID NO: 31956 - RNA, 22 nt, Human
agaggcccucucugcucagucu

SEQ ID NO: 31957 - RNA, 22 nt, Human
agaggcccuggcuagagcagcu

SEQ ID NO: 31958 - RNA, 22 nt, Human
agaggccucaaaccagaccuga

SEQ ID NO: 31959 - RNA, 16 nt, Human
agaggccuugaggaag

SEQ ID NO: 31960 - RNA, 22 nt, Human
agaggccuuucuguugagugaa

SEQ ID NO: 31961 - RNA, 22 nt, Human
agaggcggagcuugcagugagc

SEQ ID NO: 31962 - RNA, 21 nt, Human
agaggcgggguuuuggaggcc

SEQ ID NO: 31963 - RNA, 22 nt, Human
agaggcuaggaccauguaucau

SEQ ID NO: 31964 - RNA, 22 nt, Human
agaggcuccgucaucccucuuu

SEQ ID NO: 31965 - RNA, 16 nt, Human
agaggcuguaauggaa

SEQ ID NO: 31966 - RNA, 22 nt, Human
agagggaaaaacucaugucauu

SEQ ID NO: 31967 - RNA, 18 nt, Human
agagggaaagcaggcuga

SEQ ID NO: 31968 - RNA, 22 nt, Human
agagggaaugugauugcaccau

SEQ ID NO: 31969 - RNA, 23 nt, Human
agagggagauguuuuucucaaga

SEQ ID NO: 31970 - RNA, 22 nt, Human
agagggagcuuuauuuuucugu

SEQ ID NO: 31971 - RNA, 22 nt, Human
agagggcagcagcaacaacucu

SEQ ID NO: 31972 - RNA, 22 nt, Human
agagggcauuaacucugucuug

SEQ ID NO: 31973 - RNA, 21 nt, Human
agagggcgaaggcgggguccg

SEQ ID NO: 31974 - RNA, 22 nt, Human
agagggcugggaugugcugugu

SEQ ID NO: 31975 - RNA, 22 nt, Human
agagggcuuugauucucaguuc

SEQ ID NO: 31976 - RNA, 22 nt, Human
agaggggcucauauccugucau

SEQ ID NO: 31977 - RNA, 22 nt, Human
agaggguagaagacaggguugc

SEQ ID NO: 31978 - RNA, 22 nt, Human
agagggugagcagguacacaug

SEQ ID NO: 31979 - RNA, 22 nt, Human
agagggugggcacgugauggau

SEQ ID NO: 31980 - RNA, 22 nt, Human
agagguaugggcauggugcugu

SEQ ID NO: 31981 - RNA, 22 nt, Human
agagguauguucacuucccuuu

SEQ ID NO: 31982 - RNA, 22 nt, Human
agagguauugcacgugcucucu

SEQ ID NO: 31983 - RNA, 22 nt, Human
agaggucaaugggacuuggauc

SEQ ID NO: 31984 - RNA, 18 nt, Human
agccagguggaauggaac

SEQ ID NO: 31985 - RNA, 22 nt, Human
agccagguuaaaccacagucaa

SEQ ID NO: 31986 - RNA, 22 nt, Human
agccaguagaucgggaggaugu

SEQ ID NO: 31987 - RNA, 22 nt, Human
agccaguccaucacuaaugggu

SEQ ID NO: 31988 - RNA, 22 nt, Human
agccagucccuugagcgugccc

SEQ ID NO: 31989 - RNA, 22 nt, Human
agccagucggggccaugcuggg

SEQ ID NO: 31990 - RNA, 21 nt, Human
agccagucucaguacuguacu

SEQ ID NO: 31991 - RNA, 21 nt, Human
agccagucugccagagaagcc

SEQ ID NO: 31992 - RNA, 21 nt, Human
agccagucuguuuucuagugc

SEQ ID NO: 31993 - RNA, 22 nt, Human
agccagugacauacgauuggga

SEQ ID NO: 31994 - RNA, 22 nt, Human
agccagugggauuagagccucu

SEQ ID NO: 31995 - RNA, 22 nt, Human
agccaguuggcuaugaggagga

SEQ ID NO: 31996 - RNA, 22 nt, Human
agccaguuuccagauauuaacu

SEQ ID NO: 31997 - RNA, 22 nt, Human
agccaucacuugagaaucuauu

SEQ ID NO: 31998 - RNA, 22 nt, Human
agccaucauuucugucacuggc

SEQ ID NO: 31999 - RNA, 22 nt, Human
agccauccuccacagccuugau

SEQ ID NO: 32000 - RNA, 22 nt, Human
agccaugcucaguuccuggagc

SEQ ID NO: 32001 - RNA, 22 nt, Human
agccaugggcucccaguccuuu

SEQ ID NO: 32002 - RNA, 22 nt, Human
agccauguaugaggguuuccag

SEQ ID NO: 32003 - RNA, 22 nt, Human
agccauguuaaauggacuugau

SEQ ID NO: 32004 - RNA, 22 nt, Human
agccauucauugugcucucaga

SEQ ID NO: 32005 - RNA, 22 nt, Human
agcccaagaagagcuuucuugc

SEQ ID NO: 32006 - RNA, 22 nt, Human
agcccaaggcuucccugcuggc

SEQ ID NO: 32007 - RNA, 23 nt, Human
agcccaccuuguuaguccugugg

SEQ ID NO: 32008 - RNA, 22 nt, Human
agcccagagacaaugcucagua

SEQ ID NO: 32009 - RNA, 22 nt, Human
agcccagagccccggccauguu

SEQ ID NO: 32010 - RNA, 22 nt, Human
agcccagcagaaaguccagccu

SEQ ID NO: 32011 - RNA, 22 nt, Human
agcccagcccgggcugcgcuuu

SEQ ID NO: 32012 - RNA, 22 nt, Human
agcccagcuuucaccccucugg

SEQ ID NO: 32013 - RNA, 22 nt, Human
agcccaggagguggagguugca

SEQ ID NO: 32014 - RNA, 22 nt, Human
agcccagggaguugauuagcau

SEQ ID NO: 32015 - RNA, 22 nt, Human
agcccaggucucaaaguacagg

SEQ ID NO: 32016 - RNA, 22 nt, Human
agcccaggugacucauacaccc

SEQ ID NO: 32017 - RNA, 22 nt, Human
agcccaggugagggguucgaaa

SEQ ID NO: 32018 - RNA, 22 nt, Human
agcccagguggagugugugggg

SEQ ID NO: 32019 - RNA, 22 nt, Human
agcccaugcagaccuucccaga

SEQ ID NO: 32020 - RNA, 22 nt, Human
agcccaugguguacucuguggc

SEQ ID NO: 32021 - RNA, 22 nt, Human
agccccacacucucucugagaa

SEQ ID NO: 32022 - RNA, 22 nt, Human
agccccaggaugggccgcagga

SEQ ID NO: 32023 - RNA, 17 nt, Human
agcccccacucccaagu

SEQ ID NO: 32024 - RNA, 22 nt, Human
agcccccaggagucuccacgcc

SEQ ID NO: 32025 - RNA, 22 nt, Human
agcccccagucuaaacuguugg

SEQ ID NO: 32026 - RNA, 22 nt, Human
agcccccucccuagugacugga

SEQ ID NO: 32027 - RNA, 17 nt, Human
agccccucagcgucacc

SEQ ID NO: 32028 - RNA, 23 nt, Human
agccccucauggugucuagacag

SEQ ID NO: 32029 - RNA, 22 nt, Human
agccccugcuggguguagcuca

SEQ ID NO: 32030 - RNA, 22 nt, Human
agccccuuccaguucucagauc

SEQ ID NO: 32031 - RNA, 22 nt, Human
agccccuugcacuuccccacgc

SEQ ID NO: 32032 - RNA, 22 nt, Human
agcccuaaauuaucuuuauuuu

SEQ ID NO: 32033 - RNA, 22 nt, Human
agcccuaacucccaguaucuug

SEQ ID NO: 32034 - RNA, 22 nt, Human
agcccucaggcuuugcugggcc

SEQ ID NO: 32035 - RNA, 22 nt, Human
agcccuccaaagguugggggag

SEQ ID NO: 32036 - RNA, 22 nt, Human
agcccuccuggggccacgcugg

SEQ ID NO: 32037 - RNA, 22 nt, Human
agcccuccuuuguucaugcugc

SEQ ID NO: 32038 - RNA, 22 nt, Human
agcccucugagcuagucaccau

SEQ ID NO: 32039 - RNA, 22 nt, Human
agcccugagcuggccugggcuu

SEQ ID NO: 32040 - RNA, 22 nt, Human
agcccugcaggaugagggaggu

SEQ ID NO: 32041 - RNA, 22 nt, Human
agcccugcauagaagggaacac

SEQ ID NO: 32042 - RNA, 22 nt, Human
agcccugccauucucuggagcu

SEQ ID NO: 32043 - RNA, 22 nt, Human
agcccugcgugccaggggacug

SEQ ID NO: 32044 - RNA, 22 nt, Human
aggcuucuuagauuggcuggag

SEQ ID NO: 32045 - RNA, 22 nt, Human
aggcuucuugauaaaaugcaga

SEQ ID NO: 32046 - RNA, 18 nt, Human
aggcuucuuggcucaguc

SEQ ID NO: 32047 - RNA, 22 nt, Human
aggcuugaaaugaaaucuguaa

SEQ ID NO: 32048 - RNA, 22 nt, Human
aggcuugauuuguccugcuuaa

SEQ ID NO: 32049 - RNA, 21 nt, Human
aggcuuggauagauauucaua

SEQ ID NO: 32050 - RNA, 19 nt, Human
aggcuuggauuguggccaa

SEQ ID NO: 32051 - RNA, 21 nt, Human
aggcuuggguaaaaaggucau

SEQ ID NO: 32052 - RNA, 22 nt, Human
aggcuugggucagaaggcuugu

SEQ ID NO: 32053 - RNA, 22 nt, Human
aggcuuggugccaaggagccug

SEQ ID NO: 32054 - RNA, 22 nt, Human
aggcuugucucagaagaugcug

SEQ ID NO: 32055 - RNA, 20 nt, Human
aggcuugugcuuugucacuc

SEQ ID NO: 32056 - RNA, 22 nt, Human
aggcuuuggggcauucuguguu

SEQ ID NO: 32057 - RNA, 22 nt, Human
aggcuuuuggagaagcauaugc

SEQ ID NO: 32058 - RNA, 22 nt, Human
agggaaauaaucuauucugagg

SEQ ID NO: 32059 - RNA, 23 nt, Human
agggaacaagcaagcugcuaguc

SEQ ID NO: 32060 - RNA, 22 nt, Human
agggaacagugaaaggcaucag

SEQ ID NO: 32061 - RNA, 22 nt, Human
agggaagcaauauuagauauca

SEQ ID NO: 32062 - RNA, 22 nt, Human
agggaagcaaugauuauuauuc

SEQ ID NO: 32063 - RNA, 22 nt, Human
agggaagccaagccuuagagaa

SEQ ID NO: 32064 - RNA, 22 nt, Human
agggaagcccuggcugagaccc

SEQ ID NO: 32065 - RNA, 22 nt, Human
agggaagcugcuggguccaccu

SEQ ID NO: 32066 - RNA, 22 nt, Human
agggaaggaaaagcugucgcuu

SEQ ID NO: 32067 - RNA, 22 nt, Human
agggaaggaggccauguguccc

SEQ ID NO: 32068 - RNA, 22 nt, Human
agggaagggaaaaacacucguc

SEQ ID NO: 32069 - RNA, 22 nt, Human
agggaauccaucuaucuucauu

SEQ ID NO: 32070 - RNA, 22 nt, Human
agggacacaugugauuauuuau

SEQ ID NO: 32071 - RNA, 22 nt, Human
agggacacugaugagaaauucu

SEQ ID NO: 32072 - RNA, 22 nt, Human
agggacaguauccaucucacag

SEQ ID NO: 32073 - RNA, 22 nt, Human
agggaccagccugcccagggcu

SEQ ID NO: 32074 - RNA, 22 nt, Human
agggaccagcgugagucugagg

SEQ ID NO: 32075 - RNA, 22 nt, Human
agggaccugucaaugacaguua

SEQ ID NO: 32076 - RNA, 22 nt, Human
agggacgccgugcgggaccgug

SEQ ID NO: 32077 - RNA, 22 nt, Human
agggacucccugggccgacacg

SEQ ID NO: 32078 - RNA, 22 nt, Human
agggacugagcuaggaucuagu

SEQ ID NO: 32079 - RNA, 22 nt, Human
agggacuuguguccuauguaug

SEQ ID NO: 32080 - RNA, 22 nt, Human
agggagaagguccaugccuguc

SEQ ID NO: 32081 - RNA, 22 nt, Human
agggagaagguuuagcugugag

SEQ ID NO: 32082 - RNA, 19 nt, Human
agggagaauuccaagagga

SEQ ID NO: 32083 - RNA, 22 nt, Human
agggagagacauuuccuucuug

SEQ ID NO: 32084 - RNA, 16 nt, Human
agggagagaggaacau

SEQ ID NO: 32085 - RNA, 22 nt, Human
agggagaguuugauguuuccuc

SEQ ID NO: 32086 - RNA, 23 nt, Human
agggagaugccacaaagaugccc

SEQ ID NO: 32087 - RNA, 22 nt, Human
agggagcaaagguuucaggguu

SEQ ID NO: 32088 - RNA, 22 nt, Human
agggagcagggcuccuuugggu

SEQ ID NO: 32089 - RNA, 21 nt, Human
agggagcuauuuauaguaagc

SEQ ID NO: 32090 - RNA, 22 nt, Human
agggagcucgaugccugagugu

SEQ ID NO: 32091 - RNA, 22 nt, Human
agggagcuucuacuucaaggca

SEQ ID NO: 32092 - RNA, 21 nt, Human
agggagcuuuagguagaaguu

SEQ ID NO: 32093 - RNA, 22 nt, Human
agccugugcuguguuugcucca

SEQ ID NO: 32094 - RNA, 22 nt, Human
agccuguggaucccugcacugg

SEQ ID NO: 32095 - RNA, 22 nt, Human
agccuuacauaaacagccuuau

SEQ ID NO: 32096 - RNA, 22 nt, Human
agccuucaaccuagcuagagca

SEQ ID NO: 32097 - RNA, 22 nt, Human
agccuucacugggaccuuggau

SEQ ID NO: 32098 - RNA, 23 nt, Human
agccuucaggcaaugucaguaga

SEQ ID NO: 32099 - RNA, 22 nt, Human
agccuucaguaagggcuuagca

SEQ ID NO: 32100 - RNA, 22 nt, Human
agccuuccagguagauggcaca

SEQ ID NO: 32101 - RNA, 22 nt, Human
agccuuuaacacuucacauuga

SEQ ID NO: 32102 - RNA, 22 nt, Human
agccuuuuggaguuauucuggg

SEQ ID NO: 32103 - RNA, 22 nt, Human
agcgacagaaaccaaggacaag

SEQ ID NO: 32104 - RNA, 22 nt, Human
agcgcccaggggcagggcucuc

SEQ ID NO: 32105 - RNA, 22 nt, Human
agcgcuggugaucucuauuuug

SEQ ID NO: 32106 - RNA, 22 nt, Human
agcgcugugggcgugcgaggag

SEQ ID NO: 32107 - RNA, 21 nt, Human
agcggcagacccugcauuuga

SEQ ID NO: 32108 - RNA, 22 nt, Human
agcggcugucggccagccggag

SEQ ID NO: 32109 - RNA, 22 nt, Human
agcgggucugcaagccuucccu

SEQ ID NO: 32110 - RNA, 22 nt, Human
agcggucaggagaaauaagcau

SEQ ID NO: 32111 - RNA, 22 nt, Human
agcguaugaauauuugaagaga

SEQ ID NO: 32112 - RNA, 22 nt, Human
agcguggauguggggcgcggcu

SEQ ID NO: 32113 - RNA, 22 nt, Human
agcuaaaucacuuauucuuuca

SEQ ID NO: 32114 - RNA, 22 nt, Human
agcuaaauguugcuuaaaauuu

SEQ ID NO: 32115 - RNA, 22 nt, Human
agcuaacaugacuagaagcuuc

SEQ ID NO: 32116 - RNA, 19 nt, Human
agcuaagacaagggacauc

SEQ ID NO: 32117 - RNA, 20 nt, Human
agcuaagaggaaaagugaga

SEQ ID NO: 32118 - RNA, 22 nt, Human
agcuaagauuuauuaaaggccc

SEQ ID NO: 32119 - RNA, 22 nt, Human
agcuaaggaugacuaguacuuc

SEQ ID NO: 32120 - RNA, 19 nt, Human
agcuaauggaaguuuacug

SEQ ID NO: 32121 - RNA, 17 nt, Human
agcuacaaggcaguuca

SEQ ID NO: 32122 - RNA, 20 nt, Human
agcuacaaugcgaagcuggc

SEQ ID NO: 32123 - RNA, 22 nt, Human
agcuacaccccuuuacaguccu

SEQ ID NO: 32124 - RNA, 22 nt, Human
agcuacagaugagcccaguauc

SEQ ID NO: 32125 - RNA, 22 nt, Human
agcuacagcuguacucugcagg

SEQ ID NO: 32126 - RNA, 22 nt, Human
agcuacccgaggacaggcuaag

SEQ ID NO: 32127 - RNA, 22 nt, Human
agcuagaacuacaggcaugugc

SEQ ID NO: 32128 - RNA, 22 nt, Human
agcuagaaguccuagauaaagg

SEQ ID NO: 32129 - RNA, 22 nt, Human
agcuagaauauugaucugaaau

SEQ ID NO: 32130 - RNA, 23 nt, Human
agcuagcauaaugucuggcuccu

SEQ ID NO: 32131 - RNA, 17 nt, Human
agcuagggccuagaauc

SEQ ID NO: 32132 - RNA, 22 nt, Human
agcuaguuaaacuaugaauaca

SEQ ID NO: 32133 - RNA, 23 nt, Human
agcuauaaaaucugugacagcag

SEQ ID NO: 32134 - RNA, 22 nt, Human
agcuaucaguaggaccauguuc

SEQ ID NO: 32135 - RNA, 22 nt, Human
agcuaucucaggcacucacauu

SEQ ID NO: 32136 - RNA, 22 nt, Human
agcuauggguguggguuccauu

SEQ ID NO: 32137 - RNA, 22 nt, Human
agcuaugguaaucauccaccaa

SEQ ID NO: 32138 - RNA, 22 nt, Human
agcuauugugugcccagcagga

SEQ ID NO: 32139 - RNA, 22 nt, Human
agcuauuuauugagcuccauug

SEQ ID NO: 32140 - RNA, 21 nt, Human
agcuauuucagauuugagagc

SEQ ID NO: 32141 - RNA, 22 nt, Human
agcucaaagcuguuacauugua

SEQ ID NO: 32142 - RNA, 22 nt, Human
agcucaauuuaaggcuuggcuu

SEQ ID NO: 32143 - RNA, 22 nt, Human
agcucacaccucaucagggugg

SEQ ID NO: 32144 - RNA, 18 nt, Human
agcucacagaucuguuuu

SEQ ID NO: 32145 - RNA, 22 nt, Human
agcucacauucucaucagaugu

SEQ ID NO: 32146 - RNA, 22 nt, Human
agcucagaaaugccaguaggua

SEQ ID NO: 32147 - RNA, 22 nt, Human
agcucagagauaaucaagagac

SEQ ID NO: 32148 - RNA, 22 nt, Human
agcucagagggaggugaagugg

SEQ ID NO: 32149 - RNA, 21 nt, Human
agcucagcaagauggaggcuc

SEQ ID NO: 32150 - RNA, 22 nt, Human
agcucagcacugucagcacucc

SEQ ID NO: 32151 - RNA, 22 nt, Human
agcucaggcaacucugggcccc

SEQ ID NO: 32152 - RNA, 19 nt, Human
agcucaggcccaucguccc

SEQ ID NO: 32153 - RNA, 22 nt, Human
agcucaggucauuccagggaug

SEQ ID NO: 32154 - RNA, 22 nt, Human
agcuccaagguugaggagugag

SEQ ID NO: 32155 - RNA, 22 nt, Human
agcuccacucccugccuguuuc

SEQ ID NO: 32156 - RNA, 23 nt, Human
agcuccagaacauagcacaggaa

SEQ ID NO: 32157 - RNA, 22 nt, Human
agcuccagaagccugcaaggua

SEQ ID NO: 32158 - RNA, 22 nt, Human
agcuccagauuaauuguaggag

SEQ ID NO: 32159 - RNA, 22 nt, Human
agcuccagcccuaguacagcug

SEQ ID NO: 32160 - RNA, 22 nt, Human
agcuccagcggauggucuuaua

SEQ ID NO: 32161 - RNA, 22 nt, Human
agggcuccaaggaaguguagcu

SEQ ID NO: 32162 - RNA, 22 nt, Human
agggcucccgcgguguccggga

SEQ ID NO: 32163 - RNA, 22 nt, Human
agggcuccgggccaccggccug

SEQ ID NO: 32164 - RNA, 18 nt, Human
agggcucucugcuggguu

SEQ ID NO: 32165 - RNA, 22 nt, Human
agggcucucuuggacaacugcu

SEQ ID NO: 32166 - RNA, 20 nt, Human
agggcucugccuugcugaug

SEQ ID NO: 32167 - RNA, 23 nt, Human
agggcugaaugcagagaagcaga

SEQ ID NO: 32168 - RNA, 22 nt, Human
agggcugacaaauggcagugac

SEQ ID NO: 32169 - RNA, 22 nt, Human
agggcugagaaugacagggccg

SEQ ID NO: 32170 - RNA, 22 nt, Human
agggcugagcccaggcauguag

SEQ ID NO: 32171 - RNA, 22 nt, Human
agggcugaguggugcagucaaa

SEQ ID NO: 32172 - RNA, 18 nt, Human
agggcugaugaguuuggg

SEQ ID NO: 32173 - RNA, 22 nt, Human
agggcugcaaugggagauaacu

SEQ ID NO: 32174 - RNA, 22 nt, Human
agggcugcaggcaagauauggc

SEQ ID NO: 32175 - RNA, 22 nt, Human
agggcugcccagugugagagcu

SEQ ID NO: 32176 - RNA, 22 nt, Human
agggcugcuaccuuaaucaguu

SEQ ID NO: 32177 - RNA, 22 nt, Human
agggcugcuuugcuaaauaugg

SEQ ID NO: 32178 - RNA, 22 nt, Human
agggcuggagccacagcuggga

SEQ ID NO: 32179 - RNA, 22 nt, Human
agggcuggcaucucuaaugcug

SEQ ID NO: 32180 - RNA, 22 nt, Human
agggcuguuuuucaguguguga

SEQ ID NO: 32181 - RNA, 22 nt, Human
agggcuguuuuuggcaccuggg

SEQ ID NO: 32182 - RNA, 22 nt, Human
agggcuugacaagggcuggagc

SEQ ID NO: 32183 - RNA, 22 nt, Human
agggcuuguaggguggcuguag

SEQ ID NO: 32184 - RNA, 22 nt, Human
agggcuuguggucguggcugug

SEQ ID NO: 32185 - RNA, 22 nt, Human
agggcuuuacuucucaguucua

SEQ ID NO: 32186 - RNA, 22 nt, Human
agggcuuuggcccccugcugca

SEQ ID NO: 32187 - RNA, 19 nt, Human
agggcuuugugugcugcuc

SEQ ID NO: 32188 - RNA, 22 nt, Human
agggcuuuugagcgcacgucug

SEQ ID NO: 32189 - RNA, 22 nt, Human
aggggaaaucucucgccaucug

SEQ ID NO: 32190 - RNA, 22 nt, Human
aggggaaaugccuuggugguac

SEQ ID NO: 32191 - RNA, 22 nt, Human
aggggaagauuauacuuuugaa

SEQ ID NO: 32192 - RNA, 21 nt, Human
aggggaaguagaguuuugauu

SEQ ID NO: 32193 - RNA, 22 nt, Human
aggggacauuuagcaaugacua

SEQ ID NO: 32194 - RNA, 22 nt, Human
aggggaugccuaguggagucuc

SEQ ID NO: 32195 - RNA, 22 nt, Human
aggggaugccugaggaucugua

SEQ ID NO: 32196 - RNA, 22 nt, Human
aggggauggagcuggaaggcag

SEQ ID NO: 32197 - RNA, 20 nt, Human
aggggcaccugcgacggggc

SEQ ID NO: 32198 - RNA, 22 nt, Human
aggggcacuucucaggcugugg

SEQ ID NO: 32199 - RNA, 22 nt, Human
aggggcaggugcugcacuuaga

SEQ ID NO: 32200 - RNA, 21 nt, Human
aggggcccuugccaggacgcc

SEQ ID NO: 32201 - RNA, 22 nt, Human
aggggcggccugccugaagcag

SEQ ID NO: 32202 - RNA, 22 nt, Human
aaagcagcaaauacuuuugcac

SEQ ID NO: 32203 - RNA, 22 nt, Human
aaagcagcaaguauuuguuacu

SEQ ID NO: 32204 - RNA, 22 nt, Human
aaagcagcagaaagcuggcccc

SEQ ID NO: 32205 - RNA, 22 nt, Human
aaagcagcagaaucucucaggg

SEQ ID NO: 32206 - RNA, 22 nt, Human
aaagcagcugauagucucaucu

SEQ ID NO: 32207 - RNA, 22 nt, Human
aaagcaggguccaaggagaugu

SEQ ID NO: 32208 - RNA, 22 nt, Human
aaagcaguaguuuucaaauagu

SEQ ID NO: 32209 - RNA, 22 nt, Human
aaagcaguauaaguaacggaag

SEQ ID NO: 32210 - RNA, 22 nt, Human
aaagcaguaugaaaggcaauaa

SEQ ID NO: 32211 - RNA, 20 nt, Human
aaagcaguaugcaaguagag

SEQ ID NO: 32212 - RNA, 22 nt, Human
aaagcaguccuucccuuaaggu

SEQ ID NO: 32213 - RNA, 21 nt, Human
aaagcaucacgaacauuuggg

SEQ ID NO: 32214 - RNA, 22 nt, Human
aaagcaugacucaagaauuacu

SEQ ID NO: 32215 - RNA, 22 nt, Human
aaagcaugauuagauagaugau

SEQ ID NO: 32216 - RNA, 22 nt, Human
aaagcaugugaauagaauaugg

SEQ ID NO: 32217 - RNA, 22 nt, Human
aaagcauguugggucccucuuu

SEQ ID NO: 32218 - RNA, 22 nt, Human
aaagcauuacuagacuggauuu

SEQ ID NO: 32219 - RNA, 22 nt, Human
aaagcauuucaugucuagaaag

SEQ ID NO: 32220 - RNA, 22 nt, Human
aaagccacaguucuaugucugc

SEQ ID NO: 32221 - RNA, 22 nt, Human
aaagccaggcagccaagccagu

SEQ ID NO: 32222 - RNA, 22 nt, Human
aaagccaggggagggauuccca

SEQ ID NO: 32223 - RNA, 22 nt, Human
aaagccaguucuuagagaaagc

SEQ ID NO: 32224 - RNA, 22 nt, Human
aaagccauaucuauucuauucu

SEQ ID NO: 32225 - RNA, 22 nt, Human
aaagccaucugcugguucgcau

SEQ ID NO: 32226 - RNA, 22 nt, Human
aaagccaugaauguuauagagg

SEQ ID NO: 32227 - RNA, 22 nt, Human
aaagccaugggucuuuggcaua

SEQ ID NO: 32228 - RNA, 22 nt, Human
aaagcccauguggaaguacagg

SEQ ID NO: 32229 - RNA, 22 nt, Human
aaagccuucugucuagcagaua

SEQ ID NO: 32230 - RNA, 22 nt, Human
aaagccuucuucggucugugau

SEQ ID NO: 32231 - RNA, 22 nt, Human
aaagccuuugucucaggcucug

SEQ ID NO: 32232 - RNA, 22 nt, Human
aaagccuuuucuguuuaacaca

SEQ ID NO: 32233 - RNA, 22 nt, Human
aaagcuaguaauauuuuaaucc

SEQ ID NO: 32234 - RNA, 22 nt, Human
aaagcuauuugugaguuauaga

SEQ ID NO: 32235 - RNA, 22 nt, Human
aaagcuauuuuauugcagcucu

SEQ ID NO: 32236 - RNA, 22 nt, Human
aaagcucaucauuaggaggcua

SEQ ID NO: 32237 - RNA, 22 nt, Human
aaagcucucugaacaccagacc

SEQ ID NO: 32238 - RNA, 22 nt, Human
aaagcucugguuuggagcauuu

SEQ ID NO: 32239 - RNA, 22 nt, Human
aaagcucuuacuguacuaguga

SEQ ID NO: 32240 - RNA, 22 nt, Human
aaagcucuuauguaaacagaaa

SEQ ID NO: 32241 - RNA, 22 nt, Human
aaagcucuuggauuuuagacuc

SEQ ID NO: 32242 - RNA, 22 nt, Human
aaagcugcugccaaucaggcuu

SEQ ID NO: 32243 - RNA, 22 nt, Human
aaagcugcugugaaugguuugg

SEQ ID NO: 32244 - RNA, 22 nt, Human
aaagcugcuuuaaacaucuaug

SEQ ID NO: 32245 - RNA, 22 nt, Human
aaagcugggcuagguuuguuuc

SEQ ID NO: 32246 - RNA, 22 nt, Human
aaacagucaugguugcuguuca

SEQ ID NO: 32247 - RNA, 22 nt, Human
aaacaguggccaauucuggaga

SEQ ID NO: 32248 - RNA, 22 nt, Human
aaacaguuuauaacaugauacu

SEQ ID NO: 32249 - RNA, 22 nt, Human
aaacaguuuuuuaagucucuag

SEQ ID NO: 32250 - RNA, 22 nt, Human
aaacaucaccauuuuaccuaau

SEQ ID NO: 32251 - RNA, 22 nt, Human
aaacaugagcacuugcuucaua

SEQ ID NO: 32252 - RNA, 22 nt, Human
aaacaugagcauuucuguuuaa

SEQ ID NO: 32253 - RNA, 22 nt, Human
aaacaugaugucauauaugcca

SEQ ID NO: 32254 - RNA, 22 nt, Human
aaacaugcauucaagaaaaucu

SEQ ID NO: 32255 - RNA, 22 nt, Human
aaacauuagacaccauaugcuc

SEQ ID NO: 32256 - RNA, 22 nt, Human
aaacauugaugggaaguuuaau

SEQ ID NO: 32257 - RNA, 22 nt, Human
aaacauuguaauuuuagcaugg

SEQ ID NO: 32258 - RNA, 22 nt, Human
aaaccaacccuggcuggccuag

SEQ ID NO: 32259 - RNA, 22 nt, Human
aaaccacaguucagugcuuuug

SEQ ID NO: 32260 - RNA, 22 nt, Human
aaaccacaugccuucaaaugcu

SEQ ID NO: 32261 - RNA, 22 nt, Human
aaaccagugauagacuagacac

SEQ ID NO: 32262 - RNA, 18 nt, Human
aaacccacucagcgcuga

SEQ ID NO: 32263 - RNA, 22 nt, Human
aaaccuagaaggaagggucucu

SEQ ID NO: 32264 - RNA, 22 nt, Human
aaaccucuuaauggccuguaau

SEQ ID NO: 32265 - RNA, 22 nt, Human
aaaccucuuuuaaggaguuguu

SEQ ID NO: 32266 - RNA, 22 nt, Human
aaaccugaaggaugauacaaca

SEQ ID NO: 32267 - RNA, 22 nt, Human
aaaccugaauguaugucagaag

SEQ ID NO: 32268 - RNA, 22 nt, Human
aaaccuggaacauuugacuagg

SEQ ID NO: 32269 - RNA, 22 nt, Human
aaaccuggacuuguaaugauaa

SEQ ID NO: 32270 - RNA, 22 nt, Human
aaaccuguagcaguuuguuaca

SEQ ID NO: 32271 - RNA, 22 nt, Human
aaaccuuucucagugcuaaaau

SEQ ID NO: 32272 - RNA, 22 nt, Human
aaaccuuucugcucucagcgua

SEQ ID NO: 32273 - RNA, 22 nt, Human
aaaccuuugccuggaagggagu

SEQ ID NO: 32274 - RNA, 20 nt, Human
aaacgagccaucauucuggu

SEQ ID NO: 32275 - RNA, 21 nt, Human
aaacuagaguguggcaaagcu

SEQ ID NO: 32276 - RNA, 21 nt, Human
aaacuagcagcaaccaugauc

SEQ ID NO: 32277 - RNA, 19 nt, Human
aaacucauagacucauauu

SEQ ID NO: 32278 - RNA, 22 nt, Human
aaacuccugggcucaagcaguu

SEQ ID NO: 32279 - RNA, 22 nt, Human
aaacucuaagacacuguacaau

SEQ ID NO: 32280 - RNA, 22 nt, Human
aaacucuaaucaaauauagcau

SEQ ID NO: 32281 - RNA, 22 nt, Human
aaacucuaguuaugaaguuugu

SEQ ID NO: 32282 - RNA, 22 nt, Human
aaacucucuuuucuucaguagg

SEQ ID NO: 32283 - RNA, 19 nt, Human
aaacucugaaggccacugg

SEQ ID NO: 32284 - RNA, 22 nt, Human
aaacucugaugcuuauugggaa

SEQ ID NO: 32285 - RNA, 22 nt, Human
aaacucugccauuuuuggccug

SEQ ID NO: 32286 - RNA, 22 nt, Human
aaacucuuccuuucuuuaaagu

SEQ ID NO: 32287 - RNA, 22 nt, Human
aaacucuuggucaacaugagga

SEQ ID NO: 32288 - RNA, 22 nt, Human
aaacugaaacaucaucauguug

SEQ ID NO: 32289 - RNA, 22 nt, Human
aaacugaagccuuggagugaca

SEQ ID NO: 32290 - RNA, 22 nt, Human
aaacugcaaugacagguaggag

SEQ ID NO: 32291 - RNA, 22 nt, Human
aaacugcacacgaugugccuga

SEQ ID NO: 32292 - RNA, 22 nt, Human
aaacugcacaugaggcuggugc

SEQ ID NO: 32293 - RNA, 22 nt, Human
aaacugcacuuuauuuugucaa

SEQ ID NO: 32294 - RNA, 22 nt, Human
aaacugcaugaagcugauuuua

SEQ ID NO: 32295 - RNA, 18 nt, Human
aaacuggcuuggccugug

SEQ ID NO: 32296 - RNA, 22 nt, Human
aaacugguaaucggcaagugag

SEQ ID NO: 32297 - RNA, 22 nt, Human
aaacugguagcaauuuaagggu

SEQ ID NO: 32298 - RNA, 22 nt, Human
aaacugguauucaaauguuugg

SEQ ID NO: 32299 - RNA, 22 nt, Human
aaacuguaaagcaggugaguag

SEQ ID NO: 32300 - RNA, 22 nt, Human
aaacuguaaauacuaguaagug

SEQ ID NO: 32301 - RNA, 22 nt, Human
aaacuguaagagaauaaacuac

SEQ ID NO: 32302 - RNA, 22 nt, Human
aaacuguaaugcaggaucaaga

SEQ ID NO: 32303 - RNA, 22 nt, Human
aaacugucauuuuauauaguua

SEQ ID NO: 32304 - RNA, 22 nt, Human
aaacuguccucccgagguuucc

SEQ ID NO: 32305 - RNA, 22 nt, Human
aaacuguuccuuuuucagcaac

SEQ ID NO: 32306 - RNA, 23 nt, Human
aaacuguugcuucaauguauccu

SEQ ID NO: 32307 - RNA, 22 nt, Human
aaacuuauuuuaucacaguuca

SEQ ID NO: 32308 - RNA, 22 nt, Human
aaacuucagggaauaaaagagu

SEQ ID NO: 32309 - RNA, 22 nt, Human
aaacuucagugaaugacuuaug

SEQ ID NO: 32310 - RNA, 17 nt, Human
aaacuucauucucagga

SEQ ID NO: 32311 - RNA, 22 nt, Human
aaacccauggcugauaucacua

SEQ ID NO: 32312 - RNA, 22 nt, Human
aaaccggggccuuuccacaaug

SEQ ID NO: 32313 - RNA, 22 nt, Human
aaaccuauuggcaagaauaaua

SEQ ID NO: 32314 - RNA, 22 nt, Human
aaaccucuuuccauuagaggaa

SEQ ID NO: 32315 - RNA, 22 nt, Human
aaaccugauagauuuucagaau

SEQ ID NO: 32316 - RNA, 22 nt, Human
aaaccugguggaacggugaaua

SEQ ID NO: 32317 - RNA, 19 nt, Human
aaaccuguuaguagagcac

SEQ ID NO: 32318 - RNA, 23 nt, Human
aaaccuuuuguagaacaauugcu

SEQ ID NO: 32319 - RNA, 22 nt, Human
aaacggauauaacagcaaacgc

SEQ ID NO: 32320 - RNA, 22 nt, Human
aaacuaaugaagugaagacgcu

SEQ ID NO: 32321 - RNA, 22 nt, Human
aaacuacacuuugggaccagca

SEQ ID NO: 32322 - RNA, 22 nt, Human
aaacuacugauuugugaauuga

SEQ ID NO: 32323 - RNA, 22 nt, Human
aaacuacuggauuaguaacuua

SEQ ID NO: 32324 - RNA, 22 nt, Human
aaacuagaaaucagcaagauag

SEQ ID NO: 32325 - RNA, 22 nt, Human
aaacuagagauggcagguggaa

SEQ ID NO: 32326 - RNA, 22 nt, Human
aaacuagagcaugugaguggga

SEQ ID NO: 32327 - RNA, 22 nt, Human
aaacuagguucugauuuccaag

SEQ ID NO: 32328 - RNA, 22 nt, Human
aaacuaucccugccauaauuuu

SEQ ID NO: 32329 - RNA, 22 nt, Human
aaacucaagucuaugaacaagg

SEQ ID NO: 32330 - RNA, 22 nt, Human
aaacucagaagguacagaaggg

SEQ ID NO: 32331 - RNA, 22 nt, Human
aaacuccugcauacucagaagc

SEQ ID NO: 32332 - RNA, 22 nt, Human
aaacucuaggacgaugggauag

SEQ ID NO: 32333 - RNA, 22 nt, Human
aaacucugcacugcgguaaggu

SEQ ID NO: 32334 - RNA, 22 nt, Human
aaacucuguauuugcugugggu

SEQ ID NO: 32335 - RNA, 22 nt, Human
aaacugaagagcuuuuugacac

SEQ ID NO: 32336 - RNA, 22 nt, Human
aaacugaaguucuggaggggua

SEQ ID NO: 32337 - RNA, 16 nt, Human
aaacugacggcaucug

SEQ ID NO: 32338 - RNA, 22 nt, Human
aaacugaggaaugacagcauua

SEQ ID NO: 32339 - RNA, 22 nt, Human
aaacugaggaguuagacuaggg

SEQ ID NO: 32340 - RNA, 22 nt, Human
aaacugauaaaauaaguacauu

SEQ ID NO: 32341 - RNA, 22 nt, Human
aaacugcaauuauuuuugcaau

SEQ ID NO: 32342 - RNA, 22 nt, Human
aaacugcaggucaugacccauu

SEQ ID NO: 32343 - RNA, 22 nt, Human
aaacugccaaaagaccuuggau

SEQ ID NO: 32344 - RNA, 22 nt, Human
aaacugguaauaaaauggauua

SEQ ID NO: 32345 - RNA, 22 nt, Human
aaacugguuucugagauggaac

SEQ ID NO: 32346 - RNA, 22 nt, Human
aaacuguaaguuugaggggaaa

SEQ ID NO: 32347 - RNA, 22 nt, Human
aaacuguaggagggaaaggaag

SEQ ID NO: 32348 - RNA, 22 nt, Human
aaacuguauagggaaaaguaga

SEQ ID NO: 32349 - RNA, 22 nt, Human
aaacuguauauuuauggcaugu

SEQ ID NO: 32350 - RNA, 22 nt, Human
aaacuguauuccauccucauca

SEQ ID NO: 32351 - RNA, 22 nt, Human
aaacugucaccuaauguauuuu

SEQ ID NO: 32352 - RNA, 22 nt, Human
aaacugugaagcaaguacaagg

SEQ ID NO: 32353 - RNA, 22 nt, Human
aaacuguguaugcagagagcau

SEQ ID NO: 32354 - RNA, 22 nt, Human
aaacuguuucccuccauaaccu

SEQ ID NO: 32355 - RNA, 22 nt, Human
aaacuuaguagaguucauauua

SEQ ID NO: 32356 - RNA, 22 nt, Human
aaacuucagacuccccacuucu

SEQ ID NO: 32357 - RNA, 23 nt, Human
aaacuucaguagugucaucagcc

SEQ ID NO: 32358 - RNA, 22 nt, Human
aaacuugagccaagggcuuggg

SEQ ID NO: 32359 - RNA, 22 nt, Human
aaacuugauuuagaacuaaggc

SEQ ID NO: 32360 - RNA, 22 nt, Human
aaacuugggugacccugagcaa

SEQ ID NO: 32361 - RNA, 22 nt, Human
aaacuuuguagagaaugcuggc

SEQ ID NO: 32362 - RNA, 22 nt, Human
aaacuuuuuuagguucauaggc

SEQ ID NO: 32363 - RNA, 22 nt, Human
aaagggaaaauauuuagacaua

SEQ ID NO: 32364 - RNA, 22 nt, Human
aaagggaacucuaauuaucuuc

SEQ ID NO: 32365 - RNA, 22 nt, Human
aaagggaauguguaggacaugu

SEQ ID NO: 32366 - RNA, 22 nt, Human
aaagggccaauggagagugugg

SEQ ID NO: 32367 - RNA, 22 nt, Human
aaagggcugaaguagucucugu

SEQ ID NO: 32368 - RNA, 22 nt, Human
aaaggucagcugccaucguucu

SEQ ID NO: 32369 - RNA, 22 nt, Human
aaaggucuuaagguuaagcagg

SEQ ID NO: 32370 - RNA, 22 nt, Human
aaagguuaguucuuagaagugc

SEQ ID NO: 32371 - RNA, 22 nt, Human
aaagguucucuuguucauuauu

SEQ ID NO: 32372 - RNA, 22 nt, Human
aaagguuuauugauucugcucu

SEQ ID NO: 32373 - RNA, 22 nt, Human
aaagguuuauuuguugcucaca

SEQ ID NO: 32374 - RNA, 22 nt, Human
aaagguuugcauggaauuuacc

SEQ ID NO: 32375 - RNA, 22 nt, Human
aaagguuuuguucaucgauuuu

SEQ ID NO: 32376 - RNA, 22 nt, Human
aaaguaacaauaagguucuauu

SEQ ID NO: 32377 - RNA, 22 nt, Human
aaaguaagauuugcauuucaga

SEQ ID NO: 32378 - RNA, 22 nt, Human
aaaguaaggguuaaucuacuuu

SEQ ID NO: 32379 - RNA, 22 nt, Human
aaaguacucgaggaggaggagc

SEQ ID NO: 32380 - RNA, 22 nt, Human
aaaguacugaugccaucagcac

SEQ ID NO: 32381 - RNA, 22 nt, Human
aaaguaguauaaaauucaugug

SEQ ID NO: 32382 - RNA, 22 nt, Human
aaaguaguuagucaugugaaaa

SEQ ID NO: 32383 - RNA, 22 nt, Human
aaaguaucaagggaagcauuuu

SEQ ID NO: 32384 - RNA, 22 nt, Human
aaaguaucuuacugcagccgag

SEQ ID NO: 32385 - RNA, 22 nt, Human
aaaguauucaaaaauauuuggu

SEQ ID NO: 32386 - RNA, 22 nt, Human
aaaguauuuuugacaggcauua

SEQ ID NO: 32387 - RNA, 22 nt, Human
aaagucaaaaugcucuccuguc

SEQ ID NO: 32388 - RNA, 22 nt, Human
aaagucacuuacagcucuuuug

SEQ ID NO: 32389 - RNA, 22 nt, Human
aaagucacuuccuucugucagc

SEQ ID NO: 32390 - RNA, 22 nt, Human
aaagucaggcuguguaccuaac

SEQ ID NO: 32391 - RNA, 22 nt, Human
aaagucaucauuucuuuucaaa

SEQ ID NO: 32392 - RNA, 22 nt, Human
aaagucaucuaggagcagauuu

SEQ ID NO: 32393 - RNA, 22 nt, Human
aaagucaugcaguugaacuuuu

SEQ ID NO: 32394 - RNA, 22 nt, Human
aaagucauguuuuuguuuagca

SEQ ID NO: 32395 - RNA, 22 nt, Human
aaagucauuuagccuuaucucc

SEQ ID NO: 32396 - RNA, 22 nt, Human
aaagucauuuguauauacccuu

SEQ ID NO: 32397 - RNA, 22 nt, Human
aaaguccaauuuuguucaggcu

SEQ ID NO: 32398 - RNA, 22 nt, Human
aaaguccuugcaguuuccucuu

SEQ ID NO: 32399 - RNA, 22 nt, Human
aaaguccuuuuugccaugcaag

SEQ ID NO: 32400 - RNA, 22 nt, Human
aaagucuccacugggaaccaaa

SEQ ID NO: 32401 - RNA, 22 nt, Human
aaagucugaaagauaagaguga

SEQ ID NO: 32402 - RNA, 20 nt, Human
aaagucuguuuaucucugga

SEQ ID NO: 32403 - RNA, 22 nt, Human
aaagucuucacggcacuagugu

SEQ ID NO: 32404 - RNA, 22 nt, Human
aaagucuuuauuuuguaucuuu

SEQ ID NO: 32405 - RNA, 19 nt, Human
aaagugaaugcuguuuucu

SEQ ID NO: 32406 - RNA, 22 nt, Human
aaagugacugccagugcugggc

SEQ ID NO: 32407 - RNA, 22 nt, Human
aaagugaugccaggagucuggu

SEQ ID NO: 32408 - RNA, 19 nt, Human
aaagugauuuuuucuggca

SEQ ID NO: 32409 - RNA, 22 nt, Human
aaagugcaccugcuucuucuug

SEQ ID NO: 32410 - RNA, 22 nt, Human
aaagugcacucucagugcugcu

SEQ ID NO: 32411 - RNA, 22 nt, Human
aaagugcaguaacuugcccaag

SEQ ID NO: 32412 - RNA, 22 nt, Human
aaagugcauuguuuguguuccu

SEQ ID NO: 32413 - RNA, 22 nt, Human
aaagugcugaaauuacaggugu

SEQ ID NO: 32414 - RNA, 22 nt, Human
aaagugcugagacagacuggga

SEQ ID NO: 32415 - RNA, 22 nt, Human
aaagugcugagauuacaagcgu

SEQ ID NO: 32416 - RNA, 22 nt, Human
aaagugcugggauuacaggcuu

SEQ ID NO: 32417 - RNA, 22 nt, Human
aaagugcugggauuccaggcgu

SEQ ID NO: 32418 - RNA, 22 nt, Human
aaagugcugugggcuguaagug

SEQ ID NO: 32419 - RNA, 22 nt, Human
aaagugcuuucccacauuuguu

SEQ ID NO: 32420 - RNA, 22 nt, Human
aacacugagggaaaagagauag

SEQ ID NO: 32421 - RNA, 22 nt, Human
aacacugcuccaaaaaaggcuu

SEQ ID NO: 32422 - RNA, 20 nt, Human
aacacugcuucuauauuuuc

SEQ ID NO: 32423 - RNA, 22 nt, Human
aacacugggauaggugauagac

SEQ ID NO: 32424 - RNA, 17 nt, Human
aacacugggugagccuc

SEQ ID NO: 32425 - RNA, 22 nt, Human
aacacugguucugacuacacag

SEQ ID NO: 32426 - RNA, 22 nt, Human
aacacuguaacagcaucauuuu

SEQ ID NO: 32427 - RNA, 22 nt, Human
aacacuguaucagucuucaaua

SEQ ID NO: 32428 - RNA, 22 nt, Human
aacacugugagguaaugaccua

SEQ ID NO: 32429 - RNA, 22 nt, Human
aacacuuaaggagagaucaaau

SEQ ID NO: 32430 - RNA, 22 nt, Human
aacacuuauccacauuugaaag

SEQ ID NO: 32431 - RNA, 22 nt, Human
aacacuucccaucagagggaca

SEQ ID NO: 32432 - RNA, 22 nt, Human
aacacuucccgaccauauggcu

SEQ ID NO: 32433 - RNA, 22 nt, Human
aacacuuuccugccuuucugau

SEQ ID NO: 32434 - RNA, 22 nt, Human
aacacuuuguugccuaugaacg

SEQ ID NO: 32435 - RNA, 22 nt, Human
aacacuuuuuaguaaagauuga

SEQ ID NO: 32436 - RNA, 22 nt, Human
aacagaaaagguagguggcuuu

SEQ ID NO: 32437 - RNA, 22 nt, Human
aacagaacuguuguucuggagg

SEQ ID NO: 32438 - RNA, 22 nt, Human
aacagaauugcugcugccaaug

SEQ ID NO: 32439 - RNA, 22 nt, Human
aacagacucacagcuagagaag

SEQ ID NO: 32440 - RNA, 22 nt, Human
aacagaguggagccaaacuuug

SEQ ID NO: 32441 - RNA, 22 nt, Human
aacagaguuucaaauaacaucu

SEQ ID NO: 32442 - RNA, 22 nt, Human
aacagauaaguauaucuaugua

SEQ ID NO: 32443 - RNA, 22 nt, Human
aacagauaauuucuaaguuacu

SEQ ID NO: 32444 - RNA, 22 nt, Human
aacagauggccaagugcauggg

SEQ ID NO: 32445 - RNA, 22 nt, Human
aacagauuguaaccugauagcc

SEQ ID NO: 32446 - RNA, 19 nt, Human
aacagcaacuuccuaguca

SEQ ID NO: 32447 - RNA, 22 nt, Human
aacagcaagggcggggucaaga

SEQ ID NO: 32448 - RNA, 22 nt, Human
aacagcagcaugacagcugggu

SEQ ID NO: 32449 - RNA, 22 nt, Human
aacagcaggcaccaaggcuaug

SEQ ID NO: 32450 - RNA, 22 nt, Human
aacagcauauuucauauauuga

SEQ ID NO: 32451 - RNA, 22 nt, Human
aacagccacugauacugaauag

SEQ ID NO: 32452 - RNA, 22 nt, Human
aacagcgucuuuccagcuguuc

SEQ ID NO: 32453 - RNA, 22 nt, Human
aacagcuagaauucuacuggcu

SEQ ID NO: 32454 - RNA, 22 nt, Human
aacagcuauuagaacuucaugg

SEQ ID NO: 32455 - RNA, 22 nt, Human
aacagcuuacucaauggugauu

SEQ ID NO: 32456 - RNA, 22 nt, Human
aacagcuucaucacauggcaua

SEQ ID NO: 32457 - RNA, 22 nt, Human
aacagcuugaggaauaucauca

SEQ ID NO: 32458 - RNA, 22 nt, Human
aacagcuugcugcaccuuaaua

SEQ ID NO: 32459 - RNA, 22 nt, Human
aacagcuuuguauacaguaacu

SEQ ID NO: 32460 - RNA, 22 nt, Human
aacaggaggccuuccaguccag

SEQ ID NO: 32461 - RNA, 18 nt, Human
aacaggauccuccacuuc

SEQ ID NO: 32462 - RNA, 22 nt, Human
aacaggccuuguuuuuguucau

SEQ ID NO: 32463 - RNA, 22 nt, Human
aacaggcucacucugacuucua

SEQ ID NO: 32464 - RNA, 22 nt, Human
aacaggcucuucauuuccagag

SEQ ID NO: 32465 - RNA, 22 nt, Human
aacaggggcugguugaaagagc

SEQ ID NO: 32466 - RNA, 20 nt, Human
aacagggggcugcagagggc

SEQ ID NO: 32467 - RNA, 22 nt, Human
aacaguaacgagauguccuaac

SEQ ID NO: 32468 - RNA, 22 nt, Human
aacaguaguauuuaaacugaac

SEQ ID NO: 32469 - RNA, 22 nt, Human
aacaguauaugaaauguuagga

SEQ ID NO: 32470 - RNA, 22 nt, Human
aacaguaugugagauuuacaca

SEQ ID NO: 32471 - RNA, 22 nt, Human
aacagucacauuguucaacuuu

SEQ ID NO: 32472 - RNA, 22 nt, Human
aacagucagcuucucgggacau

SEQ ID NO: 32473 - RNA, 22 nt, Human
aacagucugggaguuccuuaua

SEQ ID NO: 32474 - RNA, 22 nt, Human
aacagucuuacagaaguagcca

SEQ ID NO: 32475 - RNA, 22 nt, Human
aacagucuuggaagucuuguua

SEQ ID NO: 32476 - RNA, 22 nt, Human
aacagugaggugaauaugcucc

SEQ ID NO: 32477 - RNA, 22 nt, Human
aacagugcuguuauaaauguac

SEQ ID NO: 32478 - RNA, 22 nt, Human
aacaguggggaaaagaguuggu

SEQ ID NO: 32479 - RNA, 22 nt, Human
aacaguguguacacaucauagg

SEQ ID NO: 32480 - RNA, 17 nt, Human
aacaguuaaugggggaa

SEQ ID NO: 32481 - RNA, 22 nt, Human
aacaguuacccuuaagaucuuu

SEQ ID NO: 32482 - RNA, 21 nt, Human
aacaguucucuuugaaggugu

SEQ ID NO: 32483 - RNA, 22 nt, Human
aacaguuuaugagauaugcuau

SEQ ID NO: 32484 - RNA, 22 nt, Human
aacaguuugcuuuaagaggcac

SEQ ID NO: 32485 - RNA, 22 nt, Human
aacaguuuggguagguauguag

SEQ ID NO: 32486 - RNA, 22 nt, Human
aacauacagugagcaguggacu

SEQ ID NO: 32487 - RNA, 22 nt, Human
aacauagaauaaaugaguuagg

SEQ ID NO: 32488 - RNA, 22 nt, Human
aacauagaauggcuccagagcu

SEQ ID NO: 32489 - RNA, 22 nt, Human
aacauagagacaggaagugcuu

SEQ ID NO: 32490 - RNA, 22 nt, Human
aacauaucauaggaugucauug

SEQ ID NO: 32491 - RNA, 22 nt, Human
aacauaucuacggauacgauua

SEQ ID NO: 32492 - RNA, 22 nt, Human
aacaucaguauucucaucugua

SEQ ID NO: 32493 - RNA, 22 nt, Human
aacaucauccuuugaguauuua

SEQ ID NO: 32494 - RNA, 22 nt, Human
aacauccccuucaugucaugau

SEQ ID NO: 32495 - RNA, 22 nt, Human
aacaucuacuaagugccaggca

SEQ ID NO: 32496 - RNA, 22 nt, Human
aacaucuagguucucaucgaua

SEQ ID NO: 32497 - RNA, 22 nt, Human
aacaucuaguuccuauauaaua

SEQ ID NO: 32498 - RNA, 22 nt, Human
aacaucuccaaccuacauccac

SEQ ID NO: 32499 - RNA, 19 nt, Human
aacaucuguaacuauuuuc

SEQ ID NO: 32500 - RNA, 22 nt, Human
aacaucuuaucugcaugauccc

SEQ ID NO: 32501 - RNA, 22 nt, Human
aacaucuucagagaagcuaagu

SEQ ID NO: 32502 - RNA, 22 nt, Human
aacaucuuuacaacagaccuag

SEQ ID NO: 32503 - RNA, 22 nt, Human
aacaucuuuuuguuugcugaaa

SEQ ID NO: 32504 - RNA, 22 nt, Human
aacaugauuggaaaaugcuguc

SEQ ID NO: 32505 - RNA, 22 nt, Human
aacaugcagugagccgaugagg

SEQ ID NO: 32506 - RNA, 22 nt, Human
aacaugcaugaagaaguuauau

SEQ ID NO: 32507 - RNA, 22 nt, Human
aacaugcucuguuucuuggaug

SEQ ID NO: 32508 - RNA, 22 nt, Human
aacaugcucuuccuggcuaguc

SEQ ID NO: 32509 - RNA, 22 nt, Human
aacaugcugccuuucuacgagu

SEQ ID NO: 32510 - RNA, 22 nt, Human
aacaugcuugcuuagaaucagc

SEQ ID NO: 32511 - RNA, 22 nt, Human
aacaugcuuugauaaauaaaag

SEQ ID NO: 32512 - RNA, 22 nt, Human
aacauguaccuacaaucagaau

SEQ ID NO: 32513 - RNA, 20 nt, Human
aagaaggccugcccagacac

SEQ ID NO: 32514 - RNA, 22 nt, Human
aagaaggcggaccagaagggag

SEQ ID NO: 32515 - RNA, 22 nt, Human
aagaagguugaaugacuacuuu

SEQ ID NO: 32516 - RNA, 22 nt, Human
aagaaguuggaaaugauugaga

SEQ ID NO: 32517 - RNA, 22 nt, Human
aagaauaacacuuagguuuugc

SEQ ID NO: 32518 - RNA, 22 nt, Human
aagaauacuucguaaguaggau

SEQ ID NO: 32519 - RNA, 23 nt, Human
aagaaucaguaaguaaggagacc

SEQ ID NO: 32520 - RNA, 22 nt, Human
aagaaucucucaagugugacaa

SEQ ID NO: 32521 - RNA, 18 nt, Human
aagaaucucugacucuuu

SEQ ID NO: 32522 - RNA, 22 nt, Human
aagaaucuuuccaguuuugaug

SEQ ID NO: 32523 - RNA, 22 nt, Human
aagaaugagcucaaagaucuua

SEQ ID NO: 32524 - RNA, 22 nt, Human
aagaauggugguggggccagca

SEQ ID NO: 32525 - RNA, 22 nt, Human
aagaauguggcauuuauuuaua

SEQ ID NO: 32526 - RNA, 22 nt, Human
aagaauuaucugaaagcugugu

SEQ ID NO: 32527 - RNA, 22 nt, Human
aagaauuauugcaauacuagau

SEQ ID NO: 32528 - RNA, 22 nt, Human
aagaauucacugguagagucaa

SEQ ID NO: 32529 - RNA, 22 nt, Human
aagauacauaaagguagagucu

SEQ ID NO: 32530 - RNA, 22 nt, Human
aagauacauauuuguucuagug

SEQ ID NO: 32531 - RNA, 22 nt, Human
aagauacauguuaggagcaacc

SEQ ID NO: 32532 - RNA, 22 nt, Human
aagauacucaguggauaugcau

SEQ ID NO: 32533 - RNA, 20 nt, Human
aagauacuccagaaauuaaa

SEQ ID NO: 32534 - RNA, 22 nt, Human
aagauauagauggugguauaaa

SEQ ID NO: 32535 - RNA, 22 nt, Human
aagauauauuuuggugauuuca

SEQ ID NO: 32536 - RNA, 22 nt, Human
aagaucaagaucagagaacagc

SEQ ID NO: 32537 - RNA, 22 nt, Human
aagaucagaacuuuauacagga

SEQ ID NO: 32538 - RNA, 22 nt, Human
aagaucaugguuuaucugggag

SEQ ID NO: 32539 - RNA, 22 nt, Human
aagaucuauuaugagucagguc

SEQ ID NO: 32540 - RNA, 22 nt, Human
aagaugaaucaguauguguccu

SEQ ID NO: 32541 - RNA, 21 nt, Human
aagaugauauuuuaucuguag

SEQ ID NO: 32542 - RNA, 22 nt, Human
aagaugccuguagcaggaagau

SEQ ID NO: 32543 - RNA, 22 nt, Human
aagaugcuaauuguggaaguug

SEQ ID NO: 32544 - RNA, 22 nt, Human
aagauggaguaguguaaugguu

SEQ ID NO: 32545 - RNA, 22 nt, Human
aagauggcuuagaguccuggug

SEQ ID NO: 32546 - RNA, 22 nt, Human
aagaugugcugucuugccacuc

SEQ ID NO: 32547 - RNA, 22 nt, Human
aagaugugucucaucagggugu

SEQ ID NO: 32548 - RNA, 22 nt, Human
aagauguuaaaucuguagaauu

SEQ ID NO: 32549 - RNA, 22 nt, Human
aagauguuaaauugggggcauu

SEQ ID NO: 32550 - RNA, 22 nt, Human
aagauguuagauuauggggaca

SEQ ID NO: 32551 - RNA, 22 nt, Human
aagauguugcauuagaauaccu

SEQ ID NO: 32552 - RNA, 18 nt, Human
aagauguuuaaugggaag

SEQ ID NO: 32553 - RNA, 22 nt, Human
aagauguuuagguaaaaaguuu

SEQ ID NO: 32554 - RNA, 22 nt, Human
aagauuacuacggaacaugacc

SEQ ID NO: 32555 - RNA, 22 nt, Human
aagauucacagagugaaugaaa

SEQ ID NO: 32556 - RNA, 22 nt, Human
aagauucagccaaauuguucau

SEQ ID NO: 32557 - RNA, 22 nt, Human
aagauucaguugauguguucca

SEQ ID NO: 32558 - RNA, 22 nt, Human
aagauucuacaaacucugguaa

SEQ ID NO: 32559 - RNA, 22 nt, Human
aagauucuagaggaacuucuua

SEQ ID NO: 32560 - RNA, 22 nt, Human
aagauucucagagugaaagaau

SEQ ID NO: 32561 - RNA, 20 nt, Human
aagauucugauuuguagcgu

SEQ ID NO: 32562 - RNA, 22 nt, Human
aagauucuguauuucuaacaau

SEQ ID NO: 32563 - RNA, 22 nt, Human
aagauucuuaccuauacccagu

SEQ ID NO: 32564 - RNA, 22 nt, Human
aagauugacggcuuugagugcu

SEQ ID NO: 32565 - RNA, 22 nt, Human
aagauugccccauuuacacugc

SEQ ID NO: 32566 - RNA, 22 nt, Human
aagauuguuuugggggaagugg

SEQ ID NO: 32567 - RNA, 22 nt, Human
aagauuuacuuucuuuguaaua

SEQ ID NO: 32568 - RNA, 22 nt, Human
aagauuuccauuucuagcucau

SEQ ID NO: 32569 - RNA, 22 nt, Human
aagauuuccuucaguagagcua

SEQ ID NO: 32570 - RNA, 22 nt, Human
aagauuucucuccuggaaagca

SEQ ID NO: 32571 - RNA, 19 nt, Human
aagauuuggucauugauaa

SEQ ID NO: 32572 - RNA, 22 nt, Human
aagauuuuuuuccacagacuca

SEQ ID NO: 32573 - RNA, 22 nt, Human
aagcaaacaggagaagagcugu

SEQ ID NO: 32574 - RNA, 22 nt, Human
aagcaaagaguuuaguggguga

SEQ ID NO: 32575 - RNA, 22 nt, Human
aagcaaagugaauuuugccaag

SEQ ID NO: 32576 - RNA, 22 nt, Human
aagcaaaugaaccagagguaau

SEQ ID NO: 32577 - RNA, 22 nt, Human
aagcaacauucucuguggcauu

SEQ ID NO: 32578 - RNA, 22 nt, Human
aagcaacucccuccucauuuuu

SEQ ID NO: 32579 - RNA, 22 nt, Human
aagcaacuggcucauugucuca

SEQ ID NO: 32580 - RNA, 22 nt, Human
aagcaagaggaaauguggaccu

SEQ ID NO: 32581 - RNA, 22 nt, Human
aagcaagaguuggagugauguu

SEQ ID NO: 32582 - RNA, 22 nt, Human
aagcaagcccaggcucagucaa

SEQ ID NO: 32583 - RNA, 19 nt, Human
aagcaagcuuugagugggu

SEQ ID NO: 32584 - RNA, 22 nt, Human
aagcaaggcccagagcaucagc

SEQ ID NO: 32585 - RNA, 22 nt, Human
aagcaauaagccagauuuggau

SEQ ID NO: 32586 - RNA, 22 nt, Human
aagcaauacaaguggucauuga

SEQ ID NO: 32587 - RNA, 22 nt, Human
aagcaauaggguaaucuacuca

SEQ ID NO: 32588 - RNA, 23 nt, Human
aagcaaugcugagccaguucuga

SEQ ID NO: 32589 - RNA, 21 nt, Human
aagcaauuaccuucccaugug

SEQ ID NO: 32590 - RNA, 22 nt, Human
aagcacaauuuaggacugaaau

SEQ ID NO: 32591 - RNA, 22 nt, Human
aagcacacagcaaaggggagcu

SEQ ID NO: 32592 - RNA, 22 nt, Human
aagcacacuuggcucuguguac

SEQ ID NO: 32593 - RNA, 23 nt, Human
aagcacagaaugguuuaggaguu

SEQ ID NO: 32594 - RNA, 22 nt, Human
aagcacagacacaaaaggcuuu

SEQ ID NO: 32595 - RNA, 22 nt, Human
aagcacagauaaaacaggauuc

SEQ ID NO: 32596 - RNA, 22 nt, Human
aagcacagccagguuaggggcu

SEQ ID NO: 32597 - RNA, 22 nt, Human
aagcacagggacucaggaccgg

SEQ ID NO: 32598 - RNA, 22 nt, Human
aagcacagugggcagagcagcc

SEQ ID NO: 32599 - RNA, 22 nt, Human
aagcacaugagcuauucaugcu

SEQ ID NO: 32600 - RNA, 20 nt, Human
aagcacauuucuacaauaau

SEQ ID NO: 32601 - RNA, 22 nt, Human
aagcaccacccucccaaccugu

SEQ ID NO: 32602 - RNA, 22 nt, Human
aagcacccaauuuacagcaguu

SEQ ID NO: 32603 - RNA, 22 nt, Human
aagcacuaggucacacaaguua

SEQ ID NO: 32604 - RNA, 22 nt, Human
aagcacuggggccacagacacg

SEQ ID NO: 32605 - RNA, 22 nt, Human
aagcagaaagaacaacugagug

SEQ ID NO: 32606 - RNA, 22 nt, Human
aagcagaacugggaaguagugg

SEQ ID NO: 32607 - RNA, 20 nt, Human
aagcagaagcugcucucagc

SEQ ID NO: 32608 - RNA, 18 nt, Human
aagcagacagcagacagu

SEQ ID NO: 32609 - RNA, 22 nt, Human
aagcagacaucccauacuuuug

SEQ ID NO: 32610 - RNA, 22 nt, Human
aagcagauauugugggaguggg

SEQ ID NO: 32611 - RNA, 22 nt, Human
aagcagaugcagcuaauaaagc

SEQ ID NO: 32612 - RNA, 15 nt, Human
aagcagcaauauaua

SEQ ID NO: 32613 - RNA, 22 nt, Human
aagcagcacaguaauauuggug

SEQ ID NO: 32614 - RNA, 22 nt, Human
aagcagcagcaggauuaaagag

SEQ ID NO: 32615 - RNA, 22 nt, Human
aagcagcauagcucccuuaguu

SEQ ID NO: 32616 - RNA, 22 nt, Human
aagcagcauaugacagcaucca

SEQ ID NO: 32617 - RNA, 22 nt, Human
aagcagcauccugggcagaccu

SEQ ID NO: 32618 - RNA, 22 nt, Human
aagcagcaugcuaugcuggugg

SEQ ID NO: 32619 - RNA, 22 nt, Human
aagcagcauucagugaaaugug

SEQ ID NO: 32620 - RNA, 22 nt, Human
aagcagccaccucaucuccacu

SEQ ID NO: 32621 - RNA, 19 nt, Human
aagcagcccuggcaagagc

SEQ ID NO: 32622 - RNA, 22 nt, Human
aagcagcuuccccaaagugccu

SEQ ID NO: 32623 - RNA, 22 nt, Human
aagcagcuuuugaagagugagg

SEQ ID NO: 32624 - RNA, 21 nt, Human
aagcaggacauaugaugcccu

SEQ ID NO: 32625 - RNA, 22 nt, Human
aagcaggcaggguggagaguuu

SEQ ID NO: 32626 - RNA, 18 nt, Human
aagcaggguccauugugc

SEQ ID NO: 32627 - RNA, 22 nt, Human
aagcagggucuuccucaguugg

SEQ ID NO: 32628 - RNA, 22 nt, Human
aagcaggguuuuuccaccgcag

SEQ ID NO: 32629 - RNA, 22 nt, Human
aagcagguuaugaaauauagaa

SEQ ID NO: 32630 - RNA, 22 nt, Human
aaccauuugccauuaucuuaag

SEQ ID NO: 32631 - RNA, 22 nt, Human
aacccagagcuggaggagagua

SEQ ID NO: 32632 - RNA, 22 nt, Human
aacccaggagacagguugcagu

SEQ ID NO: 32633 - RNA, 22 nt, Human
aacccaggagauggagguugug

SEQ ID NO: 32634 - RNA, 22 nt, Human
aaccccaguaccccaggauaug

SEQ ID NO: 32635 - RNA, 22 nt, Human
aacccgagggccccaggcucgg

SEQ ID NO: 32636 - RNA, 22 nt, Human
aacccgggaggcagagguugug

SEQ ID NO: 32637 - RNA, 22 nt, Human
aacccucagcuguuugaggaga

SEQ ID NO: 32638 - RNA, 22 nt, Human
aaguugauuuaaacuacuaguc

SEQ ID NO: 32639 - RNA, 22 nt, Human
aaguugcuaaaggaguucuuug

SEQ ID NO: 32640 - RNA, 20 nt, Human
aaguuggcuccuccuagcaa

SEQ ID NO: 32641 - RNA, 22 nt, Human
aaguuuacauaagugaugauga

SEQ ID NO: 32642 - RNA, 22 nt, Human
aaguuuagaacuauaagaguga

SEQ ID NO: 32643 - RNA, 22 nt, Human
aaguuuagcgcucucucaagga

SEQ ID NO: 32644 - RNA, 22 nt, Human
aaguuuaucuuugcuggguacu

SEQ ID NO: 32645 - RNA, 22 nt, Human
aaguuucaaauguugauuaugc

SEQ ID NO: 32646 - RNA, 22 nt, Human
aaguuucaugacuugguuauua

SEQ ID NO: 32647 - RNA, 20 nt, Human
aaguuucaugcucuggggau

SEQ ID NO: 32648 - RNA, 22 nt, Human
aaguuucauuguucauguaaca

SEQ ID NO: 32649 - RNA, 22 nt, Human
aaguuucuauuauuacauucgu

SEQ ID NO: 32650 - RNA, 22 nt, Human
aaguuucucaauggcaacuggg

SEQ ID NO: 32651 - RNA, 22 nt, Human
aaguuucugauauuguuaaagc

SEQ ID NO: 32652 - RNA, 22 nt, Human
aaguuucugggcaagacaaggc

SEQ ID NO: 32653 - RNA, 21 nt, Human
aaguuugggauucaguuucca

SEQ ID NO: 32654 - RNA, 22 nt, Human
aaguuugucgaaauuaucagca

SEQ ID NO: 32655 - RNA, 22 nt, Human
aaguuugugucagagcuguuac

SEQ ID NO: 32656 - RNA, 22 nt, Human
aaguuuguuguacauguuagua

SEQ ID NO: 32657 - RNA, 21 nt, Human
aaguuuuauguugccauuugu

SEQ ID NO: 32658 - RNA, 20 nt, Human
aaguuuucuccaaauacagu

SEQ ID NO: 32659 - RNA, 22 nt, Human
aaguuuuugguagagaaaagua

SEQ ID NO: 32660 - RNA, 20 nt, Human
aauaaacuacugagagaugu

SEQ ID NO: 32661 - RNA, 22 nt, Human
aauaaacuuccacuguguuuuu

SEQ ID NO: 32662 - RNA, 22 nt, Human
aauaaagaauggaugagaucgu

SEQ ID NO: 32663 - RNA, 22 nt, Human
aauaaaggcaccauaaggcaaa

SEQ ID NO: 32664 - RNA, 22 nt, Human
aauaaaguagcguuuaaggugc

SEQ ID NO: 32665 - RNA, 22 nt, Human
aauaacagagaaggguggcuuc

SEQ ID NO: 32666 - RNA, 22 nt, Human
aauaacaggguugauuugcaau

SEQ ID NO: 32667 - RNA, 22 nt, Human
aauaaccuuacuuauuacaugg

SEQ ID NO: 32668 - RNA, 22 nt, Human
aauaacuuaagaaauuucccca

SEQ ID NO: 32669 - RNA, 22 nt, Human
aagucccaaagucacucugcuu

SEQ ID NO: 32670 - RNA, 22 nt, Human
aagucccugguuccuagcaaaa

SEQ ID NO: 32671 - RNA, 22 nt, Human
aaguccuagacuuggauaguuu

SEQ ID NO: 32672 - RNA, 20 nt, Human
aaguccugaccuagucuaaa

SEQ ID NO: 32673 - RNA, 22 nt, Human
aaguccugccaccuauaagccu

SEQ ID NO: 32674 - RNA, 22 nt, Human
aaguccugugcuagagacaccu

SEQ ID NO: 32675 - RNA, 22 nt, Human
aaguccugugugcuuacacuug

SEQ ID NO: 32676 - RNA, 22 nt, Human
aaguccuguuccucauacuucc

SEQ ID NO: 32677 - RNA, 22 nt, Human
aaguccuuaggaagcagucguu

SEQ ID NO: 32678 - RNA, 22 nt, Human
aaguccuuuccaguccugugau

SEQ ID NO: 32679 - RNA, 22 nt, Human
aaguccuuucucauggaggaau

SEQ ID NO: 32680 - RNA, 22 nt, Human
aagucuaaacacauauuuaaaa

SEQ ID NO: 32681 - RNA, 22 nt, Human
aagucuaaccuauuccgguguu

SEQ ID NO: 32682 - RNA, 22 nt, Human
aagucucucugugugggauaag

SEQ ID NO: 32683 - RNA, 22 nt, Human
aagucucuuuucuuccuguauu

SEQ ID NO: 32684 - RNA, 22 nt, Human
aagucuggaagucucaguuuuc

SEQ ID NO: 32685 - RNA, 22 nt, Human
aagucugggccagggcacagcc

SEQ ID NO: 32686 - RNA, 22 nt, Human
aagucuggugcuguccucaccc

SEQ ID NO: 32687 - RNA, 22 nt, Human
aagucuguagaaaaacaguuua

SEQ ID NO: 32688 - RNA, 22 nt, Human
aagucuuacagacaagcugaag

SEQ ID NO: 32689 - RNA, 22 nt, Human
aagucuuacauaaacaggaaau

SEQ ID NO: 32690 - RNA, 22 nt, Human
aagucuuauuugucauguaugu

SEQ ID NO: 32691 - RNA, 22 nt, Human
aagucuugaugaucuccuccuu

SEQ ID NO: 32692 - RNA, 18 nt, Human
aagucuuggaauuuccac

SEQ ID NO: 32693 - RNA, 22 nt, Human
aagucuugguagagaaggacuu

SEQ ID NO: 32694 - RNA, 22 nt, Human
aagucuuucauaagucucuuau

SEQ ID NO: 32695 - RNA, 22 nt, Human
aagucuuuuugaaucuauaacu

SEQ ID NO: 32696 - RNA, 22 nt, Human
aagugaaacauguaucucuuua

SEQ ID NO: 32697 - RNA, 22 nt, Human
aagugaaucuccuuucuuuauu

SEQ ID NO: 32698 - RNA, 22 nt, Human
aagugaauggggcagacuucag

SEQ ID NO: 32699 - RNA, 22 nt, Human
aagugaauucauuguguuauau

SEQ ID NO: 32700 - RNA, 22 nt, Human
aagugacuuaaucuccucucag

SEQ ID NO: 32701 - RNA, 22 nt, Human
aagugagugaaaaugcagaaua

SEQ ID NO: 32702 - RNA, 22 nt, Human
aagugagugguaaggagcaugg

SEQ ID NO: 32703 - RNA, 22 nt, Human
aagugauacaucuagucuauaa

SEQ ID NO: 32704 - RNA, 22 nt, Human
aagugaugcuacgacuuugaca

SEQ ID NO: 32705 - RNA, 22 nt, Human
aagugauuaaccaugcucugcu

SEQ ID NO: 32706 - RNA, 22 nt, Human
aagugauuugcaugcuuaauuc

SEQ ID NO: 32707 - RNA, 22 nt, Human
aagugauuuuccuacuugcuaa

SEQ ID NO: 32708 - RNA, 22 nt, Human
aagugcaauuugaaauucugca

SEQ ID NO: 32709 - RNA, 22 nt, Human
aagugcagagagcugacgaacu

SEQ ID NO: 32710 - RNA, 22 nt, Human
aagugcuaggauuacaggugug

SEQ ID NO: 32711 - RNA, 23 nt, Human
aagugcuauguuuauaagagcug

SEQ ID NO: 32712 - RNA, 22 nt, Human
aagugcucccauauccugcccu

SEQ ID NO: 32713 - RNA, 22 nt, Human
aagugcuguacaguguguaaau

SEQ ID NO: 32714 - RNA, 22 nt, Human
aagugcuguuucugaugaaugc

SEQ ID NO: 32715 - RNA, 22 nt, Human
aagugcuugaucauaguucuca

SEQ ID NO: 32716 - RNA, 22 nt, Human
aagugcuuuaaaauuuccugag

SEQ ID NO: 32717 - RNA, 22 nt, Human
aaguggagccagggaaacugaa

SEQ ID NO: 32718 - RNA, 22 nt, Human
aaguggagcuauaggcucagau

SEQ ID NO: 32719 - RNA, 22 nt, Human
aaguggaggccgaguucacgca

SEQ ID NO: 32720 - RNA, 22 nt, Human
aaguggcacgcuuuuuggaguu

SEQ ID NO: 32721 - RNA, 22 nt, Human
aaguggcaguucaggaagcaga

SEQ ID NO: 32722 - RNA, 22 nt, Human
aaguggcauguauaagaaagaa

SEQ ID NO: 32723 - RNA, 22 nt, Human
aaguggcucauguggcuucugc

SEQ ID NO: 32724 - RNA, 22 nt, Human
aaguggcuuugagcuucugcca

SEQ ID NO: 32725 - RNA, 22 nt, Human
aaguggggccuggugguacagu

SEQ ID NO: 32726 - RNA, 22 nt, Human
aagugggucagggacagaucuu

SEQ ID NO: 32727 - RNA, 22 nt, Human
aagugguagacaaagauaauug

SEQ ID NO: 32728 - RNA, 22 nt, Human
aagugguaggaagagagcacug

SEQ ID NO: 32729 - RNA, 21 nt, Human
aagugguuuagguuaccgggg

SEQ ID NO: 32730 - RNA, 22 nt, Human
aagugguuugauucaguuuaug

SEQ ID NO: 32731 - RNA, 22 nt, Human
aaguguaaauucacagacuuca

SEQ ID NO: 32732 - RNA, 22 nt, Human
aaguguauuuuuguacuaacau

SEQ ID NO: 32733 - RNA, 22 nt, Human
aagugucaauauuuuuguaggu

SEQ ID NO: 32734 - RNA, 22 nt, Human
aagugucuacauuugcuaacca

SEQ ID NO: 32735 - RNA, 22 nt, Human
aagugucuucugauggggugug

SEQ ID NO: 32736 - RNA, 22 nt, Human
aagugugggaaguugcuaaaau

SEQ ID NO: 32737 - RNA, 22 nt, Human
aagugugucuggcggcccagug

SEQ ID NO: 32738 - RNA, 22 nt, Human
aagugugucuugggaagggagg

SEQ ID NO: 32739 - RNA, 22 nt, Human
aagugugugggcaggcaguggu

SEQ ID NO: 32740 - RNA, 22 nt, Human
aaguguguugacugaauugggg

SEQ ID NO: 32741 - RNA, 22 nt, Human
aaguguguuuucaguguacuua

SEQ ID NO: 32742 - RNA, 22 nt, Human
aaguguuuaaauuauuugcagg

SEQ ID NO: 32743 - RNA, 22 nt, Human
aaguguuuacuuaaagucaugg

SEQ ID NO: 32744 - RNA, 22 nt, Human
aaguguuuagguuugcagucga

SEQ ID NO: 32745 - RNA, 22 nt, Human
aaguguuuaugguuauuguuaa

SEQ ID NO: 32746 - RNA, 22 nt, Human
aaguguuuccauugugcaggcu

SEQ ID NO: 32747 - RNA, 22 nt, Human
aauauuucuguagcuauguucu

SEQ ID NO: 32748 - RNA, 22 nt, Human
aauauuugcaucauuagcuauu

SEQ ID NO: 32749 - RNA, 19 nt, Human
aauauuuuagccucuuccu

SEQ ID NO: 32750 - RNA, 22 nt, Human
aauauuuuaggcuuuccaggcu

SEQ ID NO: 32751 - RNA, 22 nt, Human
aaucaaagaaugggcuaguugg

SEQ ID NO: 32752 - RNA, 21 nt, Human
aaucaagaguacugguguggc

SEQ ID NO: 32753 - RNA, 22 nt, Human
aaucaagaguuguguaauauuu

SEQ ID NO: 32754 - RNA, 22 nt, Human
aaucaaguauuuuccaguggca

SEQ ID NO: 32755 - RNA, 23 nt, Human
aaucacacguuuggccaggaugc

SEQ ID NO: 32756 - RNA, 20 nt, Human
aaucacaguuaacucuuucu

SEQ ID NO: 32757 - RNA, 22 nt, Human
aaucagaaagaucuugaugaga

SEQ ID NO: 32758 - RNA, 22 nt, Human
aaucagaaaggcuaaggaagca

SEQ ID NO: 32759 - RNA, 22 nt, Human
aaucagaaauugagggucuggu

SEQ ID NO: 32760 - RNA, 22 nt, Human
aaucagagcaagacauggaaca

SEQ ID NO: 32761 - RNA, 21 nt, Human
aaucagaggcuuccuaguugg

SEQ ID NO: 32762 - RNA, 17 nt, Human
aaucagauuucugagga

SEQ ID NO: 32763 - RNA, 22 nt, Human
aaucagcaaaugcuuacucagg

SEQ ID NO: 32764 - RNA, 22 nt, Human
aaucagccauuuuuccaaggag

SEQ ID NO: 32765 - RNA, 19 nt, Human
aaucaggagccuaauuagg

SEQ ID NO: 32766 - RNA, 22 nt, Human
aaucaggaggauaagggggucc

SEQ ID NO: 32767 - RNA, 22 nt, Human
aaucaggagugugcacuuugau

SEQ ID NO: 32768 - RNA, 22 nt, Human
aaucaggaugacugucauuuca

SEQ ID NO: 32769 - RNA, 22 nt, Human
aaucagucucauuuagcaggga

SEQ ID NO: 32770 - RNA, 21 nt, Human
aaucaguguucucaggggcaa

SEQ ID NO: 32771 - RNA, 21 nt, Human
aaucauacaaaacaugucagg

SEQ ID NO: 32772 - RNA, 22 nt, Human
aaucaucacgaacacaacagcg

SEQ ID NO: 32773 - RNA, 22 nt, Human
aaucauccugaagucaauaaag

SEQ ID NO: 32774 - RNA, 22 nt, Human
aaucaugugggauagucugcuc

SEQ ID NO: 32775 - RNA, 22 nt, Human
aaucauucuuauuucacagcaa

SEQ ID NO: 32776 - RNA, 22 nt, Human
aaucauuguaaaugguuuuguu

SEQ ID NO: 32777 - RNA, 22 nt, Human
aaucauuguugucguuccuaga

SEQ ID NO: 32778 - RNA, 22 nt, Human
aauccacggcaacacugggccc

SEQ ID NO: 32779 - RNA, 22 nt, Human
aauccacuuugugccccucucu

SEQ ID NO: 32780 - RNA, 22 nt, Human
aauccagcugugucacagguga

SEQ ID NO: 32781 - RNA, 22 nt, Human
aauccagguggcggagguugug

SEQ ID NO: 32782 - RNA, 22 nt, Human
aauccaugcaugcaaggaaagg

SEQ ID NO: 32783 - RNA, 22 nt, Human
aaucccauuguggaauuaagga

SEQ ID NO: 32784 - RNA, 22 nt, Human
aaucccuccccaggcaaguccu

SEQ ID NO: 32785 - RNA, 22 nt, Human
aauccgauucguguacauuaau

SEQ ID NO: 32786 - RNA, 22 nt, Human
aauccugaccugggcaugcuug

SEQ ID NO: 32787 - RNA, 22 nt, Human
aauccuuacugaaugagaaaaa

SEQ ID NO: 32788 - RNA, 22 nt, Human
aaguucaaggcagguccugagg

SEQ ID NO: 32789 - RNA, 22 nt, Human
aaguucaaggcucuagaguucc

SEQ ID NO: 32790 - RNA, 22 nt, Human
aaguucaaguaguguuacaugg

SEQ ID NO: 32791 - RNA, 23 nt, Human
aaguucaagucacagccugucuu

SEQ ID NO: 32792 - RNA, 22 nt, Human
aaguucaaucagaugaaaaagc

SEQ ID NO: 32793 - RNA, 22 nt, Human
aaguucaauggaaaagcuuuag

SEQ ID NO: 32794 - RNA, 22 nt, Human
aaguuccuugaaugaagcuagg

SEQ ID NO: 32795 - RNA, 22 nt, Human
aaguucuacuguggguaaaaug

SEQ ID NO: 32796 - RNA, 22 nt, Human
aaguucuauaucugccucacca

SEQ ID NO: 32797 - RNA, 19 nt, Human
aaguucucagaguucaaag

SEQ ID NO: 32798 - RNA, 22 nt, Human
aaguucuuagacaagcuugugg

SEQ ID NO: 32799 - RNA, 22 nt, Human
aaguucuugcugugugucagau

SEQ ID NO: 32800 - RNA, 22 nt, Human
aaguucuuguauuugccuuucu

SEQ ID NO: 32801 - RNA, 22 nt, Human
aaguucuuucauaucuuaauua

SEQ ID NO: 32802 - RNA, 22 nt, Human
aaguucuuugccagacacgugu

SEQ ID NO: 32803 - RNA, 22 nt, Human
aaguugaaucaguaacacaguu

SEQ ID NO: 32804 - RNA, 22 nt, Human
aaguugaaugcguacgugacau

SEQ ID NO: 32805 - RNA, 22 nt, Human
aaguugagaugucauaggagac

SEQ ID NO: 32806 - RNA, 22 nt, Human
aaguugauuaaucuuucgagaa

SEQ ID NO: 32807 - RNA, 22 nt, Human
aaguugcuaaugauguguuugc

SEQ ID NO: 32808 - RNA, 22 nt, Human
aaguugcuagugcuuuucugag

SEQ ID NO: 32809 - RNA, 22 nt, Human
aaguuggaaucuggaacugauc

SEQ ID NO: 32810 - RNA, 22 nt, Human
aaguugguaggagacagaaggu

SEQ ID NO: 32811 - RNA, 22 nt, Human
aaguugguguaugagacagaag

SEQ ID NO: 32812 - RNA, 22 nt, Human
aaguuguaacagaaauuuaaug

SEQ ID NO: 32813 - RNA, 22 nt, Human
aaguuguagucagaugucaguu

SEQ ID NO: 32814 - RNA, 22 nt, Human
aaguuguauauaccgcuuuaag

SEQ ID NO: 32815 - RNA, 22 nt, Human
aaguuguaugucuuagaaagua

SEQ ID NO: 32816 - RNA, 23 nt, Human
aaguuguuuuuggccagggaaag

SEQ ID NO: 32817 - RNA, 22 nt, Human
aaguuuaacuugaauucuuucu

SEQ ID NO: 32818 - RNA, 22 nt, Human
aaguuuacuggggagaucaccu

SEQ ID NO: 32819 - RNA, 22 nt, Human
aaguuuagggaagucugagcgc

SEQ ID NO: 32820 - RNA, 22 nt, Human
aaguuuaguagggacagaugga

SEQ ID NO: 32821 - RNA, 22 nt, Human
aaguuuagucuugucuuaguaa

SEQ ID NO: 32822 - RNA, 22 nt, Human
aaguuuaguuaaguaaacucuu

SEQ ID NO: 32823 - RNA, 22 nt, Human
aaguuuaucccucucacaguua

SEQ ID NO: 32824 - RNA, 22 nt, Human
aaguuuaugaagucuaagccaa

SEQ ID NO: 32825 - RNA, 22 nt, Human
aaguuuauguucuuugaaggca

SEQ ID NO: 32826 - RNA, 22 nt, Human
aaguuuauguugguaagauauc

SEQ ID NO: 32827 - RNA, 22 nt, Human
aaguuucaaauauaaaauuaca

SEQ ID NO: 32828 - RNA, 22 nt, Human
aaguuucaagagguucuuugaa

SEQ ID NO: 32829 - RNA, 22 nt, Human
aaguuucauguggagguagacu

SEQ ID NO: 32830 - RNA, 22 nt, Human
aaguuucugccauacuguggug

SEQ ID NO: 32831 - RNA, 22 nt, Human
aaguuucuguucauaucucuga

SEQ ID NO: 32832 - RNA, 22 nt, Human
aaguuucuguucgcuuuaauaa

SEQ ID NO: 32833 - RNA, 22 nt, Human
aaguuugacagaaguuucuaau

SEQ ID NO: 32834 - RNA, 22 nt, Human
aaguuugcauagauuaagcauu

SEQ ID NO: 32835 - RNA, 22 nt, Human
aaguuugucucauuugaucuuc

SEQ ID NO: 32836 - RNA, 22 nt, Human
aaguuugugagguuaaucccuu

SEQ ID NO: 32837 - RNA, 22 nt, Human
aaguuuguggucauuuauuaua

SEQ ID NO: 32838 - RNA, 22 nt, Human
aaguuugugguuauacuugauu

SEQ ID NO: 32839 - RNA, 22 nt, Human
aaguuuuaacaaguacuuacua

SEQ ID NO: 32840 - RNA, 22 nt, Human
aaguuuuacugaggacacaugu

SEQ ID NO: 32841 - RNA, 22 nt, Human
aaguuuuaugggaagaugugca

SEQ ID NO: 32842 - RNA, 22 nt, Human
aaguuuuugauucuaagagaga

SEQ ID NO: 32843 - RNA, 20 nt, Human
aauaaaagaagccuucaccc

SEQ ID NO: 32844 - RNA, 22 nt, Human
aauaaaaugaacugguagaguu

SEQ ID NO: 32845 - RNA, 22 nt, Human
aauaaaauggucaguuuucuca

SEQ ID NO: 32846 - RNA, 22 nt, Human
aauaaacaaauccuuccuuccc

SEQ ID NO: 32847 - RNA, 22 nt, Human
aauaaagcaggguccuugcacu

SEQ ID NO: 32848 - RNA, 22 nt, Human
aauaaagcaugaggcauuuauc

SEQ ID NO: 32849 - RNA, 22 nt, Human
aauaaagccugucucuuuagag

SEQ ID NO: 32850 - RNA, 22 nt, Human
aauaaaucaauccuauugguag

SEQ ID NO: 32851 - RNA, 22 nt, Human
aauaacagagucuucaagauag

SEQ ID NO: 32852 - RNA, 22 nt, Human
aauaacaggcucaucagaugcu

SEQ ID NO: 32853 - RNA, 22 nt, Human
aauaacagugccaugaaauuga

SEQ ID NO: 32854 - RNA, 21 nt, Human
aauaaccacuaauauaguggc

SEQ ID NO: 32855 - RNA, 22 nt, Human
aauaacuggcacauaucacaua

SEQ ID NO: 32856 - RNA, 21 nt, Human
acaaugcauggaacucauggc

SEQ ID NO: 32857 - RNA, 21 nt, Human
acaaugucaaggucagacauu

SEQ ID NO: 32858 - RNA, 22 nt, Human
acaaugucugcuauuuggcucu

SEQ ID NO: 32859 - RNA, 22 nt, Human
acaaugucuuugucuccuucag

SEQ ID NO: 32860 - RNA, 22 nt, Human
acaauguguuuuuauacauuug

SEQ ID NO: 32861 - RNA, 22 nt, Human
acaauguuucucuuuagucauu

SEQ ID NO: 32862 - RNA, 22 nt, Human
acaauucauuaaugugagguag

SEQ ID NO: 32863 - RNA, 22 nt, Human
acaauuccacauggcaugcagg

SEQ ID NO: 32864 - RNA, 22 nt, Human
acaauuccugagaauacuuguu

SEQ ID NO: 32865 - RNA, 22 nt, Human
acaauuucaccuuuugguucaa

SEQ ID NO: 32866 - RNA, 22 nt, Human
acaauuucuaauauagaucuua

SEQ ID NO: 32867 - RNA, 22 nt, Human
acacaaaaucaaaguccuaggc

SEQ ID NO: 32868 - RNA, 22 nt, Human
acacaaacagucuauagcacca

SEQ ID NO: 32869 - RNA, 22 nt, Human
acacaaacugcuagaaaauugg

SEQ ID NO: 32870 - RNA, 22 nt, Human
acacaaauuguaggauaauugc

SEQ ID NO: 32871 - RNA, 22 nt, Human
acacaagaauaaugaugaaggu

SEQ ID NO: 32872 - RNA, 22 nt, Human
acacaagauuguguauugaauu

SEQ ID NO: 32873 - RNA, 20 nt, Human
acacaagcacuucugguauu

SEQ ID NO: 32874 - RNA, 22 nt, Human
acacaaguucuaaagauugcgc

SEQ ID NO: 32875 - RNA, 22 nt, Human
acacaaugcauauuuuuccaga

SEQ ID NO: 32876 - RNA, 22 nt, Human
acacacaaaucuauuagugaau

SEQ ID NO: 32877 - RNA, 22 nt, Human
acacacaacucauuguguaaua

SEQ ID NO: 32878 - RNA, 22 nt, Human
acacacaauuaguuuuaugcuu

SEQ ID NO: 32879 - RNA, 22 nt, Human
acacacacaagcagguugugga

SEQ ID NO: 32880 - RNA, 22 nt, Human
acacacagaguuuauacaggca

SEQ ID NO: 32881 - RNA, 22 nt, Human
acacacagcgccuaccaugugc

SEQ ID NO: 32882 - RNA, 22 nt, Human
acacacaugcaugcuugccauu

SEQ ID NO: 32883 - RNA, 22 nt, Human
acacacaugccuuuccuaagua

SEQ ID NO: 32884 - RNA, 22 nt, Human
acacacaugguauuguucagaa

SEQ ID NO: 32885 - RNA, 22 nt, Human
acacacucaauugcauaagcac

SEQ ID NO: 32886 - RNA, 22 nt, Human
acacacuggagguaaauggggu

SEQ ID NO: 32887 - RNA, 20 nt, Human
acacacuuugaucuugagcc

SEQ ID NO: 32888 - RNA, 22 nt, Human
acacacuuuugcuaaaaauugu

SEQ ID NO: 32889 - RNA, 20 nt, Human
acacagacucagcuuggaug

SEQ ID NO: 32890 - RNA, 22 nt, Human
acacagagauguaaaguuaggc

SEQ ID NO: 32891 - RNA, 22 nt, Human
acacagagcaaaucaugacaga

SEQ ID NO: 32892 - RNA, 22 nt, Human
acacagagccagggaauacagu

SEQ ID NO: 32893 - RNA, 22 nt, Human
acacagagguggccacucuuuu

SEQ ID NO: 32894 - RNA, 22 nt, Human
acacagauauuuugaauacaua

SEQ ID NO: 32895 - RNA, 22 nt, Human
acacagaugcauuacacaucua

SEQ ID NO: 32896 - RNA, 22 nt, Human
acacagcaaggucugacuuugg

SEQ ID NO: 32897 - RNA, 21 nt, Human
acacagcugccggagacggau

SEQ ID NO: 32898 - RNA, 22 nt, Human
acacagcugugcaguuuuuuca

SEQ ID NO: 32899 - RNA, 22 nt, Human
acacaggacggcccuguggcuu

SEQ ID NO: 32900 - RNA, 22 nt, Human
acacaggagauauguaauggcu

SEQ ID NO: 32901 - RNA, 19 nt, Human
acacagggcuagaguuaca

SEQ ID NO: 32902 - RNA, 22 nt, Human
acacagggucuagaguuaggcc

SEQ ID NO: 32903 - RNA, 22 nt, Human
acacagguacacauauguaccu

SEQ ID NO: 32904 - RNA, 22 nt, Human
acacaguaaauauugucuccuc

SEQ ID NO: 32905 - RNA, 17 nt, Human
acacaguacuuuuuugc

SEQ ID NO: 32906 - RNA, 22 nt, Human
acacaguaugacauuggcagag

SEQ ID NO: 32907 - RNA, 22 nt, Human
acacaguauuacaauaggugcu

SEQ ID NO: 32908 - RNA, 22 nt, Human
acacaguggugagucuggaccu

SEQ ID NO: 32909 - RNA, 22 nt, Human
acacagugguguuuacaaaauu

SEQ ID NO: 32910 - RNA, 22 nt, Human
acacagugucuuagguaguguc

SEQ ID NO: 32911 - RNA, 22 nt, Human
acacauaagaaacuacaaagag

SEQ ID NO: 32912 - RNA, 22 nt, Human
acacauaagccuaaucaucucc

SEQ ID NO: 32913 - RNA, 22 nt, Human
acacauauaugucgaaguccuc

SEQ ID NO: 32914 - RNA, 22 nt, Human
acacauaucuaagauagaugac

SEQ ID NO: 32915 - RNA, 22 nt, Human
acacauaugcagaucccccaca

SEQ ID NO: 32916 - RNA, 22 nt, Human
acacauaugccauuacagcaaa

SEQ ID NO: 32917 - RNA, 22 nt, Human
acacauaugguugguaggaguu

SEQ ID NO: 32918 - RNA, 22 nt, Human
acacauauguaugcaucaugug

SEQ ID NO: 32919 - RNA, 22 nt, Human
acacauauguggcaacuguaga

SEQ ID NO: 32920 - RNA, 22 nt, Human
acacaucagaaauaugaaugag

SEQ ID NO: 32921 - RNA, 22 nt, Human
acacaucaugccaaguuucacc

SEQ ID NO: 32922 - RNA, 22 nt, Human
acacaucuaucucuacacaagg

SEQ ID NO: 32923 - RNA, 22 nt, Human
acacaucuccagccagcaggag

SEQ ID NO: 32924 - RNA, 19 nt, Human
acacaugaggagggacccc

SEQ ID NO: 32925 - RNA, 22 nt, Human
acacaugaguucucaucuugug

SEQ ID NO: 32926 - RNA, 22 nt, Human
acacaugauuaaugccaagcau

SEQ ID NO: 32927 - RNA, 22 nt, Human
acacaugcacaacaguucuuuc

SEQ ID NO: 32928 - RNA, 22 nt, Human
acacaugcauaagccuucccuu

SEQ ID NO: 32929 - RNA, 20 nt, Human
acacaugcauagagagagag

SEQ ID NO: 32930 - RNA, 20 nt, Human
acacaugcauucaugugggc

SEQ ID NO: 32931 - RNA, 22 nt, Human
acacaugcgauagagagguagg

SEQ ID NO: 32932 - RNA, 22 nt, Human
acacauguaaaacacuuagcaa

SEQ ID NO: 32933 - RNA, 22 nt, Human
acacauguuuacagucuucagu

SEQ ID NO: 32934 - RNA, 22 nt, Human
acacauguuuccaaaagcaccc

SEQ ID NO: 32935 - RNA, 22 nt, Human
acacauuaaaacgucuacaaug

SEQ ID NO: 32936 - RNA, 22 nt, Human
aaugcuuccaaaauaccaagcc

SEQ ID NO: 32937 - RNA, 22 nt, Human
aaugcuuucucagaguccuuca

SEQ ID NO: 32938 - RNA, 22 nt, Human
aaugcuuugucugcuccagacu

SEQ ID NO: 32939 - RNA, 18 nt, Human
aauggaaggggugcuguu

SEQ ID NO: 32940 - RNA, 21 nt, Human
aauggaaguuuaaagguaucc

SEQ ID NO: 32941 - RNA, 22 nt, Human
aauggagaggcugugagugaga

SEQ ID NO: 32942 - RNA, 22 nt, Human
aauggcaaaaggauaacaagga

SEQ ID NO: 32943 - RNA, 22 nt, Human
aauggcaacaugguauagugag

SEQ ID NO: 32944 - RNA, 22 nt, Human
aauggcaagagccacagaggcg

SEQ ID NO: 32945 - RNA, 22 nt, Human
aauggcaagcugaacucagaag

SEQ ID NO: 32946 - RNA, 22 nt, Human
aauggcaaggaaaccguuacca

SEQ ID NO: 32947 - RNA, 22 nt, Human
aauggcagaaugggccagaagc

SEQ ID NO: 32948 - RNA, 22 nt, Human
aauggccagcugggagaguuga

SEQ ID NO: 32949 - RNA, 22 nt, Human
aauggccuuugagaugaaaggg

SEQ ID NO: 32950 - RNA, 21 nt, Human
aauggcugggcaaggucucuc

SEQ ID NO: 32951 - RNA, 22 nt, Human
aauggcuggguuucauuuugua

SEQ ID NO: 32952 - RNA, 22 nt, Human
aauggcuucuuuuugguauaau

SEQ ID NO: 32953 - RNA, 22 nt, Human
aauggcuugcaaauggguccau

SEQ ID NO: 32954 - RNA, 22 nt, Human
aauggcuuucagcaaggauaga

SEQ ID NO: 32955 - RNA, 22 nt, Human
aauggcuuuggucuggguccca

SEQ ID NO: 32956 - RNA, 22 nt, Human
aauggcuuuugcacuuaaaucg

SEQ ID NO: 32957 - RNA, 22 nt, Human
aaugggagagaacacaaagucc

SEQ ID NO: 32958 - RNA, 22 nt, Human
aaugggagguaguaugggaggu

SEQ ID NO: 32959 - RNA, 22 nt, Human
aaugggauaauuguucauggga

SEQ ID NO: 32960 - RNA, 22 nt, Human
aaugggauaggucuucaggaau

SEQ ID NO: 32961 - RNA, 22 nt, Human
aaugguaauauuucauaguugu

SEQ ID NO: 32962 - RNA, 22 nt, Human
aaugguaauuugcagaaagucc

SEQ ID NO: 32963 - RNA, 22 nt, Human
aauggucaaaaagauacguaaa

SEQ ID NO: 32964 - RNA, 22 nt, Human
aauggucacuauguaaggugau

SEQ ID NO: 32965 - RNA, 18 nt, Human
acacacacaccuguguau

SEQ ID NO: 32966 - RNA, 22 nt, Human
acacacagaaggaagccccacu

SEQ ID NO: 32967 - RNA, 22 nt, Human
acacacagguaaaggagccugg

SEQ ID NO: 32968 - RNA, 22 nt, Human
acacacgugcucaacacgcucc

SEQ ID NO: 32969 - RNA, 21 nt, Human
acacacuacacauuccuaguu

SEQ ID NO: 32970 - RNA, 21 nt, Human
acacacucugagucuucuauu

SEQ ID NO: 32971 - RNA, 22 nt, Human
acacacuguaaggacuaucacu

SEQ ID NO: 32972 - RNA, 22 nt, Human
acacacuucacccuugagcuaa

SEQ ID NO: 32973 - RNA, 22 nt, Human
acacacuucagauguaauuugu

SEQ ID NO: 32974 - RNA, 22 nt, Human
acacacuugcagagaggaggga

SEQ ID NO: 32975 - RNA, 22 nt, Human
acacacuuuaaauuaaaccucu

SEQ ID NO: 32976 - RNA, 17 nt, Human
acacagacaggcagaca

SEQ ID NO: 32977 - RNA, 22 nt, Human
acacagaggaaagugugaaggg

SEQ ID NO: 32978 - RNA, 21 nt, Human
acacagaggcaucaucacuuu

SEQ ID NO: 32979 - RNA, 22 nt, Human
acacagagggcagaagauacau

SEQ ID NO: 32980 - RNA, 20 nt, Human
acacagagugagucugcuug

SEQ ID NO: 32981 - RNA, 22 nt, Human
acacagauaaugcucauauagg

SEQ ID NO: 32982 - RNA, 22 nt, Human
acacagauauuguacuugaucc

SEQ ID NO: 32983 - RNA, 22 nt, Human
acacagauuucacuggaauaga

SEQ ID NO: 32984 - RNA, 22 nt, Human
acacagcaacuugcaguaugga

SEQ ID NO: 32985 - RNA, 22 nt, Human
acacagccgugaaucugcuucu

SEQ ID NO: 32986 - RNA, 22 nt, Human
acacagcuagugaguggcagag

SEQ ID NO: 32987 - RNA, 22 nt, Human
acacagcuaugggguaggaaac

SEQ ID NO: 32988 - RNA, 22 nt, Human
acacagcuuucagucauuaucu

SEQ ID NO: 32989 - RNA, 22 nt, Human
acacaggaaaugguuuaguuuu

SEQ ID NO: 32990 - RNA, 22 nt, Human
acacaggaacucaagcucgcuu

SEQ ID NO: 32991 - RNA, 22 nt, Human
acacaggaacucugagaggugg

SEQ ID NO: 32992 - RNA, 22 nt, Human
acacaggacagggauguguuuu

SEQ ID NO: 32993 - RNA, 18 nt, Human
acacaggcugacagcacc

SEQ ID NO: 32994 - RNA, 17 nt, Human
acacagggagagggagc

SEQ ID NO: 32995 - RNA, 22 nt, Human
acacagggauauuucagguggu

SEQ ID NO: 32996 - RNA, 22 nt, Human
acacagggcaaugcuuugaccu

SEQ ID NO: 32997 - RNA, 22 nt, Human
acacagggcugcgccugacccc

SEQ ID NO: 32998 - RNA, 22 nt, Human
acacagguuaaaauaauuggga

SEQ ID NO: 32999 - RNA, 22 nt, Human
acacagguuccaucuccaccuu

SEQ ID NO: 33000 - RNA, 21 nt, Human
acacaguaacugggcgcaggg

SEQ ID NO: 33001 - RNA, 20 nt, Human
acacaguagaugagugacug

SEQ ID NO: 33002 - RNA, 22 nt, Human
acacaguaucaaauuucaucuu

SEQ ID NO: 33003 - RNA, 22 nt, Human
acacaguaugcaucuagaaauu

SEQ ID NO: 33004 - RNA, 22 nt, Human
acacaguucuuagcaggugucu

SEQ ID NO: 33005 - RNA, 22 nt, Human
acacaguucuuucacuguuggu

SEQ ID NO: 33006 - RNA, 22 nt, Human
acacaguuuaugguauucuguu

SEQ ID NO: 33007 - RNA, 22 nt, Human
acacauacauggggaagaugag

SEQ ID NO: 33008 - RNA, 20 nt, Human
acacauagauaagaagcuga

SEQ ID NO: 33009 - RNA, 20 nt, Human
acacauauagcagcauaaac

SEQ ID NO: 33010 - RNA, 22 nt, Human
acacauauauacauauuugugc

SEQ ID NO: 33011 - RNA, 22 nt, Human
acacauaugucauugaaaaauc

SEQ ID NO: 33012 - RNA, 22 nt, Human
acacaucagccucagcuuuggg

SEQ ID NO: 33013 - RNA, 22 nt, Human
acacaucucaggggacacucuc

SEQ ID NO: 33014 - RNA, 22 nt, Human
acacaucuuagacugaaauaug

SEQ ID NO: 33015 - RNA, 22 nt, Human
acacaugaaucacugguggaag

SEQ ID NO: 33016 - RNA, 22 nt, Human
acacaugugauucuaagacagc

SEQ ID NO: 33017 - RNA, 20 nt, Human
acacaugugcguguucagua

SEQ ID NO: 33018 - RNA, 22 nt, Human
acacaugugucugcaugcagug

SEQ ID NO: 33019 - RNA, 22 nt, Human
acacauguucaagaauguucag

SEQ ID NO: 33020 - RNA, 22 nt, Human
acacauguuuguguagucaguu

SEQ ID NO: 33021 - RNA, 22 nt, Human
acacauuaugagcaguugucuu

SEQ ID NO: 33022 - RNA, 22 nt, Human
acacauuccugcagacaugaug

SEQ ID NO: 33023 - RNA, 22 nt, Human
acacauugcagacaucucauua

SEQ ID NO: 33024 - RNA, 22 nt, Human
acacauuuauuacaugcaugug

SEQ ID NO: 33025 - RNA, 22 nt, Human
acacauuucucccagucuccau

SEQ ID NO: 33026 - RNA, 22 nt, Human
acacauuucucuuuuuguaagu

SEQ ID NO: 33027 - RNA, 22 nt, Human
acacauuuucaacacugucaag

SEQ ID NO: 33028 - RNA, 22 nt, Human
acaccaaaguagaauuaaugua

SEQ ID NO: 33029 - RNA, 22 nt, Human
acaccacaaguaacucuuuucc

SEQ ID NO: 33030 - RNA, 22 nt, Human
acaccagggauaugaggaagga

SEQ ID NO: 33031 - RNA, 22 nt, Human
acaccauacucauguugguucc

SEQ ID NO: 33032 - RNA, 22 nt, Human
acacccagagcgccagugccga

SEQ ID NO: 33033 - RNA, 22 nt, Human
acacccagauuaugcacacaaa

SEQ ID NO: 33034 - RNA, 22 nt, Human
acacccuuguccauagcagaug

SEQ ID NO: 33035 - RNA, 22 nt, Human
acaccuuugccccaagucauag

SEQ ID NO: 33036 - RNA, 22 nt, Human
acaccuuuuauucgccaggcac

SEQ ID NO: 33037 - RNA, 22 nt, Human
acacggaaucccuuuugugaca

SEQ ID NO: 33038 - RNA, 22 nt, Human
acacgguggccagcaguaggug

SEQ ID NO: 33039 - RNA, 23 nt, Human
acacguguguguacauagauagu

SEQ ID NO: 33040 - RNA, 22 nt, Human
acacuaaaugagucuacaguac

SEQ ID NO: 33041 - RNA, 23 nt, Human
acacuaaaugugaaggagcaaag

SEQ ID NO: 33042 - RNA, 22 nt, Human
acacuaagguuggagucacagu

SEQ ID NO: 33043 - RNA, 22 nt, Human
acacuaguagaauaguguuugc

SEQ ID NO: 33044 - RNA, 22 nt, Human
acacuauacuuccauugcuggu

SEQ ID NO: 33045 - RNA, 22 nt, Human
acacucacccucccacugccug

SEQ ID NO: 33046 - RNA, 22 nt, Human
acacucaguaaacgacaauggg

SEQ ID NO: 33047 - RNA, 22 nt, Human
acacucuacagagcaaucuacc

SEQ ID NO: 33048 - RNA, 22 nt, Human
acacucugcucugagcuucagg

SEQ ID NO: 33049 - RNA, 22 nt, Human
acacucugugaggcauguaaug

SEQ ID NO: 33050 - RNA, 22 nt, Human
acacucuuucacuaccuuaauu

SEQ ID NO: 33051 - RNA, 22 nt, Human
acacucuuuuugugguugucua

SEQ ID NO: 33052 - RNA, 22 nt, Human
acacugaagagcacuuucaaag

SEQ ID NO: 33053 - RNA, 22 nt, Human
acacugacugggcaguauaguc

SEQ ID NO: 33054 - RNA, 19 nt, Human
acacugaucagaucagcag

SEQ ID NO: 33055 - RNA, 22 nt, Human
acagagcugggugcccccugga

SEQ ID NO: 33056 - RNA, 22 nt, Human
acagaggaagcauauagcacaa

SEQ ID NO: 33057 - RNA, 22 nt, Human
acagaggacaacuaggcgcuca

SEQ ID NO: 33058 - RNA, 22 nt, Human
acagaggccgccucucucacgg

SEQ ID NO: 33059 - RNA, 22 nt, Human
acagaggccucguagguacaac

SEQ ID NO: 33060 - RNA, 22 nt, Human
acagaggggucacagccugaag

SEQ ID NO: 33061 - RNA, 22 nt, Human
acagagggucugggcacaggac

SEQ ID NO: 33062 - RNA, 22 nt, Human
acagaggguuucuaaggauuug

SEQ ID NO: 33063 - RNA, 22 nt, Human
acagaggucaccuuuguaucuu

SEQ ID NO: 33064 - RNA, 22 nt, Human
acagagguggaccucagcaggc

SEQ ID NO: 33065 - RNA, 22 nt, Human
acagagguguguguaggacagu

SEQ ID NO: 33066 - RNA, 23 nt, Human
acagaguacagugugcuuagugg

SEQ ID NO: 33067 - RNA, 22 nt, Human
acagaguacauucagagacuau

SEQ ID NO: 33068 - RNA, 22 nt, Human
acagaguaggugcucaguaaau

SEQ ID NO: 33069 - RNA, 22 nt, Human
acagaguaucuaucaggaguau

SEQ ID NO: 33070 - RNA, 22 nt, Human
acagagucaugguagucaaagg

SEQ ID NO: 33071 - RNA, 19 nt, Human
acagaguccagaggaaagg

SEQ ID NO: 33072 - RNA, 22 nt, Human
acagagucugacagguaggcgc

SEQ ID NO: 33073 - RNA, 22 nt, Human
acagagucuuacguggugauaa

SEQ ID NO: 33074 - RNA, 22 nt, Human
uguaagaaucagucuuuaaugu

SEQ ID NO: 33075 - RNA, 22 nt, Human
uguaagauauucagcuuauuga

SEQ ID NO: 33076 - RNA, 22 nt, Human
uguaaggacaacaggagaaaaa

SEQ ID NO: 33077 - RNA, 22 nt, Human
uguaaggagugugaguuugagu

SEQ ID NO: 33078 - RNA, 21 nt, Human
uguaaguuucaucugaauugg

SEQ ID NO: 33079 - RNA, 22 nt, Human
uguaaugagucacuuaccuuaa

SEQ ID NO: 33080 - RNA, 22 nt, Human
uguaauuaaacugaagacagaa

SEQ ID NO: 33081 - RNA, 22 nt, Human
uguguauagaugcaugcauaua

SEQ ID NO: 33082 - RNA, 22 nt, Human
uguguauauauguuuaagucau

SEQ ID NO: 33083 - RNA, 20 nt, Human
uguguaugugcacaugcgaa

SEQ ID NO: 33084 - RNA, 22 nt, Human
uguguauuaccauuuuacagcu

SEQ ID NO: 33085 - RNA, 22 nt, Human
uguguauucugagguagguaua

SEQ ID NO: 33086 - RNA, 22 nt, Human
uguguauuucuggaacagacua

SEQ ID NO: 33087 - RNA, 22 nt, Human
ugugucaaagucaggugucacu

SEQ ID NO: 33088 - RNA, 22 nt, Human
ugugucaaaguguggaguauuu

SEQ ID NO: 33089 - RNA, 22 nt, Human
ugugucaaguggaauuucaggg

SEQ ID NO: 33090 - RNA, 22 nt, Human
ugugucaauuuucauuccuacu

SEQ ID NO: 33091 - RNA, 22 nt, Human
ugugucagagguagagauggca

SEQ ID NO: 33092 - RNA, 19 nt, Human
ugugucagcagggggcuuc

SEQ ID NO: 33093 - RNA, 20 nt, Human
ugugucaggcccugauuaaa

SEQ ID NO: 33094 - RNA, 22 nt, Human
ugugucauagagagcacaaauc

SEQ ID NO: 33095 - RNA, 22 nt, Human
uguguccacugaauguguauua

SEQ ID NO: 33096 - RNA, 19 nt, Human
uguguccuagcagccaguc

SEQ ID NO: 33097 - RNA, 22 nt, Human
uguguccucagggaagcagaga

SEQ ID NO: 33098 - RNA, 22 nt, Human
uguguccucuuaccucugaccc

SEQ ID NO: 33099 - RNA, 22 nt, Human
uguguccugugcaaggggauga

SEQ ID NO: 33100 - RNA, 22 nt, Human
uguguccuuucuuaagagugag

SEQ ID NO: 33101 - RNA, 22 nt, Human
uguguccuuuggaggaucagcg

SEQ ID NO: 33102 - RNA, 22 nt, Human
ugugucucauuuccuccugcug

SEQ ID NO: 33103 - RNA, 22 nt, Human
ugugucuccauagccagcuagc

SEQ ID NO: 33104 - RNA, 22 nt, Human
ugugucucuccuggaagcacgu

SEQ ID NO: 33105 - RNA, 22 nt, Human
ugugucucuuuguccuagagcu

SEQ ID NO: 33106 - RNA, 22 nt, Human
ugugucugaacaugcuuuguaa

SEQ ID NO: 33107 - RNA, 22 nt, Human
ugugucugaacuaguugcucuc

SEQ ID NO: 33108 - RNA, 23 nt, Human
ugugucuguuuagggaggaugug

SEQ ID NO: 33109 - RNA, 22 nt, Human
ugugucuuuggcgaugucugga

SEQ ID NO: 33110 - RNA, 20 nt, Human
ugugugaacacggacucugu

SEQ ID NO: 33111 - RNA, 22 nt, Human
ugugugaacauguuuucauuuc

SEQ ID NO: 33112 - RNA, 22 nt, Human
ugugugaagugauuuuaagucu

SEQ ID NO: 33113 - RNA, 22 nt, Human
ugugugaaucuauugaauauau

SEQ ID NO: 33114 - RNA, 22 nt, Human
ugugugaauucugagcaguuua

SEQ ID NO: 33115 - RNA, 22 nt, Human
ugugugacccccagugaagccu

SEQ ID NO: 33116 - RNA, 22 nt, Human
ugugugaggacucagugaaaca

SEQ ID NO: 33117 - RNA, 22 nt, Human
ugugugaggauuccugguucuu

SEQ ID NO: 33118 - RNA, 22 nt, Human
ugugugaguaaggcugagagag

SEQ ID NO: 33119 - RNA, 22 nt, Human
ugugugauugcaggagaugugg

SEQ ID NO: 33120 - RNA, 19 nt, Human
ugugugcaaauggaagcca

SEQ ID NO: 33121 - RNA, 22 nt, Human
ugugugcacaaagaguacaugg

SEQ ID NO: 33122 - RNA, 22 nt, Human
ugugugcacaggaguguuugaa

SEQ ID NO: 33123 - RNA, 22 nt, Human
ugugugcagacagauauuacuu

SEQ ID NO: 33124 - RNA, 21 nt, Human
ugugugcauaugcauguacau

SEQ ID NO: 33125 - RNA, 20 nt, Human
ugugugcaucuguauguauu

SEQ ID NO: 33126 - RNA, 22 nt, Human
ugugugccagauacaagcacug

SEQ ID NO: 33127 - RNA, 22 nt, Human
ugugugccccagaugaguagcu

SEQ ID NO: 33128 - RNA, 22 nt, Human
ugugugccugagccgugccugg

SEQ ID NO: 33129 - RNA, 22 nt, Human
ugugugcucgauggcccugcag

SEQ ID NO: 33130 - RNA, 22 nt, Human
uguguggauucaucucaaagag

SEQ ID NO: 33131 - RNA, 22 nt, Human
ugugugggagcacgggcuguug

SEQ ID NO: 33132 - RNA, 22 nt, Human
ugugugggugguaaggaaggcc

SEQ ID NO: 33133 - RNA, 22 nt, Human
uguguguaaggaagcuuuaugg

SEQ ID NO: 33134 - RNA, 22 nt, Human
uguguguacucuccaguccuga

SEQ ID NO: 33135 - RNA, 22 nt, Human
uguguguauaauaaugucugca

SEQ ID NO: 33136 - RNA, 19 nt, Human
uguguguauuucaguucuu

SEQ ID NO: 33137 - RNA, 22 nt, Human
ugugugucagucuuguuuaggg

SEQ ID NO: 33138 - RNA, 22 nt, Human
ugugugucauuuaggguggagc

SEQ ID NO: 33139 - RNA, 22 nt, Human
ugugugucugcacauguauaau

SEQ ID NO: 33140 - RNA, 22 nt, Human
ugugugugcacaugcauauaca

SEQ ID NO: 33141 - RNA, 22 nt, Human
ugugugugcacgugcgcgcgag

SEQ ID NO: 33142 - RNA, 22 nt, Human
uguguguguccucauuugcaga

SEQ ID NO: 33143 - RNA, 22 nt, Human
uguguguucucaauuauugaug

SEQ ID NO: 33144 - RNA, 22 nt, Human
uguguuaaggcacugauaucug

SEQ ID NO: 33145 - RNA, 22 nt, Human
uguguuaaggugcaucuagugc

SEQ ID NO: 33146 - RNA, 22 nt, Human
uguguuaauuuauugccucaga

SEQ ID NO: 33147 - RNA, 19 nt, Human
uguguucaaacuccaucuc

SEQ ID NO: 33148 - RNA, 22 nt, Human
uguguucagcaggcaccuucuu

SEQ ID NO: 33149 - RNA, 22 nt, Human
uguguucaucuuuaaagggaag

SEQ ID NO: 33150 - RNA, 22 nt, Human
uguguucauguauguauacaua

SEQ ID NO: 33151 - RNA, 22 nt, Human
uguguucauguugauucauagc

SEQ ID NO: 33152 - RNA, 22 nt, Human
uguguuccuucgucuucccuuc

SEQ ID NO: 33153 - RNA, 22 nt, Human
uguguucugaaggagaagagug

SEQ ID NO: 33154 - RNA, 22 nt, Human
uguguucuggcugugacagcug

SEQ ID NO: 33155 - RNA, 21 nt, Human
uguguucuucuaggucagcua

SEQ ID NO: 33156 - RNA, 22 nt, Human
uguguuuacuucuaugcaguuu

SEQ ID NO: 33157 - RNA, 22 nt, Human
uguguuucagaaccuucuuuca

SEQ ID NO: 33158 - RNA, 22 nt, Human
uguguuuuaaauggaaauuuga

SEQ ID NO: 33159 - RNA, 22 nt, Human
uguguuuuaucuauuguaucuu

SEQ ID NO: 33160 - RNA, 22 nt, Human
uguuaaaaaugcagauuccuau

SEQ ID NO: 33161 - RNA, 22 nt, Human
uguuaaaaccacaggugaggac

SEQ ID NO: 33162 - RNA, 22 nt, Human
uguuaaacagcugucuucuuca

SEQ ID NO: 33163 - RNA, 20 nt, Human
uguuaaaggacacuugcuuu

SEQ ID NO: 33164 - RNA, 22 nt, Human
uguuaaaugcucagcucgggga

SEQ ID NO: 33165 - RNA, 22 nt, Human
uguuaaauguuccuuuacugga

SEQ ID NO: 33166 - RNA, 22 nt, Human
uguuaaauugauucaccuuucu

SEQ ID NO: 33167 - RNA, 22 nt, Human
uguuaacaauaaguccaggcau

SEQ ID NO: 33168 - RNA, 22 nt, Human
uguuaacauacugcuuucuaau

SEQ ID NO: 33169 - RNA, 22 nt, Human
uguuaagagaguuucuaauauu

SEQ ID NO: 33170 - RNA, 22 nt, Human
uguuaaggagacacaugaaaaa

SEQ ID NO: 33171 - RNA, 22 nt, Human
uguuaaggguaaacagcaguaa

SEQ ID NO: 33172 - RNA, 22 nt, Human
uguuaaguugccaguguaugac

SEQ ID NO: 33173 - RNA, 22 nt, Human
uguuaauauacuaaaauccacu

SEQ ID NO: 33174 - RNA, 22 nt, Human
uguuacaaacuguuguuucuau

SEQ ID NO: 33175 - RNA, 23 nt, Human
uguuacaagcaccacagguggcu

SEQ ID NO: 33176 - RNA, 22 nt, Human
uguuacaaggaagaauguaggu

SEQ ID NO: 33177 - RNA, 22 nt, Human
uguuacacccacaaaaaauucc

SEQ ID NO: 33178 - RNA, 22 nt, Human
uguuacagcagaauugaaagag

SEQ ID NO: 33179 - RNA, 22 nt, Human
uguuacagggauaaaugaggua

SEQ ID NO: 33180 - RNA, 22 nt, Human
uguuacagucauuguuuucuga

SEQ ID NO: 33181 - RNA, 22 nt, Human
uguuaccauaggucagaacguu

SEQ ID NO: 33182 - RNA, 22 nt, Human
uguuacuucuuauuucuuacau

SEQ ID NO: 33183 - RNA, 22 nt, Human
uguuagaaaggcuauuggacca

SEQ ID NO: 33184 - RNA, 22 nt, Human
uguuagaaguuaaucacuaauu

SEQ ID NO: 33185 - RNA, 22 nt, Human
uguuagaauauuguaauauucg

SEQ ID NO: 33186 - RNA, 22 nt, Human
uguuagagcuaagauaacaucu

SEQ ID NO: 33187 - RNA, 22 nt, Human
uguuagauuccugaugaauuua

SEQ ID NO: 33188 - RNA, 22 nt, Human
uguuagccucaugcuuaauagg

SEQ ID NO: 33189 - RNA, 16 nt, Human
uguuagcugugcauua

SEQ ID NO: 33190 - RNA, 22 nt, Human
uucaacaaguaguacacacagu

SEQ ID NO: 33191 - RNA, 22 nt, Human
uucaacaaguauuuauugagca

SEQ ID NO: 33192 - RNA, 22 nt, Human
uucaacaauuaaguaucagccu

SEQ ID NO: 33193 - RNA, 22 nt, Human
uucaacagugauggccuuugua

SEQ ID NO: 33194 - RNA, 22 nt, Human
uucaacauaugaauuuugggug

SEQ ID NO: 33195 - RNA, 22 nt, Human
uucaacaugcaaacauguuugu

SEQ ID NO: 33196 - RNA, 22 nt, Human
uucaacaugcaaacuuugggag

SEQ ID NO: 33197 - RNA, 19 nt, Human
uucaacaugcugaggcagc

SEQ ID NO: 33198 - RNA, 22 nt, Human
uucaacauuugaaaugaaugaa

SEQ ID NO: 33199 - RNA, 22 nt, Human
uucaacuaauguuuauuuuaug

SEQ ID NO: 33200 - RNA, 22 nt, Human
uucaacuagauuuauacaauuc

SEQ ID NO: 33201 - RNA, 22 nt, Human
uucaacuauuaugaauaaaauu

SEQ ID NO: 33202 - RNA, 22 nt, Human
uucaacucuucaagaucacauc

SEQ ID NO: 33203 - RNA, 22 nt, Human
uucaacuuuggagauuuaauaa

SEQ ID NO: 33204 - RNA, 22 nt, Human
uucaagaggcuuaauucuggau

SEQ ID NO: 33205 - RNA, 23 nt, Human
uucaagauacgguuuccaggcug

SEQ ID NO: 33206 - RNA, 17 nt, Human
uucaagauauugaaaug

SEQ ID NO: 33207 - RNA, 21 nt, Human
uucaagauauuuaaaaggugg

SEQ ID NO: 33208 - RNA, 22 nt, Human
uucaagaucgaguuuaaaguga

SEQ ID NO: 33209 - RNA, 22 nt, Human
uucaagauggccccagugagcc

SEQ ID NO: 33210 - RNA, 22 nt, Human
uucaagguaugguagcugguca

SEQ ID NO: 33211 - RNA, 22 nt, Human
uucaaguagucacacaugauau

SEQ ID NO: 33212 - RNA, 22 nt, Human
uucaaguaugagaaaggggacu

SEQ ID NO: 33213 - RNA, 22 nt, Human
uucaagucaauuuuugaaugac

SEQ ID NO: 33214 - RNA, 22 nt, Human
uucaagucugaagaggacuaau

SEQ ID NO: 33215 - RNA, 22 nt, Human
uucaagucuggagaucuggaac

SEQ ID NO: 33216 - RNA, 22 nt, Human
uucaaguuuacuuugaaguuua

SEQ ID NO: 33217 - RNA, 22 nt, Human
uucaaguuuuauauccauggcu

SEQ ID NO: 33218 - RNA, 22 nt, Human
uucaaguuuuauauugaagcaa

SEQ ID NO: 33219 - RNA, 22 nt, Human
uucaaguuuugacuuaguccuu

SEQ ID NO: 33220 - RNA, 22 nt, Human
uucaauagaaagucccuaguua

SEQ ID NO: 33221 - RNA, 22 nt, Human
uucaauaucauuguuuagucuc

SEQ ID NO: 33222 - RNA, 22 nt, Human
uucaauaucucuaagaaugagg

SEQ ID NO: 33223 - RNA, 22 nt, Human
uucaauaugauauuagcugugg

SEQ ID NO: 33224 - RNA, 22 nt, Human
uucaaucauugcaaaguaaugg

SEQ ID NO: 33225 - RNA, 21 nt, Human
uucaaugaaaacaaagugagg

SEQ ID NO: 33226 - RNA, 22 nt, Human
uucaaugauuuuuagggaucau

SEQ ID NO: 33227 - RNA, 22 nt, Human
uucaaugcaagggaggucugaa

SEQ ID NO: 33228 - RNA, 22 nt, Human
uucaaugcuuauauggacuaau

SEQ ID NO: 33229 - RNA, 22 nt, Human
uucacaaagcuggagcauuucc

SEQ ID NO: 33230 - RNA, 21 nt, Human
uucacaaccugcuuuaguggg

SEQ ID NO: 33231 - RNA, 22 nt, Human
uucacaagucauuagcugcaua

SEQ ID NO: 33232 - RNA, 19 nt, Human
uucacaauuaugaaauuag

SEQ ID NO: 33233 - RNA, 22 nt, Human
uucacaauuucccuucaucagg

SEQ ID NO: 33234 - RNA, 22 nt, Human
uucacacacagcuuccuauugu

SEQ ID NO: 33235 - RNA, 22 nt, Human
uucacacagaaucugaggagcu

SEQ ID NO: 33236 - RNA, 22 nt, Human
uucacacuguuuuucauagugg

SEQ ID NO: 33237 - RNA, 22 nt, Human
uucacacuuguuaggauggcuu

SEQ ID NO: 33238 - RNA, 22 nt, Human
uucacacuuuggaauuccaccu

SEQ ID NO: 33239 - RNA, 22 nt, Human
uucacagagagaacucaaacca

SEQ ID NO: 33240 - RNA, 23 nt, Human
uucacagauuaaauauuucuucu

SEQ ID NO: 33241 - RNA, 22 nt, Human
uucacaggcuuggagguggggg

SEQ ID NO: 33242 - RNA, 22 nt, Human
uucacagggccacuggcaggag

SEQ ID NO: 33243 - RNA, 22 nt, Human
uucacaggugacuggggauaac

SEQ ID NO: 33244 - RNA, 22 nt, Human
uucacagguugaagccuaaucc

SEQ ID NO: 33245 - RNA, 22 nt, Human
uucacaguauagguuuccagcg

SEQ ID NO: 33246 - RNA, 22 nt, Human
uucacagucacccuucuccaug

SEQ ID NO: 33247 - RNA, 22 nt, Human
uucacaguggcugacaggcugg

SEQ ID NO: 33248 - RNA, 22 nt, Human
uucacaguuuaauggcaaggau

SEQ ID NO: 33249 - RNA, 22 nt, Human
uucacauaggagcaugguuuuu

SEQ ID NO: 33250 - RNA, 22 nt, Human
uucacaucucagcacugccucu

SEQ ID NO: 33251 - RNA, 22 nt, Human
uucacauuaucaggauuguuuc

SEQ ID NO: 33252 - RNA, 22 nt, Human
uucacauugaaggugcuuucuu

SEQ ID NO: 33253 - RNA, 22 nt, Human
uucacauugugguucaugugaa

SEQ ID NO: 33254 - RNA, 19 nt, Human
uucacauuuugcucugagg

SEQ ID NO: 33255 - RNA, 19 nt, Human
uucacauuuuuguggcacu

SEQ ID NO: 33256 - RNA, 22 nt, Human
uucaccccaaauucccagugga

SEQ ID NO: 33257 - RNA, 22 nt, Human
uucaccgugaaccgauuccuca

SEQ ID NO: 33258 - RNA, 22 nt, Human
uucaccuggcacaugugagccu

SEQ ID NO: 33259 - RNA, 22 nt, Human
uucacugcuacauccaggugcc

SEQ ID NO: 33260 - RNA, 22 nt, Human
uucacugugauguuuaagagaa

SEQ ID NO: 33261 - RNA, 22 nt, Human
uucacuguuggcuuugcuuguc

SEQ ID NO: 33262 - RNA, 22 nt, Human
uucacuguuucauccuacuucu

SEQ ID NO: 33263 - RNA, 22 nt, Human
uucagaaaaagaccauugcaau

SEQ ID NO: 33264 - RNA, 22 nt, Human
uucagaaauaaaauaucccaac

SEQ ID NO: 33265 - RNA, 22 nt, Human
uucagaaaugucagccaucaga

SEQ ID NO: 33266 - RNA, 22 nt, Human
uucagaaauucauggaguucag

SEQ ID NO: 33267 - RNA, 22 nt, Human
uucagaacaaccaugguuagau

SEQ ID NO: 33268 - RNA, 22 nt, Human
uucagaacugucuguccuuuuc

SEQ ID NO: 33269 - RNA, 22 nt, Human
uucagaaggugcagccugggcc

SEQ ID NO: 33270 - RNA, 22 nt, Human
uucagaauauccguuuaaguuu

SEQ ID NO: 33271 - RNA, 22 nt, Human
uuagaauuucugcucacuuuga

SEQ ID NO: 33272 - RNA, 23 nt, Human
uuagacaauccucaaaagguaau

SEQ ID NO: 33273 - RNA, 22 nt, Human
uuagacaaucuguugguaaggu

SEQ ID NO: 33274 - RNA, 22 nt, Human
uuagacauuaaaugccauuuaa

SEQ ID NO: 33275 - RNA, 22 nt, Human
uuagacuagaagcuuccacuuu

SEQ ID NO: 33276 - RNA, 22 nt, Human
uuagagaaccaaugaauagucu

SEQ ID NO: 33277 - RNA, 22 nt, Human
uuagagauugucuaguauugug

SEQ ID NO: 33278 - RNA, 22 nt, Human
uuagagcaggaguugacagauu

SEQ ID NO: 33279 - RNA, 22 nt, Human
uuagagccaguuacaaggucaa

SEQ ID NO: 33280 - RNA, 22 nt, Human
uuagagcugauaguacacuggu

SEQ ID NO: 33281 - RNA, 22 nt, Human
uuagaggaaagugacuccgaug

SEQ ID NO: 33282 - RNA, 22 nt, Human
uuagaggacuguaggugggaau

SEQ ID NO: 33283 - RNA, 21 nt, Human
uuagaguagagaacaugaucc

SEQ ID NO: 33284 - RNA, 22 nt, Human
uuagaguagagccauuucuguu

SEQ ID NO: 33285 - RNA, 21 nt, Human
uuagaguugccauuauaugua

SEQ ID NO: 33286 - RNA, 22 nt, Human
uuagaguuuucuguuccucuaa

SEQ ID NO: 33287 - RNA, 22 nt, Human
uuagauacccaaguggaucugu

SEQ ID NO: 33288 - RNA, 18 nt, Human
uuagauacuagugugcua

SEQ ID NO: 33289 - RNA, 22 nt, Human
uuagauaggacucauagauugg

SEQ ID NO: 33290 - RNA, 22 nt, Human
uuagaucaauacuaaagaaguu

SEQ ID NO: 33291 - RNA, 22 nt, Human
uuagaucauuuugaacuaauuu

SEQ ID NO: 33292 - RNA, 22 nt, Human
uuagauuuacaagcacuguuua

SEQ ID NO: 33293 - RNA, 22 nt, Human
uuagauuuauaugugagaaugg

SEQ ID NO: 33294 - RNA, 21 nt, Human
uuagcaaagcaaacacaugcu

SEQ ID NO: 33295 - RNA, 22 nt, Human
uuagcaaauuuccaggugaugc

SEQ ID NO: 33296 - RNA, 22 nt, Human
uuagcaauaugaaugcauuugc

SEQ ID NO: 33297 - RNA, 22 nt, Human
uuagcacccugauacuagaaug

SEQ ID NO: 33298 - RNA, 22 nt, Human
uuagcagcaucccuggccugua

SEQ ID NO: 33299 - RNA, 22 nt, Human
uugccaccgucauggccauuau

SEQ ID NO: 33300 - RNA, 22 nt, Human
uugccagauaggcaugaaaagu

SEQ ID NO: 33301 - RNA, 22 nt, Human
uugccaggcucugguuccagcc

SEQ ID NO: 33302 - RNA, 22 nt, Human
uugccaggggacaucuggagcc

SEQ ID NO: 33303 - RNA, 22 nt, Human
uugccagggucaggaugagauc

SEQ ID NO: 33304 - RNA, 22 nt, Human
uugccaucccuuaccucaguca

SEQ ID NO: 33305 - RNA, 22 nt, Human
uugccauuaaaacauguuaucu

SEQ ID NO: 33306 - RNA, 22 nt, Human
uugcccaccuucuuuucgugcc

SEQ ID NO: 33307 - RNA, 22 nt, Human
uugcccacucagcccuguggag

SEQ ID NO: 33308 - RNA, 22 nt, Human
uugcccagagucacccagcuca

SEQ ID NO: 33309 - RNA, 22 nt, Human
uugcccagaguccacagcguac

SEQ ID NO: 33310 - RNA, 22 nt, Human
uugcccugcggguccugcgcaa

SEQ ID NO: 33311 - RNA, 22 nt, Human
uugcccugucaguagaagugca

SEQ ID NO: 33312 - RNA, 22 nt, Human
uugcccugucucacuauguuaa

SEQ ID NO: 33313 - RNA, 22 nt, Human
uugccuagaguugcacaucugg

SEQ ID NO: 33314 - RNA, 22 nt, Human
uugccucaagauuuuuuauuga

SEQ ID NO: 33315 - RNA, 22 nt, Human
uugccucauuuucuggugaaau

SEQ ID NO: 33316 - RNA, 22 nt, Human
uugccuccuuuuaaggaaauca

SEQ ID NO: 33317 - RNA, 22 nt, Human
uugccuggacucugcugguauu

SEQ ID NO: 33318 - RNA, 22 nt, Human
uugccuuguuauucucucagaa

SEQ ID NO: 33319 - RNA, 22 nt, Human
uugccuuuaaccccugaaaggc

SEQ ID NO: 33320 - RNA, 22 nt, Human
uugcgcgcggcuaggucucggu

SEQ ID NO: 33321 - RNA, 22 nt, Human
uugcuaaaaauggaauuauagg

SEQ ID NO: 33322 - RNA, 22 nt, Human
uugcuaaauguguuauaucugu

SEQ ID NO: 33323 - RNA, 22 nt, Human
uugcuaaguuauagaguaucuu

SEQ ID NO: 33324 - RNA, 22 nt, Human
uugcuaauaaaguuuuuaugug

SEQ ID NO: 33325 - RNA, 22 nt, Human
uugcuaaucauauuucaucacu

SEQ ID NO: 33326 - RNA, 22 nt, Human
uugcuagcugguguaugcauug

SEQ ID NO: 33327 - RNA, 22 nt, Human
uugcuauacucauuaguuauuu

SEQ ID NO: 33328 - RNA, 22 nt, Human
uugcucagcacuggagccagcu

SEQ ID NO: 33329 - RNA, 22 nt, Human
uugcucaggcuggugugcagug

SEQ ID NO: 33330 - RNA, 22 nt, Human
uugcucaggcuuagagcuacua

SEQ ID NO: 33331 - RNA, 22 nt, Human
uugcucauuccgugagaagauc

SEQ ID NO: 33332 - RNA, 22 nt, Human
uugcucauuugccuuuagguuu

SEQ ID NO: 33333 - RNA, 21 nt, Human
uugcucuacagugagggcagc

SEQ ID NO: 33334 - RNA, 22 nt, Human
uugcucugauuagguggaaaca

SEQ ID NO: 33335 - RNA, 22 nt, Human
uugcucugcaguccagacagua

SEQ ID NO: 33336 - RNA, 22 nt, Human
uugcucuguccagccagcaggu

SEQ ID NO: 33337 - RNA, 22 nt, Human
uugcugaaaacaggucaucagg

SEQ ID NO: 33338 - RNA, 22 nt, Human
uugcugaaagguagcugugugg

SEQ ID NO: 33339 - RNA, 22 nt, Human
uugcugaaaucuaugacauccu

SEQ ID NO: 33340 - RNA, 19 nt, Human
uugcugaaggaagccucug

SEQ ID NO: 33341 - RNA, 22 nt, Human
uugcugaaggccucuugggguu

SEQ ID NO: 33342 - RNA, 22 nt, Human
uugcugaaugcaaguuggauag

SEQ ID NO: 33343 - RNA, 22 nt, Human
uugcugauaaaauaaaccaaga

SEQ ID NO: 33344 - RNA, 22 nt, Human
uugcugauggagggaaugcuca

SEQ ID NO: 33345 - RNA, 22 nt, Human
uugcugauuuguuucuauucca

SEQ ID NO: 33346 - RNA, 22 nt, Human
uugcugccagcgcccugcaggg

SEQ ID NO: 33347 - RNA, 23 nt, Human
uugcugccugagccuuccucugg

SEQ ID NO: 33348 - RNA, 22 nt, Human
uugcugccuuggagaagcuccu

SEQ ID NO: 33349 - RNA, 22 nt, Human
uugcugccuugucucagggucu

SEQ ID NO: 33350 - RNA, 22 nt, Human
uugcuggcaauuuagagauuuc

SEQ ID NO: 33351 - RNA, 22 nt, Human
uugcuggcuugaagauagagga

SEQ ID NO: 33352 - RNA, 22 nt, Human
uugcuggggugugaaaucugau

SEQ ID NO: 33353 - RNA, 22 nt, Human
uugcugggucagaagccaggag

SEQ ID NO: 33354 - RNA, 22 nt, Human
uugcugggugcuauuaugaaca

SEQ ID NO: 33355 - RNA, 22 nt, Human
uugcuguagcucauuucacucu

SEQ ID NO: 33356 - RNA, 22 nt, Human
uugcugugucauuuguuuaauc

SEQ ID NO: 33357 - RNA, 22 nt, Human
uugcugugucugauggcugaga

SEQ ID NO: 33358 - RNA, 22 nt, Human
uugcuguuacaauuauuuaccc

SEQ ID NO: 33359 - RNA, 22 nt, Human
uugcuguugaugaugugauaca

SEQ ID NO: 33360 - RNA, 22 nt, Human
uugcuuauagagaguuucauac

SEQ ID NO: 33361 - RNA, 22 nt, Human
uugcuucacuacuucuaggcuc

SEQ ID NO: 33362 - RNA, 22 nt, Human
uugcuucaguagcucuuuaaag

SEQ ID NO: 33363 - RNA, 22 nt, Human
uugcuucauauuuguggcuugc

SEQ ID NO: 33364 - RNA, 22 nt, Human
uugcuucauuuccucaggcuuu

SEQ ID NO: 33365 - RNA, 22 nt, Human
uugcuuccucgaggccagcgug

SEQ ID NO: 33366 - RNA, 22 nt, Human
uugcuuccucuaguuucuugaa

SEQ ID NO: 33367 - RNA, 22 nt, Human
uugcuuccuggaugugacuuug

SEQ ID NO: 33368 - RNA, 22 nt, Human
uugcuucucagggccugaugca

SEQ ID NO: 33369 - RNA, 22 nt, Human
uugcuucuggaacuuucuguuc

SEQ ID NO: 33370 - RNA, 22 nt, Human
uugcuucuuagauauuccucuc

SEQ ID NO: 33371 - RNA, 22 nt, Human
uugcuugacuuuguguaccugu

SEQ ID NO: 33372 - RNA, 23 nt, Human
uugcuugagcccaggaaguggag

SEQ ID NO: 33373 - RNA, 22 nt, Human
uugcuugcuucuauuuuauaca

SEQ ID NO: 33374 - RNA, 22 nt, Human
uugcuuggcaggcuuccagucu

SEQ ID NO: 33375 - RNA, 15 nt, Human
uugcuuuaagacaug

SEQ ID NO: 33376 - RNA, 22 nt, Human
uugcuuuaagguaucuggagaa

SEQ ID NO: 33377 - RNA, 22 nt, Human
uugcuuuaaugagauuuugcca

SEQ ID NO: 33378 - RNA, 22 nt, Human
uugcuuuacaaaaauugauggu

SEQ ID NO: 33379 - RNA, 22 nt, Human
uugcuuuaucuaagcauggcca

SEQ ID NO: 33380 - RNA, 22 nt, Human
uugcuuuauuggguuuacugcc

SEQ ID NO: 33381 - RNA, 22 nt, Human
uugcuuuccgucaugugcuaau

SEQ ID NO: 33382 - RNA, 18 nt, Human
uugcuuuguaagcuugca

SEQ ID NO: 33383 - RNA, 22 nt, Human
uugcuuuguuuaaaagugguau

SEQ ID NO: 33384 - RNA, 22 nt, Human
uugcuuuucccugucucugauu

SEQ ID NO: 33385 - RNA, 22 nt, Human
uugcuuuugugugcucucugga

SEQ ID NO: 33386 - RNA, 22 nt, Human
uuggaaacuuggauggaaaacc

SEQ ID NO: 33387 - RNA, 22 nt, Human
uuggaaagauuauuauuaugaa

SEQ ID NO: 33388 - RNA, 22 nt, Human
uuggaaagcaacuuuugagagu

SEQ ID NO: 33389 - RNA, 22 nt, Human
uuggaaaggagauucuauugug

SEQ ID NO: 33390 - RNA, 22 nt, Human
uuggaaaguuuuuacugaagac

SEQ ID NO: 33391 - RNA, 22 nt, Human
uuggaacacagcagcugauuuu

SEQ ID NO: 33392 - RNA, 22 nt, Human
uuggaacagaaacagacaaaua

SEQ ID NO: 33393 - RNA, 20 nt, Human
uuggaacaguggaucagcag

SEQ ID NO: 33394 - RNA, 22 nt, Human
uuggaacucaauaauucuucuu

SEQ ID NO: 33395 - RNA, 22 nt, Human
uuggaacucuaccaacaguagu

SEQ ID NO: 33396 - RNA, 22 nt, Human
uuggaacuggaggaacaugcua

SEQ ID NO: 33397 - RNA, 22 nt, Human
uuggaacuuaacccugauaggu

SEQ ID NO: 33398 - RNA, 22 nt, Human
uuggaagacaaugcugauucuc

SEQ ID NO: 33399 - RNA, 22 nt, Human
uuggaagaccagaggccuuguc

SEQ ID NO: 33400 - RNA, 22 nt, Human
uuggaagaggaaaaugagccua

SEQ ID NO: 33401 - RNA, 22 nt, Human
uuggaagaucuaacagaggcau

SEQ ID NO: 33402 - RNA, 22 nt, Human
uuggaagcgagcacauggagga

SEQ ID NO: 33403 - RNA, 22 nt, Human
uuggaaggaauuaaggucauga

SEQ ID NO: 33404 - RNA, 22 nt, Human
uuggaaggaccaggccuugauu

SEQ ID NO: 33405 - RNA, 22 nt, Human
uuggaagggaacaccauuugac

SEQ ID NO: 33406 - RNA, 22 nt, Human
uuggaaggguuucaguuagucu

SEQ ID NO: 33407 - RNA, 22 nt, Human
uuggaagguucuggucaugguu

SEQ ID NO: 33408 - RNA, 22 nt, Human
uuucuaguccucaugcaucauu

SEQ ID NO: 33409 - RNA, 22 nt, Human
uuucuagugguuaagauuuaca

SEQ ID NO: 33410 - RNA, 22 nt, Human
uuucuauagcuuucuugggagu

SEQ ID NO: 33411 - RNA, 22 nt, Human
uuucuaucugagaagauaucua

SEQ ID NO: 33412 - RNA, 22 nt, Human
uuucuauuggcgucacuguugu

SEQ ID NO: 33413 - RNA, 22 nt, Human
uuucuauuuuaaaggcauaugg

SEQ ID NO: 33414 - RNA, 18 nt, Human
uuucucagacucucuuuc

SEQ ID NO: 33415 - RNA, 22 nt, Human
uuucucagagcacggggaguga

SEQ ID NO: 33416 - RNA, 22 nt, Human
uuucucagcuguggagccuauc

SEQ ID NO: 33417 - RNA, 22 nt, Human
uuucucaguaguaauggcaguc

SEQ ID NO: 33418 - RNA, 22 nt, Human
uuucucagucacaugaaccaau

SEQ ID NO: 33419 - RNA, 22 nt, Human
uuucucauggacccuucaugau

SEQ ID NO: 33420 - RNA, 22 nt, Human
uuucucauggcccuuggcuuuu

SEQ ID NO: 33421 - RNA, 16 nt, Human
uuucucauugucauca

SEQ ID NO: 33422 - RNA, 22 nt, Human
uuucuccaauguaucagcacac

SEQ ID NO: 33423 - RNA, 22 nt, Human
uuucucccaacucuggaagcca

SEQ ID NO: 33424 - RNA, 22 nt, Human
uuucucccagucuccugagaca

SEQ ID NO: 33425 - RNA, 22 nt, Human
uuucucccuccacuacaggcuc

SEQ ID NO: 33426 - RNA, 22 nt, Human
uuucucgcguuugagcucucag

SEQ ID NO: 33427 - RNA, 22 nt, Human
uuucucggcagagaugaugggc

SEQ ID NO: 33428 - RNA, 22 nt, Human
uuucucucuggcccugauuguc

SEQ ID NO: 33429 - RNA, 22 nt, Human
uugcuuuagguauagaauccau

SEQ ID NO: 33430 - RNA, 22 nt, Human
uugcuuuauauucaagagagga

SEQ ID NO: 33431 - RNA, 23 nt, Human
uugcuuucaucaugagaugcucc

SEQ ID NO: 33432 - RNA, 22 nt, Human
uugcuuuuaauuaaucauugcu

SEQ ID NO: 33433 - RNA, 22 nt, Human
uuggaaaccaggcuuugagacg

SEQ ID NO: 33434 - RNA, 22 nt, Human
uuggaaacgucaccuuuuccuu

SEQ ID NO: 33435 - RNA, 22 nt, Human
uuggaaagaccgaauuccuguu

SEQ ID NO: 33436 - RNA, 22 nt, Human
uuggaaagggaggaauguagac

SEQ ID NO: 33437 - RNA, 22 nt, Human
uuggaaaugauuucuauuauua

SEQ ID NO: 33438 - RNA, 22 nt, Human
uuggaaauggcuguaguuauga

SEQ ID NO: 33439 - RNA, 21 nt, Human
uuggaacaagcagcaguuugc

SEQ ID NO: 33440 - RNA, 23 nt, Human
uuggaacacaguaaaugcacaau

SEQ ID NO: 33441 - RNA, 22 nt, Human
uuggaacacuagaaucuguacu

SEQ ID NO: 33442 - RNA, 22 nt, Human
uuggaacaugccgggguccagg

SEQ ID NO: 33443 - RNA, 22 nt, Human
uuggaagaaauaucaauagugu

SEQ ID NO: 33444 - RNA, 22 nt, Human
uuggaagcccucugcaagaucc

SEQ ID NO: 33445 - RNA, 22 nt, Human
uuggaaggauuuagagaugucu

SEQ ID NO: 33446 - RNA, 22 nt, Human
uuggaaggccagcaccuugagu

SEQ ID NO: 33447 - RNA, 22 nt, Human
uuggaaggcccugccuagcagg

SEQ ID NO: 33448 - RNA, 22 nt, Human
uuggaagggauauuggcauaug

SEQ ID NO: 33449 - RNA, 20 nt, Human
uuggaagguggagaagagga

SEQ ID NO: 33450 - RNA, 22 nt, Human
uuggaauccugagaugagaauu

SEQ ID NO: 33451 - RNA, 21 nt, Human
uuggaaucuuaggaguguggg

SEQ ID NO: 33452 - RNA, 22 nt, Human
uuggaauugaggauuuacauag

SEQ ID NO: 33453 - RNA, 22 nt, Human
uuggaauugugaacuaagugau

SEQ ID NO: 33454 - RNA, 22 nt, Human
uuggaauuuaguaaaauaaugc

SEQ ID NO: 33455 - RNA, 22 nt, Human
uuggaauuugagaccaagaaaa

SEQ ID NO: 33456 - RNA, 23 nt, Human
uuggacaaggccagagccagcac

SEQ ID NO: 33457 - RNA, 22 nt, Human
uuggaccaaauuaaaaguuggc

SEQ ID NO: 33458 - RNA, 23 nt, Human
uuggaccacuacuguuuucucuu

SEQ ID NO: 33459 - RNA, 17 nt, Human
uuggaccagauucuaaa

SEQ ID NO: 33460 - RNA, 22 nt, Human
uuggaccaugguagggaacuug

SEQ ID NO: 33461 - RNA, 22 nt, Human
uuggagaacuggcauuuuuaau

SEQ ID NO: 33462 - RNA, 22 nt, Human
uuggagagaggcugcucaggcu

SEQ ID NO: 33463 - RNA, 22 nt, Human
uuggagagauuaucagaccagc

SEQ ID NO: 33464 - RNA, 22 nt, Human
uuggagagauuuaggucucagu

SEQ ID NO: 33465 - RNA, 22 nt, Human
uuggagagggcuuggaucacac

SEQ ID NO: 33466 - RNA, 23 nt, Human
uuggagagggugaguagugucag

SEQ ID NO: 33467 - RNA, 22 nt, Human
uuggagauaucacaccuucaca

SEQ ID NO: 33468 - RNA, 22 nt, Human
uuggaggaagcucaugggggau

SEQ ID NO: 33469 - RNA, 22 nt, Human
uuggaggaggcauuggaggauu

SEQ ID NO: 33470 - RNA, 15 nt, Human
uuggaggauguagua

SEQ ID NO: 33471 - RNA, 22 nt, Human
uuggagggacagauggcuaggc

SEQ ID NO: 33472 - RNA, 22 nt, Human
uuggaggggccacugcagagcu

SEQ ID NO: 33473 - RNA, 22 nt, Human
uuggagugacagaugaggaaac

SEQ ID NO: 33474 - RNA, 22 nt, Human
uuggauaaaaauguuuaagugu

SEQ ID NO: 33475 - RNA, 22 nt, Human
uuggaucacucugaagccuuac

SEQ ID NO: 33476 - RNA, 22 nt, Human
uuggauccaucucaggcauagg

SEQ ID NO: 33477 - RNA, 22 nt, Human
uuggaugagagggugugguaca

SEQ ID NO: 33478 - RNA, 22 nt, Human
uuggaugagguugagaaucauu

SEQ ID NO: 33479 - RNA, 22 nt, Human
uuggauggagguucaagcacua

SEQ ID NO: 33480 - RNA, 21 nt, Human
uuggauguauuuauguuuuag

SEQ ID NO: 33481 - RNA, 20 nt, Human
uuggaugugcauggccgugc

SEQ ID NO: 33482 - RNA, 22 nt, Human
uuggcaaucaauucugacgucu

SEQ ID NO: 33483 - RNA, 22 nt, Human
uuggcacuauucacuccauggg

SEQ ID NO: 33484 - RNA, 22 nt, Human
uuggcacucauccugguuguuu

SEQ ID NO: 33485 - RNA, 22 nt, Human
uuggcacugugccuggcacauu

SEQ ID NO: 33486 - RNA, 22 nt, Human
uuggcagaaauguggcugggag

SEQ ID NO: 33487 - RNA, 22 nt, Human
uuggcagacugacaaucuguuu

SEQ ID NO: 33488 - RNA, 22 nt, Human
uuggcagaugagaccagggguu

SEQ ID NO: 33489 - RNA, 22 nt, Human
uuggcagauggauucaacauua

SEQ ID NO: 33490 - RNA, 22 nt, Human
uuggcagcaagaggcucuucug

SEQ ID NO: 33491 - RNA, 20 nt, Human
uuggcagcaguuccaaguga

SEQ ID NO: 33492 - RNA, 22 nt, Human
uuggcagggcugcuugucuagg

SEQ ID NO: 33493 - RNA, 22 nt, Human
uuggcaguaaaagaaaaugcuu

SEQ ID NO: 33494 - RNA, 22 nt, Human
uuggcaguagugguaguacauu

SEQ ID NO: 33495 - RNA, 21 nt, Human
uuggcagucagaaaugugagg

SEQ ID NO: 33496 - RNA, 22 nt, Human
uuggcagucagucuuggugcuu

SEQ ID NO: 33497 - RNA, 22 nt, Human
uuggcauaccuuagugguggag

SEQ ID NO: 33498 - RNA, 22 nt, Human
uuggcauccacuuugcaaguuu

SEQ ID NO: 33499 - RNA, 22 nt, Human
uuggcauuggagaugcaagaac

SEQ ID NO: 33500 - RNA, 22 nt, Human
uuggccaaagcucaccagugcu

SEQ ID NO: 33501 - RNA, 22 nt, Human
uuggccaaauacacaccuuuug

SEQ ID NO: 33502 - RNA, 22 nt, Human
uuggccaaccagaacggagguc

SEQ ID NO: 33503 - RNA, 22 nt, Human
uuggccaaggucacugggugag

SEQ ID NO: 33504 - RNA, 22 nt, Human
uuggccaauccuauuggguggg

SEQ ID NO: 33505 - RNA, 22 nt, Human
uuggccaauuccagaggaucau

SEQ ID NO: 33506 - RNA, 22 nt, Human
uuggccacaauccaagccuugg

SEQ ID NO: 33507 - RNA, 22 nt, Human
uuggccagcagcucuggcuuag

SEQ ID NO: 33508 - RNA, 22 nt, Human
uuggccagcgacgaccuucuua

SEQ ID NO: 33509 - RNA, 22 nt, Human
uuggccagcucuggaaaguggu

SEQ ID NO: 33510 - RNA, 22 nt, Human
uuggccagguguaggucacacc

SEQ ID NO: 33511 - RNA, 22 nt, Human
uuggccagguguccagcccagg

SEQ ID NO: 33512 - RNA, 22 nt, Human
uuggccagugcuugugauuuuc

SEQ ID NO: 33513 - RNA, 22 nt, Human
uuggcccacucucagaaugugg

SEQ ID NO: 33514 - RNA, 22 nt, Human
uuggcccagcaugcgggucugu

SEQ ID NO: 33515 - RNA, 22 nt, Human
uuggcccuagaugauuaaguug

SEQ ID NO: 33516 - RNA, 22 nt, Human
uuggcccuggcacacccccacg

SEQ ID NO: 33517 - RNA, 22 nt, Human
uugcaaauguuucauaacagua

SEQ ID NO: 33518 - RNA, 22 nt, Human
uugcaaauuaaagaggauagca

SEQ ID NO: 33519 - RNA, 22 nt, Human
uugcaaauuauauaagggaugc

SEQ ID NO: 33520 - RNA, 22 nt, Human
uugcaaauugcaagaguuggau

SEQ ID NO: 33521 - RNA, 22 nt, Human
uugcaacagguguguuuuggug

SEQ ID NO: 33522 - RNA, 22 nt, Human
uugcaacuaaaagaacuugaca

SEQ ID NO: 33523 - RNA, 16 nt, Human
uugcaaggcguuuaua

SEQ ID NO: 33524 - RNA, 22 nt, Human
uugcaaggcuagguucacccac

SEQ ID NO: 33525 - RNA, 22 nt, Human
uugcaagggcaugugugcgugu

SEQ ID NO: 33526 - RNA, 22 nt, Human
uugcaagguuucucucugccua

SEQ ID NO: 33527 - RNA, 22 nt, Human
uugcaaguuaaaaauuauuagu

SEQ ID NO: 33528 - RNA, 20 nt, Human
uugcacagagaaggaggcag

SEQ ID NO: 33529 - RNA, 22 nt, Human
uugcacagaguggauauucagu

SEQ ID NO: 33530 - RNA, 22 nt, Human
uugcacagaugagggugaugcu

SEQ ID NO: 33531 - RNA, 22 nt, Human
uugcacagaugcacaugguugc

SEQ ID NO: 33532 - RNA, 23 nt, Human
uugcacaguuucggaaacugagg

SEQ ID NO: 33533 - RNA, 22 nt, Human
uugcagaaaacaguuuucuugu

SEQ ID NO: 33534 - RNA, 22 nt, Human
uugcagaagggcacagugauca

SEQ ID NO: 33535 - RNA, 22 nt, Human
uugcagaaucucaggaaggaga

SEQ ID NO: 33536 - RNA, 22 nt, Human
uugcagacagugagagugaaag

SEQ ID NO: 33537 - RNA, 22 nt, Human
uugcagaggcaaaaaugaacuc

SEQ ID NO: 33538 - RNA, 22 nt, Human
uugcagaugaagaaagugguag

SEQ ID NO: 33539 - RNA, 19 nt, Human
uugcagcaaaguuaggacc

SEQ ID NO: 33540 - RNA, 22 nt, Human
uugcagcagggugaauucacuc

SEQ ID NO: 33541 - RNA, 22 nt, Human
uugcagcucugauccagggacc

SEQ ID NO: 33542 - RNA, 22 nt, Human
uugcagcugugagcuuuacacg

SEQ ID NO: 33543 - RNA, 22 nt, Human
uugcagcuguugcaaagucucu

SEQ ID NO: 33544 - RNA, 22 nt, Human
uugcagcuucuugcaucagaaa

SEQ ID NO: 33545 - RNA, 22 nt, Human
uugcaggaaacugagugugagc

SEQ ID NO: 33546 - RNA, 22 nt, Human
uugcagggaccugcagaaagcu

SEQ ID NO: 33547 - RNA, 22 nt, Human
uugcagggcaaauggucagaua

SEQ ID NO: 33548 - RNA, 22 nt, Human
uuugcagugucagcuucugugu

SEQ ID NO: 33549 - RNA, 22 nt, Human
uuugcauaggauggacauuuua

SEQ ID NO: 33550 - RNA, 22 nt, Human
uuugcauauuaauaucugcgcu

SEQ ID NO: 33551 - RNA, 22 nt, Human
uuugcauccugugugugaaagu

SEQ ID NO: 33552 - RNA, 22 nt, Human
uuugcaugggagguaguaauca

SEQ ID NO: 33553 - RNA, 22 nt, Human
uuugcauuaguuuagauuucaa

SEQ ID NO: 33554 - RNA, 22 nt, Human
uuugcauuaucucacuuauaua

SEQ ID NO: 33555 - RNA, 22 nt, Human
uuugcauugccucugacuuaug

SEQ ID NO: 33556 - RNA, 22 nt, Human
uuugcauuucucguaaggaaac

SEQ ID NO: 33557 - RNA, 22 nt, Human
uuugcauuuuagauuuaggccu

SEQ ID NO: 33558 - RNA, 19 nt, Human
uuugccuugcagcugugug

SEQ ID NO: 33559 - RNA, 22 nt, Human
uuugcgucuaugugugagccuu

SEQ ID NO: 33560 - RNA, 22 nt, Human
uuugcuaaaagugaugaagaca

SEQ ID NO: 33561 - RNA, 22 nt, Human
uuugcuauuuuucugugcagcu

SEQ ID NO: 33562 - RNA, 22 nt, Human
uuugcucaguucucuguauuuu

SEQ ID NO: 33563 - RNA, 22 nt, Human
uuugcucuuaugaacaaggugg

SEQ ID NO: 33564 - RNA, 22 nt, Human
uuugcugaacuaaaauucugaa

SEQ ID NO: 33565 - RNA, 22 nt, Human
uuugcugggcucugugccagac

SEQ ID NO: 33566 - RNA, 21 nt, Human
uuugcuucaauuccagaagcu

SEQ ID NO: 33567 - RNA, 22 nt, Human
uuugcuuccuaguuggguaaua

SEQ ID NO: 33568 - RNA, 22 nt, Human
uuugcuugacccuugugcugaa

SEQ ID NO: 33569 - RNA, 22 nt, Human
uuugcuuugggagguugucugg

SEQ ID NO: 33570 - RNA, 22 nt, Human
uuugcuuuguuuaaaaguggua

SEQ ID NO: 33571 - RNA, 22 nt, Human
uuuggaaaaagacagcuuauga

SEQ ID NO: 33572 - RNA, 22 nt, Human
uuuggaaacacggucaucuucc

SEQ ID NO: 33573 - RNA, 22 nt, Human
uuuggaaagugugauuucaagg

SEQ ID NO: 33574 - RNA, 22 nt, Human
uuuggaaaguugucacuuuaga

SEQ ID NO: 33575 - RNA, 22 nt, Human
uuuggaaauuacucauuguccu

SEQ ID NO: 33576 - RNA, 22 nt, Human
uuuggaagacagggcaggaaag

SEQ ID NO: 33577 - RNA, 22 nt, Human
uuuggaagggaaccaaaacaug

SEQ ID NO: 33578 - RNA, 22 nt, Human
uuuggaauaaucagauccuagu

SEQ ID NO: 33579 - RNA, 22 nt, Human
uuuggaauauuaaaaugucuca

SEQ ID NO: 33580 - RNA, 22 nt, Human
uuuggaauggaauagagauugc

SEQ ID NO: 33581 - RNA, 22 nt, Human
uuuggaauucugcagcucaugu

SEQ ID NO: 33582 - RNA, 22 nt, Human
uuuggaauuggcauucuauucu

SEQ ID NO: 33583 - RNA, 22 nt, Human
uuuggacaaguuacugguuucc

SEQ ID NO: 33584 - RNA, 22 nt, Human
uuuggacugcaugaugaucugg

SEQ ID NO: 33585 - RNA, 22 nt, Human
uuuggaggggaagaccuuggag

SEQ ID NO: 33586 - RNA, 22 nt, Human
uuuggauauguuucugucuucu

SEQ ID NO: 33587 - RNA, 22 nt, Human
uuuggauugcuuggaugcuucg

SEQ ID NO: 33588 - RNA, 22 nt, Human
uuuggcaaagauggcuagcugu

SEQ ID NO: 33589 - RNA, 22 nt, Human
uuuggcaaauucuugguaguau

SEQ ID NO: 33590 - RNA, 22 nt, Human
uuuggcagaggaagaaggcaca

SEQ ID NO: 33591 - RNA, 21 nt, Human
uuuggcaguuucccaggaaau

SEQ ID NO: 33592 - RNA, 22 nt, Human
uuuggcaugggcuauuugcuuu

SEQ ID NO: 33593 - RNA, 22 nt, Human
uuuggccacuugggaguccagg

SEQ ID NO: 33594 - RNA, 22 nt, Human
uuuggcggacugagaacgcggg

SEQ ID NO: 33595 - RNA, 22 nt, Human
uuuggcuaauuaggugcugauu

SEQ ID NO: 33596 - RNA, 23 nt, Human
uuuggcuccauggguggcucauu

SEQ ID NO: 33597 - RNA, 22 nt, Human
uuuggcucuaguaaauauaacc

SEQ ID NO: 33598 - RNA, 19 nt, Human
uuuggcucuggucagagag

SEQ ID NO: 33599 - RNA, 22 nt, Human
uuuggcucugugucuucaccca

SEQ ID NO: 33600 - RNA, 21 nt, Human
uuuggcuucucugcugcagcc

SEQ ID NO: 33601 - RNA, 22 nt, Human
uuugggaaauaguagaaaaugu

SEQ ID NO: 33602 - RNA, 22 nt, Human
uuugggaacaaugaggaucuga

SEQ ID NO: 33603 - RNA, 22 nt, Human
uuugggcacacaaauauuuuau

SEQ ID NO: 33604 - RNA, 20 nt, Human
uuugggcacggcuagauuuu

SEQ ID NO: 33605 - RNA, 22 nt, Human
uuugggcagugggcuuagcggc

SEQ ID NO: 33606 - RNA, 22 nt, Human
uuugggcauuagaauauucuuu

SEQ ID NO: 33607 - RNA, 22 nt, Human
uuugggcuguacaauuucugua

SEQ ID NO: 33608 - RNA, 22 nt, Human
uuuggggagacauggccagcug

SEQ ID NO: 33609 - RNA, 22 nt, Human
uuugguaaaaugaacuagcuuu

SEQ ID NO: 33610 - RNA, 22 nt, Human
uuugguaaccuugcauucuuua

SEQ ID NO: 33611 - RNA, 22 nt, Human
uuugguaaguaugaaugcagua

SEQ ID NO: 33612 - RNA, 22 nt, Human
uuuggucuuggauuuaucagug

SEQ ID NO: 33613 - RNA, 22 nt, Human
uuugguuaaacgagagaacaua

SEQ ID NO: 33614 - RNA, 22 nt, Human
uuugguuugaaugagcauaaga

SEQ ID NO: 33615 - RNA, 22 nt, Human
uuuguaaaagcccaagcuguag

SEQ ID NO: 33616 - RNA, 22 nt, Human
uuuguaacaaguugaucuggua

SEQ ID NO: 33617 - RNA, 22 nt, Human
uuuguaacucucccuuuguaua

SEQ ID NO: 33618 - RNA, 19 nt, Human
uuuguaaguccuuacugau

SEQ ID NO: 33619 - RNA, 22 nt, Human
uuuguacacaaccugugguagu

SEQ ID NO: 33620 - RNA, 22 nt, Human
uuuguacaccuaccuaauacag

SEQ ID NO: 33621 - RNA, 22 nt, Human
uuuguacauauaaaucuuguau

SEQ ID NO: 33622 - RNA, 18 nt, Human
uuuguacccuuuuccuag

SEQ ID NO: 33623 - RNA, 22 nt, Human
uuuguagaacuauacuuacauu

SEQ ID NO: 33624 - RNA, 22 nt, Human
uuuguagaggguaauugacaga

SEQ ID NO: 33625 - RNA, 22 nt, Human
uuuguauaaaugaagaugcugg

SEQ ID NO: 33626 - RNA, 22 nt, Human
cccaguggagauaggagugugg

SEQ ID NO: 33627 - RNA, 22 nt, Human
cccaguggggaaauagcuagcu

SEQ ID NO: 33628 - RNA, 22 nt, Human
cccagugucaccaacaggacac

SEQ ID NO: 33629 - RNA, 20 nt, Human
cccaguguccagccuugcca

SEQ ID NO: 33630 - RNA, 22 nt, Human
cccagugugguucuuuggagaa

SEQ ID NO: 33631 - RNA, 22 nt, Human
cccaguuucaacuuuccagugg

SEQ ID NO: 33632 - RNA, 22 nt, Human
cccaucccugauuuucacucgu

SEQ ID NO: 33633 - RNA, 17 nt, Human
cccaugagcccacuccc

SEQ ID NO: 33634 - RNA, 22 nt, Human
cccaugcacccucuaagaagga

SEQ ID NO: 33635 - RNA, 22 nt, Human
cccauggagugccugagggcca

SEQ ID NO: 33636 - RNA, 22 nt, Human
cccauggggacaccaugaagga

SEQ ID NO: 33637 - RNA, 22 nt, Human
cccauucauccucgcuuccuuc

SEQ ID NO: 33638 - RNA, 22 nt, Human
cccauuuagaguauaagagaga

SEQ ID NO: 33639 - RNA, 22 nt, Human
cccauuuagauaacaguucaaa

SEQ ID NO: 33640 - RNA, 23 nt, Human
cccauuuagcggaugagggaagu

SEQ ID NO: 33641 - RNA, 22 nt, Human
cccauuuaugacuacacaggug

SEQ ID NO: 33642 - RNA, 22 nt, Human
cccauuuugcuuaugcugcugu

SEQ ID NO: 33643 - RNA, 22 nt, Human
cccauuuuugugugaguaauga

SEQ ID NO: 33644 - RNA, 22 nt, Human
ccccaaaacuuagugacuuaaa

SEQ ID NO: 33645 - RNA, 22 nt, Human
ccccaaaacuuggugacuucca

SEQ ID NO: 33646 - RNA, 20 nt, Human
ccccacacuauugagcacuu

SEQ ID NO: 33647 - RNA, 22 nt, Human
ccccacagcuuguggagagaau

SEQ ID NO: 33648 - RNA, 22 nt, Human
ccccacaggugucugaggcagg

SEQ ID NO: 33649 - RNA, 22 nt, Human
ccccaccauguagaaacugaga

SEQ ID NO: 33650 - RNA, 22 nt, Human
ccccaccugugcgucugccgca

SEQ ID NO: 33651 - RNA, 22 nt, Human
ccccagagaaagucagcagcau

SEQ ID NO: 33652 - RNA, 22 nt, Human
ccccagagagcaccaugaagcc

SEQ ID NO: 33653 - RNA, 22 nt, Human
ccccagcacaggcuccucagau

SEQ ID NO: 33654 - RNA, 21 nt, Human
ccccagcaccuugccagccug

SEQ ID NO: 33655 - RNA, 22 nt, Human
ccccagcacucugacucuuacc

SEQ ID NO: 33656 - RNA, 22 nt, Human
ccccagcccacaagcauauuaa

SEQ ID NO: 33657 - RNA, 22 nt, Human
ccccaggagcuuguuuuagaga

SEQ ID NO: 33658 - RNA, 22 nt, Human
cccccaccugaggacagucuua

SEQ ID NO: 33659 - RNA, 22 nt, Human
cccccagucugaacagcagcug

SEQ ID NO: 33660 - RNA, 22 nt, Human
ccccgcgcguugucccgcaggu

SEQ ID NO: 33661 - RNA, 22 nt, Human
ccccucauaggucagacacgca

SEQ ID NO: 33662 - RNA, 22 nt, Human
ccccucauucauguccuugcuu

SEQ ID NO: 33663 - RNA, 23 nt, Human
ccccucugguggcucagcuccug

SEQ ID NO: 33664 - RNA, 22 nt, Human
ccucuguaagccuuagucuaga

SEQ ID NO: 33665 - RNA, 22 nt, Human
ccucuguacagccucuuuauug

SEQ ID NO: 33666 - RNA, 22 nt, Human
ccucugugacuucuaccuucac

SEQ ID NO: 33667 - RNA, 22 nt, Human
ccucugugucagggaagagacu

SEQ ID NO: 33668 - RNA, 22 nt, Human
ccucuucaccucgggcacacug

SEQ ID NO: 33669 - RNA, 22 nt, Human
ccucuuccacugggccccaucc

SEQ ID NO: 33670 - RNA, 22 nt, Human
ccucuuccugcacugacauuuu

SEQ ID NO: 33671 - RNA, 22 nt, Human
ccucuuccuucucacuguggaa

SEQ ID NO: 33672 - RNA, 19 nt, Human
ccucuucucuggcagcaga

SEQ ID NO: 33673 - RNA, 22 nt, Human
ccucuucugcuucaggagcacu

SEQ ID NO: 33674 - RNA, 22 nt, Human
ccucuuggagucuaucauucug

SEQ ID NO: 33675 - RNA, 22 nt, Human
ccucuuuaaucccauccaugug

SEQ ID NO: 33676 - RNA, 22 nt, Human
ccucuuugagauucaguuuucc

SEQ ID NO: 33677 - RNA, 22 nt, Human
ccugaaacaucuucuguaaaua

SEQ ID NO: 33678 - RNA, 22 nt, Human
ccugaaaugaguucugcucacu

SEQ ID NO: 33679 - RNA, 21 nt, Human
ccugaaauucucacuagcuua

SEQ ID NO: 33680 - RNA, 22 nt, Human
ccugaacagucugaaaggagac

SEQ ID NO: 33681 - RNA, 22 nt, Human
ccugaacucuaaauagagcagu

SEQ ID NO: 33682 - RNA, 22 nt, Human
ccugaagaugcuguggccuggu

SEQ ID NO: 33683 - RNA, 23 nt, Human
ccugaagggucaggguccucagc

SEQ ID NO: 33684 - RNA, 22 nt, Human
ccugacagugguagccuuggca

SEQ ID NO: 33685 - RNA, 22 nt, Human
ccugaccaacguggugaaaccc

SEQ ID NO: 33686 - RNA, 19 nt, Human
ccugaccacacaggccuug

SEQ ID NO: 33687 - RNA, 22 nt, Human
ccugaccacccuuggacaaggu

SEQ ID NO: 33688 - RNA, 22 nt, Human
ccugacuagcugggacuacaga

SEQ ID NO: 33689 - RNA, 22 nt, Human
ccugacucuggccaggccagcu

SEQ ID NO: 33690 - RNA, 22 nt, Human
ccugacuuaagucuccuguugg

SEQ ID NO: 33691 - RNA, 22 nt, Human
ccugagaauaauucuccauagc

SEQ ID NO: 33692 - RNA, 22 nt, Human
ccugagaauguuuaacagagaa

SEQ ID NO: 33693 - RNA, 22 nt, Human
ccugagagagaagcgaccuggu

SEQ ID NO: 33694 - RNA, 22 nt, Human
ccugagagcauuccacacugaa

SEQ ID NO: 33695 - RNA, 22 nt, Human
ccugagagcccuagccaggcgc

SEQ ID NO: 33696 - RNA, 22 nt, Human
ccugagagguuggccuguccag

SEQ ID NO: 33697 - RNA, 22 nt, Human
ccugagagugcgugccuccuua

SEQ ID NO: 33698 - RNA, 22 nt, Human
ccugagauuucauugucuggcc

SEQ ID NO: 33699 - RNA, 22 nt, Human
ccugagcacaagggagcuuuga

SEQ ID NO: 33700 - RNA, 22 nt, Human
ccugagcagggcucugcagggc

SEQ ID NO: 33701 - RNA, 22 nt, Human
ccugagccaagagucagaaucu

SEQ ID NO: 33702 - RNA, 22 nt, Human
ccugagcuccaguagcagccag

SEQ ID NO: 33703 - RNA, 22 nt, Human
ccugagcugaacuaagcaguuu

SEQ ID NO: 33704 - RNA, 22 nt, Human
ccugagcuuuaaaagccaugua

SEQ ID NO: 33705 - RNA, 19 nt, Human
ccugaggaaaagaugauug

SEQ ID NO: 33706 - RNA, 22 nt, Human
ccugaggacacacgcugcagga

SEQ ID NO: 33707 - RNA, 22 nt, Human
ccugaggcaaggacuugguggc

SEQ ID NO: 33708 - RNA, 22 nt, Human
ccugaggcuccaccuccagaga

SEQ ID NO: 33709 - RNA, 22 nt, Human
ccugaggcuugggaguuccgcc

SEQ ID NO: 33710 - RNA, 22 nt, Human
ccugagggaacaugcacccaau

SEQ ID NO: 33711 - RNA, 22 nt, Human
ccugagggaaggaugcuaccca

SEQ ID NO: 33712 - RNA, 22 nt, Human
ccugagggcgccgagcucccag

SEQ ID NO: 33713 - RNA, 22 nt, Human
ccugaggucagccauucuugcc

SEQ ID NO: 33714 - RNA, 22 nt, Human
ccugagguuauccaucuaccug

SEQ ID NO: 33715 - RNA, 22 nt, Human
ccugaguagcuggaauuaaagg

SEQ ID NO: 33716 - RNA, 22 nt, Human
ccugaguggcaggguuugggcu

SEQ ID NO: 33717 - RNA, 22 nt, Human
ccugaguggccaggcagcugug

SEQ ID NO: 33718 - RNA, 22 nt, Human
ccugaguggggagcuaagugag

SEQ ID NO: 33719 - RNA, 19 nt, Human
ccugaguguuucagagaca

SEQ ID NO: 33720 - RNA, 22 nt, Human
ccugaguugucaguugcuguag

SEQ ID NO: 33721 - RNA, 22 nt, Human
ccugaucaaagaggucagcauu

SEQ ID NO: 33722 - RNA, 22 nt, Human
ccugauggagcccugcugcaug

SEQ ID NO: 33723 - RNA, 19 nt, Human
ccugauggagcuggugcaa

SEQ ID NO: 33724 - RNA, 22 nt, Human
ccugaugguauauuguugggag

SEQ ID NO: 33725 - RNA, 22 nt, Human
ccugauuauuguaaauauauuu

SEQ ID NO: 33726 - RNA, 22 nt, Human
ccugcaagaccugagacacacc

SEQ ID NO: 33727 - RNA, 22 nt, Human
ccugcacaggccaggcaucuga

SEQ ID NO: 33728 - RNA, 22 nt, Human
ccugcacaugugugcgccugua

SEQ ID NO: 33729 - RNA, 22 nt, Human
ccugcacccaggccgcaccucu

SEQ ID NO: 33730 - RNA, 22 nt, Human
ccugcaccuaacacaacgcucu

SEQ ID NO: 33731 - RNA, 22 nt, Human
ccugcaccugagcagccugacu

SEQ ID NO: 33732 - RNA, 22 nt, Human
ccugcaccugccaugugagaua

SEQ ID NO: 33733 - RNA, 22 nt, Human
ccugcagaagaguccagcucau

SEQ ID NO: 33734 - RNA, 22 nt, Human
ccugcagacacuuguccagcaa

SEQ ID NO: 33735 - RNA, 22 nt, Human
gagcucugaaaaagcuugccuu

SEQ ID NO: 33736 - RNA, 23 nt, Human
gagcucugcacuaggcccuggga

SEQ ID NO: 33737 - RNA, 22 nt, Human
gagcucugccauggcucccacc

SEQ ID NO: 33738 - RNA, 22 nt, Human
gagcucugcggaaaacgugccg

SEQ ID NO: 33739 - RNA, 22 nt, Human
gagcucugcuuggguucuuagg

SEQ ID NO: 33740 - RNA, 22 nt, Human
gagcucuggcagggcaggucug

SEQ ID NO: 33741 - RNA, 22 nt, Human
gagcucuggguguguugucagu

SEQ ID NO: 33742 - RNA, 22 nt, Human
gagcucuguucucguccugcug

SEQ ID NO: 33743 - RNA, 22 nt, Human
gagcucuuccccaucuuacauc

SEQ ID NO: 33744 - RNA, 22 nt, Human
gagcucuuuaccaggucaggac

SEQ ID NO: 33745 - RNA, 22 nt, Human
gagcugaacaaauugcgagugg

SEQ ID NO: 33746 - RNA, 22 nt, Human
gagcugaagaugucagaaccgu

SEQ ID NO: 33747 - RNA, 22 nt, Human
gagcugaauugaagcaaggagc

SEQ ID NO: 33748 - RNA, 22 nt, Human
gagcugagaucgugccauugca

SEQ ID NO: 33749 - RNA, 22 nt, Human
gagcugagauuugaagcaaguu

SEQ ID NO: 33750 - RNA, 22 nt, Human
gagcugagcagggagccucacu

SEQ ID NO: 33751 - RNA, 22 nt, Human
gagcugaggcugaggccucacu

SEQ ID NO: 33752 - RNA, 22 nt, Human
gagcugaguaucccacugaagu

SEQ ID NO: 33753 - RNA, 21 nt, Human
gagcugcaccuugaccuguuu

SEQ ID NO: 33754 - RNA, 22 nt, Human
gagcugcacgcagcauccaaga

SEQ ID NO: 33755 - RNA, 22 nt, Human
gagcugcagacuugauacagga

SEQ ID NO: 33756 - RNA, 22 nt, Human
gagcugcagagcucgaaggaac

SEQ ID NO: 33757 - RNA, 22 nt, Human
gagcugcagcggcugacgcaac

SEQ ID NO: 33758 - RNA, 22 nt, Human
gagcugcccugagcuuugcaug

SEQ ID NO: 33759 - RNA, 22 nt, Human
gagcugccugugugccaugaug

SEQ ID NO: 33760 - RNA, 19 nt, Human
gagcugccuuuugaagacc

SEQ ID NO: 33761 - RNA, 22 nt, Human
gagcugcuggcuccucagguua

SEQ ID NO: 33762 - RNA, 22 nt, Human
gagcuggaggcagugcugaggu

SEQ ID NO: 33763 - RNA, 22 nt, Human
gagcuggcaagucuguccuugg

SEQ ID NO: 33764 - RNA, 22 nt, Human
gagcuggcagugguagacaugg

SEQ ID NO: 33765 - RNA, 22 nt, Human
gagcuggcuaauacugacuuau

SEQ ID NO: 33766 - RNA, 22 nt, Human
gagcuggcuccgccaugcugcu

SEQ ID NO: 33767 - RNA, 22 nt, Human
gagcugggaguuauagcauguu

SEQ ID NO: 33768 - RNA, 22 nt, Human
gagcugggauuugaaccuggga

SEQ ID NO: 33769 - RNA, 22 nt, Human
gagcugggcgagccggggaagu

SEQ ID NO: 33770 - RNA, 21 nt, Human
gagcugggcgaggcuccgggg

SEQ ID NO: 33771 - RNA, 22 nt, Human
gagcugggcuggcuuccucccu

SEQ ID NO: 33772 - RNA, 22 nt, Human
gagcugggucuccaccuuggca

SEQ ID NO: 33773 - RNA, 22 nt, Human
gagcugguuuuaggcuaugucu

SEQ ID NO: 33774 - RNA, 20 nt, Human
gagcugugcucucaggagcc

SEQ ID NO: 33775 - RNA, 22 nt, Human
gagcuguggaaggcagggacca

SEQ ID NO: 33776 - RNA, 22 nt, Human
gagcugugugccuggauggucu

SEQ ID NO: 33777 - RNA, 22 nt, Human
gagcuguucaaggacaggcacg

SEQ ID NO: 33778 - RNA, 22 nt, Human
gagcuguuuuuccaaacuauug

SEQ ID NO: 33779 - RNA, 22 nt, Human
gagcuucagaauuuaacagacu

SEQ ID NO: 33780 - RNA, 22 nt, Human
gagcuuccacucuagaaggagu

SEQ ID NO: 33781 - RNA, 22 nt, Human
gagcuuccauccuuacugugug

SEQ ID NO: 33782 - RNA, 22 nt, Human
gagcuuccugaugccgaccagu

SEQ ID NO: 33783 - RNA, 22 nt, Human
gagcuuccuuuuucugcaugac

SEQ ID NO: 33784 - RNA, 22 nt, Human
gagcuuggacaccuuggcaggu

SEQ ID NO: 33785 - RNA, 22 nt, Human
gagcuuggugaugccuccuggu

SEQ ID NO: 33786 - RNA, 22 nt, Human
gagcuuuaagggcacuggucuu

SEQ ID NO: 33787 - RNA, 22 nt, Human
gagcuuuaccuuagguucuguu

SEQ ID NO: 33788 - RNA, 22 nt, Human
gagcuuugagauucuuauggua

SEQ ID NO: 33789 - RNA, 22 nt, Human
gagcuuuggugccaaguauuug

SEQ ID NO: 33790 - RNA, 22 nt, Human
gagcuuuuacugcuguauugaa

SEQ ID NO: 33791 - RNA, 22 nt, Human
gagcuuuugugggggccaaggu

SEQ ID NO: 33792 - RNA, 22 nt, Human
gaggaaaauauucagggagguu

SEQ ID NO: 33793 - RNA, 22 nt, Human
gaggaaacauuguagaagcagu

SEQ ID NO: 33794 - RNA, 22 nt, Human
gaggaacagagacgggaucgcu

SEQ ID NO: 33795 - RNA, 22 nt, Human
gaggaacagcagccacaugucc

SEQ ID NO: 33796 - RNA, 22 nt, Human
gaggaaccacucugagaagcca

SEQ ID NO: 33797 - RNA, 22 nt, Human
gaggaacccagcugggguugcc

SEQ ID NO: 33798 - RNA, 22 nt, Human
gaggaaccugggcuuccauccu

SEQ ID NO: 33799 - RNA, 19 nt, Human
gaggaacuggcuugguucc

SEQ ID NO: 33800 - RNA, 22 nt, Human
gaggaacuuaugauauucuacu

SEQ ID NO: 33801 - RNA, 22 nt, Human
gaggaagagcauggccaguuuc

SEQ ID NO: 33802 - RNA, 22 nt, Human
gaggaagcagggcuuggcugag

SEQ ID NO: 33803 - RNA, 22 nt, Human
ccugcccacacagcaauuuuaa

SEQ ID NO: 33804 - RNA, 23 nt, Human
ccugcccaggaauccggcggcgu

SEQ ID NO: 33805 - RNA, 22 nt, Human
ccugcccagggucaccacagag

SEQ ID NO: 33806 - RNA, 22 nt, Human
ccugcccauacugaccucuaau

SEQ ID NO: 33807 - RNA, 22 nt, Human
ccugcccccgucagaggugaug

SEQ ID NO: 33808 - RNA, 22 nt, Human
ccugcccuaauccagagacuag

SEQ ID NO: 33809 - RNA, 22 nt, Human
ccugcccugucacuggcuaggg

SEQ ID NO: 33810 - RNA, 22 nt, Human
ccugccucaggacucugcauau

SEQ ID NO: 33811 - RNA, 22 nt, Human
ccugccugacagagaagguuca

SEQ ID NO: 33812 - RNA, 19 nt, Human
ccugccugaccccggcuac

SEQ ID NO: 33813 - RNA, 22 nt, Human
ccugccugcagaaaguaucucc

SEQ ID NO: 33814 - RNA, 22 nt, Human
ccugccugccugcuggccggga

SEQ ID NO: 33815 - RNA, 22 nt, Human
ccugccugcuuucugcuuugca

SEQ ID NO: 33816 - RNA, 22 nt, Human
ccugccuggcuuccagaagaga

SEQ ID NO: 33817 - RNA, 22 nt, Human
ccugccuguaagauggguacaa

SEQ ID NO: 33818 - RNA, 22 nt, Human
ccugccugucuuuauccccugu

SEQ ID NO: 33819 - RNA, 20 nt, Human
ccugccuguguuugugauga

SEQ ID NO: 33820 - RNA, 22 nt, Human
ccugcguccacggcugggagac

SEQ ID NO: 33821 - RNA, 19 nt, Human
ccugcugaagugaugcagc

SEQ ID NO: 33822 - RNA, 20 nt, Human
ccugcugagccagugugagg

SEQ ID NO: 33823 - RNA, 22 nt, Human
ccugcugaggucagccacccaa

SEQ ID NO: 33824 - RNA, 22 nt, Human
ccugcuggacguggaggagggg

SEQ ID NO: 33825 - RNA, 22 nt, Human
ccugcuggccacugcuccaccu

SEQ ID NO: 33826 - RNA, 22 nt, Human
ccugcugguguccaggcuuugg

SEQ ID NO: 33827 - RNA, 22 nt, Human
ccugcugguuuuuacaaagaug

SEQ ID NO: 33828 - RNA, 22 nt, Human
ccugcuguaaugugucuuuauu

SEQ ID NO: 33829 - RNA, 22 nt, Human
ccugcuguccccugagccugga

SEQ ID NO: 33830 - RNA, 22 nt, Human
ccugcugucucugggcaggcag

SEQ ID NO: 33831 - RNA, 22 nt, Human
ccugcugugaaacuggcauaug

SEQ ID NO: 33832 - RNA, 22 nt, Human
ccugcugugaagccaggccugu

SEQ ID NO: 33833 - RNA, 22 nt, Human
ccugcugugucccuggcuuucu

SEQ ID NO: 33834 - RNA, 22 nt, Human
ccugcuguuagauuucagucac

SEQ ID NO: 33835 - RNA, 20 nt, Human
ccugcuguuuccauggggcc

SEQ ID NO: 33836 - RNA, 22 nt, Human
ccugcuucagggaugauggcac

SEQ ID NO: 33837 - RNA, 22 nt, Human
ccugcuuccuucaaguuuaucu

SEQ ID NO: 33838 - RNA, 22 nt, Human
ccugcuuugagaugggcagcag

SEQ ID NO: 33839 - RNA, 22 nt, Human
ccuggaaaaugccacuuucaca

SEQ ID NO: 33840 - RNA, 22 nt, Human
ccuggaaacacaugaugaugaa

SEQ ID NO: 33841 - RNA, 22 nt, Human
ccuggaaagagaaugaaugagc

SEQ ID NO: 33842 - RNA, 22 nt, Human
ccuggaaaugucgcguguagaa

SEQ ID NO: 33843 - RNA, 20 nt, Human
ccuggaagagcuccccaggc

SEQ ID NO: 33844 - RNA, 22 nt, Human
gaggaugccugggucggggaag

SEQ ID NO: 33845 - RNA, 22 nt, Human
gaggaugguaugaggcaagcaa

SEQ ID NO: 33846 - RNA, 22 nt, Human
gaggauguccacauggacggug

SEQ ID NO: 33847 - RNA, 22 nt, Human
gaggaugugucuggucugggca

SEQ ID NO: 33848 - RNA, 22 nt, Human
gaggcaacacauuuggaaagca

SEQ ID NO: 33849 - RNA, 22 nt, Human
gaggcacaauacaugucucaag

SEQ ID NO: 33850 - RNA, 22 nt, Human
gaggcacagaguaggugcacac

SEQ ID NO: 33851 - RNA, 22 nt, Human
gaggcacagucccgaggcaagg

SEQ ID NO: 33852 - RNA, 22 nt, Human
gaggcacaguucuuccuccaga

SEQ ID NO: 33853 - RNA, 22 nt, Human
gaggcacauauauacagagccc

SEQ ID NO: 33854 - RNA, 22 nt, Human
gaggcaccagccccgcuagccu

SEQ ID NO: 33855 - RNA, 22 nt, Human
gaggcaccucgcgggaggaggc

SEQ ID NO: 33856 - RNA, 22 nt, Human
gaggcagaaguugcagugagca

SEQ ID NO: 33857 - RNA, 22 nt, Human
gaggcagcagggcugguuccuu

SEQ ID NO: 33858 - RNA, 22 nt, Human
gaggcagcggcucacagagaaa

SEQ ID NO: 33859 - RNA, 18 nt, Human
gaggcagcuagcaauuuu

SEQ ID NO: 33860 - RNA, 22 nt, Human
gaggcagcugaagcuucaaaga

SEQ ID NO: 33861 - RNA, 22 nt, Human
gaggcagcuuggggcugugggu

SEQ ID NO: 33862 - RNA, 22 nt, Human
gaggcaggcagauugcuugagg

SEQ ID NO: 33863 - RNA, 22 nt, Human
gaggcagugaacaauuccugug

SEQ ID NO: 33864 - RNA, 22 nt, Human
gaggcaguguugaaaaggagag

SEQ ID NO: 33865 - RNA, 22 nt, Human
gaggcaugucuggccuguccca

SEQ ID NO: 33866 - RNA, 22 nt, Human
gaggccacaguccugaggcauc

SEQ ID NO: 33867 - RNA, 22 nt, Human
gaggccacggaagggagcugug

SEQ ID NO: 33868 - RNA, 22 nt, Human
gaggccagccccucuugaaggc

SEQ ID NO: 33869 - RNA, 22 nt, Human
gaggccaggaagcccaagauca

SEQ ID NO: 33870 - RNA, 22 nt, Human
gaggccaggacaugaaagcuga

SEQ ID NO: 33871 - RNA, 22 nt, Human
gaggccaggaggaucucucuaa

SEQ ID NO: 33872 - RNA, 22 nt, Human
gaggccaggagugcuguaaguu

SEQ ID NO: 33873 - RNA, 15 nt, Human
gaggccaggcaugug

SEQ ID NO: 33874 - RNA, 22 nt, Human
gaggccaggggucagcaauugg

SEQ ID NO: 33875 - RNA, 22 nt, Human
gaggcccaggucaagcagccac

SEQ ID NO: 33876 - RNA, 20 nt, Human
gaggccucagccucagcucc

SEQ ID NO: 33877 - RNA, 22 nt, Human
gaggccucugucccgccaggga

SEQ ID NO: 33878 - RNA, 23 nt, Human
gaggccuggcccugccacaucuc

SEQ ID NO: 33879 - RNA, 22 nt, Human
gaggccuggcugucagucccca

SEQ ID NO: 33880 - RNA, 22 nt, Human
gaggccugggagccuguccucc

SEQ ID NO: 33881 - RNA, 22 nt, Human
gaggccuggugcuguguccaca

SEQ ID NO: 33882 - RNA, 22 nt, Human
gaggccugguuuccagcauccu

SEQ ID NO: 33883 - RNA, 22 nt, Human
gaggccuguagucauggaugua

SEQ ID NO: 33884 - RNA, 22 nt, Human
gaggccuugggaugugccacgg

SEQ ID NO: 33885 - RNA, 22 nt, Human
gaggcuaagcacuggcauuucu

SEQ ID NO: 33886 - RNA, 22 nt, Human
gaggcuaaguaacuguccaugg

SEQ ID NO: 33887 - RNA, 22 nt, Human
gaggcuagauguuugcugggag

SEQ ID NO: 33888 - RNA, 22 nt, Human
gaggcucaaaccuggacagagc

SEQ ID NO: 33889 - RNA, 22 nt, Human
gaggcucaacccacagggguug

SEQ ID NO: 33890 - RNA, 22 nt, Human
gaggcucacgacgggacgaacu

SEQ ID NO: 33891 - RNA, 22 nt, Human
gaggcucacugggcaaagacuc

SEQ ID NO: 33892 - RNA, 22 nt, Human
gaggcucagagaagucauggua

SEQ ID NO: 33893 - RNA, 22 nt, Human
gaggcucagagacuuuaaguuu

SEQ ID NO: 33894 - RNA, 22 nt, Human
gaggcucagagagguccacaua

SEQ ID NO: 33895 - RNA, 22 nt, Human
gaggcucagagggagcaugguc

SEQ ID NO: 33896 - RNA, 22 nt, Human
gaggcucaguuauuuuagccug

SEQ ID NO: 33897 - RNA, 22 nt, Human
gaggcuccccaugaggccccag

SEQ ID NO: 33898 - RNA, 22 nt, Human
gaggcuccuccuuacauuuacc

SEQ ID NO: 33899 - RNA, 22 nt, Human
gaggcuccuugaaagggggacu

SEQ ID NO: 33900 - RNA, 22 nt, Human
gaggcucugugaugugccaggc

SEQ ID NO: 33901 - RNA, 22 nt, Human
gaggcucuucaauaggucaaug

SEQ ID NO: 33902 - RNA, 22 nt, Human
gaggcucuuucuuuggacuuca

SEQ ID NO: 33903 - RNA, 22 nt, Human
gaggcugaacagguucucauga

SEQ ID NO: 33904 - RNA, 22 nt, Human
gaggcugaaguguacaugggug

SEQ ID NO: 33905 - RNA, 22 nt, Human
gaggcugaauggccagaagcca

SEQ ID NO: 33906 - RNA, 22 nt, Human
gaggcugcaggcaaugcugccc

SEQ ID NO: 33907 - RNA, 22 nt, Human
gaggcugcauucuucccacugc

SEQ ID NO: 33908 - RNA, 22 nt, Human
gaggcugccccuuccucagcug

SEQ ID NO: 33909 - RNA, 22 nt, Human
gaggcugcugccaucauuaggu

SEQ ID NO: 33910 - RNA, 22 nt, Human
gaggcugcuguuagcccugggc

SEQ ID NO: 33911 - RNA, 22 nt, Human
gaggcuggacgugcauuucuac

SEQ ID NO: 33912 - RNA, 22 nt, Human
gaggcuggagauauuccaaucu

SEQ ID NO: 33913 - RNA, 22 nt, Human
gaggcuguaacuugggcacugg

SEQ ID NO: 33914 - RNA, 22 nt, Human
gaggcugugugucccucuggac

SEQ ID NO: 33915 - RNA, 22 nt, Human
gaggcuguuaggagggacucug

SEQ ID NO: 33916 - RNA, 22 nt, Human
gaggcuguuggcugaucugagu

SEQ ID NO: 33917 - RNA, 22 nt, Human
gaggcuuuauaacuauuuguuc

SEQ ID NO: 33918 - RNA, 22 nt, Human
gaggcuuugguuauaaaagauc

SEQ ID NO: 33919 - RNA, 22 nt, Human
gaggcuuuucucuaaauagugg

SEQ ID NO: 33920 - RNA, 22 nt, Human
gagggaagaggguuugaauuca

SEQ ID NO: 33921 - RNA, 22 nt, Human
gagggaaggacccauuuuaagu

SEQ ID NO: 33922 - RNA, 22 nt, Human
gagggaaggucacccuuguagc

SEQ ID NO: 33923 - RNA, 22 nt, Human
cgggcagauugggaagguucau

SEQ ID NO: 33924 - RNA, 21 nt, Human
cgggcuggccgggcccucacc

SEQ ID NO: 33925 - RNA, 22 nt, Human
cgggcuuccuccagggaagugc

SEQ ID NO: 33926 - RNA, 22 nt, Human
cggggagggcagaggcucccuc

SEQ ID NO: 33927 - RNA, 22 nt, Human
cggggcagagggucuucuccag

SEQ ID NO: 33928 - RNA, 22 nt, Human
cggggccucaguuuccccaccu

SEQ ID NO: 33929 - RNA, 22 nt, Human
cggggcugacagcaggugugcu

SEQ ID NO: 33930 - RNA, 22 nt, Human
cggggcugaggcaacgcggaga

SEQ ID NO: 33931 - RNA, 22 nt, Human
cggggcugcgcucuuccugccg

SEQ ID NO: 33932 - RNA, 22 nt, Human
cggggcuguagcacagcugagc

SEQ ID NO: 33933 - RNA, 22 nt, Human
cgggguggcacucuaaauagaa

SEQ ID NO: 33934 - RNA, 22 nt, Human
cgguaaggucugagacaacacc

SEQ ID NO: 33935 - RNA, 22 nt, Human
cggucugagagcaggagaaggg

SEQ ID NO: 33936 - RNA, 22 nt, Human
cggucugaucuggaaauagggc

SEQ ID NO: 33937 - RNA, 20 nt, Human
cguaaggcaagugcugcauc

SEQ ID NO: 33938 - RNA, 19 nt, Human
cguaccugacacagaacag

SEQ ID NO: 33939 - RNA, 22 nt, Human
cguaucaaagcaaaacauauuu

SEQ ID NO: 33940 - RNA, 22 nt, Human
cguaugaaauuuuugacauuug

SEQ ID NO: 33941 - RNA, 22 nt, Human
cguauuuagaaggcugcugaaa

SEQ ID NO: 33942 - RNA, 22 nt, Human
cgucauccuuuggaugaaucac

SEQ ID NO: 33943 - RNA, 22 nt, Human
cguccauauuccugagggcuca

SEQ ID NO: 33944 - RNA, 22 nt, Human
cgucccaguuccagccgcgcug

SEQ ID NO: 33945 - RNA, 22 nt, Human
cguccccucguucccacuuugg

SEQ ID NO: 33946 - RNA, 22 nt, Human
cgucuagacaguuuccaaaaga

SEQ ID NO: 33947 - RNA, 18 nt, Human
cgugaguggaggcugcgg

SEQ ID NO: 33948 - RNA, 22 nt, Human
cgugaugcucaggaggucauag

SEQ ID NO: 33949 - RNA, 22 nt, Human
cgugcagcggagcuggucacug

SEQ ID NO: 33950 - RNA, 22 nt, Human
cgugcucuggacucguggcaca

SEQ ID NO: 33951 - RNA, 20 nt, Human
cgugcugugaccuugagcau

SEQ ID NO: 33952 - RNA, 22 nt, Human
cguggcaguggaaggcugggug

SEQ ID NO: 33953 - RNA, 21 nt, Human
cuagagugggaccggagucua

SEQ ID NO: 33954 - RNA, 23 nt, Human
cuagaugcaagcuccaugaggga

SEQ ID NO: 33955 - RNA, 22 nt, Human
cuagauucauauauuuuuggag

SEQ ID NO: 33956 - RNA, 22 nt, Human
cuagcacuuagggauuguuaug

SEQ ID NO: 33957 - RNA, 22 nt, Human
cuagcagaagcuccuugagggu

SEQ ID NO: 33958 - RNA, 22 nt, Human
cuagcagcaucacaggaagacu

SEQ ID NO: 33959 - RNA, 22 nt, Human
cuagcagcauucuucuaguuag

SEQ ID NO: 33960 - RNA, 22 nt, Human
cuagccaacaccuuauuuucug

SEQ ID NO: 33961 - RNA, 20 nt, Human
cuagccuggccuugcucugg

SEQ ID NO: 33962 - RNA, 22 nt, Human
cuagcuucaaguccuggcugug

SEQ ID NO: 33963 - RNA, 22 nt, Human
cuagcuuuguccauugucuugc

SEQ ID NO: 33964 - RNA, 22 nt, Human
cuaggaaagacacagagaguuu

SEQ ID NO: 33965 - RNA, 22 nt, Human
cuaggaauccuuuuagaguugg

SEQ ID NO: 33966 - RNA, 22 nt, Human
cuaggaaugguaccucuuacaa

SEQ ID NO: 33967 - RNA, 22 nt, Human
cuaggcacuuguaaggccgcuc

SEQ ID NO: 33968 - RNA, 22 nt, Human
cuaggcagauggagaaguggcu

SEQ ID NO: 33969 - RNA, 20 nt, Human
cuaggcagcgagugacugag

SEQ ID NO: 33970 - RNA, 22 nt, Human
cuaggccacagggcaaaaagga

SEQ ID NO: 33971 - RNA, 22 nt, Human
cuaggcugcagaugcauggaau

SEQ ID NO: 33972 - RNA, 22 nt, Human
cuagggcacuaggacucaugug

SEQ ID NO: 33973 - RNA, 22 nt, Human
cuagggcagggaguguuugcgc

SEQ ID NO: 33974 - RNA, 22 nt, Human
cuagggcuagacagacgcaugu

SEQ ID NO: 33975 - RNA, 18 nt, Human
cuagggcuguggcucuca

SEQ ID NO: 33976 - RNA, 22 nt, Human
cuaggggcaugaaauagagaau

SEQ ID NO: 33977 - RNA, 22 nt, Human
cuagguauucauguuucguggc

SEQ ID NO: 33978 - RNA, 22 nt, Human
cuaggugauccacugcucucuu

SEQ ID NO: 33979 - RNA, 22 nt, Human
cuaguagcccauuuuggauacc

SEQ ID NO: 33980 - RNA, 22 nt, Human
cuaguauuaagugugaguaaaa

SEQ ID NO: 33981 - RNA, 22 nt, Human
cuagucacacaguaaggacggg

SEQ ID NO: 33982 - RNA, 22 nt, Human
cuagucacucagcacugacaaa

SEQ ID NO: 33983 - RNA, 22 nt, Human
cuaguccacuguccugccucca

SEQ ID NO: 33984 - RNA, 20 nt, Human
cuagucucacaucccuggca

SEQ ID NO: 33985 - RNA, 22 nt, Human
cuagugagucugaaugaguugc

SEQ ID NO: 33986 - RNA, 22 nt, Human
cuaguguacaagugguggagau

SEQ ID NO: 33987 - RNA, 22 nt, Human
cuaguuaguucugggucauccu

SEQ ID NO: 33988 - RNA, 22 nt, Human
cuaguucuaaaucuguugucca

SEQ ID NO: 33989 - RNA, 22 nt, Human
cuaguucuccugaaauguuugg

SEQ ID NO: 33990 - RNA, 22 nt, Human
cuaguucugccauucaguguca

SEQ ID NO: 33991 - RNA, 22 nt, Human
cuaguugcucuccuuuaaaccu

SEQ ID NO: 33992 - RNA, 22 nt, Human
cuaguuuuaagcuccuugaggu

SEQ ID NO: 33993 - RNA, 22 nt, Human
cuauaaaucuacccagcauugg

SEQ ID NO: 33994 - RNA, 22 nt, Human
cuauacagagcauccuuaacuu

SEQ ID NO: 33995 - RNA, 22 nt, Human
cuauacagcagcuuacuaguua

SEQ ID NO: 33996 - RNA, 22 nt, Human
cuauacaucccaauuucagaga

SEQ ID NO: 33997 - RNA, 22 nt, Human
cuauacuacuauacagauguaa

SEQ ID NO: 33998 - RNA, 22 nt, Human
cuauagaaaauuguaucacacg

SEQ ID NO: 33999 - RNA, 22 nt, Human
cuauauauaucaucuuccaguu

SEQ ID NO: 34000 - RNA, 22 nt, Human
cuauaucaucauuaccugcacc

SEQ ID NO: 34001 - RNA, 22 nt, Human
cuauaucuacauuugcuguuug

SEQ ID NO: 34002 - RNA, 22 nt, Human
cuauccauuaaagccuuggaaa

SEQ ID NO: 34003 - RNA, 22 nt, Human
cuaucuguaaauuugagguucu

SEQ ID NO: 34004 - RNA, 22 nt, Human
cuaucuuucgauucuagcuuaa

SEQ ID NO: 34005 - RNA, 22 nt, Human
cuaugcaucugaacaauagaga

SEQ ID NO: 34006 - RNA, 22 nt, Human
cuauggaagggaugcaaagaaa

SEQ ID NO: 34007 - RNA, 22 nt, Human
cuauggcucaauucuagugguu

SEQ ID NO: 34008 - RNA, 22 nt, Human
cuauguaugcgauuagaauuuu

SEQ ID NO: 34009 - RNA, 18 nt, Human
cuauuacaaugcaguggu

SEQ ID NO: 34010 - RNA, 22 nt, Human
cuauuagaaagcaucuucuaua

SEQ ID NO: 34011 - RNA, 19 nt, Human
cuauuagcuugggcaucau

SEQ ID NO: 34012 - RNA, 22 nt, Human
cuauuaggcuuccauuucaugc

SEQ ID NO: 34013 - RNA, 22 nt, Human
cuauuauuagauaaucuacuug

SEQ ID NO: 34014 - RNA, 22 nt, Human
cuauucagccucuaagacaagu

SEQ ID NO: 34015 - RNA, 22 nt, Human
cuauucaguugugggcaacaau

SEQ ID NO: 34016 - RNA, 22 nt, Human
cuauucugauuaccagauauug

SEQ ID NO: 34017 - RNA, 22 nt, Human
cuauugaauagcccaaaucauu

SEQ ID NO: 34018 - RNA, 22 nt, Human
cuauugaauuaacuauuaaagu

SEQ ID NO: 34019 - RNA, 19 nt, Human
cuauugcacauagcugaag

SEQ ID NO: 34020 - RNA, 22 nt, Human
cuauugcauuugcaucuucauc

SEQ ID NO: 34021 - RNA, 22 nt, Human
cuauugcuaucauucugguggu

SEQ ID NO: 34022 - RNA, 22 nt, Human
cuauuguuauaauuguugacau

SEQ ID NO: 34023 - RNA, 22 nt, Human
cuauuuaagaauaaaaggggca

SEQ ID NO: 34024 - RNA, 22 nt, Human
cuauuuaugugcuauuuuguau

SEQ ID NO: 34025 - RNA, 22 nt, Human
cuauuuauuguggguauccagg

SEQ ID NO: 34026 - RNA, 22 nt, Human
cuauuucaaggcccagauauga

SEQ ID NO: 34027 - RNA, 22 nt, Human
cuauuucugccuaaugaccugu

SEQ ID NO: 34028 - RNA, 22 nt, Human
cuauuugaauugucacaggcua

SEQ ID NO: 34029 - RNA, 22 nt, Human
cuauuuggccagaagaggguca

SEQ ID NO: 34030 - RNA, 22 nt, Human
cuauuuguacagcauuaguaau

SEQ ID NO: 34031 - RNA, 22 nt, Human
cuauuuguacagcauucgaguu

SEQ ID NO: 34032 - RNA, 22 nt, Human
cuauuugucacaacugguguuu

SEQ ID NO: 34033 - RNA, 22 nt, Human
cuauuugucaguuuggcuuuaa

SEQ ID NO: 34034 - RNA, 22 nt, Human
cuauuuuaacuugauuaccucu

SEQ ID NO: 34035 - RNA, 22 nt, Human
cuauuuucauucuuacauuguc

SEQ ID NO: 34036 - RNA, 17 nt, Human
cuauuuuggagauuaaa

SEQ ID NO: 34037 - RNA, 22 nt, Human
cuauuuuguccuuagugcaggg

SEQ ID NO: 34038 - RNA, 22 nt, Human
cucaaaagacuuaaacauaaga

SEQ ID NO: 34039 - RNA, 22 nt, Human
cucaaaaugguuaauuuuaaua

SEQ ID NO: 34040 - RNA, 22 nt, Human
cucaaacugugcuuguaaauuc

SEQ ID NO: 34041 - RNA, 22 nt, Human
cucaagaagagggagaccuaca

SEQ ID NO: 34042 - RNA, 22 nt, Human
gaguccugcuuucaauucuuuu

SEQ ID NO: 34043 - RNA, 22 nt, Human
gaguccuuuucauagcaguggg

SEQ ID NO: 34044 - RNA, 22 nt, Human
gagucgagcagaaagccgucgg

SEQ ID NO: 34045 - RNA, 22 nt, Human
gagucuccuacuggcuguccuu

SEQ ID NO: 34046 - RNA, 22 nt, Human
gagucucugcuauguuuucucu

SEQ ID NO: 34047 - RNA, 22 nt, Human
gagucucuggaggggucagacc

SEQ ID NO: 34048 - RNA, 22 nt, Human
gagucugaggggagagcugggu

SEQ ID NO: 34049 - RNA, 22 nt, Human
gagucuggucauuuucucuccc

SEQ ID NO: 34050 - RNA, 22 nt, Human
gagucugugguauuuuaucaua

SEQ ID NO: 34051 - RNA, 22 nt, Human
gagucuucugaguuauuggaua

SEQ ID NO: 34052 - RNA, 22 nt, Human
gagugacaggaauauuuaucug

SEQ ID NO: 34053 - RNA, 22 nt, Human
gagugaguggccaggaggcaga

SEQ ID NO: 34054 - RNA, 22 nt, Human
gagugaguuggaaaacagacac

SEQ ID NO: 34055 - RNA, 22 nt, Human
gagugaugucuguagugaagaa

SEQ ID NO: 34056 - RNA, 22 nt, Human
gagugcaauaaacuguuuucua

SEQ ID NO: 34057 - RNA, 22 nt, Human
gagugcagaaauucccuuccug

SEQ ID NO: 34058 - RNA, 22 nt, Human
gagugcagaugaacagaagauu

SEQ ID NO: 34059 - RNA, 22 nt, Human
gagugcagaugccagccccagu

SEQ ID NO: 34060 - RNA, 21 nt, Human
gagugcagcaagguagagucu

SEQ ID NO: 34061 - RNA, 22 nt, Human
gagugcauggacuacuggcuug

SEQ ID NO: 34062 - RNA, 22 nt, Human
gauccguuugugugggaguauu

SEQ ID NO: 34063 - RNA, 22 nt, Human
gauccugucuccgcaccguguu

SEQ ID NO: 34064 - RNA, 22 nt, Human
gauccuugcacuugacuuggca

SEQ ID NO: 34065 - RNA, 22 nt, Human
gaucgauucagugugccuaccc

SEQ ID NO: 34066 - RNA, 22 nt, Human
gaucucaaagcaguguggguug

SEQ ID NO: 34067 - RNA, 22 nt, Human
gaucuccaucugcagugucugg

SEQ ID NO: 34068 - RNA, 22 nt, Human
gaucucugaaucugaagccuuc

SEQ ID NO: 34069 - RNA, 18 nt, Human
gaucucugcagugccuac

SEQ ID NO: 34070 - RNA, 22 nt, Human
gaucucuguggacucuuagcac

SEQ ID NO: 34071 - RNA, 22 nt, Human
gaucugaaaaugcucuucuucu

SEQ ID NO: 34072 - RNA, 22 nt, Human
gaucugaaauagcuacugcaga

SEQ ID NO: 34073 - RNA, 22 nt, Human
gaucugaaccuugccuguuggg

SEQ ID NO: 34074 - RNA, 22 nt, Human
gaucugaagaguuauuuucuga

SEQ ID NO: 34075 - RNA, 22 nt, Human
gaucugcacucugagaggcuug

SEQ ID NO: 34076 - RNA, 22 nt, Human
gaucuggaaucugaaggcugag

SEQ ID NO: 34077 - RNA, 22 nt, Human
gaucugguacaggccugcagcc

SEQ ID NO: 34078 - RNA, 22 nt, Human
gaucuguuucauucacagucug

SEQ ID NO: 34079 - RNA, 22 nt, Human
gaucuucucuuuaguagaaaca

SEQ ID NO: 34080 - RNA, 22 nt, Human
gaucuuggaauggcacagcuga

SEQ ID NO: 34081 - RNA, 21 nt, Human
gaucuuuacuuuccuacuuac

SEQ ID NO: 34082 - RNA, 22 nt, Human
gaucuuuucagucuugguaguu

SEQ ID NO: 34083 - RNA, 22 nt, Human
gaugaaauagaauuaauuuagg

SEQ ID NO: 34084 - RNA, 22 nt, Human
gaugaaaugcugagccugaguu

SEQ ID NO: 34085 - RNA, 22 nt, Human
gaugaacauauuccucuccaga

SEQ ID NO: 34086 - RNA, 22 nt, Human
gaugaacauuuaaagccucuug

SEQ ID NO: 34087 - RNA, 22 nt, Human
gaugaagaggcacugacauauu

SEQ ID NO: 34088 - RNA, 22 nt, Human
gaugaagcuauuugguuggcac

SEQ ID NO: 34089 - RNA, 22 nt, Human
gaugaaggggcuggugcccucu

SEQ ID NO: 34090 - RNA, 22 nt, Human
gaugacaaaacuuuugccagca

SEQ ID NO: 34091 - RNA, 22 nt, Human
gaugacaaaagaguaaguaaug

SEQ ID NO: 34092 - RNA, 22 nt, Human
gaugacacuaagcauguugugg

SEQ ID NO: 34093 - RNA, 22 nt, Human
gaugacaguucuagcaucugaa

SEQ ID NO: 34094 - RNA, 22 nt, Human
gaugagaaauggacaggagugg

SEQ ID NO: 34095 - RNA, 20 nt, Human
gaugagacccaugcaugaga

SEQ ID NO: 34096 - RNA, 22 nt, Human
gaugagcugugauuaauaagua

SEQ ID NO: 34097 - RNA, 22 nt, Human
gaugagggccugguggcugugc

SEQ ID NO: 34098 - RNA, 22 nt, Human
gaugaggggucauuggcuggga

SEQ ID NO: 34099 - RNA, 22 nt, Human
gaugaggucauguuuuacauau

SEQ ID NO: 34100 - RNA, 22 nt, Human
gaugagguuuuugaaaugugga

SEQ ID NO: 34101 - RNA, 22 nt, Human
gaugagugaggacaggguggca

SEQ ID NO: 34102 - RNA, 22 nt, Human
gaugauaacucuuuaugaugaa

SEQ ID NO: 34103 - RNA, 22 nt, Human
gaugauaagauggaguugaauu

SEQ ID NO: 34104 - RNA, 22 nt, Human
gaugauauauauggaaagccua

SEQ ID NO: 34105 - RNA, 22 nt, Human
gaugaucaucuguaaaguuaga

SEQ ID NO: 34106 - RNA, 22 nt, Human
gaugaucugagguacaugaaac

SEQ ID NO: 34107 - RNA, 22 nt, Human
gaugaugggauccagcaaugua

SEQ ID NO: 34108 - RNA, 22 nt, Human
gaugauuguuggcucucuugau

SEQ ID NO: 34109 - RNA, 22 nt, Human
gaugauuucuccauucccuucu

SEQ ID NO: 34110 - RNA, 22 nt, Human
gaugauuuuaugucuugucauu

SEQ ID NO: 34111 - RNA, 22 nt, Human
gaugcaaaccuuacauggaccu

SEQ ID NO: 34112 - RNA, 22 nt, Human
gaugcagggcagcucugggaca

SEQ ID NO: 34113 - RNA, 22 nt, Human
gaugcagggggaacgacgcccu

SEQ ID NO: 34114 - RNA, 22 nt, Human
gaugcauucgggauguuuacuu

SEQ ID NO: 34115 - RNA, 22 nt, Human
gaugcccaggcccaaccaugga

SEQ ID NO: 34116 - RNA, 22 nt, Human
gaugccuguggugagcacacau

SEQ ID NO: 34117 - RNA, 22 nt, Human
gaugcgggcccgcuccacugcc

SEQ ID NO: 34118 - RNA, 22 nt, Human
gaugcuccaaacagcaauucuu

SEQ ID NO: 34119 - RNA, 22 nt, Human
gaugcuccuuggugauagaaua

SEQ ID NO: 34120 - RNA, 22 nt, Human
gaugcugagagauuggagacua

SEQ ID NO: 34121 - RNA, 22 nt, Human
gaugcugauaauucaugagaag

SEQ ID NO: 34122 - RNA, 22 nt, Human
gaugcuggaagugcugaucuug

SEQ ID NO: 34123 - RNA, 22 nt, Human
gaugcugggaccacagaguguu

SEQ ID NO: 34124 - RNA, 22 nt, Human
gaugcugugguaagccccaccg

SEQ ID NO: 34125 - RNA, 22 nt, Human
gaugcuuacauagcccaagugu

SEQ ID NO: 34126 - RNA, 22 nt, Human
gaugcuuuccaagaaauccuca

SEQ ID NO: 34127 - RNA, 22 nt, Human
gauggacaccuccugagguucu

SEQ ID NO: 34128 - RNA, 22 nt, Human
gauggagucugaagcugggaac

SEQ ID NO: 34129 - RNA, 22 nt, Human
gauggccaaggaccacgcaucg

SEQ ID NO: 34130 - RNA, 22 nt, Human
gauggcuuaagaguaaaaggca

SEQ ID NO: 34131 - RNA, 22 nt, Human
gauggcuuccuucucacugugu

SEQ ID NO: 34132 - RNA, 22 nt, Human
gauggcuucucucuagcuuggu

SEQ ID NO: 34133 - RNA, 20 nt, Human
gauggcuuuagaagcuggua

SEQ ID NO: 34134 - RNA, 22 nt, Human
gauggcuuugaggaauuugaau

SEQ ID NO: 34135 - RNA, 22 nt, Human
gauggcuuugccugcugugagg

SEQ ID NO: 34136 - RNA, 22 nt, Human
gaugggcagcacagcuggccaa

SEQ ID NO: 34137 - RNA, 22 nt, Human
gaugggcguggcgcguuuggug

SEQ ID NO: 34138 - RNA, 22 nt, Human
gaugggcuucuuccaugaagaa

SEQ ID NO: 34139 - RNA, 22 nt, Human
gaugggguccuugaccuggcca

SEQ ID NO: 34140 - RNA, 22 nt, Human
gauggguagccuuucaauagca

SEQ ID NO: 34141 - RNA, 22 nt, Human
gauggguauuggcagaagaggg

SEQ ID NO: 34142 - RNA, 22 nt, Human
gauggguggguucugugagagg

SEQ ID NO: 34143 - RNA, 21 nt, Human
gaugguagccucauagaagua

SEQ ID NO: 34144 - RNA, 22 nt, Human
gauggucaggcuuuaacaucug

SEQ ID NO: 34145 - RNA, 22 nt, Human
gauggugcaggugaagugcugg

SEQ ID NO: 34146 - RNA, 22 nt, Human
gaugguuuaugauagaugggaa

SEQ ID NO: 34147 - RNA, 22 nt, Human
gaugguuugguaaaaguauguu

SEQ ID NO: 34148 - RNA, 18 nt, Human
gauguaaaauaguagcuu

SEQ ID NO: 34149 - RNA, 22 nt, Human
gauguaaagcuucagagccggc

SEQ ID NO: 34150 - RNA, 22 nt, Human
gauguaaauggucuuuggcaga

SEQ ID NO: 34151 - RNA, 22 nt, Human
gauguauaaccuggcuauguua

SEQ ID NO: 34152 - RNA, 22 nt, Human
gauguauagcuuuaacugaccc

SEQ ID NO: 34153 - RNA, 22 nt, Human
gauguauagggccaugacacca

SEQ ID NO: 34154 - RNA, 22 nt, Human
gaugucaucaggcuaagacacu

SEQ ID NO: 34155 - RNA, 22 nt, Human
gauguccagcgucuggcugccu

SEQ ID NO: 34156 - RNA, 18 nt, Human
gaugucucgaggagacua

SEQ ID NO: 34157 - RNA, 22 nt, Human
gaugucugucugagccgcugga

SEQ ID NO: 34158 - RNA, 22 nt, Human
gaugucuuacuaacuagccuuu

SEQ ID NO: 34159 - RNA, 22 nt, Human
gaugucuuucugugugccuaga

SEQ ID NO: 34160 - RNA, 22 nt, Human
ccuuugugaauaugcagaaaau

SEQ ID NO: 34161 - RNA, 22 nt, Human
ccuuugugcaucucugcuccua

SEQ ID NO: 34162 - RNA, 22 nt, Human
ccuuugugguggcccagugugg

SEQ ID NO: 34163 - RNA, 22 nt, Human
ccuuuuauacucagugauauca

SEQ ID NO: 34164 - RNA, 22 nt, Human
ccuuuuauauggcucaucacag

SEQ ID NO: 34165 - RNA, 22 nt, Human
ccuuuucccauguuucuggagc

SEQ ID NO: 34166 - RNA, 22 nt, Human
ccuuuucuaggaugcuuuauag

SEQ ID NO: 34167 - RNA, 22 nt, Human
ccuuuucuauguaccagcagug

SEQ ID NO: 34168 - RNA, 22 nt, Human
ccuuuucuugccacugacucgg

SEQ ID NO: 34169 - RNA, 22 nt, Human
cgaaacaucuaugaucauuaau

SEQ ID NO: 34170 - RNA, 22 nt, Human
cgagaugguauuuuuaacgcag

SEQ ID NO: 34171 - RNA, 22 nt, Human
gcagcccugcagcuccacaccg

SEQ ID NO: 34172 - RNA, 22 nt, Human
gcagcccuuucugggcagggga

SEQ ID NO: 34173 - RNA, 22 nt, Human
gcagccucugaugauggccgua

SEQ ID NO: 34174 - RNA, 17 nt, Human
gcagccucuugguagug

SEQ ID NO: 34175 - RNA, 22 nt, Human
gcagccuucaguuuggcaggag

SEQ ID NO: 34176 - RNA, 22 nt, Human
gcagccuuuggaauuagagacu

SEQ ID NO: 34177 - RNA, 22 nt, Human
gcagcgagugcggcugccacag

SEQ ID NO: 34178 - RNA, 22 nt, Human
gcagcgcuguaggcccaaggca

SEQ ID NO: 34179 - RNA, 22 nt, Human
gcagcuaguccaguuauguggc

SEQ ID NO: 34180 - RNA, 22 nt, Human
gcagcucaaaggccacggacgg

SEQ ID NO: 34181 - RNA, 22 nt, Human
gcagcucacacagcaaguuuug

SEQ ID NO: 34182 - RNA, 22 nt, Human
gcagcucaguaaaagaggagca

SEQ ID NO: 34183 - RNA, 22 nt, Human
gcagcuccuggcacaguuuuuu

SEQ ID NO: 34184 - RNA, 22 nt, Human
cucaggagcuuccucagcccau

SEQ ID NO: 34185 - RNA, 22 nt, Human
cucaggaggaggaaguucauug

SEQ ID NO: 34186 - RNA, 22 nt, Human
cucaggaggugguagaggcccu

SEQ ID NO: 34187 - RNA, 22 nt, Human
cucaggaguaguucagcagcug

SEQ ID NO: 34188 - RNA, 20 nt, Human
cucaggauacugcaaaguug

SEQ ID NO: 34189 - RNA, 22 nt, Human
cucaggauagauuguccucuca

SEQ ID NO: 34190 - RNA, 22 nt, Human
cucaggaucgcuugcccuaggg

SEQ ID NO: 34191 - RNA, 21 nt, Human
cucaggaucuuauauauuagu

SEQ ID NO: 34192 - RNA, 22 nt, Human
cucaggauggaagccuacagga

SEQ ID NO: 34193 - RNA, 21 nt, Human
cucaggauggcggccuggugg

SEQ ID NO: 34194 - RNA, 22 nt, Human
cucaggauuuacuaauuucaag

SEQ ID NO: 34195 - RNA, 22 nt, Human
cucaggcaaggcccgcauucuc

SEQ ID NO: 34196 - RNA, 22 nt, Human
cucaggcacgggucagugagcg

SEQ ID NO: 34197 - RNA, 21 nt, Human
cucaggcauuugaggagaguc

SEQ ID NO: 34198 - RNA, 21 nt, Human
cucaggcuggcagcaggcuag

SEQ ID NO: 34199 - RNA, 22 nt, Human
cucaggcugugaugugauggca

SEQ ID NO: 34200 - RNA, 22 nt, Human
cucagggacggaggcuugcgga

SEQ ID NO: 34201 - RNA, 22 nt, Human
cucagggaggagcuucugggcc

SEQ ID NO: 34202 - RNA, 22 nt, Human
cucagggaggcccugggacccu

SEQ ID NO: 34203 - RNA, 22 nt, Human
cucagggcucugcaugcacacg

SEQ ID NO: 34204 - RNA, 21 nt, Human
cucagggcuugguguccucau

SEQ ID NO: 34205 - RNA, 22 nt, Human
cucaggucacggaucugagcug

SEQ ID NO: 34206 - RNA, 22 nt, Human
cucaggucuuaguucugucauc

SEQ ID NO: 34207 - RNA, 22 nt, Human
cucaguacuuuauguauaugau

SEQ ID NO: 34208 - RNA, 22 nt, Human
cucagucugucuugucuguguu

SEQ ID NO: 34209 - RNA, 22 nt, Human
cucagugaauuggaggauggcc

SEQ ID NO: 34210 - RNA, 22 nt, Human
cucagugcagcuaggcaugaga

SEQ ID NO: 34211 - RNA, 22 nt, Human
cucagugcuagaaguagauugc

SEQ ID NO: 34212 - RNA, 22 nt, Human
cucagugcuucuagcuugauga

SEQ ID NO: 34213 - RNA, 20 nt, Human
cucagugcuuucauugccuc

SEQ ID NO: 34214 - RNA, 22 nt, Human
cucagugucuuauuguacacau

SEQ ID NO: 34215 - RNA, 22 nt, Human
cucagugugaaugcucaguaaa

SEQ ID NO: 34216 - RNA, 22 nt, Human
cucaguuucuuacucuguauaa

SEQ ID NO: 34217 - RNA, 22 nt, Human
cucaguuugaaugcugacacug

SEQ ID NO: 34218 - RNA, 22 nt, Human
cucaguuuugcuagcuggaguu

SEQ ID NO: 34219 - RNA, 22 nt, Human
cucaguuuuugcugucugguuc

SEQ ID NO: 34220 - RNA, 22 nt, Human
cucauaaacaauucuuugaggu

SEQ ID NO: 34221 - RNA, 22 nt, Human
cucauacauaugccauuccugc

SEQ ID NO: 34222 - RNA, 22 nt, Human
cucauagguuuggaaccaggua

SEQ ID NO: 34223 - RNA, 22 nt, Human
cucaucaccacauauaacaaag

SEQ ID NO: 34224 - RNA, 22 nt, Human
cucauccacccucacuaggaaa

SEQ ID NO: 34225 - RNA, 22 nt, Human
cucauccaccgcagccccucag

SEQ ID NO: 34226 - RNA, 22 nt, Human
cucaucugucugggcugguuuu

SEQ ID NO: 34227 - RNA, 22 nt, Human
cucaugauguagcgaaugagaa

SEQ ID NO: 34228 - RNA, 22 nt, Human
cucauguagcucucaggccaca

SEQ ID NO: 34229 - RNA, 22 nt, Human
cucauuagacagguauacuuua

SEQ ID NO: 34230 - RNA, 22 nt, Human
cucauuccauguguauuuugag

SEQ ID NO: 34231 - RNA, 22 nt, Human
cucauuuacuguagaacaguua

SEQ ID NO: 34232 - RNA, 22 nt, Human
cucauuuauguaaugauuaagg

SEQ ID NO: 34233 - RNA, 23 nt, Human
cuccaaggcccaacugucuaggc

SEQ ID NO: 34234 - RNA, 20 nt, Human
cuccaaggcuugcaggaggc

SEQ ID NO: 34235 - RNA, 22 nt, Human
cuccaagggcucccagacgucu

SEQ ID NO: 34236 - RNA, 22 nt, Human
cuccaccacacaucuguccacc

SEQ ID NO: 34237 - RNA, 22 nt, Human
cuccacucuggggugggugaga

SEQ ID NO: 34238 - RNA, 22 nt, Human
cuccagaaggugggggagccac

SEQ ID NO: 34239 - RNA, 22 nt, Human
cuccagagacacuucucaugau

SEQ ID NO: 34240 - RNA, 18 nt, Human
cuccagagcugugagaca

SEQ ID NO: 34241 - RNA, 22 nt, Human
cuccagauccagcugagcugca

SEQ ID NO: 34242 - RNA, 22 nt, Human
cuccagcuagggcuggcuuacu

SEQ ID NO: 34243 - RNA, 22 nt, Human
cuccaggaccagggcuccugga

SEQ ID NO: 34244 - RNA, 22 nt, Human
cuccaggagcugugucuuucuu

SEQ ID NO: 34245 - RNA, 22 nt, Human
cuccaggagggcuuccugugau

SEQ ID NO: 34246 - RNA, 22 nt, Human
cuccaggagggggauggcugua

SEQ ID NO: 34247 - RNA, 22 nt, Human
cuccaggagguugcugcuuccu

SEQ ID NO: 34248 - RNA, 22 nt, Human
cuccaggauguuagacguccag

SEQ ID NO: 34249 - RNA, 22 nt, Human
cuccaggcgggaggcgguucca

SEQ ID NO: 34250 - RNA, 22 nt, Human
cuccaggcucguccaagaucga

SEQ ID NO: 34251 - RNA, 22 nt, Human
cuccagggagcugcgggagcca

SEQ ID NO: 34252 - RNA, 22 nt, Human
cuccagggaugagacagaguag

SEQ ID NO: 34253 - RNA, 22 nt, Human
cuccagggcagcauggcagugg

SEQ ID NO: 34254 - RNA, 22 nt, Human
cuccagggcuaccagguuuuag

SEQ ID NO: 34255 - RNA, 22 nt, Human
cuccaggggccagaagccuggc

SEQ ID NO: 34256 - RNA, 22 nt, Human
cuccagggggcauccacacagc

SEQ ID NO: 34257 - RNA, 22 nt, Human
cuccaggugcagaaggacucag

SEQ ID NO: 34258 - RNA, 22 nt, Human
cuccagguugacuucagucaau

SEQ ID NO: 34259 - RNA, 22 nt, Human
cuccagugagugagcaggcgac

SEQ ID NO: 34260 - RNA, 22 nt, Human
cuccagugcacccagaggauuu

SEQ ID NO: 34261 - RNA, 22 nt, Human
cuccagugcuucuagaaaauac

SEQ ID NO: 34262 - RNA, 22 nt, Human
cuccaguggcaaguccgggcgg

SEQ ID NO: 34263 - RNA, 22 nt, Human
cuccagugggggugagccuaga

SEQ ID NO: 34264 - RNA, 22 nt, Human
cuccaguggugauggggaagaa

SEQ ID NO: 34265 - RNA, 20 nt, Human
cuccaguguucaggggagug

SEQ ID NO: 34266 - RNA, 22 nt, Human
cuccauauguucaguuaugcag

SEQ ID NO: 34267 - RNA, 22 nt, Human
cuccaugaauuugagcuuugug

SEQ ID NO: 34268 - RNA, 22 nt, Human
cucccaagauaaauaaggcagu

SEQ ID NO: 34269 - RNA, 22 nt, Human
cucccaagcugugcugaacugu

SEQ ID NO: 34270 - RNA, 22 nt, Human
cucccaagggguaagggagcug

SEQ ID NO: 34271 - RNA, 22 nt, Human
cucccagagagcaggugggccg

SEQ ID NO: 34272 - RNA, 22 nt, Human
cucccaggcagggcugcccacu

SEQ ID NO: 34273 - RNA, 22 nt, Human
cucccagggccaucgagucacu

SEQ ID NO: 34274 - RNA, 21 nt, Human
cucccagggugacuguucaac

SEQ ID NO: 34275 - RNA, 22 nt, Human
cucccagguuccgacgccucuu

SEQ ID NO: 34276 - RNA, 22 nt, Human
cuccccaccuucgcggucccug

SEQ ID NO: 34277 - RNA, 22 nt, Human
cuccccagguucaggagguggg

SEQ ID NO: 34278 - RNA, 22 nt, Human
cuccccauggcaacaguuaugg

SEQ ID NO: 34279 - RNA, 22 nt, Human
cuccccauugugaccucaucca

SEQ ID NO: 34280 - RNA, 22 nt, Human
gcaggguccauggaggcagccc

SEQ ID NO: 34281 - RNA, 22 nt, Human
gcagggucugaggccacagagg

SEQ ID NO: 34282 - RNA, 19 nt, Human
gcaggguguugacuguccc

SEQ ID NO: 34283 - RNA, 22 nt, Human
gcaggguucucagcagugaugg

SEQ ID NO: 34284 - RNA, 21 nt, Human
gcaggguuugugcugugaguu

SEQ ID NO: 34285 - RNA, 19 nt, Human
gcagguagagacagcagcc

SEQ ID NO: 34286 - RNA, 22 nt, Human
gcaggucuugaaggugugauuu

SEQ ID NO: 34287 - RNA, 18 nt, Human
gcaggugccacugcuguu

SEQ ID NO: 34288 - RNA, 22 nt, Human
gcagguggaagcagcagacuca

SEQ ID NO: 34289 - RNA, 16 nt, Human
gcagguggaucaccug

SEQ ID NO: 34290 - RNA, 15 nt, Human
gcagguggaucacuu

SEQ ID NO: 34291 - RNA, 22 nt, Human
gcaggugggggucggugcaucu

SEQ ID NO: 34292 - RNA, 22 nt, Human
gcaggugucuucagcaggauga

SEQ ID NO: 34293 - RNA, 19 nt, Human
gcaggugugaauccguaga

SEQ ID NO: 34294 - RNA, 22 nt, Human
gcagguguggguggcugccagg

SEQ ID NO: 34295 - RNA, 22 nt, Human
gcagguuagauuuaauccauuc

SEQ ID NO: 34296 - RNA, 22 nt, Human
gcaguaaagccugagauauaug

SEQ ID NO: 34297 - RNA, 22 nt, Human
gcaguaaaggugacaauauagg

SEQ ID NO: 34298 - RNA, 22 nt, Human
gcaguaaauaauuuuguguaua

SEQ ID NO: 34299 - RNA, 22 nt, Human
gcaguaagaaagucaagcaguu

SEQ ID NO: 34300 - RNA, 22 nt, Human
gcaguaagaugggguaaucgua

SEQ ID NO: 34301 - RNA, 22 nt, Human
gcaguaagauguuucccagagc

SEQ ID NO: 34302 - RNA, 20 nt, Human
cuccucaguuccaugggagg

SEQ ID NO: 34303 - RNA, 22 nt, Human
cuccuccagacuuacugaaucc

SEQ ID NO: 34304 - RNA, 22 nt, Human
cuccuccagcuuccaguggcuc

SEQ ID NO: 34305 - RNA, 22 nt, Human
cuccuccaguccuccaaggaca

SEQ ID NO: 34306 - RNA, 22 nt, Human
cuccucccucuuugccacacau

SEQ ID NO: 34307 - RNA, 22 nt, Human
cuccuccuaaaugauucuuccu

SEQ ID NO: 34308 - RNA, 22 nt, Human
cuccucgaagcaaccugcaggc

SEQ ID NO: 34309 - RNA, 22 nt, Human
cuccucuagaagcugaccugga

SEQ ID NO: 34310 - RNA, 17 nt, Human
cuccucucuggguuacu

SEQ ID NO: 34311 - RNA, 22 nt, Human
cuccucuggguccugguggcca

SEQ ID NO: 34312 - RNA, 22 nt, Human
cuccucugucuaccacgagggu

SEQ ID NO: 34313 - RNA, 22 nt, Human
cuccucuuuggggauuuacaca

SEQ ID NO: 34314 - RNA, 22 nt, Human
cuccugagaauuuucaguugga

SEQ ID NO: 34315 - RNA, 22 nt, Human
cuccugagcugcagccuugugu

SEQ ID NO: 34316 - RNA, 22 nt, Human
cuccugaggaaaagcuugguca

SEQ ID NO: 34317 - RNA, 22 nt, Human
cuccugaggggacaggacucau

SEQ ID NO: 34318 - RNA, 22 nt, Human
cuccugaguaguagcauuguca

SEQ ID NO: 34319 - RNA, 22 nt, Human
cuccugagucuccacgccccgu

SEQ ID NO: 34320 - RNA, 22 nt, Human
cuccugccaccgcgguguccug

SEQ ID NO: 34321 - RNA, 22 nt, Human
cuccugcgguacuacugugcuu

SEQ ID NO: 34322 - RNA, 22 nt, Human
cuccuggacauggagcggagga

SEQ ID NO: 34323 - RNA, 22 nt, Human
cuccuggaccagggcuauuggg

SEQ ID NO: 34324 - RNA, 22 nt, Human
cuccuggcagcaacauuuauau

SEQ ID NO: 34325 - RNA, 17 nt, Human
cuccuggcagccucagg

SEQ ID NO: 34326 - RNA, 22 nt, Human
cuccuggcucgcccccagcuga

SEQ ID NO: 34327 - RNA, 22 nt, Human
cuccuggcucugccacuuacua

SEQ ID NO: 34328 - RNA, 22 nt, Human
cuccugggagucuuccuggaug

SEQ ID NO: 34329 - RNA, 22 nt, Human
cuccuggggcacuuagaagcaa

SEQ ID NO: 34330 - RNA, 22 nt, Human
cuccugggggacagcggcaggg

SEQ ID NO: 34331 - RNA, 22 nt, Human
cuccugguucagagagcugaga

SEQ ID NO: 34332 - RNA, 22 nt, Human
cuccugguuccugucuuaaaua

SEQ ID NO: 34333 - RNA, 22 nt, Human
cuccugucccggggaccgccga

SEQ ID NO: 34334 - RNA, 22 nt, Human
cuccugugaggcuuaagcccag

SEQ ID NO: 34335 - RNA, 20 nt, Human
cuccugugccucucugggcc

SEQ ID NO: 34336 - RNA, 22 nt, Human
cuccuguguucaagcgauucuc

SEQ ID NO: 34337 - RNA, 22 nt, Human
cuccuucacgcaggcugccaug

SEQ ID NO: 34338 - RNA, 22 nt, Human
cuccuucccaugagugugggca

SEQ ID NO: 34339 - RNA, 22 nt, Human
cuccuuccccuacucagcaucc

SEQ ID NO: 34340 - RNA, 22 nt, Human
cuccuuccugcagaucugagau

SEQ ID NO: 34341 - RNA, 22 nt, Human
cuccuuggccguuaaugucaca

SEQ ID NO: 34342 - RNA, 22 nt, Human
cucggaauggaacaacagcggu

SEQ ID NO: 34343 - RNA, 22 nt, Human
cucggcagguggagguuguagu

SEQ ID NO: 34344 - RNA, 19 nt, Human
cucgugcacccaucaccug

SEQ ID NO: 34345 - RNA, 22 nt, Human
cucuaacacuguaaugcuuucu

SEQ ID NO: 34346 - RNA, 22 nt, Human
cucuagaacagugcugagccuu

SEQ ID NO: 34347 - RNA, 22 nt, Human
cucuagaaggucucccugccag

SEQ ID NO: 34348 - RNA, 18 nt, Human
cucuagaaugggagauuu

SEQ ID NO: 34349 - RNA, 22 nt, Human
cucuagcagcagcccuuccuua

SEQ ID NO: 34350 - RNA, 22 nt, Human
cucuagcucccagggagcgucu

SEQ ID NO: 34351 - RNA, 22 nt, Human
cucuagcugaggucacugcuau

SEQ ID NO: 34352 - RNA, 22 nt, Human
cucuaggccauccagggccauu

SEQ ID NO: 34353 - RNA, 22 nt, Human
cucuauguuaugcagaauuaag

SEQ ID NO: 34354 - RNA, 20 nt, Human
cucuauuauuaauuucuuaa

SEQ ID NO: 34355 - RNA, 22 nt, Human
cucuauucuaauggauucuggg

SEQ ID NO: 34356 - RNA, 22 nt, Human
cucucaaaguaagguguauaca

SEQ ID NO: 34357 - RNA, 22 nt, Human
cucucaaaugucauuccucuau

SEQ ID NO: 34358 - RNA, 22 nt, Human
cucucagaaguagcacgugggc

SEQ ID NO: 34359 - RNA, 22 nt, Human
cucucagcaggaaagcaugcaa

SEQ ID NO: 34360 - RNA, 15 nt, Human
cucucaggcaggcag

SEQ ID NO: 34361 - RNA, 22 nt, Human
cucucagggcagguggccuuuc

SEQ ID NO: 34362 - RNA, 22 nt, Human
cucucaguaaauuucugcccca

SEQ ID NO: 34363 - RNA, 22 nt, Human
cucuccagaucugcugagccag

SEQ ID NO: 34364 - RNA, 22 nt, Human
cucuccagccacagaagcugcu

SEQ ID NO: 34365 - RNA, 22 nt, Human
cucuccaggagagcacuuugag

SEQ ID NO: 34366 - RNA, 22 nt, Human
cucuccaggcgagguccuacug

SEQ ID NO: 34367 - RNA, 22 nt, Human
cucuccagggaagcaguguacu

SEQ ID NO: 34368 - RNA, 22 nt, Human
cucuccagggguagaugccuuc

SEQ ID NO: 34369 - RNA, 22 nt, Human
cucuccaucugugugaccuccc

SEQ ID NO: 34370 - RNA, 22 nt, Human
cucucccagucaggcucaggau

SEQ ID NO: 34371 - RNA, 22 nt, Human
cucuccccgguacgagcggccg

SEQ ID NO: 34372 - RNA, 22 nt, Human
cucuccucugaaguggugaccc

SEQ ID NO: 34373 - RNA, 22 nt, Human
cucuccuggggagcacacacac

SEQ ID NO: 34374 - RNA, 22 nt, Human
cucuccuuuacugcagagagcg

SEQ ID NO: 34375 - RNA, 22 nt, Human
cucuccuuugaagcaacuguau

SEQ ID NO: 34376 - RNA, 22 nt, Human
cucucuaacgacauucccauuc

SEQ ID NO: 34377 - RNA, 19 nt, Human
cucucuccaguggcuggcu

SEQ ID NO: 34378 - RNA, 23 nt, Human
cucucucuaccaugugaggacac

SEQ ID NO: 34379 - RNA, 22 nt, Human
cucucucuaugcguuguuccua

SEQ ID NO: 34380 - RNA, 22 nt, Human
cucucucuucuuuguaggggcc

SEQ ID NO: 34381 - RNA, 22 nt, Human
cucucucuuuagaagcgucugg

SEQ ID NO: 34382 - RNA, 22 nt, Human
cucucugaguggcuguacuuuc

SEQ ID NO: 34383 - RNA, 22 nt, Human
cucucuggaauuaaagcccaau

SEQ ID NO: 34384 - RNA, 22 nt, Human
cucucuggacuugaguaucagc

SEQ ID NO: 34385 - RNA, 22 nt, Human
cucucugguacauagaguuugg

SEQ ID NO: 34386 - RNA, 22 nt, Human
cucucuggucccagauuccaga

SEQ ID NO: 34387 - RNA, 18 nt, Human
cucucuggucuggauccc

SEQ ID NO: 34388 - RNA, 22 nt, Human
cucucugucuuggcauuugguc

SEQ ID NO: 34389 - RNA, 22 nt, Human
cucucugugcucacaagggcag

SEQ ID NO: 34390 - RNA, 22 nt, Human
uuuguguuuuagcuggugaggc

SEQ ID NO: 34391 - RNA, 22 nt, Human
uuuguuaaaaugcagauucugu

SEQ ID NO: 34392 - RNA, 22 nt, Human
uuuguuacaaagaaagaagagc

SEQ ID NO: 34393 - RNA, 22 nt, Human
uuuguuauaacaauaaaaaguc

SEQ ID NO: 34394 - RNA, 22 nt, Human
uuuguucaaauuuuccuaucug

SEQ ID NO: 34395 - RNA, 22 nt, Human
uuuguucaacaggugaaauaga

SEQ ID NO: 34396 - RNA, 22 nt, Human
uuuguucaacaucacuuccacc

SEQ ID NO: 34397 - RNA, 22 nt, Human
uuuguucaauauguguuugucc

SEQ ID NO: 34398 - RNA, 21 nt, Human
uuuguucacacacagggcagc

SEQ ID NO: 34399 - RNA, 22 nt, Human
uuuguucacaggguuguuguag

SEQ ID NO: 34400 - RNA, 22 nt, Human
uuuguucaccucaaggauggga

SEQ ID NO: 34401 - RNA, 22 nt, Human
uuuguucacuauaucccucagu

SEQ ID NO: 34402 - RNA, 16 nt, Human
uuuguucacuccaugg

SEQ ID NO: 34403 - RNA, 22 nt, Human
uuuguucagcucucauugauua

SEQ ID NO: 34404 - RNA, 21 nt, Human
uuuguucaggcaaguuacagu

SEQ ID NO: 34405 - RNA, 21 nt, Human
uuuguucauagcucacucuuu

SEQ ID NO: 34406 - RNA, 23 nt, Human
uuuguucaucauuagagucuagc

SEQ ID NO: 34407 - RNA, 17 nt, Human
uuuguucauugaagaga

SEQ ID NO: 34408 - RNA, 22 nt, Human
uuuguucguucaugcacgguag

SEQ ID NO: 34409 - RNA, 22 nt, Human
uuuguucuaacuucugcagaca

SEQ ID NO: 34410 - RNA, 22 nt, Human
uuuguucugaaaaucuucccuu

SEQ ID NO: 34411 - RNA, 22 nt, Human
uuuguucuuaguaucugugugc

SEQ ID NO: 34412 - RNA, 22 nt, Human
uuuguugugauaauggucugca

SEQ ID NO: 34413 - RNA, 22 nt, Human
uuuguuuacaaaaauaagcagu

SEQ ID NO: 34414 - RNA, 22 nt, Human
uuuguuuagaaagagauuggug

SEQ ID NO: 34415 - RNA, 22 nt, Human
uuuguuuauuaggggagaguug

SEQ ID NO: 34416 - RNA, 22 nt, Human
uuuguuuggcaacuugguaaag

SEQ ID NO: 34417 - RNA, 22 nt, Human
uuuguuuucaaugugucauuca

SEQ ID NO: 34418 - RNA, 22 nt, Human
uuuguuuucuguaggccuuucc

SEQ ID NO: 34419 - RNA, 22 nt, Human
uuuuaaacuccccuaguuggug

SEQ ID NO: 34420 - RNA, 22 nt, Human
uuuuaaaggcagauuauggcuu

SEQ ID NO: 34421 - RNA, 22 nt, Human
uuuuaaaucuccaguugacccc

SEQ ID NO: 34422 - RNA, 22 nt, Human
uuuuaagaaauguaugacuguc

SEQ ID NO: 34423 - RNA, 22 nt, Human
uuuuaagaacuguucugugcuu

SEQ ID NO: 34424 - RNA, 22 nt, Human
uuuuaagaggaggcuguuugaa

SEQ ID NO: 34425 - RNA, 22 nt, Human
uuuuaagugcaaucugaaugcg

SEQ ID NO: 34426 - RNA, 19 nt, Human
uuuuaagugcccuuucuuc

SEQ ID NO: 34427 - RNA, 22 nt, Human
uuuuaauccucuugguaucuua

SEQ ID NO: 34428 - RNA, 22 nt, Human
uuuuaauugcaauuaugguccc

SEQ ID NO: 34429 - RNA, 18 nt, Human
uuuuaauuucaggggugg

SEQ ID NO: 34430 - RNA, 22 nt, Human
uuuuacagucagucaaacucag

SEQ ID NO: 34431 - RNA, 22 nt, Human
uuuuaccacugggugacaugga

SEQ ID NO: 34432 - RNA, 22 nt, Human
uuuuacuuaauucuuggucaug

SEQ ID NO: 34433 - RNA, 22 nt, Human
uuuuagaaggaaugcuauggug

SEQ ID NO: 34434 - RNA, 22 nt, Human
uuuuagauuauaagucuaauuc

SEQ ID NO: 34435 - RNA, 22 nt, Human
uuuuaguaccaaccagaagaug

SEQ ID NO: 34436 - RNA, 22 nt, Human
uuuuaguguagucaccgugggu

SEQ ID NO: 34437 - RNA, 22 nt, Human
uuuuauauggcacauugguugg

SEQ ID NO: 34438 - RNA, 22 nt, Human
uuuuauauugagugagaguucc

SEQ ID NO: 34439 - RNA, 22 nt, Human
uuuuauguaauaaacuguacac

SEQ ID NO: 34440 - RNA, 22 nt, Human
uuuuauguaauccuuacugucg

SEQ ID NO: 34441 - RNA, 22 nt, Human
uuuuaugucauaaggacacuca

SEQ ID NO: 34442 - RNA, 22 nt, Human
uuuuauucuaaguaugauggga

SEQ ID NO: 34443 - RNA, 22 nt, Human
uuuuauucucagcuccagagag

SEQ ID NO: 34444 - RNA, 22 nt, Human
uuuuauugcaauaaagugugua

SEQ ID NO: 34445 - RNA, 22 nt, Human
uuuuauugucuguauugccuau

SEQ ID NO: 34446 - RNA, 22 nt, Human
uuuucagaaagaugagaaauua

SEQ ID NO: 34447 - RNA, 22 nt, Human
uuuucaggcugauuuguguuag

SEQ ID NO: 34448 - RNA, 22 nt, Human
uuuucaguuacuguuuauguga

SEQ ID NO: 34449 - RNA, 22 nt, Human
uuuucaguuccaucucugcucu

SEQ ID NO: 34450 - RNA, 22 nt, Human
uuuucaguuugcacugcagugc

SEQ ID NO: 34451 - RNA, 22 nt, Human
uuuucaucucugcuuuguaccu

SEQ ID NO: 34452 - RNA, 22 nt, Human
uuuucauguuccuuguuaagug

SEQ ID NO: 34453 - RNA, 22 nt, Human
uuuucauugagcaccugaguaa

SEQ ID NO: 34454 - RNA, 22 nt, Human
uuuucauuuuuguagaugcaag

SEQ ID NO: 34455 - RNA, 22 nt, Human
uuuuccaaaguaccaugucccu

SEQ ID NO: 34456 - RNA, 22 nt, Human
uuucaguuuaaguaacugcuau

SEQ ID NO: 34457 - RNA, 22 nt, Human
uuucaguuuagacuaaagguag

SEQ ID NO: 34458 - RNA, 22 nt, Human
uuucaguuuuauaacuuuggcc

SEQ ID NO: 34459 - RNA, 22 nt, Human
uuucauaauauccagagauuuu

SEQ ID NO: 34460 - RNA, 22 nt, Human
uuucaucaccccaaaucuaugg

SEQ ID NO: 34461 - RNA, 22 nt, Human
uuucaucauguuggcagauugg

SEQ ID NO: 34462 - RNA, 22 nt, Human
uuucaucucucuaaaagacagu

SEQ ID NO: 34463 - RNA, 22 nt, Human
uuucaugaggggcaaaaucuca

SEQ ID NO: 34464 - RNA, 22 nt, Human
uuucaugauccauuuacaaaau

SEQ ID NO: 34465 - RNA, 22 nt, Human
uuucaugauuaacuuagugaau

SEQ ID NO: 34466 - RNA, 22 nt, Human
uuucaugccucuugagaaagau

SEQ ID NO: 34467 - RNA, 22 nt, Human
uuucauguauuucccaaagcuu

SEQ ID NO: 34468 - RNA, 22 nt, Human
uuucaugugcaauuagcaauau

SEQ ID NO: 34469 - RNA, 22 nt, Human
uuucaugugcauuuagguucau

SEQ ID NO: 34470 - RNA, 22 nt, Human
uuucauguguugaauguguaca

SEQ ID NO: 34471 - RNA, 22 nt, Human
uuucauguuacaguguaaaagu

SEQ ID NO: 34472 - RNA, 22 nt, Human
uuucauguuacauuuaaaaugu

SEQ ID NO: 34473 - RNA, 22 nt, Human
uuucauguuggauacuguuuca

SEQ ID NO: 34474 - RNA, 22 nt, Human
uuucauguuuucuuaaauggca

SEQ ID NO: 34475 - RNA, 22 nt, Human
uuucauuaaagucaaaucuggu

SEQ ID NO: 34476 - RNA, 22 nt, Human
uuucauuacguguuugacuugu

SEQ ID NO: 34477 - RNA, 22 nt, Human
uuucauugacaguugggggaaa

SEQ ID NO: 34478 - RNA, 22 nt, Human
uuucauuggcagagccuguuuu

SEQ ID NO: 34479 - RNA, 20 nt, Human
uuucauugucagaaucuuau

SEQ ID NO: 34480 - RNA, 22 nt, Human
uuucauugucaucuaucuuaga

SEQ ID NO: 34481 - RNA, 22 nt, Human
uuucauuguccccaggcaagac

SEQ ID NO: 34482 - RNA, 22 nt, Human
uuucauugugaugcuuuuauca

SEQ ID NO: 34483 - RNA, 22 nt, Human
uuuccaaaggcuaaacucaguu

SEQ ID NO: 34484 - RNA, 16 nt, Human
uuuccaaagggcagcu

SEQ ID NO: 34485 - RNA, 22 nt, Human
uuuccaaagguggcaggaacaa

SEQ ID NO: 34486 - RNA, 22 nt, Human
uuuccaagagcuuauuucugaa

SEQ ID NO: 34487 - RNA, 22 nt, Human
uuuccaagauaauacacagaaa

SEQ ID NO: 34488 - RNA, 22 nt, Human
uuuccaaggaugugucucucua

SEQ ID NO: 34489 - RNA, 22 nt, Human
uuuccacaauguuuuugcagga

SEQ ID NO: 34490 - RNA, 22 nt, Human
uuuccacagcuguauaaaauaa

SEQ ID NO: 34491 - RNA, 22 nt, Human
uuuccacaucaccaugagguga

SEQ ID NO: 34492 - RNA, 22 nt, Human
uuuccacucuggccaccaucuu

SEQ ID NO: 34493 - RNA, 20 nt, Human
uuuccacuguaauguaugau

SEQ ID NO: 34494 - RNA, 22 nt, Human
uuuccagauuaagauaccacuu

SEQ ID NO: 34495 - RNA, 23 nt, Human
uuuccaggugaccgucagaauua

SEQ ID NO: 34496 - RNA, 22 nt, Human
uuuccaggugcauagaaaacag

SEQ ID NO: 34497 - RNA, 22 nt, Human
uuuccaguaaguggcaaggagc

SEQ ID NO: 34498 - RNA, 22 nt, Human
uuuccagucaccacuagaucag

SEQ ID NO: 34499 - RNA, 22 nt, Human
uuucuggauucauacagaugua

SEQ ID NO: 34500 - RNA, 22 nt, Human
uuucuguaaagaccaagccagc

SEQ ID NO: 34501 - RNA, 22 nt, Human
uuucuguaaggacuuaaugcaa

SEQ ID NO: 34502 - RNA, 22 nt, Human
uuucuguaaguggcaaauaaug

SEQ ID NO: 34503 - RNA, 22 nt, Human
uuucuguacacccacuauucau

SEQ ID NO: 34504 - RNA, 22 nt, Human
uuucuguagugugguauguagg

SEQ ID NO: 34505 - RNA, 21 nt, Human
uuucuguccuuuccaucagcu

SEQ ID NO: 34506 - RNA, 21 nt, Human
uuucugucucugccacuaguu

SEQ ID NO: 34507 - RNA, 22 nt, Human
uuucugucugacaucccugccu

SEQ ID NO: 34508 - RNA, 22 nt, Human
uuucugugaauuauaaaauuug

SEQ ID NO: 34509 - RNA, 20 nt, Human
uuucugugagaaacacuguu

SEQ ID NO: 34510 - RNA, 20 nt, Human
uuucugugauagagaggugu

SEQ ID NO: 34511 - RNA, 22 nt, Human
uuucugugguggguaguucaga

SEQ ID NO: 34512 - RNA, 22 nt, Human
uuucuguuguuggugucuggcu

SEQ ID NO: 34513 - RNA, 22 nt, Human
uuucuuaaauauuugcaggaca

SEQ ID NO: 34514 - RNA, 22 nt, Human
uuucuuagcgaugcuugauaaa

SEQ ID NO: 34515 - RNA, 19 nt, Human
uuucuuaggccuuuggccu

SEQ ID NO: 34516 - RNA, 22 nt, Human
uuucuuaggcucuaaaaugacu

SEQ ID NO: 34517 - RNA, 22 nt, Human
uuucuuagggacuguaaaauag

SEQ ID NO: 34518 - RNA, 22 nt, Human
uuucuuaguccuagagugauuu

SEQ ID NO: 34519 - RNA, 22 nt, Human
uuucuuauauucugucauuguu

SEQ ID NO: 34520 - RNA, 22 nt, Human
uuucuucagccuucacaaccug

SEQ ID NO: 34521 - RNA, 19 nt, Human
uuucuuccaaagacuaugg

SEQ ID NO: 34522 - RNA, 22 nt, Human
uuucuucccaagcaguuucaga

SEQ ID NO: 34523 - RNA, 22 nt, Human
uuucuuccccacugcaggcucu

SEQ ID NO: 34524 - RNA, 21 nt, Human
uuucuucccuuggcuucugag

SEQ ID NO: 34525 - RNA, 22 nt, Human
uuucuuccuauguaucuugcug

SEQ ID NO: 34526 - RNA, 22 nt, Human
uuucuucucacccaggacagag

SEQ ID NO: 34527 - RNA, 22 nt, Human
uuucuucucaucccugaaauca

SEQ ID NO: 34528 - RNA, 22 nt, Human
uuucuucugagaucagggagaa

SEQ ID NO: 34529 - RNA, 22 nt, Human
uuucuucuugaguaaccagauu

SEQ ID NO: 34530 - RNA, 22 nt, Human
uuucuugccagagaaaaagagu

SEQ ID NO: 34531 - RNA, 22 nt, Human
uuucuuggguuccaguucccag

SEQ ID NO: 34532 - RNA, 22 nt, Human
uuucuuguaaaagcugugggaa

SEQ ID NO: 34533 - RNA, 22 nt, Human
uuucuuguaagauguuuauuaa

SEQ ID NO: 34534 - RNA, 22 nt, Human
uuucuuuaaaggaacucuguuu

SEQ ID NO: 34535 - RNA, 22 nt, Human
uuucuuucaauucuccuaaugc

SEQ ID NO: 34536 - RNA, 22 nt, Human
uuucuuuccaugagccuaugua

SEQ ID NO: 34537 - RNA, 21 nt, Human
uuucuuucuggcucucacagu

SEQ ID NO: 34538 - RNA, 22 nt, Human
uuucuuuguaguagcauaauca

SEQ ID NO: 34539 - RNA, 19 nt, Human
uuucuuuuccccucagcac

SEQ ID NO: 34540 - RNA, 22 nt, Human
uuugaaaaaggccuuugguaug

SEQ ID NO: 34541 - RNA, 22 nt, Human
uuugaaaauuagacacaggcua

SEQ ID NO: 34542 - RNA, 22 nt, Human
uuugaaacaggugauucagcua

SEQ ID NO: 34543 - RNA, 22 nt, Human
uuugaaagaauuuauguacuuu

SEQ ID NO: 34544 - RNA, 22 nt, Human
uuugaaagacagaauauuuuug

SEQ ID NO: 34545 - RNA, 22 nt, Human
uuugaaagcaggugugggaggg

SEQ ID NO: 34546 - RNA, 22 nt, Human
uuugaaagcuacuuucggguca

SEQ ID NO: 34547 - RNA, 22 nt, Human
uuugaaagucaaccuuccaguu

SEQ ID NO: 34548 - RNA, 22 nt, Human
uuugaaaguguuuacuugggaa

SEQ ID NO: 34549 - RNA, 22 nt, Human
uuugaaauaugugucuuuugaa

SEQ ID NO: 34550 - RNA, 22 nt, Human
uuugaaauguaucaguauaggu

SEQ ID NO: 34551 - RNA, 22 nt, Human
uuugaacuaccucuccuuagca

SEQ ID NO: 34552 - RNA, 21 nt, Human
uuugaacuagagguaaauucc

SEQ ID NO: 34553 - RNA, 22 nt, Human
uuugaacuucuaccugucauau

SEQ ID NO: 34554 - RNA, 23 nt, Human
uuugaagaagugaauaucauaua

SEQ ID NO: 34555 - RNA, 22 nt, Human
uuugaagaccuuaucucuaaau

SEQ ID NO: 34556 - RNA, 22 nt, Human
uuugaagcagaugguuaagcuu

SEQ ID NO: 34557 - RNA, 23 nt, Human
uuugaagcauuuuguaucuuagu

SEQ ID NO: 34558 - RNA, 22 nt, Human
uuugaagucaaagauugauucc

SEQ ID NO: 34559 - RNA, 22 nt, Human
uuugaaguccaucuggcccagu

SEQ ID NO: 34560 - RNA, 22 nt, Human
uuugaagugcaaugaggauucu

SEQ ID NO: 34561 - RNA, 22 nt, Human
uuugaaguguuauuucuaucac

SEQ ID NO: 34562 - RNA, 22 nt, Human
uuugaaguucccccauaucaga

SEQ ID NO: 34563 - RNA, 22 nt, Human
uuugaauaaucacugggcauua

SEQ ID NO: 34564 - RNA, 19 nt, Human
uuugaauauaaugcagcua

SEQ ID NO: 34565 - RNA, 22 nt, Human
uuugaaucugauauggcagcau

SEQ ID NO: 34566 - RNA, 20 nt, Human
uuugaauguaaagcauguca

SEQ ID NO: 34567 - RNA, 22 nt, Human
uuugacaaaauuaugcuaauau

SEQ ID NO: 34568 - RNA, 22 nt, Human
uuugacaaauaggggaauaagg

SEQ ID NO: 34569 - RNA, 22 nt, Human
uuugacaaauauuuauuggcac

SEQ ID NO: 34570 - RNA, 22 nt, Human
uuugacaacacguuauuugccu

SEQ ID NO: 34571 - RNA, 22 nt, Human
cucugggucaccaucggggauu

SEQ ID NO: 34572 - RNA, 22 nt, Human
cucugggucaggacacaaaagu

SEQ ID NO: 34573 - RNA, 22 nt, Human
cucugggucucccugaggcuaa

SEQ ID NO: 34574 - RNA, 22 nt, Human
cucugggugucuuaggagcuca

SEQ ID NO: 34575 - RNA, 22 nt, Human
cucuggguucuggccugcaccc

SEQ ID NO: 34576 - RNA, 22 nt, Human
cucuggguuuugucagcugagg

SEQ ID NO: 34577 - RNA, 22 nt, Human
cucuggucaagcaaagagguuu

SEQ ID NO: 34578 - RNA, 22 nt, Human
cucuggucauuuggaagagcau

SEQ ID NO: 34579 - RNA, 22 nt, Human
cucugguguccuuuagaauuua

SEQ ID NO: 34580 - RNA, 22 nt, Human
cucugguucagggcucccuggc

SEQ ID NO: 34581 - RNA, 22 nt, Human
cucugguuucgcaggaaauaga

SEQ ID NO: 34582 - RNA, 17 nt, Human
cucuguacaggaaagag

SEQ ID NO: 34583 - RNA, 22 nt, Human
cucuguacaggagacaucucua

SEQ ID NO: 34584 - RNA, 22 nt, Human
cucuguagaaacagggcagaag

SEQ ID NO: 34585 - RNA, 22 nt, Human
cucuguagacuccaccuuugag

SEQ ID NO: 34586 - RNA, 22 nt, Human
cucugucaggcugcagaugcuc

SEQ ID NO: 34587 - RNA, 22 nt, Human
cucugucccagacccaccucuc

SEQ ID NO: 34588 - RNA, 22 nt, Human
cucuguccuaugcuugauagaa

SEQ ID NO: 34589 - RNA, 22 nt, Human
cucuguccuccaccugcuuuca

SEQ ID NO: 34590 - RNA, 22 nt, Human
cucugugagggucuguacagaa

SEQ ID NO: 34591 - RNA, 22 nt, Human
cucugugauucucauguaccac

SEQ ID NO: 34592 - RNA, 22 nt, Human
cucugugccucaguuuucuucu

SEQ ID NO: 34593 - RNA, 22 nt, Human
cucugugcgggccauggucagg

SEQ ID NO: 34594 - RNA, 22 nt, Human
cucuguggcuugccuuucuguc

SEQ ID NO: 34595 - RNA, 22 nt, Human
cucugugggccugugcuuuagu

SEQ ID NO: 34596 - RNA, 22 nt, Human
cucugugucagcugggugugca

SEQ ID NO: 34597 - RNA, 22 nt, Human
cucugugucugaguuauggucu

SEQ ID NO: 34598 - RNA, 22 nt, Human
cucugugugguccucuguauug

SEQ ID NO: 34599 - RNA, 22 nt, Human
cucuguugagcauuuuuccccu

SEQ ID NO: 34600 - RNA, 18 nt, Human
cucuuaagccuuugucaa

SEQ ID NO: 34601 - RNA, 22 nt, Human
cucuuaauuaagcugagaucug

SEQ ID NO: 34602 - RNA, 19 nt, Human
cucuuacagaauagacaca

SEQ ID NO: 34603 - RNA, 22 nt, Human
cucuuagaaacuauagagauua

SEQ ID NO: 34604 - RNA, 20 nt, Human
cucuuaguacuguuccuggu

SEQ ID NO: 34605 - RNA, 22 nt, Human
cucuuagugcaucucauuaguu

SEQ ID NO: 34606 - RNA, 22 nt, Human
cucuuaguuuaucuuugacaaa

SEQ ID NO: 34607 - RNA, 22 nt, Human
cugagguagaggaaauguagcu

SEQ ID NO: 34608 - RNA, 22 nt, Human
cugagguagggacgugccguag

SEQ ID NO: 34609 - RNA, 22 nt, Human
cugagguauuuuauugggcuag

SEQ ID NO: 34610 - RNA, 22 nt, Human
cugaggucagaguuuagucugg

SEQ ID NO: 34611 - RNA, 22 nt, Human
cugaggucaggaguucaagcug

SEQ ID NO: 34612 - RNA, 22 nt, Human
cugagguccuugacugcuugcc

SEQ ID NO: 34613 - RNA, 22 nt, Human
cugaggucuauuuugaaacugc

SEQ ID NO: 34614 - RNA, 23 nt, Human
cugaggucugcaauucuaguagu

SEQ ID NO: 34615 - RNA, 22 nt, Human
cugaggugagaggaggccaugu

SEQ ID NO: 34616 - RNA, 22 nt, Human
cugagguggccucugccgggga

SEQ ID NO: 34617 - RNA, 22 nt, Human
cugagguuuacaagcuauugcu

SEQ ID NO: 34618 - RNA, 22 nt, Human
cugagguuuguccauccuuggu

SEQ ID NO: 34619 - RNA, 19 nt, Human
cugagucaaagguuguggg

SEQ ID NO: 34620 - RNA, 22 nt, Human
cugaguuuccagauaagaccuu

SEQ ID NO: 34621 - RNA, 22 nt, Human
cugauacaaugcuaauaaauuu

SEQ ID NO: 34622 - RNA, 22 nt, Human
cugauacauaguagcaugucau

SEQ ID NO: 34623 - RNA, 22 nt, Human
cugauauuucucuuaacacuag

SEQ ID NO: 34624 - RNA, 22 nt, Human
cugaucaugugggaggauaugu

SEQ ID NO: 34625 - RNA, 22 nt, Human
cugaugccucucuucuuggcuu

SEQ ID NO: 34626 - RNA, 22 nt, Human
cugaugcucuggauguagucaa

SEQ ID NO: 34627 - RNA, 22 nt, Human
cugauggaugcuacguaagagg

SEQ ID NO: 34628 - RNA, 22 nt, Human
cugauguucauuucuuuuguac

SEQ ID NO: 34629 - RNA, 19 nt, Human
cugauguuccagagaagcu

SEQ ID NO: 34630 - RNA, 22 nt, Human
cugauuaggcuaagcaagaggg

SEQ ID NO: 34631 - RNA, 22 nt, Human
cugauuccaaagccaaagcuau

SEQ ID NO: 34632 - RNA, 22 nt, Human
cugauuccugauucaugcucuu

SEQ ID NO: 34633 - RNA, 22 nt, Human
cugauucuaggcguuccucuca

SEQ ID NO: 34634 - RNA, 22 nt, Human
cugauucuccucaagacuuucg

SEQ ID NO: 34635 - RNA, 22 nt, Human
cugauuucaugcuaucaauguu

SEQ ID NO: 34636 - RNA, 22 nt, Human
cugcaaaaguaauugcagguuu

SEQ ID NO: 34637 - RNA, 20 nt, Human
cugcaaaaugacauuaggaa

SEQ ID NO: 34638 - RNA, 22 nt, Human
cugcaaauaggaaaagggcaua

SEQ ID NO: 34639 - RNA, 22 nt, Human
cugcaaauccucagaaaggguu

SEQ ID NO: 34640 - RNA, 23 nt, Human
cugcaacucagucuggagcaguu

SEQ ID NO: 34641 - RNA, 22 nt, Human
cugcaagauuggaagaugcaau

SEQ ID NO: 34642 - RNA, 22 nt, Human
cugcaaggucaugacucucugg

SEQ ID NO: 34643 - RNA, 22 nt, Human
cugcaauaguuuagaauaauug

SEQ ID NO: 34644 - RNA, 22 nt, Human
cugcaaucuccaugcuugauuu

SEQ ID NO: 34645 - RNA, 23 nt, Human
cugcaauugccugaucucauugg

SEQ ID NO: 34646 - RNA, 22 nt, Human
cugcacacauauggcuucucuc

SEQ ID NO: 34647 - RNA, 22 nt, Human
cugcacagagcggcaguucuua

SEQ ID NO: 34648 - RNA, 22 nt, Human
cugcacaguggacagugaagau

SEQ ID NO: 34649 - RNA, 22 nt, Human
cugcacaguggguggggcguca

SEQ ID NO: 34650 - RNA, 22 nt, Human
cugcacaguguuggaagcugcc

SEQ ID NO: 34651 - RNA, 22 nt, Human
cugcacauaguaaguacucaau

SEQ ID NO: 34652 - RNA, 22 nt, Human
cugcaccauccuucaugcucug

SEQ ID NO: 34653 - RNA, 22 nt, Human
cugcacccucaaacuccugggc

SEQ ID NO: 34654 - RNA, 19 nt, Human
cugcacugagaaaaggagg

SEQ ID NO: 34655 - RNA, 22 nt, Human
cugcagaaauauggaugugaua

SEQ ID NO: 34656 - RNA, 22 nt, Human
cugcagaauggggccaagugga

SEQ ID NO: 34657 - RNA, 23 nt, Human
cugcagagaacugagggacagcc

SEQ ID NO: 34658 - RNA, 22 nt, Human
cugcagagaccuaggucagguu

SEQ ID NO: 34659 - RNA, 22 nt, Human
cugcagagcaugaggaggucug

SEQ ID NO: 34660 - RNA, 22 nt, Human
cugcagagcuugucuggaugug

SEQ ID NO: 34661 - RNA, 22 nt, Human
cugcagaggguuugagcauccu

SEQ ID NO: 34662 - RNA, 22 nt, Human
cugcagaguggagccucggcug

SEQ ID NO: 34663 - RNA, 22 nt, Human
cugcagaucuuguguacuuguc

SEQ ID NO: 34664 - RNA, 22 nt, Human
cugcagaugguauuguucuggu

SEQ ID NO: 34665 - RNA, 22 nt, Human
cugcagauuggccugauguuca

SEQ ID NO: 34666 - RNA, 22 nt, Human
cugcagcaagagaagugcugac

SEQ ID NO: 34667 - RNA, 22 nt, Human
cugcagcagaauaaucugcuca

SEQ ID NO: 34668 - RNA, 22 nt, Human
cugcagcagggcuugcccaccu

SEQ ID NO: 34669 - RNA, 22 nt, Human
cugcagcauccuagggucugug

SEQ ID NO: 34670 - RNA, 22 nt, Human
cugcagcaucgccaccugccuc

SEQ ID NO: 34671 - RNA, 22 nt, Human
cugcagccacgagucacagccc

SEQ ID NO: 34672 - RNA, 22 nt, Human
cugcagccuaggugcagcuggg

SEQ ID NO: 34673 - RNA, 19 nt, Human
cugcagcugcaccauccca

SEQ ID NO: 34674 - RNA, 22 nt, Human
cugcagcugccagugauuucag

SEQ ID NO: 34675 - RNA, 22 nt, Human
cugcagcuggagcaucuucuca

SEQ ID NO: 34676 - RNA, 22 nt, Human
cugcagcugugagugcuggaug

SEQ ID NO: 34677 - RNA, 22 nt, Human
cugcagcuuaagggagggguug

SEQ ID NO: 34678 - RNA, 22 nt, Human
cugcagcuuuggaaaccuguuu

SEQ ID NO: 34679 - RNA, 22 nt, Human
cugcaggacagggaggagcaag

SEQ ID NO: 34680 - RNA, 21 nt, Human
cuggaacaaauacuagcaaac

SEQ ID NO: 34681 - RNA, 22 nt, Human
cuggaacagaagcacuggagag

SEQ ID NO: 34682 - RNA, 22 nt, Human
cuggaagaacuccaguucugug

SEQ ID NO: 34683 - RNA, 22 nt, Human
cuggaagacucaauggccugcc

SEQ ID NO: 34684 - RNA, 22 nt, Human
cuggaagaggaagccagcugga

SEQ ID NO: 34685 - RNA, 22 nt, Human
cuggaagagugacuuugcauuu

SEQ ID NO: 34686 - RNA, 22 nt, Human
cuggaaggguacauaggaaacu

SEQ ID NO: 34687 - RNA, 22 nt, Human
cuggaagggucuacuuagcaga

SEQ ID NO: 34688 - RNA, 22 nt, Human
cuggaaggugacugucuugaau

SEQ ID NO: 34689 - RNA, 22 nt, Human
cuggaaguauaggggagaugau

SEQ ID NO: 34690 - RNA, 22 nt, Human
cuggaaguggagaguggcccuc

SEQ ID NO: 34691 - RNA, 22 nt, Human
cuggaaugaagcuauguacauu

SEQ ID NO: 34692 - RNA, 22 nt, Human
cuggaaugagcagggcuuaugg

SEQ ID NO: 34693 - RNA, 19 nt, Human
cuggaaugauagagaccuc

SEQ ID NO: 34694 - RNA, 22 nt, Human
cuggaaugucugcucaauguuu

SEQ ID NO: 34695 - RNA, 16 nt, Human
cuggacagaaaaaccu

SEQ ID NO: 34696 - RNA, 22 nt, Human
cuggacagaaaaggccacugga

SEQ ID NO: 34697 - RNA, 22 nt, Human
cuggacagaaguggcugggcag

SEQ ID NO: 34698 - RNA, 22 nt, Human
cuggacagcccucacugugugc

SEQ ID NO: 34699 - RNA, 22 nt, Human
cuggacaggcuggggacugcaa

SEQ ID NO: 34700 - RNA, 22 nt, Human
cuggacagugcugcuugagaug

SEQ ID NO: 34701 - RNA, 22 nt, Human
cuggacagugggcagaggagac

SEQ ID NO: 34702 - RNA, 22 nt, Human
cuggaccagccuccgccuucac

SEQ ID NO: 34703 - RNA, 23 nt, Human
cuggacucaggggaugugaagga

SEQ ID NO: 34704 - RNA, 22 nt, Human
cuggacucugcagagaaaagua

SEQ ID NO: 34705 - RNA, 22 nt, Human
cuggagaaaauccauguguaug

SEQ ID NO: 34706 - RNA, 22 nt, Human
cuggagaagccaaacuagucac

SEQ ID NO: 34707 - RNA, 22 nt, Human
cuggagagaaaugacaaagcua

SEQ ID NO: 34708 - RNA, 22 nt, Human
cuggagagaauguucauugcag

SEQ ID NO: 34709 - RNA, 22 nt, Human
cuggagagggagcccuggcagu

SEQ ID NO: 34710 - RNA, 22 nt, Human
cuggagauaaguaaagaggcaa

SEQ ID NO: 34711 - RNA, 22 nt, Human
cuggagauguccgggugcuguu

SEQ ID NO: 34712 - RNA, 22 nt, Human
cuggagcaaaagugacuccucu

SEQ ID NO: 34713 - RNA, 17 nt, Human
cuggagccuccaacucc

SEQ ID NO: 34714 - RNA, 22 nt, Human
cuggagccugcaguuuucacuu

SEQ ID NO: 34715 - RNA, 22 nt, Human
cuggagcuaggaaguccaagau

SEQ ID NO: 34716 - RNA, 22 nt, Human
cuggagcugccagacgggcaca

SEQ ID NO: 34717 - RNA, 22 nt, Human
cuggagcuuauugggagcagaa

SEQ ID NO: 34718 - RNA, 22 nt, Human
cuggaggaggaagucuacaaug

SEQ ID NO: 34719 - RNA, 22 nt, Human
cuggaggcacccuuagagaggc

SEQ ID NO: 34720 - RNA, 22 nt, Human
cuggaggcugaguugggucucc

SEQ ID NO: 34721 - RNA, 22 nt, Human
cuggagggggaaauguucauug

SEQ ID NO: 34722 - RNA, 22 nt, Human
cuggaggguggagagaagucuc

SEQ ID NO: 34723 - RNA, 22 nt, Human
cuggaguaaguuaagauguucc

SEQ ID NO: 34724 - RNA, 21 nt, Human
cuggagucauuuucugaguag

SEQ ID NO: 34725 - RNA, 22 nt, Human
cuggagugacuuuguuccuuuu

SEQ ID NO: 34726 - RNA, 22 nt, Human
cuggagugaggucugggagccu

SEQ ID NO: 34727 - RNA, 22 nt, Human
cuggagugcaaccucugccucc

SEQ ID NO: 34728 - RNA, 22 nt, Human
cuggaguucuaugugcuuguga

SEQ ID NO: 34729 - RNA, 22 nt, Human
cuggaguuugcggggacagaga

SEQ ID NO: 34730 - RNA, 22 nt, Human
cuggauaaauguuugcuuuaga

SEQ ID NO: 34731 - RNA, 22 nt, Human
cuggauaaucacagaggagcau

SEQ ID NO: 34732 - RNA, 22 nt, Human
cuggauccuucucuguguauuu

SEQ ID NO: 34733 - RNA, 22 nt, Human
cuggaugauaacagcaauauuu

SEQ ID NO: 34734 - RNA, 22 nt, Human
cuggaugcugagagguaccaag

SEQ ID NO: 34735 - RNA, 22 nt, Human
cuggaugcuuccucucugcuag

SEQ ID NO: 34736 - RNA, 22 nt, Human
cuggauggaaggaggauaguau

SEQ ID NO: 34737 - RNA, 22 nt, Human
cuggcacaaugucacuuuugcu

SEQ ID NO: 34738 - RNA, 22 nt, Human
cuggcacacaguaggcaccaau

SEQ ID NO: 34739 - RNA, 22 nt, Human
cuggcacagagugagcauucaa

SEQ ID NO: 34740 - RNA, 22 nt, Human
cuggcacagccacugcaggcag

SEQ ID NO: 34741 - RNA, 22 nt, Human
cuggcacaucacuccuaguuua

SEQ ID NO: 34742 - RNA, 22 nt, Human
cuggcaccaggcaugcugggag

SEQ ID NO: 34743 - RNA, 22 nt, Human
cuggaguuagaguagacacuga

SEQ ID NO: 34744 - RNA, 22 nt, Human
cuggaguucgacugaguugaau

SEQ ID NO: 34745 - RNA, 22 nt, Human
cuggaguugggaugugccugga

SEQ ID NO: 34746 - RNA, 22 nt, Human
cuggaguuuguggcuugcucaa

SEQ ID NO: 34747 - RNA, 22 nt, Human
cuggauaaaugcuuuaguugga

SEQ ID NO: 34748 - RNA, 22 nt, Human
cuggaucaugggaaagggauca

SEQ ID NO: 34749 - RNA, 22 nt, Human
cuggaucuaaagguggauguag

SEQ ID NO: 34750 - RNA, 22 nt, Human
cuggaucugaacaucgguauca

SEQ ID NO: 34751 - RNA, 22 nt, Human
cuggaucuguccccuuuuuguu

SEQ ID NO: 34752 - RNA, 22 nt, Human
cuggaucugucuuuuggauccc

SEQ ID NO: 34753 - RNA, 22 nt, Human
cuggaucuugcugcauugagaa

SEQ ID NO: 34754 - RNA, 20 nt, Human
cuggaugcuaaaacacacac

SEQ ID NO: 34755 - RNA, 22 nt, Human
cuggauggucccaugagcagcu

SEQ ID NO: 34756 - RNA, 22 nt, Human
cuggauguaaagggugaagaaa

SEQ ID NO: 34757 - RNA, 22 nt, Human
cuggauguccuuccccugaagc

SEQ ID NO: 34758 - RNA, 22 nt, Human
cuggaugucuuggggacuccug

SEQ ID NO: 34759 - RNA, 22 nt, Human
cuggauguucuucugcaauuau

SEQ ID NO: 34760 - RNA, 18 nt, Human
cuggauuaagacagugcu

SEQ ID NO: 34761 - RNA, 22 nt, Human
cuggauuuaauuaacuguugcu

SEQ ID NO: 34762 - RNA, 22 nt, Human
cuggauuugccuauggugcuuu

SEQ ID NO: 34763 - RNA, 22 nt, Human
cuggauuuuaucauuguaguuu

SEQ ID NO: 34764 - RNA, 22 nt, Human
cuggcacaacuccaccucagcg

SEQ ID NO: 34765 - RNA, 22 nt, Human
cuggcacacaaguauuuccuuu

SEQ ID NO: 34766 - RNA, 22 nt, Human
cuggcacacagaggcccucggg

SEQ ID NO: 34767 - RNA, 22 nt, Human
cuggcacagagacagaaggauu

SEQ ID NO: 34768 - RNA, 22 nt, Human
cuggcacagcuugggccccauc

SEQ ID NO: 34769 - RNA, 22 nt, Human
cuggcacaguuaacauaugcua

SEQ ID NO: 34770 - RNA, 22 nt, Human
cuggcacaugcucccugagugg

SEQ ID NO: 34771 - RNA, 22 nt, Human
cuggcacaugugagccacauca

SEQ ID NO: 34772 - RNA, 22 nt, Human
cuggcacucauaggccaguuca

SEQ ID NO: 34773 - RNA, 22 nt, Human
cuggcacugaguggcuuaugac

SEQ ID NO: 34774 - RNA, 22 nt, Human
cuggcagaguugggucucaaau

SEQ ID NO: 34775 - RNA, 22 nt, Human
cuggcagauaguaagugaucaa

SEQ ID NO: 34776 - RNA, 22 nt, Human
cuggcagauauuugcagacaug

SEQ ID NO: 34777 - RNA, 22 nt, Human
cuggcagcaguuaugaaacaau

SEQ ID NO: 34778 - RNA, 22 nt, Human
cuggcagcauuuuuuucagaag

SEQ ID NO: 34779 - RNA, 22 nt, Human
cuggcagcuggaggcuagaggc

SEQ ID NO: 34780 - RNA, 22 nt, Human
cuggcagcuuauuagaaaugca

SEQ ID NO: 34781 - RNA, 22 nt, Human
cuggcaggcacucaugaaauaa

SEQ ID NO: 34782 - RNA, 22 nt, Human
cuggcaggcggagguugcagug

SEQ ID NO: 34783 - RNA, 22 nt, Human
cuggcagggcucuuugggugcu

SEQ ID NO: 34784 - RNA, 22 nt, Human
cuggcagggugggcuuugcuuu

SEQ ID NO: 34785 - RNA, 22 nt, Human
cuggcaguauuaagagaaguga

SEQ ID NO: 34786 - RNA, 22 nt, Human
cuggcagugacauugcaggugc

SEQ ID NO: 34787 - RNA, 22 nt, Human
cuggcaguggaggaagaaaacu

SEQ ID NO: 34788 - RNA, 22 nt, Human
cuggcaguuggcagggcugcca

SEQ ID NO: 34789 - RNA, 22 nt, Human
cuggcccuaggcaaacacagau

SEQ ID NO: 34790 - RNA, 22 nt, Human
cuggcccuauuccaggccuucc

SEQ ID NO: 34791 - RNA, 22 nt, Human
cuggcccucagacucaugggca

SEQ ID NO: 34792 - RNA, 22 nt, Human
cuggcccugccuaauguacuug

SEQ ID NO: 34793 - RNA, 16 nt, Human
cuggcccuggcucugg

SEQ ID NO: 34794 - RNA, 22 nt, Human
cuggcccuggcuggagcccagg

SEQ ID NO: 34795 - RNA, 22 nt, Human
cuggcccugguaaggacaccca

SEQ ID NO: 34796 - RNA, 22 nt, Human
cuggcccugucagcacagaauc

SEQ ID NO: 34797 - RNA, 22 nt, Human
cuggcccuugacuuacagcagg

SEQ ID NO: 34798 - RNA, 22 nt, Human
cuggccgccuggggccggguga

SEQ ID NO: 34799 - RNA, 22 nt, Human
cuggccgguauuugccucuggg

SEQ ID NO: 34800 - RNA, 22 nt, Human
cuggccuagcucucugcuugaa

SEQ ID NO: 34801 - RNA, 22 nt, Human
cuggccucacagaggcuaagcc

SEQ ID NO: 34802 - RNA, 22 nt, Human
cuggccucaccucagacuuacu

SEQ ID NO: 34803 - RNA, 22 nt, Human
cuggccugaggccgccuucaga

SEQ ID NO: 34804 - RNA, 22 nt, Human
cuggccugccugccgguugucg

SEQ ID NO: 34805 - RNA, 22 nt, Human
cuggccugggagcugcuagcgu

SEQ ID NO: 34806 - RNA, 22 nt, Human
cuggccuguccugacccagccu

SEQ ID NO: 34807 - RNA, 22 nt, Human
cuggccugugggcugucuccgg

SEQ ID NO: 34808 - RNA, 22 nt, Human
cuggccuuuagccccagugucu

SEQ ID NO: 34809 - RNA, 22 nt, Human
cuggcucaauuuguacugcugu

SEQ ID NO: 34810 - RNA, 22 nt, Human
cuggcucaggguggucuggguc

SEQ ID NO: 34811 - RNA, 22 nt, Human
cuggcucauagagcagcuccaa

SEQ ID NO: 34812 - RNA, 22 nt, Human
cuggcucauuuuagcaucaggu

SEQ ID NO: 34813 - RNA, 22 nt, Human
cuggcucccaugagcucucacg

SEQ ID NO: 34814 - RNA, 22 nt, Human
cuggcuccccuacuucuuauug

SEQ ID NO: 34815 - RNA, 22 nt, Human
cuggcucccgaagcccucagug

SEQ ID NO: 34816 - RNA, 22 nt, Human
cuggcucccucgcugaggugcu

SEQ ID NO: 34817 - RNA, 22 nt, Human
cuggcuccucuacacacccaaa

SEQ ID NO: 34818 - RNA, 22 nt, Human
cuggcuccugaggcuuggcccc

SEQ ID NO: 34819 - RNA, 22 nt, Human
cuggcucuaagugucagcuccc

SEQ ID NO: 34820 - RNA, 22 nt, Human
cuggcucugaguggcucuaauu

SEQ ID NO: 34821 - RNA, 22 nt, Human
cuggcucugagugguaucuuga

SEQ ID NO: 34822 - RNA, 22 nt, Human
cuggcucugggccucagacacu

SEQ ID NO: 34823 - RNA, 22 nt, Human
cuggcucugggcuaagcuccca

SEQ ID NO: 34824 - RNA, 22 nt, Human
cuggcucuguggcuuccuucau

SEQ ID NO: 34825 - RNA, 22 nt, Human
cuggcugaagcugggcucuccu

SEQ ID NO: 34826 - RNA, 22 nt, Human
cuggcugacacaaagguaucga

SEQ ID NO: 34827 - RNA, 22 nt, Human
cuggcugaguuacuccacugag

SEQ ID NO: 34828 - RNA, 19 nt, Human
cuggcugcaaugccagggu

SEQ ID NO: 34829 - RNA, 22 nt, Human
cuggcugcaggaugaggcugcc

SEQ ID NO: 34830 - RNA, 22 nt, Human
cuggcugcaguagcaagagacu

SEQ ID NO: 34831 - RNA, 22 nt, Human
cuggcugccuauagucucccuu

SEQ ID NO: 34832 - RNA, 22 nt, Human
cuggcugcgcuaguccagaaga

SEQ ID NO: 34833 - RNA, 22 nt, Human
cuggcugcuuguagacucgacu

SEQ ID NO: 34834 - RNA, 22 nt, Human
cuggcugcuuguuuugaugggu

SEQ ID NO: 34835 - RNA, 16 nt, Human
cuggcuggaagccugg

SEQ ID NO: 34836 - RNA, 22 nt, Human
cuggcuggaaguuagagaacuu

SEQ ID NO: 34837 - RNA, 22 nt, Human
cuggcuggcaaguagaacacaa

SEQ ID NO: 34838 - RNA, 22 nt, Human
cuggcuggccauguagagauga

SEQ ID NO: 34839 - RNA, 22 nt, Human
cuggcuggcguuuuccaaaagc

SEQ ID NO: 34840 - RNA, 22 nt, Human
cuggcugggguaccaguugaac

SEQ ID NO: 34841 - RNA, 22 nt, Human
cuggcugggguccauccucuaa

SEQ ID NO: 34842 - RNA, 22 nt, Human
cuggcuggucaugucaugagcc

SEQ ID NO: 34843 - RNA, 22 nt, Human
cuggcugguccucggggacagc

SEQ ID NO: 34844 - RNA, 22 nt, Human
cuggcugguuggggagaagaca

SEQ ID NO: 34845 - RNA, 22 nt, Human
cuggcugguugucucaauccag

SEQ ID NO: 34846 - RNA, 22 nt, Human
cuggcugugcagucuuccagaa

SEQ ID NO: 34847 - RNA, 22 nt, Human
cuggcuguggauuaucacaggc

SEQ ID NO: 34848 - RNA, 22 nt, Human
cuggcugugugcccccggcacc

SEQ ID NO: 34849 - RNA, 22 nt, Human
cuggcuguuucaggcagugucc

SEQ ID NO: 34850 - RNA, 22 nt, Human
cuggcuguuucuccuuugucua

SEQ ID NO: 34851 - RNA, 20 nt, Human
cuggcuucgggaacuaguuu

SEQ ID NO: 34852 - RNA, 22 nt, Human
cuggcuugcagcucaucauaaa

SEQ ID NO: 34853 - RNA, 22 nt, Human
cuggcuugggucuaccugccuu

SEQ ID NO: 34854 - RNA, 22 nt, Human
cuggcuuguuuuaagaauacaa

SEQ ID NO: 34855 - RNA, 22 nt, Human
cuggcuuucauuucaagcacgu

SEQ ID NO: 34856 - RNA, 22 nt, Human
cuggcuuucugcaaaucuccau

SEQ ID NO: 34857 - RNA, 22 nt, Human
cuggcuuucuguuauaaagaca

SEQ ID NO: 34858 - RNA, 22 nt, Human
cuggcuuugaaaugcauuucag

SEQ ID NO: 34859 - RNA, 22 nt, Human
cuggcuuugaggauccccucuu

SEQ ID NO: 34860 - RNA, 22 nt, Human
cuggcuguggucacagguaacu

SEQ ID NO: 34861 - RNA, 22 nt, Human
cuggcugugucuuggaggagcu

SEQ ID NO: 34862 - RNA, 22 nt, Human
cuggcuguuuucaauguugaug

SEQ ID NO: 34863 - RNA, 19 nt, Human
cuggcuucaagcaguccuc

SEQ ID NO: 34864 - RNA, 23 nt, Human
cuggcuucuggggccucuguuuc

SEQ ID NO: 34865 - RNA, 22 nt, Human
cuggcuuuaaaaugcuccugga

SEQ ID NO: 34866 - RNA, 22 nt, Human
cuggcuuuaacccuacaaaccu

SEQ ID NO: 34867 - RNA, 22 nt, Human
cuggcuuuagguuggagagcug

SEQ ID NO: 34868 - RNA, 22 nt, Human
cuggcuuucauggcgcaguuga

SEQ ID NO: 34869 - RNA, 22 nt, Human
cuggcuuuccuugucugcaucc

SEQ ID NO: 34870 - RNA, 22 nt, Human
cuggcuuucucugugguguuca

SEQ ID NO: 34871 - RNA, 22 nt, Human
cuggcuuucugcacagaauugg

SEQ ID NO: 34872 - RNA, 18 nt, Human
cuggcuuucuuauccauc

SEQ ID NO: 34873 - RNA, 22 nt, Human
cuggcuuuguucugauugcuuc

SEQ ID NO: 34874 - RNA, 22 nt, Human
cugggaagccauguuucuagga

SEQ ID NO: 34875 - RNA, 22 nt, Human
cugggaagggacgccagugccu

SEQ ID NO: 34876 - RNA, 22 nt, Human
cugggaagggagucaagauacu

SEQ ID NO: 34877 - RNA, 22 nt, Human
cugggacacccagagcugcaga

SEQ ID NO: 34878 - RNA, 22 nt, Human
cugggacauauugcuaguguug

SEQ ID NO: 34879 - RNA, 22 nt, Human
cugggacaugauagaaacagau

SEQ ID NO: 34880 - RNA, 23 nt, Human
cugggacaugguaggggcacaac

SEQ ID NO: 34881 - RNA, 22 nt, Human
cugggacauggugcugucuuua

SEQ ID NO: 34882 - RNA, 22 nt, Human
cugggaccuccucacuguucua

SEQ ID NO: 34883 - RNA, 22 nt, Human
cugggaccucggggugaucaaa

SEQ ID NO: 34884 - RNA, 18 nt, Human
cugggacucaaugcuacu

SEQ ID NO: 34885 - RNA, 22 nt, Human
cugggacucagaccaguucugu

SEQ ID NO: 34886 - RNA, 22 nt, Human
cugggacuugaugaaaugacug

SEQ ID NO: 34887 - RNA, 22 nt, Human
cugggacuuguagucucggcgc

SEQ ID NO: 34888 - RNA, 22 nt, Human
cugggacuuuacccuguggccc

SEQ ID NO: 34889 - RNA, 22 nt, Human
cugggacuuuguaggccaguug

SEQ ID NO: 34890 - RNA, 22 nt, Human
cugggagcaagucaggaaaggu

SEQ ID NO: 34891 - RNA, 22 nt, Human
cugggagcccgcguccuggugg

SEQ ID NO: 34892 - RNA, 22 nt, Human
cugggagccuggcaguugcuga

SEQ ID NO: 34893 - RNA, 22 nt, Human
cugggagcugaggcugacgcug

SEQ ID NO: 34894 - RNA, 22 nt, Human
cugggagcuggaaugggagaag

SEQ ID NO: 34895 - RNA, 22 nt, Human
cugggaggcacuauucaggagg

SEQ ID NO: 34896 - RNA, 22 nt, Human
cugggagggguagccaauccua

SEQ ID NO: 34897 - RNA, 19 nt, Human
cugggagguguucagagaa

SEQ ID NO: 34898 - RNA, 22 nt, Human
gcucugcccaaugucccuacac

SEQ ID NO: 34899 - RNA, 22 nt, Human
gcucugcucuugacuuaccagg

SEQ ID NO: 34900 - RNA, 22 nt, Human
gcucugcugauccgcagccauc

SEQ ID NO: 34901 - RNA, 22 nt, Human
gcucugcuugcaucaugacugc

SEQ ID NO: 34902 - RNA, 22 nt, Human
gcucuggacuggggccugagaa

SEQ ID NO: 34903 - RNA, 22 nt, Human
gcucuggcagcugauauuagga

SEQ ID NO: 34904 - RNA, 23 nt, Human
gcucuggcagcuugugucagcac

SEQ ID NO: 34905 - RNA, 21 nt, Human
gcucuggccuacuguucccuc

SEQ ID NO: 34906 - RNA, 22 nt, Human
gcucuggcuuggggcacucguc

SEQ ID NO: 34907 - RNA, 22 nt, Human
gcucugggaacugacugccuuc

SEQ ID NO: 34908 - RNA, 22 nt, Human
gcucugggaaggaucguaguga

SEQ ID NO: 34909 - RNA, 22 nt, Human
gcucugggaaguccuuuaccau

SEQ ID NO: 34910 - RNA, 22 nt, Human
gcucugggauuaccagccuuag

SEQ ID NO: 34911 - RNA, 22 nt, Human
gcucugggccauccuggccggg

SEQ ID NO: 34912 - RNA, 22 nt, Human
gcucugggcugcccucuggaca

SEQ ID NO: 34913 - RNA, 18 nt, Human
gcucugguuccuucaacc

SEQ ID NO: 34914 - RNA, 22 nt, Human
gcucugguucucuuagaguagu

SEQ ID NO: 34915 - RNA, 22 nt, Human
gcucuguaucuguggggcuucc

SEQ ID NO: 34916 - RNA, 22 nt, Human
gcucugucauuuugcagacacu

SEQ ID NO: 34917 - RNA, 22 nt, Human
gcucugugaguauuggcccugg

SEQ ID NO: 34918 - RNA, 22 nt, Human
gcucugugccagggcugggcca

SEQ ID NO: 34919 - RNA, 22 nt, Human
gcucugugguggggcagaguuu

SEQ ID NO: 34920 - RNA, 21 nt, Human
gcucuguguuacaaguugggg

SEQ ID NO: 34921 - RNA, 22 nt, Human
gcucuguguugucagaggcacc

SEQ ID NO: 34922 - RNA, 22 nt, Human
gcucuguguuuugcccaggaga

SEQ ID NO: 34923 - RNA, 22 nt, Human
gcucuugaaaaucaaaagggaa

SEQ ID NO: 34924 - RNA, 22 nt, Human
gcucuugaauauggguuucaug

SEQ ID NO: 34925 - RNA, 22 nt, Human
gcucuugaccuuggagaacucg

SEQ ID NO: 34926 - RNA, 22 nt, Human
gcucuugauacaucaagaacuu

SEQ ID NO: 34927 - RNA, 22 nt, Human
gcucuugauguucauugacuug

SEQ ID NO: 34928 - RNA, 22 nt, Human
gcucuuuguauuuuggaaucaa

SEQ ID NO: 34929 - RNA, 19 nt, Human
gcugaaaucaaauuuggaa

SEQ ID NO: 34930 - RNA, 22 nt, Human
gcugaaauguuuaauuugggag

SEQ ID NO: 34931 - RNA, 18 nt, Human
gcugaaauucuaaacaaa

SEQ ID NO: 34932 - RNA, 17 nt, Human
gcugaacaaggaaaaua

SEQ ID NO: 34933 - RNA, 21 nt, Human
gcugaagaacucuuuauuuuc

SEQ ID NO: 34934 - RNA, 23 nt, Human
gcugaagagcaaaccaggcaaaa

SEQ ID NO: 34935 - RNA, 20 nt, Human
gcugaagauucccaugcaag

SEQ ID NO: 34936 - RNA, 22 nt, Human
gcugaagauuuuugcuagcccc

SEQ ID NO: 34937 - RNA, 16 nt, Human
gcugaagugaguauag

SEQ ID NO: 34938 - RNA, 22 nt, Human
gcugaauaggacugucaucucu

SEQ ID NO: 34939 - RNA, 22 nt, Human
gcugacaaugagaaagagcaaa

SEQ ID NO: 34940 - RNA, 22 nt, Human
gcugacacuuagaagugcccug

SEQ ID NO: 34941 - RNA, 22 nt, Human
gcugacagagugccuggccuca

SEQ ID NO: 34942 - RNA, 22 nt, Human
gcugacagcaaggggcugcccu

SEQ ID NO: 34943 - RNA, 17 nt, Human
gcugacccuggagaagu

SEQ ID NO: 34944 - RNA, 22 nt, Human
gcugaccuguggcagaagcuca

SEQ ID NO: 34945 - RNA, 22 nt, Human
gcugaccuuugccaggaaggca

SEQ ID NO: 34946 - RNA, 22 nt, Human
gcugagaacagagcucugagcu

SEQ ID NO: 34947 - RNA, 22 nt, Human
gcugagaauguuccuacuggua

SEQ ID NO: 34948 - RNA, 21 nt, Human
gcugagacgcaaccucaguga

SEQ ID NO: 34949 - RNA, 22 nt, Human
gcugagacuggcagcaggaagu

SEQ ID NO: 34950 - RNA, 22 nt, Human
gcugagagaaaagugagguucu

SEQ ID NO: 34951 - RNA, 22 nt, Human
gcugagagcaaagcaugucuag

SEQ ID NO: 34952 - RNA, 17 nt, Human
gcugagaggcagcacag

SEQ ID NO: 34953 - RNA, 21 nt, Human
gcugagagguugggaaguuca

SEQ ID NO: 34954 - RNA, 22 nt, Human
gcugagagugggugcagugcuu

SEQ ID NO: 34955 - RNA, 22 nt, Human
gcugagagugugagaucagauu

SEQ ID NO: 34956 - RNA, 22 nt, Human
gcugagcaacguggagaguuuu

SEQ ID NO: 34957 - RNA, 22 nt, Human
gcugagcacagcaaagagacaa

SEQ ID NO: 34958 - RNA, 22 nt, Human
gcugagcaggguggggaaaggc

SEQ ID NO: 34959 - RNA, 22 nt, Human
gcugagcagguguaaggaaggc

SEQ ID NO: 34960 - RNA, 22 nt, Human
gcugagccacaggcagugcacu

SEQ ID NO: 34961 - RNA, 22 nt, Human
gcugagcugaggcagggcuggg

SEQ ID NO: 34962 - RNA, 22 nt, Human
gcugaggaaaccaaugcucaga

SEQ ID NO: 34963 - RNA, 22 nt, Human
gcugaggaaaggcuggaaggga

SEQ ID NO: 34964 - RNA, 22 nt, Human
gcugaggacauacacauugugc

SEQ ID NO: 34965 - RNA, 20 nt, Human
gcugaggagcagugugguug

SEQ ID NO: 34966 - RNA, 22 nt, Human
gcugaggagcgagaacucugcu

SEQ ID NO: 34967 - RNA, 22 nt, Human
gcugaggauauagcaggaacaa

SEQ ID NO: 34968 - RNA, 20 nt, Human
gcugaggauuccuggccccu

SEQ ID NO: 34969 - RNA, 22 nt, Human
gcugaggcaaauaguuuuaagu

SEQ ID NO: 34970 - RNA, 22 nt, Human
gcugaggccaguuuaaugagga

SEQ ID NO: 34971 - RNA, 22 nt, Human
gcugaggccucagaaggcugag

SEQ ID NO: 34972 - RNA, 22 nt, Human
gcugaggcucaauccccuucug

SEQ ID NO: 34973 - RNA, 22 nt, Human
gcugaggcuuagcuaaaaauuu

SEQ ID NO: 34974 - RNA, 22 nt, Human
gcugagggaccauguuucagga

SEQ ID NO: 34975 - RNA, 22 nt, Human
gcugagggaggcugaacugagu

SEQ ID NO: 34976 - RNA, 22 nt, Human
gcugagggcauguguggcgacu

SEQ ID NO: 34977 - RNA, 22 nt, Human
gcugagggggaaggaaagcuga

SEQ ID NO: 34978 - RNA, 22 nt, Human
cuggcuuugcgucuuugccaca

SEQ ID NO: 34979 - RNA, 22 nt, Human
cuggcuuugcuggacugggagu

SEQ ID NO: 34980 - RNA, 22 nt, Human
cuggcuuuucaaacuguucagu

SEQ ID NO: 34981 - RNA, 22 nt, Human
cugggaaagcaagguuguggau

SEQ ID NO: 34982 - RNA, 22 nt, Human
cugggaaauauaauaaaguggu

SEQ ID NO: 34983 - RNA, 22 nt, Human
cugggaagaaauugugggaggc

SEQ ID NO: 34984 - RNA, 22 nt, Human
cugggaagaagggacaacagcg

SEQ ID NO: 34985 - RNA, 22 nt, Human
cugggaagaagugggcuacauu

SEQ ID NO: 34986 - RNA, 22 nt, Human
cugggaagauggugacagaauu

SEQ ID NO: 34987 - RNA, 22 nt, Human
cugggaagcauggugaugguau

SEQ ID NO: 34988 - RNA, 22 nt, Human
cugggaagcuucgagcaggaaa

SEQ ID NO: 34989 - RNA, 19 nt, Human
cugggacaaugaaagcauc

SEQ ID NO: 34990 - RNA, 22 nt, Human
cugggacacccaaggaaagagc

SEQ ID NO: 34991 - RNA, 22 nt, Human
cugggacagcugagacaggaga

SEQ ID NO: 34992 - RNA, 22 nt, Human
cugggaccagugaagcaacuca

SEQ ID NO: 34993 - RNA, 22 nt, Human
cugggacccccacugcguagcu

SEQ ID NO: 34994 - RNA, 22 nt, Human
cugggacccugcccuguggccu

SEQ ID NO: 34995 - RNA, 22 nt, Human
cugggaccugugugccugggcc

SEQ ID NO: 34996 - RNA, 22 nt, Human
cugggacuugcagagcaggagg

SEQ ID NO: 34997 - RNA, 22 nt, Human
cugggacuugggcuaugcucug

SEQ ID NO: 34998 - RNA, 22 nt, Human
cugggagaauuuguugaaggau

SEQ ID NO: 34999 - RNA, 22 nt, Human
cugggagacaagagagggcuga

SEQ ID NO: 35000 - RNA, 22 nt, Human
cugggagagaagcgaagcuggg

SEQ ID NO: 35001 - RNA, 22 nt, Human
cugggagagguggugggaagua

SEQ ID NO: 35002 - RNA, 22 nt, Human
cugggagauaugaggaucugga

SEQ ID NO: 35003 - RNA, 22 nt, Human
cugggagaucuccugagggcag

SEQ ID NO: 35004 - RNA, 22 nt, Human
cugggagaucuguugggacugg

SEQ ID NO: 35005 - RNA, 22 nt, Human
cugggagauugcuagagaugca

SEQ ID NO: 35006 - RNA, 22 nt, Human
cugggagcgcagcaggcacaac

SEQ ID NO: 35007 - RNA, 22 nt, Human
cuguucagaaaaaaucuucaug

SEQ ID NO: 35008 - RNA, 22 nt, Human
cuguucaugcugauucuguaug

SEQ ID NO: 35009 - RNA, 22 nt, Human
cuguucccgguggccgggccag

SEQ ID NO: 35010 - RNA, 22 nt, Human
cuguuccuccaccucaacaaac

SEQ ID NO: 35011 - RNA, 20 nt, Human
cuguuccugucccaugaagc

SEQ ID NO: 35012 - RNA, 22 nt, Human
cuguucugcugcauaaaaacuu

SEQ ID NO: 35013 - RNA, 22 nt, Human
cuguucuucugggaauggcccu

SEQ ID NO: 35014 - RNA, 22 nt, Human
cuguugauuagaauuucacauc

SEQ ID NO: 35015 - RNA, 22 nt, Human
cuguugcaucauggcucuuaau

SEQ ID NO: 35016 - RNA, 22 nt, Human
cuguugcuccagggaacacaga

SEQ ID NO: 35017 - RNA, 22 nt, Human
cuguuggacuuuucaaggucug

SEQ ID NO: 35018 - RNA, 22 nt, Human
cuguuggagucauuccuuccag

SEQ ID NO: 35019 - RNA, 22 nt, Human
cuguuguaaagcuauucauuug

SEQ ID NO: 35020 - RNA, 22 nt, Human
cuguuguauuuccaacuaugua

SEQ ID NO: 35021 - RNA, 22 nt, Human
cuguuguucaucaucugucauu

SEQ ID NO: 35022 - RNA, 22 nt, Human
cuguuuaaugcaaugaaaugag

SEQ ID NO: 35023 - RNA, 22 nt, Human
cuguuuauacucaaaagauaca

SEQ ID NO: 35024 - RNA, 22 nt, Human
cuguuuaucuaggaguugcagg

SEQ ID NO: 35025 - RNA, 22 nt, Human
cuguuuaucucuaaccuguuua

SEQ ID NO: 35026 - RNA, 21 nt, Human
cuguuuauuucaccugggugc

SEQ ID NO: 35027 - RNA, 19 nt, Human
cuguuucaaguaggaggag

SEQ ID NO: 35028 - RNA, 22 nt, Human
cuguuucaagugaagucagaca

SEQ ID NO: 35029 - RNA, 22 nt, Human
cuguuucacguguuuaagccca

SEQ ID NO: 35030 - RNA, 22 nt, Human
cuguuucagcuacuguuccaug

SEQ ID NO: 35031 - RNA, 22 nt, Human
cuguuucaugaaugcaauuuca

SEQ ID NO: 35032 - RNA, 22 nt, Human
cuguuuccaccuucauggcuaa

SEQ ID NO: 35033 - RNA, 22 nt, Human
cuguuuccauacagguuuuugg

SEQ ID NO: 35034 - RNA, 22 nt, Human
cuguuucuccacacucuuccca

SEQ ID NO: 35035 - RNA, 22 nt, Human
cuguuuguuggcuauugacagu

SEQ ID NO: 35036 - RNA, 22 nt, Human
cuguuuuaauggagacugaugu

SEQ ID NO: 35037 - RNA, 22 nt, Human
cuguuuucaaagagagagaaug

SEQ ID NO: 35038 - RNA, 22 nt, Human
cuuaaaagagaugacggcaggg

SEQ ID NO: 35039 - RNA, 22 nt, Human
cuuaaacaggaaagagccaggu

SEQ ID NO: 35040 - RNA, 22 nt, Human
cuuaaacugggcauucagagaa

SEQ ID NO: 35041 - RNA, 22 nt, Human
cuuaaaggucauucuguugaua

SEQ ID NO: 35042 - RNA, 22 nt, Human
cuuaaaguagaauacaagaccu

SEQ ID NO: 35043 - RNA, 22 nt, Human
cuuaaaguauugguuuaaccaa

SEQ ID NO: 35044 - RNA, 22 nt, Human
cuuaaccagaaaaugcacuugu

SEQ ID NO: 35045 - RNA, 22 nt, Human
cuuaacucuacacugcacuuua

SEQ ID NO: 35046 - RNA, 22 nt, Human
cuuaagagucuuucuguguuua

SEQ ID NO: 35047 - RNA, 22 nt, Human
cuuaagauuugcgauaccuaau

SEQ ID NO: 35048 - RNA, 22 nt, Human
cuuaauaaaugguagcuguuau

SEQ ID NO: 35049 - RNA, 22 nt, Human
cuuaaucucaccugcaaagucc

SEQ ID NO: 35050 - RNA, 22 nt, Human
cuuaaugaaagguugcacaugg

SEQ ID NO: 35051 - RNA, 22 nt, Human
cuuaaugaaugcugcuguauuu

SEQ ID NO: 35052 - RNA, 22 nt, Human
cuuaauuuaaaauaguucaggc

SEQ ID NO: 35053 - RNA, 22 nt, Human
cuuacaaaggagaggagauagg

SEQ ID NO: 35054 - RNA, 22 nt, Human
cuuacaacuuguaugugauugu

SEQ ID NO: 35055 - RNA, 22 nt, Human
cuuacacagucuggcacuucuu

SEQ ID NO: 35056 - RNA, 22 nt, Human
cuuacagcauuguucagaggcu

SEQ ID NO: 35057 - RNA, 22 nt, Human
cuuacaggaaagaagaaagcau

SEQ ID NO: 35058 - RNA, 22 nt, Human
cuuacauugugugcaugagggg

SEQ ID NO: 35059 - RNA, 22 nt, Human
cuuacauuuaaucaugugucau

SEQ ID NO: 35060 - RNA, 22 nt, Human
cuuagaaaugcagauucucagg

SEQ ID NO: 35061 - RNA, 22 nt, Human
cuuagaacagugucugccagag

SEQ ID NO: 35062 - RNA, 22 nt, Human
cuuagaagaaugccuaggacag

SEQ ID NO: 35063 - RNA, 22 nt, Human
cuuagaaggaacaguuuagugc

SEQ ID NO: 35064 - RNA, 22 nt, Human
cuuagauacaguagaaagacuc

SEQ ID NO: 35065 - RNA, 22 nt, Human
cuuagaugaagucacagaaccc

SEQ ID NO: 35066 - RNA, 22 nt, Human
cuuagcaauaagagggaauaua

SEQ ID NO: 35067 - RNA, 22 nt, Human
cuuagcagaagcuucagcuuca

SEQ ID NO: 35068 - RNA, 22 nt, Human
cuuagcaugugguguccuugua

SEQ ID NO: 35069 - RNA, 22 nt, Human
cuuagccagcuaacuuaagcac

SEQ ID NO: 35070 - RNA, 22 nt, Human
cuuagcuucacugggucucagu

SEQ ID NO: 35071 - RNA, 22 nt, Human
cuuagcuuuuccagcuucuaga

SEQ ID NO: 35072 - RNA, 22 nt, Human
cuuaggaaaguuggcugauuuc

SEQ ID NO: 35073 - RNA, 22 nt, Human
cuuaggaagcuuuugaggacaa

SEQ ID NO: 35074 - RNA, 22 nt, Human
cuuaggaaugucccuucccaca

SEQ ID NO: 35075 - RNA, 22 nt, Human
cuuaggauuuaauuucagacuc

SEQ ID NO: 35076 - RNA, 22 nt, Human
cuuaggcagggcuggaagaucu

SEQ ID NO: 35077 - RNA, 22 nt, Human
cuuagugacauguauucuucau

SEQ ID NO: 35078 - RNA, 22 nt, Human
cuuagugaggaaugaauuuguu

SEQ ID NO: 35079 - RNA, 22 nt, Human
cuuauacacccucuucccaggc

SEQ ID NO: 35080 - RNA, 22 nt, Human
cuuauacacgaacacaaggugu

SEQ ID NO: 35081 - RNA, 22 nt, Human
cuuauaguaugauguugagaau

SEQ ID NO: 35082 - RNA, 22 nt, Human
cuuauguaaaacggaaagggaa

SEQ ID NO: 35083 - RNA, 22 nt, Human
cuuauuagaaagaaaagacaug

SEQ ID NO: 35084 - RNA, 19 nt, Human
cuuauuagagugagagcuu

SEQ ID NO: 35085 - RNA, 22 nt, Human
cuuauucaaugcuggaaauguu

SEQ ID NO: 35086 - RNA, 22 nt, Human
cuuauucauaagucagacacac

SEQ ID NO: 35087 - RNA, 22 nt, Human
cuuauuggucccaggaggagaa

SEQ ID NO: 35088 - RNA, 22 nt, Human
cuuauugucuuacaguaauaga

SEQ ID NO: 35089 - RNA, 22 nt, Human
cuuauugugauaccaugcagua

SEQ ID NO: 35090 - RNA, 22 nt, Human
cuuauuuaugucugucucuaau

SEQ ID NO: 35091 - RNA, 22 nt, Human
cuuauuucagcccugggcaccc

SEQ ID NO: 35092 - RNA, 19 nt, Human
cuuauuucugguuuugggu

SEQ ID NO: 35093 - RNA, 22 nt, Human
cuuauuuguacuaauaaaucug

SEQ ID NO: 35094 - RNA, 22 nt, Human
cuucaaacccagauuaaaugca

SEQ ID NO: 35095 - RNA, 23 nt, Human
gcugagguacauuuacaggaaga

SEQ ID NO: 35096 - RNA, 22 nt, Human
gcugagguggaggaaggagacc

SEQ ID NO: 35097 - RNA, 22 nt, Human
gcugagucuugccugugcuguc

SEQ ID NO: 35098 - RNA, 22 nt, Human
gcugaguggagcagucagcgcu

SEQ ID NO: 35099 - RNA, 22 nt, Human
gcugaguguaaugauggcagag

SEQ ID NO: 35100 - RNA, 22 nt, Human
gcugaucucccuuuucucacag

SEQ ID NO: 35101 - RNA, 22 nt, Human
gcugaugggagcuggcucaccc

SEQ ID NO: 35102 - RNA, 22 nt, Human
gcugaugucccacugacagcca

SEQ ID NO: 35103 - RNA, 22 nt, Human
gcugauuaacuucauuguaguu

SEQ ID NO: 35104 - RNA, 22 nt, Human
gcugcaagucacagaaacagug

SEQ ID NO: 35105 - RNA, 22 nt, Human
gcugcaagugcauguugcaacu

SEQ ID NO: 35106 - RNA, 19 nt, Human
gcugcacacccagcaacug

SEQ ID NO: 35107 - RNA, 22 nt, Human
gcugcacagaacagucauuggc

SEQ ID NO: 35108 - RNA, 22 nt, Human
gcugcagaauuuccuucucauu

SEQ ID NO: 35109 - RNA, 22 nt, Human
gcugcagaccucaugcaggugg

SEQ ID NO: 35110 - RNA, 22 nt, Human
gcugcagagacagcugccgaug

SEQ ID NO: 35111 - RNA, 22 nt, Human
gcugcagagaugggugcccuuu

SEQ ID NO: 35112 - RNA, 22 nt, Human
gcugcagagggucuuagagagg

SEQ ID NO: 35113 - RNA, 19 nt, Human
gcugcagaguauucuuggg

SEQ ID NO: 35114 - RNA, 22 nt, Human
gcugcagaucccacccauuccc

SEQ ID NO: 35115 - RNA, 19 nt, Human
gcugcagcagagaaacugg

SEQ ID NO: 35116 - RNA, 22 nt, Human
cuguggccagauggugccaguu

SEQ ID NO: 35117 - RNA, 22 nt, Human
cuguggccagucccacaccucc

SEQ ID NO: 35118 - RNA, 23 nt, Human
cuguggcccugcuucaugcagcc

SEQ ID NO: 35119 - RNA, 19 nt, Human
cuguggccuccaggaggga

SEQ ID NO: 35120 - RNA, 18 nt, Human
gcuuucugugcagcggag

SEQ ID NO: 35121 - RNA, 21 nt, Human
gcuuucuguggacucugcacc

SEQ ID NO: 35122 - RNA, 22 nt, Human
gcuuucuugcugcaugguggcu

SEQ ID NO: 35123 - RNA, 22 nt, Human
gcuuugaagucugugucuuuug

SEQ ID NO: 35124 - RNA, 22 nt, Human
gcuuugauucuuggcuuaucag

SEQ ID NO: 35125 - RNA, 18 nt, Human
gcuuugcacucauguugu

SEQ ID NO: 35126 - RNA, 22 nt, Human
gcuuugcacuccagcuguggcc

SEQ ID NO: 35127 - RNA, 22 nt, Human
gcuuugcagacaaaauuccagc

SEQ ID NO: 35128 - RNA, 22 nt, Human
gcuuugcaggaaaccagugcau

SEQ ID NO: 35129 - RNA, 22 nt, Human
gcuuugcauuguuuaaucagga

SEQ ID NO: 35130 - RNA, 22 nt, Human
gcuuugcuagcacugcgcuucc

SEQ ID NO: 35131 - RNA, 17 nt, Human
gcuuuggaaagccuucc

SEQ ID NO: 35132 - RNA, 22 nt, Human
gcuuuucuauaagaacuuucaa

SEQ ID NO: 35133 - RNA, 19 nt, Human
gcuuuucuccuucaagcca

SEQ ID NO: 35134 - RNA, 22 nt, Human
gcuuuuggccagauggggaaac

SEQ ID NO: 35135 - RNA, 22 nt, Human
gcuuuugucauucaaaugcucu

SEQ ID NO: 35136 - RNA, 22 nt, Human
gcuuuugugagcucucacuuug

SEQ ID NO: 35137 - RNA, 22 nt, Human
gcuuuuguggcugucuucauug

SEQ ID NO: 35138 - RNA, 22 nt, Human
gcuuuuguuccacaguuuugaa

SEQ ID NO: 35139 - RNA, 18 nt, Human
gcuuuuuagugcaucuuc

SEQ ID NO: 35140 - RNA, 22 nt, Human
gcuuuuucaaaugaaagcuggu

SEQ ID NO: 35141 - RNA, 21 nt, Human
gcuuuuuguauggcccaggaa

SEQ ID NO: 35142 - RNA, 22 nt, Human
gcuuuuuuagguaagacccagg

SEQ ID NO: 35143 - RNA, 22 nt, Human
gcuuuuuugggaugccugccuu

SEQ ID NO: 35144 - RNA, 22 nt, Human
ggaaaaauagaguauacuuuaa

SEQ ID NO: 35145 - RNA, 20 nt, Human
ggaaaaaugcaugcucaaga

SEQ ID NO: 35146 - RNA, 22 nt, Human
ggaaaacuguauuugaauaacu

SEQ ID NO: 35147 - RNA, 21 nt, Human
ggaaaacuuuccuugucugaa

SEQ ID NO: 35148 - RNA, 22 nt, Human
ggaaaagaaagggacugauugg

SEQ ID NO: 35149 - RNA, 17 nt, Human
ggaaaagaagaguagga

SEQ ID NO: 35150 - RNA, 18 nt, Human
ggaaaaggagugucuagc

SEQ ID NO: 35151 - RNA, 21 nt, Human
ggaaaauuccauacacccacg

SEQ ID NO: 35152 - RNA, 22 nt, Human
ggaaaauuuccuucaaaaugug

SEQ ID NO: 35153 - RNA, 22 nt, Human
ggaaacacaugaucagacaucu

SEQ ID NO: 35154 - RNA, 19 nt, Human
ggaaacaggggccagagga

SEQ ID NO: 35155 - RNA, 18 nt, Human
ggaaaccacaggguucug

SEQ ID NO: 35156 - RNA, 22 nt, Human
ggaaacuaaagagguguuuuug

SEQ ID NO: 35157 - RNA, 22 nt, Human
ggaaagagaaguugggaggaau

SEQ ID NO: 35158 - RNA, 23 nt, Human
ggaaagagaggaguugugcauag

SEQ ID NO: 35159 - RNA, 22 nt, Human
ggaaagauguaauauuaucuaa

SEQ ID NO: 35160 - RNA, 22 nt, Human
ggaaagcuacugguguccucug

SEQ ID NO: 35161 - RNA, 22 nt, Human
ggaaaggagaugaauaggauua

SEQ ID NO: 35162 - RNA, 22 nt, Human
ggaaagucuuguguagaugucu

SEQ ID NO: 35163 - RNA, 22 nt, Human
ggaaaucagggguguugcuuuc

SEQ ID NO: 35164 - RNA, 22 nt, Human
ggaaaucuuccuucacucuuuc

SEQ ID NO: 35165 - RNA, 22 nt, Human
ggaaauguaaucacagaggguu

SEQ ID NO: 35166 - RNA, 22 nt, Human
ggaaaugucauagaaauauaag

SEQ ID NO: 35167 - RNA, 22 nt, Human
ggaacacagugccuuacaaacu

SEQ ID NO: 35168 - RNA, 22 nt, Human
ggaacacucgucaaauagcggg

SEQ ID NO: 35169 - RNA, 22 nt, Human
ggaacaguagacgaucuccuuu

SEQ ID NO: 35170 - RNA, 20 nt, Human
ggaacaugaaugugaguggc

SEQ ID NO: 35171 - RNA, 22 nt, Human
ggaacauguagagggccuguag

SEQ ID NO: 35172 - RNA, 22 nt, Human
ggaacauuggcauuuuaaggcu

SEQ ID NO: 35173 - RNA, 22 nt, Human
ggaacauuuccuggcagagagg

SEQ ID NO: 35174 - RNA, 22 nt, Human
ggaaccaggaguuacacgaguu

SEQ ID NO: 35175 - RNA, 22 nt, Human
ggaacuccugcuccaagcagcu

SEQ ID NO: 35176 - RNA, 22 nt, Human
ggaacuggguuagggucucuuc

SEQ ID NO: 35177 - RNA, 22 nt, Human
ggaacuuauacugccagauucu

SEQ ID NO: 35178 - RNA, 22 nt, Human
ggaacuuuaggauccuggcuca

SEQ ID NO: 35179 - RNA, 22 nt, Human
ggaagaaagcacacaaacuuga

SEQ ID NO: 35180 - RNA, 22 nt, Human
ggaagagaaaugagucaagacu

SEQ ID NO: 35181 - RNA, 19 nt, Human
ggaagagaggaaaggugga

SEQ ID NO: 35182 - RNA, 22 nt, Human
ggaagagagguucagcccuaag

SEQ ID NO: 35183 - RNA, 22 nt, Human
ggaagaggcugagccagguccc

SEQ ID NO: 35184 - RNA, 22 nt, Human
ggaagaggcugguagugcccgu

SEQ ID NO: 35185 - RNA, 22 nt, Human
ggaagagggaaccacgacugua

SEQ ID NO: 35186 - RNA, 22 nt, Human
ggaagauucaguuaucucauga

SEQ ID NO: 35187 - RNA, 22 nt, Human
ggaagcagccugaagccaaggg

SEQ ID NO: 35188 - RNA, 22 nt, Human
ggaagccagaaagugagaauau

SEQ ID NO: 35189 - RNA, 20 nt, Human
ggaagccagcauccuugagg

SEQ ID NO: 35190 - RNA, 22 nt, Human
ggaagccaggcccagagaugcu

SEQ ID NO: 35191 - RNA, 22 nt, Human
ggaagccccagacccagagucu

SEQ ID NO: 35192 - RNA, 22 nt, Human
ggaagccccagcugugggaucc

SEQ ID NO: 35193 - RNA, 19 nt, Human
ggaagcccuaaaggaccua

SEQ ID NO: 35194 - RNA, 22 nt, Human
ggaagccuaaagcccaggucuc

SEQ ID NO: 35195 - RNA, 22 nt, Human
ggaagcugcuuagcuaauguag

SEQ ID NO: 35196 - RNA, 22 nt, Human
ggaagcuggcauauguaauccu

SEQ ID NO: 35197 - RNA, 22 nt, Human
ggaagcugguaauuguugggac

SEQ ID NO: 35198 - RNA, 20 nt, Human
ggaagcuguggguccccagg

SEQ ID NO: 35199 - RNA, 21 nt, Human
ggaagcuguguccaugcuccu

SEQ ID NO: 35200 - RNA, 22 nt, Human
ggaagcuguuaucaucuguauc

SEQ ID NO: 35201 - RNA, 22 nt, Human
ggaaggaaguaaaugaugcuau

SEQ ID NO: 35202 - RNA, 22 nt, Human
ggaaggaagugcagacuuuaaa

SEQ ID NO: 35203 - RNA, 22 nt, Human
ggaaggaggaugcucuggccuu

SEQ ID NO: 35204 - RNA, 22 nt, Human
ggaaggaucuggcugaaaucca

SEQ ID NO: 35205 - RNA, 19 nt, Human
ggaaggcagaggggcugug

SEQ ID NO: 35206 - RNA, 22 nt, Human
ggaaggcagaggugucgugggg

SEQ ID NO: 35207 - RNA, 19 nt, Human
ggaaggccacggcaggcuu

SEQ ID NO: 35208 - RNA, 22 nt, Human
ggaaggcucuguuccuugacuu

SEQ ID NO: 35209 - RNA, 22 nt, Human
ggaaggcuuucuguucugugac

SEQ ID NO: 35210 - RNA, 22 nt, Human
ggaaggcuuugaggggugcugg

SEQ ID NO: 35211 - RNA, 22 nt, Human
ggaaggguuuggaaagccgaga

SEQ ID NO: 35212 - RNA, 22 nt, Human
ggaaggucgagcugcaucuggc

SEQ ID NO: 35213 - RNA, 22 nt, Human
ggaagugaggaauuagguuuau

SEQ ID NO: 35214 - RNA, 22 nt, Human
ggaaguguuuccuugggcagca

SEQ ID NO: 35215 - RNA, 18 nt, Human
ggaaguuuggguccccug

SEQ ID NO: 35216 - RNA, 22 nt, Human
ggaaguuuguauacuggccucu

SEQ ID NO: 35217 - RNA, 22 nt, Human
ggaauaaagaaucugguucccc

SEQ ID NO: 35218 - RNA, 22 nt, Human
ggaauacaaaucuuuguucucu

SEQ ID NO: 35219 - RNA, 22 nt, Human
ggaauauagccaguaacaguca

SEQ ID NO: 35220 - RNA, 22 nt, Human
ggaaucagaauuaggauuugaa

SEQ ID NO: 35221 - RNA, 22 nt, Human
ggaauccugguguuuucugccu

SEQ ID NO: 35222 - RNA, 22 nt, Human
ggaaucuuaauggcauggaguu

SEQ ID NO: 35223 - RNA, 22 nt, Human
ggaauguucuggaacaccgcuu

SEQ ID NO: 35224 - RNA, 22 nt, Human
ggaauguugucauuuacauuau

SEQ ID NO: 35225 - RNA, 23 nt, Human
ggaauguuuaccugugaauguca

SEQ ID NO: 35226 - RNA, 22 nt, Human
ugugugucagcccaagggccuu

SEQ ID NO: 35227 - RNA, 22 nt, Human
ugugugugaaccauugagggcu

SEQ ID NO: 35228 - RNA, 22 nt, Human
ugugugugacaaccuaguucag

SEQ ID NO: 35229 - RNA, 22 nt, Human
uguguguguuuacaguuucuca

SEQ ID NO: 35230 - RNA, 22 nt, Human
uguguguguuucugcucauaca

SEQ ID NO: 35231 - RNA, 22 nt, Human
uguguguuauuuucagccauua

SEQ ID NO: 35232 - RNA, 22 nt, Human
uguguguuggcuggagagggcu

SEQ ID NO: 35233 - RNA, 22 nt, Human
uguguuaacacugcaugauaau

SEQ ID NO: 35234 - RNA, 22 nt, Human
uguguuaaguauuugauacacu

SEQ ID NO: 35235 - RNA, 22 nt, Human
uguguuaauuccacaaacauuc

SEQ ID NO: 35236 - RNA, 22 nt, Human
uguguucaagauuaguucuagu

SEQ ID NO: 35237 - RNA, 22 nt, Human
uguguucaccaaaguguagaaa

SEQ ID NO: 35238 - RNA, 22 nt, Human
uguguucaugucacuggaaucc

SEQ ID NO: 35239 - RNA, 22 nt, Human
uguguucauuagcauugccuug

SEQ ID NO: 35240 - RNA, 22 nt, Human
uguguucuccuacagauaagga

SEQ ID NO: 35241 - RNA, 22 nt, Human
uguguucuggaaagcucacuga

SEQ ID NO: 35242 - RNA, 22 nt, Human
uguguucuuaaaagcagugaua

SEQ ID NO: 35243 - RNA, 22 nt, Human
uguguugugacauucuuggaug

SEQ ID NO: 35244 - RNA, 22 nt, Human
uguguuguuuuaagcugcugca

SEQ ID NO: 35245 - RNA, 21 nt, Human
uguguuuuaaugauauucugu

SEQ ID NO: 35246 - RNA, 22 nt, Human
uguuaaaugagauuggaauuug

SEQ ID NO: 35247 - RNA, 22 nt, Human
uguuaacaaagguuggcugggc

SEQ ID NO: 35248 - RNA, 22 nt, Human
uguuaacagaggucauuuuggg

SEQ ID NO: 35249 - RNA, 22 nt, Human
uguuaacuaauggucuaacauu

SEQ ID NO: 35250 - RNA, 22 nt, Human
uguuaacuuccuccuccucugc

SEQ ID NO: 35251 - RNA, 22 nt, Human
uguuaagaagaggcaguacuua

SEQ ID NO: 35252 - RNA, 18 nt, Human
uguuaaggauccaguagu

SEQ ID NO: 35253 - RNA, 22 nt, Human
uguuaagguccugacuucugca

SEQ ID NO: 35254 - RNA, 22 nt, Human
uguuaaucaacaacaaacagug

SEQ ID NO: 35255 - RNA, 22 nt, Human
uguuaauuucuuuagaagugga

SEQ ID NO: 35256 - RNA, 22 nt, Human
uguuacaacuauagaucccaag

SEQ ID NO: 35257 - RNA, 22 nt, Human
uguuacagaaaguuuaugaaug

SEQ ID NO: 35258 - RNA, 22 nt, Human
uguuacagaaugaauuuccgga

SEQ ID NO: 35259 - RNA, 22 nt, Human
uguuacaggaaauagaauuacc

SEQ ID NO: 35260 - RNA, 22 nt, Human
uguuacauuggaguuguuuaga

SEQ ID NO: 35261 - RNA, 22 nt, Human
uguuacauuucucuuucuugga

SEQ ID NO: 35262 - RNA, 22 nt, Human
uguuaccaaaaucuuguauauc

SEQ ID NO: 35263 - RNA, 22 nt, Human
uguuaccaggcaguauugcuua

SEQ ID NO: 35264 - RNA, 22 nt, Human
uguuacuccuucccuacucaug

SEQ ID NO: 35265 - RNA, 22 nt, Human
uguuacuuaucucacgugaugc

SEQ ID NO: 35266 - RNA, 22 nt, Human
uguuagaagacucuuuuaccua

SEQ ID NO: 35267 - RNA, 22 nt, Human
uguuagcaaggauaauuaugau

SEQ ID NO: 35268 - RNA, 22 nt, Human
uguuagcauagcucagaaggag

SEQ ID NO: 35269 - RNA, 22 nt, Human
uguuagcugugcuuuagccuuc

SEQ ID NO: 35270 - RNA, 22 nt, Human
cuuaacagauacaucugugguu

SEQ ID NO: 35271 - RNA, 22 nt, Human
cuuaagaaauugcauucuaauc

SEQ ID NO: 35272 - RNA, 22 nt, Human
cuuaagacaggcucaaagauua

SEQ ID NO: 35273 - RNA, 22 nt, Human
cuuaaggaaaagucucuuuuaa

SEQ ID NO: 35274 - RNA, 22 nt, Human
cuuaaggaguaguggugauggc

SEQ ID NO: 35275 - RNA, 22 nt, Human
cuuaaggcuucagcacagguau

SEQ ID NO: 35276 - RNA, 22 nt, Human
cuuaauuacuguccaauaugca

SEQ ID NO: 35277 - RNA, 22 nt, Human
cuuaauuucaaacugcuaguga

SEQ ID NO: 35278 - RNA, 22 nt, Human
cuuacacuucaucucauccagg

SEQ ID NO: 35279 - RNA, 22 nt, Human
cuuacaguacuucuaauaugau

SEQ ID NO: 35280 - RNA, 22 nt, Human
cuuacauugucucuugcugagc

SEQ ID NO: 35281 - RNA, 22 nt, Human
cuuacauugucuuaguuuucaa

SEQ ID NO: 35282 - RNA, 22 nt, Human
ggacaaagccugguggcaggug

SEQ ID NO: 35283 - RNA, 22 nt, Human
ggacaaaggucuggggaaccug

SEQ ID NO: 35284 - RNA, 22 nt, Human
ggacaaauucccuauuugcaug

SEQ ID NO: 35285 - RNA, 22 nt, Human
ggacaacacuucauuccagcua

SEQ ID NO: 35286 - RNA, 22 nt, Human
ggacaacauguuuuaauuaagg

SEQ ID NO: 35287 - RNA, 22 nt, Human
ggacacagauaaucacacagau

SEQ ID NO: 35288 - RNA, 22 nt, Human
ggacacagccacuuaggguacc

SEQ ID NO: 35289 - RNA, 22 nt, Human
ggacacagggcucacucucucu

SEQ ID NO: 35290 - RNA, 22 nt, Human
ggacacuacaaucugccugcau

SEQ ID NO: 35291 - RNA, 22 nt, Human
ggacacuagauggagaagggaa

SEQ ID NO: 35292 - RNA, 23 nt, Human
ggacacugcuauaaaggaucugc

SEQ ID NO: 35293 - RNA, 22 nt, Human
ggacagacagugugagugaggc

SEQ ID NO: 35294 - RNA, 22 nt, Human
ggacagcugcuuucaggccaca

SEQ ID NO: 35295 - RNA, 22 nt, Human
ggacaggcccggggagccugga

SEQ ID NO: 35296 - RNA, 22 nt, Human
ggacaggcgcagggccaaggaa

SEQ ID NO: 35297 - RNA, 22 nt, Human
ggacagggcucuuggcacuccu

SEQ ID NO: 35298 - RNA, 22 nt, Human
ggacaggggcguggggauuguu

SEQ ID NO: 35299 - RNA, 22 nt, Human
ggacaggguaaguacuagugug

SEQ ID NO: 35300 - RNA, 22 nt, Human
ggacaggugugaggcuggcaca

SEQ ID NO: 35301 - RNA, 19 nt, Human
ggacagucucagccucaug

SEQ ID NO: 35302 - RNA, 22 nt, Human
ggacagugucugcuucaggccc

SEQ ID NO: 35303 - RNA, 22 nt, Human
ggacagugugggccaucucacu

SEQ ID NO: 35304 - RNA, 22 nt, Human
ggacauggaaaucggcuugcuc

SEQ ID NO: 35305 - RNA, 22 nt, Human
ggacauggagcuccauggaggc

SEQ ID NO: 35306 - RNA, 23 nt, Human
ggacaugucucuggguauuuuga

SEQ ID NO: 35307 - RNA, 22 nt, Human
ggacaugugcaacuucuuugga

SEQ ID NO: 35308 - RNA, 22 nt, Human
ggacauuuaguuucauugggca

SEQ ID NO: 35309 - RNA, 22 nt, Human
ggaccaaaugcuuuuuaauuga

SEQ ID NO: 35310 - RNA, 22 nt, Human
ggaccacaauauuugugagguu

SEQ ID NO: 35311 - RNA, 22 nt, Human
ggaccacagcacuuggcuugag

SEQ ID NO: 35312 - RNA, 19 nt, Human
ggaccagguccugggcagc

SEQ ID NO: 35313 - RNA, 22 nt, Human
ggaccaucucuagccagagcuu

SEQ ID NO: 35314 - RNA, 22 nt, Human
ggacccaccaggccgggcucca

SEQ ID NO: 35315 - RNA, 22 nt, Human
ggacccagcucugagacccugc

SEQ ID NO: 35316 - RNA, 18 nt, Human
ggacccagggccucaccc

SEQ ID NO: 35317 - RNA, 22 nt, Human
ggaccccagagauaccaguuuu

SEQ ID NO: 35318 - RNA, 22 nt, Human
ggacccugggcucugggccuau

SEQ ID NO: 35319 - RNA, 23 nt, Human
ggacccuguggagggugagaguc

SEQ ID NO: 35320 - RNA, 22 nt, Human
ggaccugccagaacucaggcua

SEQ ID NO: 35321 - RNA, 22 nt, Human
ggaccugcccuggcucagaugc

SEQ ID NO: 35322 - RNA, 22 nt, Human
ggaccugcucucccaguucucu

SEQ ID NO: 35323 - RNA, 22 nt, Human
ggaccuggcaauuugcaucucu

SEQ ID NO: 35324 - RNA, 22 nt, Human
ggacgcagccgagggagcaggg

SEQ ID NO: 35325 - RNA, 22 nt, Human
ggacgcagcgagggaagcagcc

SEQ ID NO: 35326 - RNA, 22 nt, Human
ggacggggagcuggaaagggga

SEQ ID NO: 35327 - RNA, 22 nt, Human
ggacugaacacuuaaaugucca

SEQ ID NO: 35328 - RNA, 22 nt, Human
ggacugagcugacaucuguugg

SEQ ID NO: 35329 - RNA, 22 nt, Human
ggacugccucugucaccccagc

SEQ ID NO: 35330 - RNA, 22 nt, Human
ggacuggacucucaggcucaca

SEQ ID NO: 35331 - RNA, 22 nt, Human
ggacugugaggucugggugagg

SEQ ID NO: 35332 - RNA, 21 nt, Human
ggacuuacauagguaaggggu

SEQ ID NO: 35333 - RNA, 22 nt, Human
ggacuucuaagugccagacacu

SEQ ID NO: 35334 - RNA, 22 nt, Human
ggacuugcuaagguggcugaac

SEQ ID NO: 35335 - RNA, 22 nt, Human
ggacuuggcuucuuucagagac

SEQ ID NO: 35336 - RNA, 22 nt, Human
ggacuuuaggugagaaggcauu

SEQ ID NO: 35337 - RNA, 22 nt, Human
ggagaaagcuaugugggggagu

SEQ ID NO: 35338 - RNA, 22 nt, Human
ggagaaagggacugaucugcuc

SEQ ID NO: 35339 - RNA, 22 nt, Human
ggagaagcaggugcuuuggguc

SEQ ID NO: 35340 - RNA, 22 nt, Human
ggagaagccacacauugggugu

SEQ ID NO: 35341 - RNA, 22 nt, Human
ggagaaggaauauuggaguagg

SEQ ID NO: 35342 - RNA, 21 nt, Human
ggagaaggacaauguugagua

SEQ ID NO: 35343 - RNA, 22 nt, Human
ggagaaggcacacccaccucug

SEQ ID NO: 35344 - RNA, 22 nt, Human
ggagaagggaacugaguuuuug

SEQ ID NO: 35345 - RNA, 22 nt, Human
ggagaaggguauguguggcgga

SEQ ID NO: 35346 - RNA, 22 nt, Human
ggagaaggugcuggucacugug

SEQ ID NO: 35347 - RNA, 22 nt, Human
ggagaaugauucuuugcucacu

SEQ ID NO: 35348 - RNA, 22 nt, Human
ggagaauucuuuauuagcuuuu

SEQ ID NO: 35349 - RNA, 22 nt, Human
ggagacaacaaucaugugugaa

SEQ ID NO: 35350 - RNA, 22 nt, Human
ggagacacauauacagaaagag

SEQ ID NO: 35351 - RNA, 22 nt, Human
ggagacacccacauugcugggu

SEQ ID NO: 35352 - RNA, 22 nt, Human
ggagacaggguugaaccacgca

SEQ ID NO: 35353 - RNA, 22 nt, Human
ggagaccagaaggaagcuucga

SEQ ID NO: 35354 - RNA, 22 nt, Human
ggagaccaggucagagauggug

SEQ ID NO: 35355 - RNA, 22 nt, Human
ggagacccagguuaggaaguaa

SEQ ID NO: 35356 - RNA, 18 nt, Human
ggagacuaaacuguugac

SEQ ID NO: 35357 - RNA, 22 nt, Human
ggagacucggguucuagccuug

SEQ ID NO: 35358 - RNA, 22 nt, Human
ggagacuuggcuuggaugcuuc

SEQ ID NO: 35359 - RNA, 22 nt, Human
ggagagaauucagcuuaagauu

SEQ ID NO: 35360 - RNA, 22 nt, Human
ggagagacccuggagaaggucc

SEQ ID NO: 35361 - RNA, 22 nt, Human
ggagagagagauuguguuuauu

SEQ ID NO: 35362 - RNA, 22 nt, Human
ggagagaggcuggccgugauga

SEQ ID NO: 35363 - RNA, 22 nt, Human
ggagagauggaaaaccucccag

SEQ ID NO: 35364 - RNA, 22 nt, Human
ggagagccugugcagccggguu

SEQ ID NO: 35365 - RNA, 22 nt, Human
ggagaggacauggcucccacag

SEQ ID NO: 35366 - RNA, 22 nt, Human
ggagaggcuuggcccagccugg

SEQ ID NO: 35367 - RNA, 22 nt, Human
ggagaggguguggaaaguuauc

SEQ ID NO: 35368 - RNA, 22 nt, Human
ggagagucugagccugcuggag

SEQ ID NO: 35369 - RNA, 22 nt, Human
ggagagugggagcaacuguugc

SEQ ID NO: 35370 - RNA, 22 nt, Human
ggagaguuguuuuugccuagau

SEQ ID NO: 35371 - RNA, 22 nt, Human
ggagauaauccagggagggacu

SEQ ID NO: 35372 - RNA, 22 nt, Human
ggagauccaggcugagucuuuc

SEQ ID NO: 35373 - RNA, 23 nt, Human
ggagaucuagguuggcauuuccu

SEQ ID NO: 35374 - RNA, 22 nt, Human
ggagaugcgacucgcggggcug

SEQ ID NO: 35375 - RNA, 22 nt, Human
ggagauggaguggauucagcag

SEQ ID NO: 35376 - RNA, 22 nt, Human
ggagauggcucugcaaggucua

SEQ ID NO: 35377 - RNA, 22 nt, Human
ggagaugggggauuuuacagcg

SEQ ID NO: 35378 - RNA, 21 nt, Human
ggagauggguaucgccugggc

SEQ ID NO: 35379 - RNA, 22 nt, Human
cuuccauaaucuuguuuauuua

SEQ ID NO: 35380 - RNA, 22 nt, Human
cuucccacagaauucaaucagu

SEQ ID NO: 35381 - RNA, 22 nt, Human
cuucccaguucugcuugagggg

SEQ ID NO: 35382 - RNA, 22 nt, Human
cuucccuccuggauuccagacu

SEQ ID NO: 35383 - RNA, 22 nt, Human
cuucccugagcuuucucaggcu

SEQ ID NO: 35384 - RNA, 22 nt, Human
cuucccugauaagagccucaga

SEQ ID NO: 35385 - RNA, 22 nt, Human
cuucccuuccuggggcaauuua

SEQ ID NO: 35386 - RNA, 22 nt, Human
cuuccucaggcauuagcuggac

SEQ ID NO: 35387 - RNA, 22 nt, Human
cuuccucuagccuaguaaugcc

SEQ ID NO: 35388 - RNA, 22 nt, Human
cuuccucugaggcuucugaguc

SEQ ID NO: 35389 - RNA, 22 nt, Human
cuuccucuguguccugggcuuc

SEQ ID NO: 35390 - RNA, 22 nt, Human
cuuccucuguguccugggcuug

SEQ ID NO: 35391 - RNA, 18 nt, Human
cuuccugacuagcucugg

SEQ ID NO: 35392 - RNA, 22 nt, Human
cuuccugcaacaccuguguugc

SEQ ID NO: 35393 - RNA, 22 nt, Human
cuuccugcauugugccagaguu

SEQ ID NO: 35394 - RNA, 22 nt, Human
cuuccuggcaaagcaaucagag

SEQ ID NO: 35395 - RNA, 22 nt, Human
cuuccuggccauugccauggca

SEQ ID NO: 35396 - RNA, 22 nt, Human
cuuccugggcaauguucugcuu

SEQ ID NO: 35397 - RNA, 22 nt, Human
cuuccuuucagaggaaggccug

SEQ ID NO: 35398 - RNA, 22 nt, Human
cuuccuuugcuguucggagguu

SEQ ID NO: 35399 - RNA, 22 nt, Human
ggagccugcgggagcucccauu

SEQ ID NO: 35400 - RNA, 23 nt, Human
ggagccuggcauaugagacgcau

SEQ ID NO: 35401 - RNA, 22 nt, Human
ggagccuggccuggcucugugu

SEQ ID NO: 35402 - RNA, 22 nt, Human
ggagccugggccuccugcccuu

SEQ ID NO: 35403 - RNA, 22 nt, Human
ggagccuguuaguugagugcuc

SEQ ID NO: 35404 - RNA, 22 nt, Human
ggagccuuccagacugcccaca

SEQ ID NO: 35405 - RNA, 22 nt, Human
ggagcggucagcuggccacacg

SEQ ID NO: 35406 - RNA, 22 nt, Human
ggagcuaggcaaagcucacgga

SEQ ID NO: 35407 - RNA, 22 nt, Human
ggagcucaguggggggacugug

SEQ ID NO: 35408 - RNA, 22 nt, Human
ggagcucauaacaagguagcca

SEQ ID NO: 35409 - RNA, 22 nt, Human
ggagcuccuggcagugacagag

SEQ ID NO: 35410 - RNA, 22 nt, Human
ggagcucucuugugguacuccc

SEQ ID NO: 35411 - RNA, 22 nt, Human
ggagcugagacccaguggcuga

SEQ ID NO: 35412 - RNA, 22 nt, Human
ggagcugaguggguuuauugau

SEQ ID NO: 35413 - RNA, 22 nt, Human
ggagcugcuccuucagccaagu

SEQ ID NO: 35414 - RNA, 22 nt, Human
ggagcuggaauauauugaaacc

SEQ ID NO: 35415 - RNA, 22 nt, Human
ggagcuggagaguacagaguuu

SEQ ID NO: 35416 - RNA, 22 nt, Human
ggagcuggcccucugaguuugu

SEQ ID NO: 35417 - RNA, 22 nt, Human
ggagcuggcuacagagaacucc

SEQ ID NO: 35418 - RNA, 22 nt, Human
ggagcugggaacuauguaguau

SEQ ID NO: 35419 - RNA, 22 nt, Human
ggagcugggacccugucaucug

SEQ ID NO: 35420 - RNA, 18 nt, Human
ggagcugggccccacucc

SEQ ID NO: 35421 - RNA, 22 nt, Human
ggagcuguaacgagccauugcu

SEQ ID NO: 35422 - RNA, 22 nt, Human
ggagcuguuaaaugcagaauuu

SEQ ID NO: 35423 - RNA, 22 nt, Human
ggaggaaauccuuaguaaggca

SEQ ID NO: 35424 - RNA, 22 nt, Human
ggaggacaggggcugcagcaca

SEQ ID NO: 35425 - RNA, 22 nt, Human
ggaggaccccagcagcucccca

SEQ ID NO: 35426 - RNA, 22 nt, Human
ggaggagacggagugauuagug

SEQ ID NO: 35427 - RNA, 22 nt, Human
ggaggagagagguugcaaacac

SEQ ID NO: 35428 - RNA, 22 nt, Human
ggaggagcacuucugagcucag

SEQ ID NO: 35429 - RNA, 22 nt, Human
ggaggagcugcugugggggccc

SEQ ID NO: 35430 - RNA, 22 nt, Human
ggaggaggcggcagaaguuccu

SEQ ID NO: 35431 - RNA, 22 nt, Human
ggaggaggggcgcuuugucuau

SEQ ID NO: 35432 - RNA, 22 nt, Human
ggaggaugccaagcugugcaca

SEQ ID NO: 35433 - RNA, 22 nt, Human
ggaggauuugucaucugaagau

SEQ ID NO: 35434 - RNA, 22 nt, Human
ggaggcacuucaugcugacccg

SEQ ID NO: 35435 - RNA, 22 nt, Human
ggaggccaagucacugaccugg

SEQ ID NO: 35436 - RNA, 22 nt, Human
ggaggccagaaucuguguugga

SEQ ID NO: 35437 - RNA, 22 nt, Human
ggaggccaggaaggcucggaga

SEQ ID NO: 35438 - RNA, 22 nt, Human
ggaggccaguccuggccgggcu

SEQ ID NO: 35439 - RNA, 22 nt, Human
ggaggccaugggcagaaucuuu

SEQ ID NO: 35440 - RNA, 22 nt, Human
ggaggccuggacuuccugaugg

SEQ ID NO: 35441 - RNA, 22 nt, Human
ggaggcgauccugggaaacacc

SEQ ID NO: 35442 - RNA, 22 nt, Human
ggaggcgcggcucggcugugcc

SEQ ID NO: 35443 - RNA, 22 nt, Human
ggaggcucagacuccauccuca

SEQ ID NO: 35444 - RNA, 22 nt, Human
ggaggcucuuauuuguucaaca

SEQ ID NO: 35445 - RNA, 22 nt, Human
ggaggcucuugagaggggagua

SEQ ID NO: 35446 - RNA, 22 nt, Human
ggaggcugaggccccucacagg

SEQ ID NO: 35447 - RNA, 22 nt, Human
ggaggcuuccuggcucuugauu

SEQ ID NO: 35448 - RNA, 22 nt, Human
ggagggaaccuuggcuggauug

SEQ ID NO: 35449 - RNA, 22 nt, Human
ggagggaagugaguucucagcu

SEQ ID NO: 35450 - RNA, 22 nt, Human
ggagggaaugucuagcauucuu

SEQ ID NO: 35451 - RNA, 22 nt, Human
ggagggacccacucuagaggug

SEQ ID NO: 35452 - RNA, 22 nt, Human
ggagggaguuucauuccugccc

SEQ ID NO: 35453 - RNA, 22 nt, Human
ggagggcucccugggaguggau

SEQ ID NO: 35454 - RNA, 22 nt, Human
ggagggcuguagaggagaccug

SEQ ID NO: 35455 - RNA, 22 nt, Human
ggaggggagguccagcugaucu

SEQ ID NO: 35456 - RNA, 22 nt, Human
ggaggggcagccauggaacucc

SEQ ID NO: 35457 - RNA, 22 nt, Human
ggaggggcauaguucaccauca

SEQ ID NO: 35458 - RNA, 22 nt, Human
ggaggggcuccuguucgccccc

SEQ ID NO: 35459 - RNA, 22 nt, Human
ggaggggcugagcaacuuucag

SEQ ID NO: 35460 - RNA, 22 nt, Human
ggagggggacugacacugauuu

SEQ ID NO: 35461 - RNA, 22 nt, Human
ggaggggugcucagcugucacg

SEQ ID NO: 35462 - RNA, 22 nt, Human
ggagggguggaaggagugccug

SEQ ID NO: 35463 - RNA, 22 nt, Human
ggagggguggucaccuggcagg

SEQ ID NO: 35464 - RNA, 22 nt, Human
ggagggucuaagggagaacuga

SEQ ID NO: 35465 - RNA, 22 nt, Human
ggagggugcagacccuuugcaa

SEQ ID NO: 35466 - RNA, 20 nt, Human
ggaggucaaaugaugagaag

SEQ ID NO: 35467 - RNA, 22 nt, Human
ggaggucacaaggugaguaaag

SEQ ID NO: 35468 - RNA, 23 nt, Human
ggaggucagugccugagggugag

SEQ ID NO: 35469 - RNA, 22 nt, Human
ggaggucauaaguguauagaug

SEQ ID NO: 35470 - RNA, 22 nt, Human
ggaggucauagcugugcaggua

SEQ ID NO: 35471 - RNA, 22 nt, Human
ggagguggagguugcaaugagc

SEQ ID NO: 35472 - RNA, 22 nt, Human
ggaggugggauuaggaccuaaa

SEQ ID NO: 35473 - RNA, 22 nt, Human
ggagguucugauuugucacaac

SEQ ID NO: 35474 - RNA, 22 nt, Human
ggaguagcugcauuccgagcac

SEQ ID NO: 35475 - RNA, 22 nt, Human
ggaguaggccccgggagagagu

SEQ ID NO: 35476 - RNA, 22 nt, Human
ggaguauaucguguaucauaug

SEQ ID NO: 35477 - RNA, 22 nt, Human
ggagucacacaggaagaaggac

SEQ ID NO: 35478 - RNA, 22 nt, Human
ggagucagccugucagagugua

SEQ ID NO: 35479 - RNA, 21 nt, Human
ggaguccaaaaauuagccaug

SEQ ID NO: 35480 - RNA, 22 nt, Human
ggaguccaacgugcagccagga

SEQ ID NO: 35481 - RNA, 22 nt, Human
ggagucccagcaaagccuuccc

SEQ ID NO: 35482 - RNA, 22 nt, Human
ggagucuggaguggggcccaag

SEQ ID NO: 35483 - RNA, 22 nt, Human
ggagucugucaccuguuucucu

SEQ ID NO: 35484 - RNA, 22 nt, Human
ggagucuguuuuacaugcagga

SEQ ID NO: 35485 - RNA, 22 nt, Human
ggagucuuggccugcugagaaa

SEQ ID NO: 35486 - RNA, 22 nt, Human
ggagugaaguggcgcgaucucg

SEQ ID NO: 35487 - RNA, 22 nt, Human
ggagugaauaaguagggggaaa

SEQ ID NO: 35488 - RNA, 22 nt, Human
gaauauguguuccuggacaaga

SEQ ID NO: 35489 - RNA, 22 nt, Human
gaauauuaguaucaguuauacc

SEQ ID NO: 35490 - RNA, 22 nt, Human
gaaucaaugguagauuaaguaa

SEQ ID NO: 35491 - RNA, 22 nt, Human
gaaucagccugaguuugcagcu

SEQ ID NO: 35492 - RNA, 23 nt, Human
gaaucaguggcuaacaaggaaac

SEQ ID NO: 35493 - RNA, 22 nt, Human
gaauccaggguuguuugagcua

SEQ ID NO: 35494 - RNA, 22 nt, Human
gaaucccuugcaaguuguugua

SEQ ID NO: 35495 - RNA, 22 nt, Human
gaauccgugugauguggacuag

SEQ ID NO: 35496 - RNA, 17 nt, Human
gaauccuucucuguucu

SEQ ID NO: 35497 - RNA, 22 nt, Human
gaauccuugguuuuaagcaaua

SEQ ID NO: 35498 - RNA, 22 nt, Human
gaaucuaaaaacgggcuugguu

SEQ ID NO: 35499 - RNA, 22 nt, Human
gaaucugcauuuuaacaagauc

SEQ ID NO: 35500 - RNA, 22 nt, Human
gaaucuuagucuccuaacggcu

SEQ ID NO: 35501 - RNA, 22 nt, Human
gaaucuuaugugguguuuucua

SEQ ID NO: 35502 - RNA, 21 nt, Human
gaaucuuugauuuacauggga

SEQ ID NO: 35503 - RNA, 22 nt, Human
gaaugaaucuguaagugacaag

SEQ ID NO: 35504 - RNA, 22 nt, Human
gaaugaauucagcacauggaau

SEQ ID NO: 35505 - RNA, 22 nt, Human
gaaugagggagauguuggugca

SEQ ID NO: 35506 - RNA, 22 nt, Human
gaaugaguuaauauuugcuugg

SEQ ID NO: 35507 - RNA, 22 nt, Human
gaaugauaaauggaagcagcau

SEQ ID NO: 35508 - RNA, 22 nt, Human
gaaugcaaagcucucuauguua

SEQ ID NO: 35509 - RNA, 22 nt, Human
gaaugcuaagcaugugggaguu

SEQ ID NO: 35510 - RNA, 22 nt, Human
gaaugcuauuauuucugugugu

SEQ ID NO: 35511 - RNA, 22 nt, Human
gaaugcucucauuuuccaacau

SEQ ID NO: 35512 - RNA, 22 nt, Human
gaaugcugagacuaaagagcuu

SEQ ID NO: 35513 - RNA, 22 nt, Human
gaaugcugagucuuaucucuua

SEQ ID NO: 35514 - RNA, 22 nt, Human
cuuuggaagccaggcaguucac

SEQ ID NO: 35515 - RNA, 22 nt, Human
cuuuggaagugaccacaauccu

SEQ ID NO: 35516 - RNA, 22 nt, Human
cuuuggaagugauagauaugau

SEQ ID NO: 35517 - RNA, 22 nt, Human
cuuuggaauaaucaagcucuga

SEQ ID NO: 35518 - RNA, 22 nt, Human
cuuuggaggucauagccaagag

SEQ ID NO: 35519 - RNA, 20 nt, Human
cuuuggcaaugagaacaggg

SEQ ID NO: 35520 - RNA, 22 nt, Human
cuuuggcagccucagcugcagg

SEQ ID NO: 35521 - RNA, 22 nt, Human
cuuuggcagccucugcuauuga

SEQ ID NO: 35522 - RNA, 22 nt, Human
cuuuggcugacagguuucuggu

SEQ ID NO: 35523 - RNA, 22 nt, Human
cuuugggauuucaugagagcua

SEQ ID NO: 35524 - RNA, 22 nt, Human
cuuuguaaucauucccuugguu

SEQ ID NO: 35525 - RNA, 22 nt, Human
cuuuguaucuaaauaucuugaa

SEQ ID NO: 35526 - RNA, 22 nt, Human
cuuuguccauugauucguucaa

SEQ ID NO: 35527 - RNA, 22 nt, Human
cuuugugaugaggccuaagaca

SEQ ID NO: 35528 - RNA, 22 nt, Human
cuuugugcuuugaaugauagcu

SEQ ID NO: 35529 - RNA, 22 nt, Human
cuuuguugugccugagugcacc

SEQ ID NO: 35530 - RNA, 22 nt, Human
cuuuguuuuacucagaggcaug

SEQ ID NO: 35531 - RNA, 23 nt, Human
cuuuuaaccggcaugggagggca

SEQ ID NO: 35532 - RNA, 23 nt, Human
cuuuuaacuugaucugagaccag

SEQ ID NO: 35533 - RNA, 22 nt, Human
cuuuuaagggauaauaagaugu

SEQ ID NO: 35534 - RNA, 22 nt, Human
cuuuuacacucaucugggaggg

SEQ ID NO: 35535 - RNA, 22 nt, Human
cuuuuagcugcaaguguucaca

SEQ ID NO: 35536 - RNA, 22 nt, Human
cuuuuauuuugaauuaagggcu

SEQ ID NO: 35537 - RNA, 22 nt, Human
cuuuucagagcugagaucaccg

SEQ ID NO: 35538 - RNA, 22 nt, Human
cuuuucaugagucuguuauggg

SEQ ID NO: 35539 - RNA, 23 nt, Human
cuuuucauugccuuagcgcagag

SEQ ID NO: 35540 - RNA, 22 nt, Human
cuuuucucugcaccauguguga

SEQ ID NO: 35541 - RNA, 22 nt, Human
cuuuucucuuacauuccacugg

SEQ ID NO: 35542 - RNA, 22 nt, Human
cuuuucugugaugcugacaguc

SEQ ID NO: 35543 - RNA, 21 nt, Human
cuuuucuguguuccucccugu

SEQ ID NO: 35544 - RNA, 22 nt, Human
cuuuucuuacucccgcaaggca

SEQ ID NO: 35545 - RNA, 22 nt, Human
cuuuucuucucacggcugucag

SEQ ID NO: 35546 - RNA, 22 nt, Human
cuuuugauaguugcugagcagg

SEQ ID NO: 35547 - RNA, 22 nt, Human
cuuuugauugagcaguuucaaa

SEQ ID NO: 35548 - RNA, 22 nt, Human
cuuuugcaccuuuuaaguaaug

SEQ ID NO: 35549 - RNA, 22 nt, Human
cuuuuugcaagaguuucucauc

SEQ ID NO: 35550 - RNA, 22 nt, Human
cuuuuuguguaugcuacaguug

SEQ ID NO: 35551 - RNA, 22 nt, Human
cuuuuuguuguccacacuagga

SEQ ID NO: 35552 - RNA, 22 nt, Human
cuuuuuuccuaaggcaacauga

SEQ ID NO: 35553 - RNA, 19 nt, Human
gaaaacaugggugaggguc

SEQ ID NO: 35554 - RNA, 21 nt, Human
gaaaaccauuugcaucaugag

SEQ ID NO: 35555 - RNA, 22 nt, Human
gaaaacugugauuagaaugccu

SEQ ID NO: 35556 - RNA, 22 nt, Human
gaaaacuuggaucucuagaaug

SEQ ID NO: 35557 - RNA, 22 nt, Human
gaaaagcuuacugccacuuggc

SEQ ID NO: 35558 - RNA, 22 nt, Human
gaaaaggccuggggcaaagugu

SEQ ID NO: 35559 - RNA, 22 nt, Human
gaaaagggcaagagagagggca

SEQ ID NO: 35560 - RNA, 22 nt, Human
gaaaaguaaacacuagggguca

SEQ ID NO: 35561 - RNA, 22 nt, Human
gaaaaguauguuuauuuugacu

SEQ ID NO: 35562 - RNA, 22 nt, Human
gaaaauagcagauagaccaaug

SEQ ID NO: 35563 - RNA, 20 nt, Human
gaaaauaggccagccaggua

SEQ ID NO: 35564 - RNA, 22 nt, Human
gaaaauguuuccuguuauuugc

SEQ ID NO: 35565 - RNA, 22 nt, Human
gaaaauuucugccacaugugug

SEQ ID NO: 35566 - RNA, 22 nt, Human
gaaacaaucaucaugugauuug

SEQ ID NO: 35567 - RNA, 22 nt, Human
gaaacacauaugaacaguugau

SEQ ID NO: 35568 - RNA, 22 nt, Human
gaaacacaugcagcuccauaga

SEQ ID NO: 35569 - RNA, 22 nt, Human
gaaacacucaauuuaguaauuc

SEQ ID NO: 35570 - RNA, 22 nt, Human
gaaacacugguaaagacugccg

SEQ ID NO: 35571 - RNA, 22 nt, Human
gaaacagauuaacagcauauuu

SEQ ID NO: 35572 - RNA, 22 nt, Human
gaaacagccccugugugaagca

SEQ ID NO: 35573 - RNA, 22 nt, Human
gaaacagggaguaguaauuuac

SEQ ID NO: 35574 - RNA, 22 nt, Human
gaaacagguggcaggcuagauu

SEQ ID NO: 35575 - RNA, 22 nt, Human
gaaacagucaacuuucuuuccc

SEQ ID NO: 35576 - RNA, 22 nt, Human
gaaacauuggucugccccuuau

SEQ ID NO: 35577 - RNA, 22 nt, Human
gaaacauuguguucuacagauu

SEQ ID NO: 35578 - RNA, 22 nt, Human
gaaacauuuguugaguacuugc

SEQ ID NO: 35579 - RNA, 22 nt, Human
gaaacccaaacuaagacaguag

SEQ ID NO: 35580 - RNA, 22 nt, Human
gaaacccuuccuagagggcaag

SEQ ID NO: 35581 - RNA, 18 nt, Human
gaaaccugaggaagaaag

SEQ ID NO: 35582 - RNA, 22 nt, Human
gaaaccugagugcagaucagga

SEQ ID NO: 35583 - RNA, 22 nt, Human
gaaaccugguucugcgugaggg

SEQ ID NO: 35584 - RNA, 22 nt, Human
gaaaccuuugccgauggggucc

SEQ ID NO: 35585 - RNA, 22 nt, Human
gaaacugugaggaucuuaacuu

SEQ ID NO: 35586 - RNA, 22 nt, Human
gaaacuugccugaagucaacca

SEQ ID NO: 35587 - RNA, 22 nt, Human
gaaacuuucaugaauauaagau

SEQ ID NO: 35588 - RNA, 22 nt, Human
gaaagaagcuuuagauggcuau

SEQ ID NO: 35589 - RNA, 22 nt, Human
gaaagaaugcuauagugacuuc

SEQ ID NO: 35590 - RNA, 22 nt, Human
gaaagaccguuugggcucuaaa

SEQ ID NO: 35591 - RNA, 22 nt, Human
gaaagagaaccugggccuagau

SEQ ID NO: 35592 - RNA, 22 nt, Human
gaaagaguaugggagcuuuacu

SEQ ID NO: 35593 - RNA, 22 nt, Human
gaaagauaaucaauuacuccuu

SEQ ID NO: 35594 - RNA, 22 nt, Human
gaaagcacauacuauaaaucac

SEQ ID NO: 35595 - RNA, 22 nt, Human
gaaagcacccaagauuuccuuc

SEQ ID NO: 35596 - RNA, 22 nt, Human
gaaagcacgauaguagcaaaag

SEQ ID NO: 35597 - RNA, 22 nt, Human
gagaagguggaccugaaggagc

SEQ ID NO: 35598 - RNA, 22 nt, Human
gagaagucauuugaccaccuag

SEQ ID NO: 35599 - RNA, 22 nt, Human
gagaaguuucugguuugcauag

SEQ ID NO: 35600 - RNA, 22 nt, Human
gagaauauauugaaguaguucc

SEQ ID NO: 35601 - RNA, 22 nt, Human
gagaaucuuuccccacagaagg

SEQ ID NO: 35602 - RNA, 22 nt, Human
gagaaugaugauuuccaauuuc

SEQ ID NO: 35603 - RNA, 22 nt, Human
gagaauguuaauguugaaguau

SEQ ID NO: 35604 - RNA, 22 nt, Human
gagacaaaaguuggagugcaag

SEQ ID NO: 35605 - RNA, 22 nt, Human
gagacacaaacacauuuagagg

SEQ ID NO: 35606 - RNA, 22 nt, Human
gagacacaaacauuuauuccac

SEQ ID NO: 35607 - RNA, 18 nt, Human
gagacacaagggccugga

SEQ ID NO: 35608 - RNA, 22 nt, Human
gagacacaaucucauuuacauu

SEQ ID NO: 35609 - RNA, 22 nt, Human
gagacacaauuuccccauccua

SEQ ID NO: 35610 - RNA, 22 nt, Human
gagacacucaacaaagauauga

SEQ ID NO: 35611 - RNA, 21 nt, Human
gagacagacuuucguccccug

SEQ ID NO: 35612 - RNA, 22 nt, Human
gagacagaguuucacucuuguu

SEQ ID NO: 35613 - RNA, 22 nt, Human
gagacagcagggccagggccug

SEQ ID NO: 35614 - RNA, 22 nt, Human
gagacaguguccauccaggggc

SEQ ID NO: 35615 - RNA, 23 nt, Human
gagaccagggccagcugugucau

SEQ ID NO: 35616 - RNA, 22 nt, Human
gagaccccagcucagccuccag

SEQ ID NO: 35617 - RNA, 22 nt, Human
gagacgggguuugagacggguu

SEQ ID NO: 35618 - RNA, 21 nt, Human
gagacucucauguuauuugga

SEQ ID NO: 35619 - RNA, 22 nt, Human
gagacugauggggcucccagaa

SEQ ID NO: 35620 - RNA, 22 nt, Human
gagacugggggcuuggccuuuu

SEQ ID NO: 35621 - RNA, 22 nt, Human
gagagaaaggcuugcaggcugu

SEQ ID NO: 35622 - RNA, 22 nt, Human
gagagaaaugugcaguuugggc

SEQ ID NO: 35623 - RNA, 22 nt, Human
gagagaagaaagccaugguccu

SEQ ID NO: 35624 - RNA, 22 nt, Human
gagagacagcagaacgugcagc

SEQ ID NO: 35625 - RNA, 22 nt, Human
gagagacugauguggcuaugua

SEQ ID NO: 35626 - RNA, 22 nt, Human
gagagaggccuccauguacuga

SEQ ID NO: 35627 - RNA, 22 nt, Human
gagagcacggucuugggcaugg

SEQ ID NO: 35628 - RNA, 22 nt, Human
gagagcaggaggcagcgggacg

SEQ ID NO: 35629 - RNA, 22 nt, Human
gagagcaggcucucgggggcca

SEQ ID NO: 35630 - RNA, 22 nt, Human
gagagccagcaguaaagacauu

SEQ ID NO: 35631 - RNA, 22 nt, Human
gagagccaugguggagaugggg

SEQ ID NO: 35632 - RNA, 17 nt, Human
gagagcccucagauguc

SEQ ID NO: 35633 - RNA, 22 nt, Human
gagagcccuuagguuuagaguu

SEQ ID NO: 35634 - RNA, 22 nt, Human
gagagccuuugaagggaaguga

SEQ ID NO: 35635 - RNA, 22 nt, Human
gagagcugaggggccuggcacu

SEQ ID NO: 35636 - RNA, 18 nt, Human
gagagcugcuaccuagcu

SEQ ID NO: 35637 - RNA, 22 nt, Human
gagagcuggauucuggauaggu

SEQ ID NO: 35638 - RNA, 22 nt, Human
gagagcugggaaagccguggag

SEQ ID NO: 35639 - RNA, 22 nt, Human
gagagcugggcuuugggugaag

SEQ ID NO: 35640 - RNA, 22 nt, Human
gagagcuggguucaaguagcug

SEQ ID NO: 35641 - RNA, 22 nt, Human
gagaggaacucccagugccugg

SEQ ID NO: 35642 - RNA, 22 nt, Human
gagaggaagccaggggguguug

SEQ ID NO: 35643 - RNA, 22 nt, Human
gagaggaauaucauuauauuag

SEQ ID NO: 35644 - RNA, 22 nt, Human
gagaggagaagccugcgcuuca

SEQ ID NO: 35645 - RNA, 18 nt, Human
gagaggagccagaauuuu

SEQ ID NO: 35646 - RNA, 22 nt, Human
gagaggaguagacacuuugguu

SEQ ID NO: 35647 - RNA, 22 nt, Human
gagaggaguaggcugauggugc

SEQ ID NO: 35648 - RNA, 22 nt, Human
gagaggagucccuaucacaguu

SEQ ID NO: 35649 - RNA, 22 nt, Human
gaagauuaaaugaagugaccug

SEQ ID NO: 35650 - RNA, 22 nt, Human
gaagauuaaugagaaaccugcu

SEQ ID NO: 35651 - RNA, 22 nt, Human
gaagauugaaggcugggaauua

SEQ ID NO: 35652 - RNA, 22 nt, Human
gaagauuggggccucugcaccc

SEQ ID NO: 35653 - RNA, 22 nt, Human
gaagauuucuuuaugaaagaug

SEQ ID NO: 35654 - RNA, 22 nt, Human
gaagauuugcccaugcacuuuu

SEQ ID NO: 35655 - RNA, 22 nt, Human
gaagcaaagagcuagugccgcu

SEQ ID NO: 35656 - RNA, 22 nt, Human
gaagcaagugcaaggaagaggc

SEQ ID NO: 35657 - RNA, 22 nt, Human
gaagcaauuaaguuugugaucu

SEQ ID NO: 35658 - RNA, 22 nt, Human
gaagcacugcauuucaagauca

SEQ ID NO: 35659 - RNA, 22 nt, Human
gaagcacugugcugcuaaguug

SEQ ID NO: 35660 - RNA, 22 nt, Human
gaagcagacuuuugcuuauuug

SEQ ID NO: 35661 - RNA, 22 nt, Human
gaagcagagccuaaggcagaca

SEQ ID NO: 35662 - RNA, 22 nt, Human
gaagcagcagcuggggacaguu

SEQ ID NO: 35663 - RNA, 22 nt, Human
gaagcagcuuucuggugaggag

SEQ ID NO: 35664 - RNA, 22 nt, Human
gaagcauacuuucuauacugcu

SEQ ID NO: 35665 - RNA, 22 nt, Human
gaagccacaacuuuuucuuagc

SEQ ID NO: 35666 - RNA, 23 nt, Human
gaagccacacaaaggucgccaag

SEQ ID NO: 35667 - RNA, 22 nt, Human
gaagccagauuaucacaagcca

SEQ ID NO: 35668 - RNA, 22 nt, Human
gaagcccaagcuucacagcuau

SEQ ID NO: 35669 - RNA, 22 nt, Human
gaagcccagcaaacugugauca

SEQ ID NO: 35670 - RNA, 22 nt, Human
gaagcccaggcuuccuuggcuu

SEQ ID NO: 35671 - RNA, 22 nt, Human
gaagccucaacaucucugcguc

SEQ ID NO: 35672 - RNA, 22 nt, Human
gaagccuggagaccagauguug

SEQ ID NO: 35673 - RNA, 22 nt, Human
gaagccugguccagagcuccca

SEQ ID NO: 35674 - RNA, 22 nt, Human
gaagccuuaucagucacuuaua

SEQ ID NO: 35675 - RNA, 22 nt, Human
gaagccuugaacugcaaacccc

SEQ ID NO: 35676 - RNA, 22 nt, Human
gaagcugaggucaggugggugg

SEQ ID NO: 35677 - RNA, 22 nt, Human
gaagcugaguggacucuggcca

SEQ ID NO: 35678 - RNA, 22 nt, Human
gaagcugcguguagccauacuu

SEQ ID NO: 35679 - RNA, 22 nt, Human
gaagcuggagaaugggucuagg

SEQ ID NO: 35680 - RNA, 22 nt, Human
gaagcuggcugaaguucagcua

SEQ ID NO: 35681 - RNA, 22 nt, Human
gaagcugugcugggggaucugu

SEQ ID NO: 35682 - RNA, 22 nt, Human
gaaggaagacugguuuaaaugu

SEQ ID NO: 35683 - RNA, 22 nt, Human
gaaggaagauucuguuggaauc

SEQ ID NO: 35684 - RNA, 22 nt, Human
gaaggaagcugucuggaugugu

SEQ ID NO: 35685 - RNA, 22 nt, Human
gaaggaagggcuggcugucuug

SEQ ID NO: 35686 - RNA, 22 nt, Human
gaaggacccacgaagucacugg

SEQ ID NO: 35687 - RNA, 22 nt, Human
gaaggacccucuggggucucag

SEQ ID NO: 35688 - RNA, 22 nt, Human
gaaggagacccugaagaugcug

SEQ ID NO: 35689 - RNA, 22 nt, Human
gaaggagagagacaucgucccu

SEQ ID NO: 35690 - RNA, 22 nt, Human
gaaggagaggauugugaggcug

SEQ ID NO: 35691 - RNA, 22 nt, Human
gaaggagagggucaaggauaau

SEQ ID NO: 35692 - RNA, 22 nt, Human
gaaggagccgagcucuucccca

SEQ ID NO: 35693 - RNA, 22 nt, Human
gaaggaggcuccccaaagucug

SEQ ID NO: 35694 - RNA, 22 nt, Human
gaaggaggucugauacaauaug

SEQ ID NO: 35695 - RNA, 22 nt, Human
gaaggcaagugcuccuuggguc

SEQ ID NO: 35696 - RNA, 20 nt, Human
gaaggcaaugguuuggcaca

SEQ ID NO: 35697 - RNA, 22 nt, Human
gaaggcagguuuuucaaaacug

SEQ ID NO: 35698 - RNA, 22 nt, Human
gaaggcauuuuaugccuuauag

SEQ ID NO: 35699 - RNA, 22 nt, Human
gaaggccacaagagaaguuaag

SEQ ID NO: 35700 - RNA, 22 nt, Human
gaaggccucacucugcagcaua

SEQ ID NO: 35701 - RNA, 22 nt, Human
gaaggccugugguagugagacg

SEQ ID NO: 35702 - RNA, 22 nt, Human
gaaggcuaaaggggcagagguu

SEQ ID NO: 35703 - RNA, 22 nt, Human
gaaggcugagcagacaggccaa

SEQ ID NO: 35704 - RNA, 22 nt, Human
gaaggcugaugacagauucugc

SEQ ID NO: 35705 - RNA, 22 nt, Human
gaaggcugccaguggcccucuu

SEQ ID NO: 35706 - RNA, 22 nt, Human
gacugugggcucuguuugucuu

SEQ ID NO: 35707 - RNA, 22 nt, Human
gacuguggggggcggacacaag

SEQ ID NO: 35708 - RNA, 22 nt, Human
gacuuaaaggcugaauguagga

SEQ ID NO: 35709 - RNA, 22 nt, Human
gacuucaaaucaugcuaaaccu

SEQ ID NO: 35710 - RNA, 22 nt, Human
gacuucaacuucuggggagcaa

SEQ ID NO: 35711 - RNA, 22 nt, Human
gacuucacaauaaugugacacu

SEQ ID NO: 35712 - RNA, 22 nt, Human
gacuucagauauuuuuuaaguu

SEQ ID NO: 35713 - RNA, 22 nt, Human
gacuucuauuaauaccucuacu

SEQ ID NO: 35714 - RNA, 22 nt, Human
gacuucuccagacugccuggua

SEQ ID NO: 35715 - RNA, 22 nt, Human
gacuucucccaaccaucagagg

SEQ ID NO: 35716 - RNA, 22 nt, Human
gacuucucggcacccuuuggca

SEQ ID NO: 35717 - RNA, 22 nt, Human
gacuucugaauuccuaucaggu

SEQ ID NO: 35718 - RNA, 22 nt, Human
gacuucugagcuauccagcugu

SEQ ID NO: 35719 - RNA, 22 nt, Human
gacuugggcuugggcguggguu

SEQ ID NO: 35720 - RNA, 22 nt, Human
gacuuggggauuuaucucacag

SEQ ID NO: 35721 - RNA, 22 nt, Human
gacuugggggaagauguggcug

SEQ ID NO: 35722 - RNA, 22 nt, Human
gacuuggguggauugugacucu

SEQ ID NO: 35723 - RNA, 18 nt, Human
gacuuuaaaacacugcuc

SEQ ID NO: 35724 - RNA, 22 nt, Human
gacuuuaaaaguuugugcuugg

SEQ ID NO: 35725 - RNA, 22 nt, Human
gacuuuaaagccugacauuuua

SEQ ID NO: 35726 - RNA, 22 nt, Human
gacuuuaucuuguccuuccugc

SEQ ID NO: 35727 - RNA, 22 nt, Human
gacuuuauuuccuuauuuguga

SEQ ID NO: 35728 - RNA, 22 nt, Human
gacuuuauuuuaacggagauuc

SEQ ID NO: 35729 - RNA, 22 nt, Human
gacuuucuaaugcucuguagau

SEQ ID NO: 35730 - RNA, 22 nt, Human
gacuuucucuccucccaggugu

SEQ ID NO: 35731 - RNA, 22 nt, Human
gacuuucuuaggcccccuaaua

SEQ ID NO: 35732 - RNA, 22 nt, Human
gacuuucuugcagaaauauucc

SEQ ID NO: 35733 - RNA, 22 nt, Human
gacuuugaacaguguaucagua

SEQ ID NO: 35734 - RNA, 22 nt, Human
gacuuugacgaaagagucauua

SEQ ID NO: 35735 - RNA, 22 nt, Human
gacuuugagggauacaaacauu

SEQ ID NO: 35736 - RNA, 22 nt, Human
gacuuugccacuugcuccagcu

SEQ ID NO: 35737 - RNA, 22 nt, Human
gacuuuggauucauuaucugga

SEQ ID NO: 35738 - RNA, 22 nt, Human
gacuuuugaauaagguaggaua

SEQ ID NO: 35739 - RNA, 22 nt, Human
gagaaacaggaauugagucgcu

SEQ ID NO: 35740 - RNA, 22 nt, Human
gagaaacugaaacauagggcca

SEQ ID NO: 35741 - RNA, 22 nt, Human
gagaaagauggaaucuuacagg

SEQ ID NO: 35742 - RNA, 19 nt, Human
gagaaagcaggcacagcac

SEQ ID NO: 35743 - RNA, 22 nt, Human
gagaaagcuucagaaauggccu

SEQ ID NO: 35744 - RNA, 22 nt, Human
gagaaagcuucuuucccacagg

SEQ ID NO: 35745 - RNA, 22 nt, Human
gagaaagggauaauuugaagag

SEQ ID NO: 35746 - RNA, 22 nt, Human
gagaacacaugcagacugggua

SEQ ID NO: 35747 - RNA, 22 nt, Human
gagaacagagauaauuuuacuu

SEQ ID NO: 35748 - RNA, 23 nt, Human
gagaacagccacagagagcugug

SEQ ID NO: 35749 - RNA, 22 nt, Human
gagaacauuaauaguuaauuuu

SEQ ID NO: 35750 - RNA, 22 nt, Human
gagaacuaaucaugcauggagu

SEQ ID NO: 35751 - RNA, 22 nt, Human
gagaagaaauagaaucacauuu

SEQ ID NO: 35752 - RNA, 22 nt, Human
gagaagcaaucagcagccaccc

SEQ ID NO: 35753 - RNA, 22 nt, Human
gagaagcaaucgugacaucucc

SEQ ID NO: 35754 - RNA, 22 nt, Human
gagaagcaauuuccaacugugc

SEQ ID NO: 35755 - RNA, 22 nt, Human
gagaaggaaguugagccagcau

SEQ ID NO: 35756 - RNA, 22 nt, Human
gagaaggaggcgaagcgugugc

SEQ ID NO: 35757 - RNA, 22 nt, Human
gagaaggaguagcugaccuggg

SEQ ID NO: 35758 - RNA, 18 nt, Human
gagaaggccacuuguuuu

SEQ ID NO: 35759 - RNA, 22 nt, Human
gagaaggcuucuuuuccucuga

SEQ ID NO: 35760 - RNA, 22 nt, Human
gagaagggcuugggagucaaca

SEQ ID NO: 35761 - RNA, 22 nt, Human
gagaaguuguaggagaauuuug

SEQ ID NO: 35762 - RNA, 22 nt, Human
gagaaguuuaaucauuagacca

SEQ ID NO: 35763 - RNA, 17 nt, Human
gagaaguuuugcuaccg

SEQ ID NO: 35764 - RNA, 22 nt, Human
gagaaguuuuucuuauuacaug

SEQ ID NO: 35765 - RNA, 22 nt, Human
gagaauaucuuggcagucucug

SEQ ID NO: 35766 - RNA, 22 nt, Human
gaauacaccaaggaaucagaau

SEQ ID NO: 35767 - RNA, 22 nt, Human
gaauacacgcacgacacggggg

SEQ ID NO: 35768 - RNA, 22 nt, Human
gaauacaugauacaugaacugc

SEQ ID NO: 35769 - RNA, 18 nt, Human
gaauacugagagcacaaa

SEQ ID NO: 35770 - RNA, 22 nt, Human
gaauacuuuuguuaggaaaacg

SEQ ID NO: 35771 - RNA, 22 nt, Human
gaauagauagcuuggaugguug

SEQ ID NO: 35772 - RNA, 22 nt, Human
gaauauauuggugaaaauaguu

SEQ ID NO: 35773 - RNA, 18 nt, Human
gaauaucuagcacauagu

SEQ ID NO: 35774 - RNA, 22 nt, Human
gaaucaauuauccaggcuguug

SEQ ID NO: 35775 - RNA, 22 nt, Human
gaaucaauugugaagacuauga

SEQ ID NO: 35776 - RNA, 22 nt, Human
gaaucacagaggcaaauucuga

SEQ ID NO: 35777 - RNA, 22 nt, Human
gaaucagacugaccugaguuca

SEQ ID NO: 35778 - RNA, 22 nt, Human
gaaucuagggccuagaucacag

SEQ ID NO: 35779 - RNA, 22 nt, Human
gaaucuaugccucauauagacc

SEQ ID NO: 35780 - RNA, 22 nt, Human
gaaucucaguggaagcaggaag

SEQ ID NO: 35781 - RNA, 22 nt, Human
gaaucucauucuaacuaguagg

SEQ ID NO: 35782 - RNA, 22 nt, Human
gaaucuuaccucucuauuguug

SEQ ID NO: 35783 - RNA, 20 nt, Human
gaaucuuuccccaugcaaug

SEQ ID NO: 35784 - RNA, 22 nt, Human
gaaucuuuugucucgugaauaa

SEQ ID NO: 35785 - RNA, 22 nt, Human
gaaugaaagauuugcauucuau

SEQ ID NO: 35786 - RNA, 22 nt, Human
gaaugaagcaggucacacaguu

SEQ ID NO: 35787 - RNA, 22 nt, Human
gaaugaauagguguccagaugg

SEQ ID NO: 35788 - RNA, 22 nt, Human
gaaugaauuuuggauggugaag

SEQ ID NO: 35789 - RNA, 22 nt, Human
gaaugagacuaugcgaguguga

SEQ ID NO: 35790 - RNA, 22 nt, Human
gaaugauagagcugccuucgga

SEQ ID NO: 35791 - RNA, 22 nt, Human
gaaugauauauuagcagauuuu

SEQ ID NO: 35792 - RNA, 22 nt, Human
gaaugauuugguuguuuagauu

SEQ ID NO: 35793 - RNA, 22 nt, Human
gaaugcacacgugugugcaugc

SEQ ID NO: 35794 - RNA, 19 nt, Human
gaaugcagaagagagugga

SEQ ID NO: 35795 - RNA, 22 nt, Human
gaaugcagauggcugguguaug

SEQ ID NO: 35796 - RNA, 22 nt, Human
gaaugcagcugacagucguuuu

SEQ ID NO: 35797 - RNA, 22 nt, Human
gaaugcaugugaagcaaagaau

SEQ ID NO: 35798 - RNA, 22 nt, Human
gaaugcuuggaaccugaaguuc

SEQ ID NO: 35799 - RNA, 22 nt, Human
gaaugcuuugggaauucagaau

SEQ ID NO: 35800 - RNA, 22 nt, Human
gaauggaaacugggagauggcc

SEQ ID NO: 35801 - RNA, 22 nt, Human
gaauggcauagcuuucuuuaca

SEQ ID NO: 35802 - RNA, 22 nt, Human
gaauguaauaggaaacgugugg

SEQ ID NO: 35803 - RNA, 22 nt, Human
gaauguccuccuggaucacucc

SEQ ID NO: 35804 - RNA, 22 nt, Human
gaaugucuguuucaacaagcac

SEQ ID NO: 35805 - RNA, 22 nt, Human
gaaugugucacccugucccaug

SEQ ID NO: 35806 - RNA, 22 nt, Human
gaauguucugaggaaucagaga

SEQ ID NO: 35807 - RNA, 22 nt, Human
gaauguuuaaggaaggcguggc

SEQ ID NO: 35808 - RNA, 19 nt, Human
gaauguuucugucucuucu

SEQ ID NO: 35809 - RNA, 22 nt, Human
gaauguuuuuaggaauguuaug

SEQ ID NO: 35810 - RNA, 22 nt, Human
gaauguuuuuauaaguguuaca

SEQ ID NO: 35811 - RNA, 22 nt, Human
gaauuacaaagugagacaagcu

SEQ ID NO: 35812 - RNA, 22 nt, Human
gaauuacauuguuagccuuccu

SEQ ID NO: 35813 - RNA, 22 nt, Human
gaauuaguguugaaaucagggc

SEQ ID NO: 35814 - RNA, 22 nt, Human
gaauuccacuuuggcuuuuggg

SEQ ID NO: 35815 - RNA, 22 nt, Human
ggcccagcuguauauuacaguu

SEQ ID NO: 35816 - RNA, 22 nt, Human
ggcccagcugugcuuccagccc

SEQ ID NO: 35817 - RNA, 22 nt, Human
ggcccagucuggggcccuguga

SEQ ID NO: 35818 - RNA, 20 nt, Human
ggcccagugaaccaggacgg

SEQ ID NO: 35819 - RNA, 22 nt, Human
ggcccaguguaccccaggcagu

SEQ ID NO: 35820 - RNA, 22 nt, Human
ggcccaguguugccagaccuga

SEQ ID NO: 35821 - RNA, 22 nt, Human
ggcccaucucuugcucuggguu

SEQ ID NO: 35822 - RNA, 22 nt, Human
ggccccacgggggaguccuagu

SEQ ID NO: 35823 - RNA, 22 nt, Human
ggccccagauucugggcugggu

SEQ ID NO: 35824 - RNA, 22 nt, Human
ggccccagcuguggugaauaga

SEQ ID NO: 35825 - RNA, 22 nt, Human
ggccccagcuucaaccccgugg

SEQ ID NO: 35826 - RNA, 17 nt, Human
ggccccggagccugaca

SEQ ID NO: 35827 - RNA, 22 nt, Human
ggccccucagcaucugagucag

SEQ ID NO: 35828 - RNA, 22 nt, Human
ggcccucccggugaugaagagc

SEQ ID NO: 35829 - RNA, 22 nt, Human
ggcccugcgauuagguggcagg

SEQ ID NO: 35830 - RNA, 22 nt, Human
ggcccugcugaguggaguggag

SEQ ID NO: 35831 - RNA, 22 nt, Human
ggcccugggacacaacaccgaa

SEQ ID NO: 35832 - RNA, 22 nt, Human
ggcccuguccuggcugucuccg

SEQ ID NO: 35833 - RNA, 20 nt, Human
ggccgaaauaauaguggcuu

SEQ ID NO: 35834 - RNA, 22 nt, Human
ggccgcggauuuucccgcuggc

SEQ ID NO: 35835 - RNA, 22 nt, Human
ggccggccuuugcgagcauucu

SEQ ID NO: 35836 - RNA, 22 nt, Human
ggccuaguuuuuucugguaggu

SEQ ID NO: 35837 - RNA, 22 nt, Human
ggccuauguuccugggcuaggg

SEQ ID NO: 35838 - RNA, 22 nt, Human
ggccucaagcuacccucucacc

SEQ ID NO: 35839 - RNA, 21 nt, Human
ggccucagccaccuggcucug

SEQ ID NO: 35840 - RNA, 22 nt, Human
ggccucaggguugggcccauua

SEQ ID NO: 35841 - RNA, 22 nt, Human
ggccuccucacccugcucaggc

SEQ ID NO: 35842 - RNA, 22 nt, Human
ggccucgagcaauacucccauc

SEQ ID NO: 35843 - RNA, 22 nt, Human
ggccucucauguccugggcuuc

SEQ ID NO: 35844 - RNA, 22 nt, Human
ggccucucuggcauggcugccc

SEQ ID NO: 35845 - RNA, 20 nt, Human
ggccucugaggacaaggaga

SEQ ID NO: 35846 - RNA, 22 nt, Human
ggccucugcaggccucgacaag

SEQ ID NO: 35847 - RNA, 22 nt, Human
ggccucugggguccugagccca

SEQ ID NO: 35848 - RNA, 22 nt, Human
ggccucugguucacagggagga

SEQ ID NO: 35849 - RNA, 22 nt, Human
ggccucuguucugcauuccucc

SEQ ID NO: 35850 - RNA, 22 nt, Human
ggccucuguuuggagccaggau

SEQ ID NO: 35851 - RNA, 22 nt, Human
ggccugaaauaaaguagcagaa

SEQ ID NO: 35852 - RNA, 22 nt, Human
ggccugaaugccugaguguggg

SEQ ID NO: 35853 - RNA, 20 nt, Human
ggccugagcauggcuggcag

SEQ ID NO: 35854 - RNA, 22 nt, Human
ggccugaggccaccagcagccc

SEQ ID NO: 35855 - RNA, 22 nt, Human
ggccugaggcgucccagcugug

SEQ ID NO: 35856 - RNA, 22 nt, Human
ggccugaucuuugacccucauc

SEQ ID NO: 35857 - RNA, 22 nt, Human
ggccugcucaguccucuuucuu

SEQ ID NO: 35858 - RNA, 22 nt, Human
ggccugcucuguuuagaggggg

SEQ ID NO: 35859 - RNA, 22 nt, Human
ggccugcugacccaaguccugu

SEQ ID NO: 35860 - RNA, 22 nt, Human
ggccugcugcagugugacaguu

SEQ ID NO: 35861 - RNA, 22 nt, Human
ggccugcuggcuccagcgcccg

SEQ ID NO: 35862 - RNA, 22 nt, Human
ggccugcuucucagugagcuug

SEQ ID NO: 35863 - RNA, 22 nt, Human
ggccuggacaccugaggucuua

SEQ ID NO: 35864 - RNA, 22 nt, Human
ggccuggagcagagacuaggga

SEQ ID NO: 35865 - RNA, 22 nt, Human
ggccuggagucagggaaagcaa

SEQ ID NO: 35866 - RNA, 22 nt, Human
ggccuggaguuuggggaauaga

SEQ ID NO: 35867 - RNA, 22 nt, Human
ggccuggcauggggacuaaggg

SEQ ID NO: 35868 - RNA, 22 nt, Human
ggccugggccuuuguguuuuga

SEQ ID NO: 35869 - RNA, 22 nt, Human
ggccuguccagccugccuggcu

SEQ ID NO: 35870 - RNA, 22 nt, Human
ggccugucucacccccgggugc

SEQ ID NO: 35871 - RNA, 22 nt, Human
ggccugugagaaucaaggaaaa

SEQ ID NO: 35872 - RNA, 22 nt, Human
ggccugugagcccuugcaugua

SEQ ID NO: 35873 - RNA, 22 nt, Human
ggccugugagccuuaguuuaua

SEQ ID NO: 35874 - RNA, 22 nt, Human
ggccuguggcuuuggcgucuaa

SEQ ID NO: 35875 - RNA, 22 nt, Human
ggccuguguccuccuugcccug

SEQ ID NO: 35876 - RNA, 23 nt, Human
ggccuguguuuugucugaaguac

SEQ ID NO: 35877 - RNA, 22 nt, Human
ggccuuagcggucauagcaaag

SEQ ID NO: 35878 - RNA, 22 nt, Human
ggccuuaggcucaacaggcaga

SEQ ID NO: 35879 - RNA, 22 nt, Human
gacagcaaccucaugagaaacu

SEQ ID NO: 35880 - RNA, 22 nt, Human
gacagcaagagacagagcaucc

SEQ ID NO: 35881 - RNA, 22 nt, Human
gacagcagacagaacuaccugc

SEQ ID NO: 35882 - RNA, 22 nt, Human
gacagcagaugaagccugcaga

SEQ ID NO: 35883 - RNA, 22 nt, Human
gacagcagcauaauacaugaac

SEQ ID NO: 35884 - RNA, 22 nt, Human
gacagcaugagagaugccagug

SEQ ID NO: 35885 - RNA, 22 nt, Human
gacagccaggucugaugaccca

SEQ ID NO: 35886 - RNA, 22 nt, Human
gacagcugaaggaugauucagg

SEQ ID NO: 35887 - RNA, 22 nt, Human
gacagcuggcaguggaaaggug

SEQ ID NO: 35888 - RNA, 18 nt, Human
gacagcuguccugagccc

SEQ ID NO: 35889 - RNA, 22 nt, Human
gacagcugugcaggagaagggg

SEQ ID NO: 35890 - RNA, 22 nt, Human
gacagcuuaggaaguuucuauu

SEQ ID NO: 35891 - RNA, 22 nt, Human
gacaggaaauauggggguuguu

SEQ ID NO: 35892 - RNA, 19 nt, Human
gacaggaaggcuaccagua

SEQ ID NO: 35893 - RNA, 22 nt, Human
gacaggauauuaugauagauuc

SEQ ID NO: 35894 - RNA, 21 nt, Human
gacaggcaaggagucacuuag

SEQ ID NO: 35895 - RNA, 22 nt, Human
gacaggcaggccagggcugugg

SEQ ID NO: 35896 - RNA, 22 nt, Human
gacaggcuagguugcuguccuc

SEQ ID NO: 35897 - RNA, 22 nt, Human
gacaggcuauuuucuuacgggu

SEQ ID NO: 35898 - RNA, 22 nt, Human
gacagggacgaggcuucaggca

SEQ ID NO: 35899 - RNA, 22 nt, Human
gacagggaggaaagagacugcu

SEQ ID NO: 35900 - RNA, 22 nt, Human
gacaggguuugcaaggacuucg

SEQ ID NO: 35901 - RNA, 21 nt, Human
gacaggugauucagagcaggg

SEQ ID NO: 35902 - RNA, 18 nt, Human
gacaggugggugagacca

SEQ ID NO: 35903 - RNA, 22 nt, Human
gacagguguguguauauuaggg

SEQ ID NO: 35904 - RNA, 22 nt, Human
gacagguugaaguaucaaaggu

SEQ ID NO: 35905 - RNA, 22 nt, Human
gacaguaagaccuuaccagccu

SEQ ID NO: 35906 - RNA, 22 nt, Human
gacaguaagagugucuggguuc

SEQ ID NO: 35907 - RNA, 22 nt, Human
gacaguaagucagagacuuggu

SEQ ID NO: 35908 - RNA, 22 nt, Human
gacaguacagguagaagucacu

SEQ ID NO: 35909 - RNA, 22 nt, Human
gacagucacuuccaggagagga

SEQ ID NO: 35910 - RNA, 22 nt, Human
gacaguccuugcccaguaucua

SEQ ID NO: 35911 - RNA, 22 nt, Human
gacaguggaaugacccuuugag

SEQ ID NO: 35912 - RNA, 22 nt, Human
gacagugguguuuuccauugca

SEQ ID NO: 35913 - RNA, 22 nt, Human
gacaguguuacaauuuaaugga

SEQ ID NO: 35914 - RNA, 22 nt, Human
gacaguguuuguauaauuccug

SEQ ID NO: 35915 - RNA, 22 nt, Human
gacaguuuugcuaaaagguuga

SEQ ID NO: 35916 - RNA, 22 nt, Human
gacaguuuuuaauccuuucaug

SEQ ID NO: 35917 - RNA, 22 nt, Human
gacauauacuauggaugguucu

SEQ ID NO: 35918 - RNA, 22 nt, Human
gacauauuugaaaccaagagaa

SEQ ID NO: 35919 - RNA, 22 nt, Human
gacaucaauauucugcagggau

SEQ ID NO: 35920 - RNA, 20 nt, Human
gacaucauguacacauugcc

SEQ ID NO: 35921 - RNA, 21 nt, Human
gacauccaugugaguggcagu

SEQ ID NO: 35922 - RNA, 23 nt, Human
gacaucuguuuugucccugugcu

SEQ ID NO: 35923 - RNA, 22 nt, Human
gacaugauggaaaaaaaugcuc

SEQ ID NO: 35924 - RNA, 22 nt, Human
gacuuauucacgcagcuauacu

SEQ ID NO: 35925 - RNA, 22 nt, Human
gacuucaaaagcugacauucau

SEQ ID NO: 35926 - RNA, 22 nt, Human
gacuucauaauauugagcaugu

SEQ ID NO: 35927 - RNA, 22 nt, Human
gacuucaugacauucaggucag

SEQ ID NO: 35928 - RNA, 22 nt, Human
gacuuccuaagauucaggaaug

SEQ ID NO: 35929 - RNA, 22 nt, Human
gacuucugccucaggggaaggu

SEQ ID NO: 35930 - RNA, 22 nt, Human
gacuucuguuaacuuguaagag

SEQ ID NO: 35931 - RNA, 22 nt, Human
gacuucuucaugucuuuuccac

SEQ ID NO: 35932 - RNA, 22 nt, Human
gacuugggggcuuuggauaggc

SEQ ID NO: 35933 - RNA, 21 nt, Human
gacuuuaauuugagagcaaaa

SEQ ID NO: 35934 - RNA, 20 nt, Human
gacuuuacaucagcacucuu

SEQ ID NO: 35935 - RNA, 22 nt, Human
gacuuuauuauaguggcaauag

SEQ ID NO: 35936 - RNA, 22 nt, Human
gacuuucugagucaaagaaagg

SEQ ID NO: 35937 - RNA, 22 nt, Human
gacuuucugcuauacuuucugu

SEQ ID NO: 35938 - RNA, 22 nt, Human
gacuuucuuuuaccucaaggau

SEQ ID NO: 35939 - RNA, 22 nt, Human
gacuuugcccuaaugaggucuc

SEQ ID NO: 35940 - RNA, 22 nt, Human
gacuuugcugugucagcuucag

SEQ ID NO: 35941 - RNA, 22 nt, Human
gacuuuggagcagaaagaaauu

SEQ ID NO: 35942 - RNA, 22 nt, Human
gacuuuggcaucuagacauugu

SEQ ID NO: 35943 - RNA, 22 nt, Human
gacuuugguuugagcaagucag

SEQ ID NO: 35944 - RNA, 22 nt, Human
gagaaaaucuugggucaagaau

SEQ ID NO: 35945 - RNA, 22 nt, Human
gagaaaaugucagacuuggucg

SEQ ID NO: 35946 - RNA, 22 nt, Human
gagaaacacuguuaguuuauua

SEQ ID NO: 35947 - RNA, 22 nt, Human
gagaaaccgauucugcauguca

SEQ ID NO: 35948 - RNA, 23 nt, Human
gagaaaccucgguaagcaggagg

SEQ ID NO: 35949 - RNA, 22 nt, Human
gagaaaccuguaaggaaggaag

SEQ ID NO: 35950 - RNA, 22 nt, Human
gagaaacuguuggaauuuuaau

SEQ ID NO: 35951 - RNA, 22 nt, Human
gagaaagggaacuuacagagug

SEQ ID NO: 35952 - RNA, 22 nt, Human
gagaaauaggcaaugguaucua

SEQ ID NO: 35953 - RNA, 22 nt, Human
gagaaaugcaugcaugucauca

SEQ ID NO: 35954 - RNA, 22 nt, Human
gagaacaaggaagagucggcag

SEQ ID NO: 35955 - RNA, 22 nt, Human
gagaacuucaggauuauucaag

SEQ ID NO: 35956 - RNA, 22 nt, Human
gagaacuugaacuuuuccucug

SEQ ID NO: 35957 - RNA, 22 nt, Human
gagaacuuucuguguuuuuauc

SEQ ID NO: 35958 - RNA, 22 nt, Human
gagaagaaaauuccgugaacac

SEQ ID NO: 35959 - RNA, 22 nt, Human
gagaagaacuugggcaaaguca

SEQ ID NO: 35960 - RNA, 22 nt, Human
gagaagacgugauggccaagaa

SEQ ID NO: 35961 - RNA, 16 nt, Human
gagaagagcccggcag

SEQ ID NO: 35962 - RNA, 22 nt, Human
gagaagcucuagagguguuuuu

SEQ ID NO: 35963 - RNA, 22 nt, Human
gagaagcuggacuuuccaaacu

SEQ ID NO: 35964 - RNA, 22 nt, Human
gagaaggagcuccuuggggucu

SEQ ID NO: 35965 - RNA, 22 nt, Human
gagaaggaugaggaaaugguau

SEQ ID NO: 35966 - RNA, 22 nt, Human
gagaaggcugauccuuggaguu

SEQ ID NO: 35967 - RNA, 22 nt, Human
gagaaggcuggucuuaagucga

SEQ ID NO: 35968 - RNA, 18 nt, Human
gagaagugcauacauuau

SEQ ID NO: 35969 - RNA, 22 nt, Human
gagaaguuagcucuguuuaggu

SEQ ID NO: 35970 - RNA, 22 nt, Human
gagaaguuuggagugaagguuu

SEQ ID NO: 35971 - RNA, 22 nt, Human
gagaauauuagaguuaguuuau

SEQ ID NO: 35972 - RNA, 22 nt, Human
gagaauauuuuuagcuuuccuc

SEQ ID NO: 35973 - RNA, 22 nt, Human
gagaaucauggcaacagaauga

SEQ ID NO: 35974 - RNA, 22 nt, Human
gagaaucauuuacagaaugauu

SEQ ID NO: 35975 - RNA, 22 nt, Human
gagaaucuccagaugaaguccu

SEQ ID NO: 35976 - RNA, 22 nt, Human
gagaauuacuguuuuuauaaca

SEQ ID NO: 35977 - RNA, 22 nt, Human
gagaauuucccagucugugcug

SEQ ID NO: 35978 - RNA, 22 nt, Human
gagacaaagcuuccugugggua

SEQ ID NO: 35979 - RNA, 22 nt, Human
gagacacacauucuggagagaa

SEQ ID NO: 35980 - RNA, 22 nt, Human
gagacacacccaagguuaugag

SEQ ID NO: 35981 - RNA, 22 nt, Human
gagacacagagaggcuguguga

SEQ ID NO: 35982 - RNA, 22 nt, Human
gagacacagcagauauucaauc

SEQ ID NO: 35983 - RNA, 22 nt, Human
gagacacaggcacagaagaggc

SEQ ID NO: 35984 - RNA, 22 nt, Human
gagacacuugcugugaggucgc

SEQ ID NO: 35985 - RNA, 22 nt, Human
gagacagagagguacucaacau

SEQ ID NO: 35986 - RNA, 22 nt, Human
gagacagagaucuugcugaguc

SEQ ID NO: 35987 - RNA, 22 nt, Human
gagacagaugcugcuggagcau

SEQ ID NO: 35988 - RNA, 22 nt, Human
gagacagcacaggccacuggga

SEQ ID NO: 35989 - RNA, 17 nt, Human
gagacagcaggagcccc

SEQ ID NO: 35990 - RNA, 21 nt, Human
gagacagcccagugccagggc

SEQ ID NO: 35991 - RNA, 22 nt, Human
gagacagccuacuccagucuca

SEQ ID NO: 35992 - RNA, 22 nt, Human
gagacaggauuuaaccaaagcu

SEQ ID NO: 35993 - RNA, 22 nt, Human
gagaccaggaaguacagcagcc

SEQ ID NO: 35994 - RNA, 22 nt, Human
gagaccucuugguaucgcuagg

SEQ ID NO: 35995 - RNA, 22 nt, Human
gagacucuugcuuuaauagccc

SEQ ID NO: 35996 - RNA, 22 nt, Human
gagacugcauagauggccacaa

SEQ ID NO: 35997 - RNA, 22 nt, Human
ggccuuagugagguccugaugc

SEQ ID NO: 35998 - RNA, 22 nt, Human
ggccuuccugcugcuccgggcc

SEQ ID NO: 35999 - RNA, 19 nt, Human
ggccuugcucuguggcagc

SEQ ID NO: 36000 - RNA, 22 nt, Human
ggccuugcuuggguuauaugcc

SEQ ID NO: 36001 - RNA, 22 nt, Human
ggccuuggauccaagcugcggc

SEQ ID NO: 36002 - RNA, 22 nt, Human
ggccuuggccuagcccuccagg

SEQ ID NO: 36003 - RNA, 22 nt, Human
ggccuugggaggagggucagaa

SEQ ID NO: 36004 - RNA, 22 nt, Human
ggccuuggggaggauggugucc

SEQ ID NO: 36005 - RNA, 22 nt, Human
ggccuugguaaagggaugcaug

SEQ ID NO: 36006 - RNA, 22 nt, Human
ggccuugguaaugggggacugu

SEQ ID NO: 36007 - RNA, 22 nt, Human
ggccuugguacuguaaaccgag

SEQ ID NO: 36008 - RNA, 22 nt, Human
ggccuugguuccaaagcaggca

SEQ ID NO: 36009 - RNA, 22 nt, Human
ggcgagcagcgcugugucaggu

SEQ ID NO: 36010 - RNA, 22 nt, Human
ggcgaggccgggacaggcugga

SEQ ID NO: 36011 - RNA, 22 nt, Human
ggcgcacaaugugcagguuugu

SEQ ID NO: 36012 - RNA, 22 nt, Human
ggcgccagcgguaaguaagaca

SEQ ID NO: 36013 - RNA, 22 nt, Human
ggcgcccaucggugcagagggc

SEQ ID NO: 36014 - RNA, 22 nt, Human
ggcggcccugcacgugcugagg

SEQ ID NO: 36015 - RNA, 22 nt, Human
ggcggcuuauucacucugggga

SEQ ID NO: 36016 - RNA, 22 nt, Human
ggcgggagcagcagcucugagc

SEQ ID NO: 36017 - RNA, 22 nt, Human
ggcggguggcgaggcuucucgg

SEQ ID NO: 36018 - RNA, 18 nt, Human
ggcggguguuuuauucac

SEQ ID NO: 36019 - RNA, 22 nt, Human
ggcgugggaaguggggcuucug

SEQ ID NO: 36020 - RNA, 22 nt, Human
ggcguuucaccauguugaccag

SEQ ID NO: 36021 - RNA, 22 nt, Human
ggcuacagggccuggccaaggu

SEQ ID NO: 36022 - RNA, 22 nt, Human
ggcuacaguggcucagugcugg

SEQ ID NO: 36023 - RNA, 22 nt, Human
ggcuaccagauaaauuacagag

SEQ ID NO: 36024 - RNA, 22 nt, Human
ggcuacuagacuuugauacuag

SEQ ID NO: 36025 - RNA, 22 nt, Human
ggcuacuagguaccauuuagaa

SEQ ID NO: 36026 - RNA, 22 nt, Human
ggcuagaaacucaggcaagaaa

SEQ ID NO: 36027 - RNA, 22 nt, Human
ggcuagaugguauauaaggaug

SEQ ID NO: 36028 - RNA, 22 nt, Human
ggcuagcuccuccgcgcaucca

SEQ ID NO: 36029 - RNA, 22 nt, Human
ggcuagcuuagagucaugcuag

SEQ ID NO: 36030 - RNA, 22 nt, Human
ggcuaggcucaccuggagaguu

SEQ ID NO: 36031 - RNA, 22 nt, Human
ggcuagggacuccuccucaggg

SEQ ID NO: 36032 - RNA, 22 nt, Human
ggcuauauccucacaagaugga

SEQ ID NO: 36033 - RNA, 22 nt, Human
gaggcucacuuucauccucuuc

SEQ ID NO: 36034 - RNA, 22 nt, Human
gaggcucagagggacuuucaag

SEQ ID NO: 36035 - RNA, 22 nt, Human
gaggcucagggaaacagcgcag

SEQ ID NO: 36036 - RNA, 22 nt, Human
gaggcucauugcauugugcauu

SEQ ID NO: 36037 - RNA, 22 nt, Human
gaggcuccauggaggaguaugg

SEQ ID NO: 36038 - RNA, 22 nt, Human
gaggcucccaaggggcuaggcc

SEQ ID NO: 36039 - RNA, 22 nt, Human
gaggcucccuuuagguccagau

SEQ ID NO: 36040 - RNA, 20 nt, Human
gaggcucugggcauggcgcc

SEQ ID NO: 36041 - RNA, 22 nt, Human
gaggcucuuuaaaucuuuugga

SEQ ID NO: 36042 - RNA, 22 nt, Human
gaggcugagacucugaauuuuu

SEQ ID NO: 36043 - RNA, 22 nt, Human
gaggcugagaguuuguucuacu

SEQ ID NO: 36044 - RNA, 22 nt, Human
gaggcugaggguuagagaguca

SEQ ID NO: 36045 - RNA, 22 nt, Human
gaggcugccaaugugugcaugu

SEQ ID NO: 36046 - RNA, 20 nt, Human
gaggcugcggacugcuggac

SEQ ID NO: 36047 - RNA, 22 nt, Human
gaggcugcggggaggagccugc

SEQ ID NO: 36048 - RNA, 22 nt, Human
gaggcugcugagagcccuguuu

SEQ ID NO: 36049 - RNA, 22 nt, Human
gaggcuggaauauuagaaaugu

SEQ ID NO: 36050 - RNA, 22 nt, Human
gaggcugggaaguccaagauca

SEQ ID NO: 36051 - RNA, 22 nt, Human
gaggcugguaggaaaggaaaca

SEQ ID NO: 36052 - RNA, 22 nt, Human
gaggcugguucccuugaucuuu

SEQ ID NO: 36053 - RNA, 22 nt, Human
gaggcugguuugccuuuuggca

SEQ ID NO: 36054 - RNA, 22 nt, Human
gaggcuguaaguguggagccua

SEQ ID NO: 36055 - RNA, 22 nt, Human
gaggcugugucuugggguggaa

SEQ ID NO: 36056 - RNA, 22 nt, Human
gaggcuguuagggccugaggua

SEQ ID NO: 36057 - RNA, 22 nt, Human
gaggcuucuggaaagccuggca

SEQ ID NO: 36058 - RNA, 22 nt, Human
gaggcuucuguaacccuguccu

SEQ ID NO: 36059 - RNA, 23 nt, Human
gaggcuugaucagcuuccuccac

SEQ ID NO: 36060 - RNA, 22 nt, Human
gagggaaacagauggguugugg

SEQ ID NO: 36061 - RNA, 22 nt, Human
gagggaagaaagaauugaugcg

SEQ ID NO: 36062 - RNA, 22 nt, Human
gagggaagauuccccauauggg

SEQ ID NO: 36063 - RNA, 22 nt, Human
gagggaagucauaauguucuag

SEQ ID NO: 36064 - RNA, 22 nt, Human
gagggacagcuaaagagaaauu

SEQ ID NO: 36065 - RNA, 22 nt, Human
gagggaccccaggcuggcccuu

SEQ ID NO: 36066 - RNA, 22 nt, Human
gagggaccuuuacacagacauu

SEQ ID NO: 36067 - RNA, 22 nt, Human
gagggaggcaucaugaauccag

SEQ ID NO: 36068 - RNA, 22 nt, Human
gagggagggaaaguuuaacacu

SEQ ID NO: 36069 - RNA, 22 nt, Human
gagggagggccaggucccaacc

SEQ ID NO: 36070 - RNA, 18 nt, Human
gagggaguagcugagguu

SEQ ID NO: 36071 - RNA, 22 nt, Human
gagggagugccagagggccagc

SEQ ID NO: 36072 - RNA, 22 nt, Human
gagggaugcagaaacagaggcc

SEQ ID NO: 36073 - RNA, 22 nt, Human
gagggaugugccugaaggcagg

SEQ ID NO: 36074 - RNA, 20 nt, Human
gagggcacauuguuccgugc

SEQ ID NO: 36075 - RNA, 22 nt, Human
gagggcaccagaagagccagau

SEQ ID NO: 36076 - RNA, 22 nt, Human
gagggcacuggguuucaauguc

SEQ ID NO: 36077 - RNA, 22 nt, Human
gagggcagagucuaaugaugca

SEQ ID NO: 36078 - RNA, 22 nt, Human
gagggccagaaaguuauugaga

SEQ ID NO: 36079 - RNA, 22 nt, Human
gagggccagaguccugggguca

SEQ ID NO: 36080 - RNA, 22 nt, Human
gagggccagaucccaggaggaa

SEQ ID NO: 36081 - RNA, 22 nt, Human
gagggccagccugccaagggcc

SEQ ID NO: 36082 - RNA, 22 nt, Human
gagggcccuggcuggcuccagc

SEQ ID NO: 36083 - RNA, 22 nt, Human
gagggccuagaagcuccauaug

SEQ ID NO: 36084 - RNA, 22 nt, Human
gagggccucugcugcuccacau

SEQ ID NO: 36085 - RNA, 22 nt, Human
gagggccuggcacagggaggcu

SEQ ID NO: 36086 - RNA, 22 nt, Human
gagggcgcuucagagagaugaa

SEQ ID NO: 36087 - RNA, 22 nt, Human
gagggcguucagucagugucuc

SEQ ID NO: 36088 - RNA, 22 nt, Human
gagggcucaacuacuacuaggc

SEQ ID NO: 36089 - RNA, 22 nt, Human
gagggcucugucuggaagggaa

SEQ ID NO: 36090 - RNA, 22 nt, Human
gagggcugaaguguuuuaugag

SEQ ID NO: 36091 - RNA, 22 nt, Human
gagggcugccacguugggcgag

SEQ ID NO: 36092 - RNA, 22 nt, Human
gagggcuggggcuuaggcuuag

SEQ ID NO: 36093 - RNA, 19 nt, Human
gagggcuugauggacccga

SEQ ID NO: 36094 - RNA, 22 nt, Human
gaggggaagacuucuggacagu

SEQ ID NO: 36095 - RNA, 22 nt, Human
gaggggaguaaagucauguuac

SEQ ID NO: 36096 - RNA, 22 nt, Human
gaggggcagaaugugaucaggg

SEQ ID NO: 36097 - RNA, 22 nt, Human
gaggggcaggauuauugggauu

SEQ ID NO: 36098 - RNA, 22 nt, Human
gaggggcagugcacccgggccc

SEQ ID NO: 36099 - RNA, 22 nt, Human
gaggggccggcaugugccucuc

SEQ ID NO: 36100 - RNA, 22 nt, Human
gaggggcuguggagcucucugg

SEQ ID NO: 36101 - RNA, 22 nt, Human
gaggggcuugaggcccugaugg

SEQ ID NO: 36102 - RNA, 22 nt, Human
gagggggacguauccugguaug

SEQ ID NO: 36103 - RNA, 22 nt, Human
gagggggcucccugaagccagu

SEQ ID NO: 36104 - RNA, 22 nt, Human
gagggggcucugccaaccuguc

SEQ ID NO: 36105 - RNA, 22 nt, Human
gagggguccugccuuggcugga

SEQ ID NO: 36106 - RNA, 22 nt, Human
gagggguggcccuggcguguac

SEQ ID NO: 36107 - RNA, 22 nt, Human
gagggucccugcucagggccag

SEQ ID NO: 36108 - RNA, 22 nt, Human
gagggugcaggcaagagcaaaa

SEQ ID NO: 36109 - RNA, 22 nt, Human
gaggguggaaaggguguaccug

SEQ ID NO: 36110 - RNA, 22 nt, Human
gaggguggccuuuagagcccau

SEQ ID NO: 36111 - RNA, 22 nt, Human
gaggguggcuccucccugggcc

SEQ ID NO: 36112 - RNA, 22 nt, Human
gagggugggccagauaugaggg

SEQ ID NO: 36113 - RNA, 22 nt, Human
gagggugucuggaugcuagacu

SEQ ID NO: 36114 - RNA, 22 nt, Human
gaggguuggugcaaaugggaug

SEQ ID NO: 36115 - RNA, 22 nt, Human
gagguaacacuguucagugggc

SEQ ID NO: 36116 - RNA, 22 nt, Human
gagguaauuacuauguucagau

SEQ ID NO: 36117 - RNA, 22 nt, Human
gagguacagaguguuccaaugu

SEQ ID NO: 36118 - RNA, 22 nt, Human
gagguacaugaggauacacagg

SEQ ID NO: 36119 - RNA, 22 nt, Human
gagguagcaugcuggaagggac

SEQ ID NO: 36120 - RNA, 22 nt, Human
gagguaggcugugaaagggggu

SEQ ID NO: 36121 - RNA, 22 nt, Human
gagguauaguucuauuagauga

SEQ ID NO: 36122 - RNA, 22 nt, Human
gagguauggauaucuggagagg

SEQ ID NO: 36123 - RNA, 22 nt, Human
gagguauugacuaugggauggc

SEQ ID NO: 36124 - RNA, 22 nt, Human
gaggucaaggucaagagacaga

SEQ ID NO: 36125 - RNA, 22 nt, Human
gaggucaggcucaagcugggcc

SEQ ID NO: 36126 - RNA, 22 nt, Human
gaggucagucagaccaggguuu

SEQ ID NO: 36127 - RNA, 22 nt, Human
gaggucauuguugcauuaauug

SEQ ID NO: 36128 - RNA, 22 nt, Human
gagguccaacacaauggguguu

SEQ ID NO: 36129 - RNA, 22 nt, Human
gagguccauacagcuauucuac

SEQ ID NO: 36130 - RNA, 22 nt, Human
gagguccauuuucacauaugau

SEQ ID NO: 36131 - RNA, 22 nt, Human
gaggucugccuucaggagaguu

SEQ ID NO: 36132 - RNA, 22 nt, Human
gaggucuuagaagaaaaaucau

SEQ ID NO: 36133 - RNA, 22 nt, Human
gaggucuugucugauagggaaa

SEQ ID NO: 36134 - RNA, 22 nt, Human
gaggugagaagggggucagaug

SEQ ID NO: 36135 - RNA, 22 nt, Human
gaggugaguggggucuccaggg

SEQ ID NO: 36136 - RNA, 22 nt, Human
gaggugauuuucaaaagaacuu

SEQ ID NO: 36137 - RNA, 22 nt, Human
gaggugcugcuguacuucuugc

SEQ ID NO: 36138 - RNA, 22 nt, Human
gagguggaaggcaggaacaaau

SEQ ID NO: 36139 - RNA, 22 nt, Human
gagguggcgcgccaucccugcc

SEQ ID NO: 36140 - RNA, 22 nt, Human
gagguggcuccaggagcaaugc

SEQ ID NO: 36141 - RNA, 22 nt, Human
gagguggcuccuucagggaaua

SEQ ID NO: 36142 - RNA, 22 nt, Human
gggaucuugaaacagcuggauu

SEQ ID NO: 36143 - RNA, 22 nt, Human
gggaucuuucugaugcuguggc

SEQ ID NO: 36144 - RNA, 22 nt, Human
gggaugaauugagucagaaggg

SEQ ID NO: 36145 - RNA, 22 nt, Human
gggaugacuacuuaugggaagu

SEQ ID NO: 36146 - RNA, 19 nt, Human
gggaugcacucugaccacu

SEQ ID NO: 36147 - RNA, 22 nt, Human
gggauggaggguagagcaagug

SEQ ID NO: 36148 - RNA, 22 nt, Human
gggauggggggaagcguccaug

SEQ ID NO: 36149 - RNA, 22 nt, Human
gggauggggucgggacccugcu

SEQ ID NO: 36150 - RNA, 22 nt, Human
gggaugucguggguggcagcug

SEQ ID NO: 36151 - RNA, 22 nt, Human
gggauugaauugggggaucaca

SEQ ID NO: 36152 - RNA, 22 nt, Human
gggauuugugggauggccagug

SEQ ID NO: 36153 - RNA, 22 nt, Human
gggcaaagugguggaggcaguu

SEQ ID NO: 36154 - RNA, 22 nt, Human
gggcaagcacagcgagcgugcg

SEQ ID NO: 36155 - RNA, 22 nt, Human
gggcaagcagugaggacagcac

SEQ ID NO: 36156 - RNA, 22 nt, Human
gggcaauuaaggucccguuucc

SEQ ID NO: 36157 - RNA, 22 nt, Human
gggcacagaagucuaagacauc

SEQ ID NO: 36158 - RNA, 22 nt, Human
gggcacaugcuuagggaggaaa

SEQ ID NO: 36159 - RNA, 22 nt, Human
gggcacuggaaggcucucaggc

SEQ ID NO: 36160 - RNA, 18 nt, Human
gggcacuggggacuggag

SEQ ID NO: 36161 - RNA, 22 nt, Human
gggcacuguacacugugcaugg

SEQ ID NO: 36162 - RNA, 22 nt, Human
gggcacuguguucagagugcag

SEQ ID NO: 36163 - RNA, 22 nt, Human
gggcacuuaaugggcacagaga

SEQ ID NO: 36164 - RNA, 22 nt, Human
gggcacuucuaagcauggggcu

SEQ ID NO: 36165 - RNA, 22 nt, Human
gggcagacugguuauacacggg

SEQ ID NO: 36166 - RNA, 22 nt, Human
gggcagagagcuggaacuccuu

SEQ ID NO: 36167 - RNA, 20 nt, Human
gggcagcaagacauuugaca

SEQ ID NO: 36168 - RNA, 22 nt, Human
gggcagcagaauuggacagaaa

SEQ ID NO: 36169 - RNA, 22 nt, Human
gggcagcagagcccugccgagu

SEQ ID NO: 36170 - RNA, 21 nt, Human
gggcagcagcagcaacaaggg

SEQ ID NO: 36171 - RNA, 22 nt, Human
gggcagcagcaggaggucucug

SEQ ID NO: 36172 - RNA, 22 nt, Human
gggcagcagccacucauuuagc

SEQ ID NO: 36173 - RNA, 22 nt, Human
gggcagcaggcuccacguuccu

SEQ ID NO: 36174 - RNA, 22 nt, Human
gggcagcaguugcccuaaucaa

SEQ ID NO: 36175 - RNA, 22 nt, Human
gggcagcaugucacuagcaugg

SEQ ID NO: 36176 - RNA, 22 nt, Human
gggcagccccagcgcguuggcu

SEQ ID NO: 36177 - RNA, 22 nt, Human
gggcagccugcuuucugaucca

SEQ ID NO: 36178 - RNA, 22 nt, Human
gggcagcuagcccucuagccca

SEQ ID NO: 36179 - RNA, 20 nt, Human
gggcagcuccccucauucug

SEQ ID NO: 36180 - RNA, 21 nt, Human
gggcagcucuguuuuauuuuc

SEQ ID NO: 36181 - RNA, 22 nt, Human
gggcagcugccagaggccaugg

SEQ ID NO: 36182 - RNA, 22 nt, Human
gggcagcuggauaguuuuaaau

SEQ ID NO: 36183 - RNA, 16 nt, Human
gggcaggaaucagggu

SEQ ID NO: 36184 - RNA, 22 nt, Human
gggcaggagagggccaccugga

SEQ ID NO: 36185 - RNA, 22 nt, Human
gggcaggaggcuaauucugcau

SEQ ID NO: 36186 - RNA, 22 nt, Human
gggcaggaugcaguuucagaga

SEQ ID NO: 36187 - RNA, 22 nt, Human
gggcagguacaagaugcuucuu

SEQ ID NO: 36188 - RNA, 22 nt, Human
gggcagguaggugaaauaauga

SEQ ID NO: 36189 - RNA, 15 nt, Human
gggcaggucuggggc

SEQ ID NO: 36190 - RNA, 22 nt, Human
gggcaggugaccucuuguccug

SEQ ID NO: 36191 - RNA, 22 nt, Human
gggcaggugauuuuggcuccau

SEQ ID NO: 36192 - RNA, 22 nt, Human
gggcaggugccagcucccuguc

SEQ ID NO: 36193 - RNA, 22 nt, Human
gggcaggugcccagggccagag

SEQ ID NO: 36194 - RNA, 22 nt, Human
gggcagguggagggcccagcca

SEQ ID NO: 36195 - RNA, 22 nt, Human
gggcagguuauuggaguaggga

SEQ ID NO: 36196 - RNA, 22 nt, Human
gggcaguagcuucguaggcauc

SEQ ID NO: 36197 - RNA, 22 nt, Human
gggcagugauuuuccuuagagg

SEQ ID NO: 36198 - RNA, 22 nt, Human
gggcagugguuacacagcugag

SEQ ID NO: 36199 - RNA, 22 nt, Human
gggcagugucgaggucuggucc

SEQ ID NO: 36200 - RNA, 23 nt, Human
gggcaguuauguuguccuuggcu

SEQ ID NO: 36201 - RNA, 19 nt, Human
gggcaucaaagugcuggug

SEQ ID NO: 36202 - RNA, 22 nt, Human
gggcaucuuguagccuucacuu

SEQ ID NO: 36203 - RNA, 22 nt, Human
gggcaugacuuuuggaguggga

SEQ ID NO: 36204 - RNA, 22 nt, Human
gggcaugagaggcaggcaagug

SEQ ID NO: 36205 - RNA, 22 nt, Human
gggcauggaggucugucugcag

SEQ ID NO: 36206 - RNA, 22 nt, Human
gggcauggcgugugcuggauuc

SEQ ID NO: 36207 - RNA, 22 nt, Human
gggcaugguggcaggcaccugu

SEQ ID NO: 36208 - RNA, 22 nt, Human
gggcauguaggaauccauggag

SEQ ID NO: 36209 - RNA, 21 nt, Human
gggccacaccuucugcagacc

SEQ ID NO: 36210 - RNA, 22 nt, Human
gggccacggaaggaccaguggg

SEQ ID NO: 36211 - RNA, 22 nt, Human
gggccagguaucgucuuuagua

SEQ ID NO: 36212 - RNA, 22 nt, Human
gggcccacuggcugucugaccc

SEQ ID NO: 36213 - RNA, 19 nt, Human
gggcccagcauggaggguu

SEQ ID NO: 36214 - RNA, 22 nt, Human
gggcccagcccucugcucacug

SEQ ID NO: 36215 - RNA, 22 nt, Human
gggcccaguacccucugccaag

SEQ ID NO: 36216 - RNA, 22 nt, Human
gggccccuuguaucucuggcuc

SEQ ID NO: 36217 - RNA, 22 nt, Human
gggcccugccuaaggaacacac

SEQ ID NO: 36218 - RNA, 22 nt, Human
gggcccuggacguggcggcaga

SEQ ID NO: 36219 - RNA, 22 nt, Human
gggcccuggauuuaagcaugga

SEQ ID NO: 36220 - RNA, 22 nt, Human
gggcccuggccgaaucccucug

SEQ ID NO: 36221 - RNA, 22 nt, Human
gggcccugggauucagagcaag

SEQ ID NO: 36222 - RNA, 22 nt, Human
gggcccugugauuucuugagga

SEQ ID NO: 36223 - RNA, 22 nt, Human
gggcccuucagcuuccucugca

SEQ ID NO: 36224 - RNA, 22 nt, Human
gggccggagcugggucccgcgc

SEQ ID NO: 36225 - RNA, 22 nt, Human
gggccucacuaugugguccagg

SEQ ID NO: 36226 - RNA, 22 nt, Human
gggccucagagauggucaguga

SEQ ID NO: 36227 - RNA, 22 nt, Human
gggccuccggggugagcugugg

SEQ ID NO: 36228 - RNA, 22 nt, Human
gggccucucccuucucacgcau

SEQ ID NO: 36229 - RNA, 22 nt, Human
gggccugaaaccuucagggcuu

SEQ ID NO: 36230 - RNA, 22 nt, Human
gggccugcagguucugagaggc

SEQ ID NO: 36231 - RNA, 22 nt, Human
gggccugcuccccaucgcugcu

SEQ ID NO: 36232 - RNA, 22 nt, Human
gggccuggcaugcagccccguu

SEQ ID NO: 36233 - RNA, 22 nt, Human
gggccuuccgacucccaaggcc

SEQ ID NO: 36234 - RNA, 22 nt, Human
gggccuuggcgaaguguggugg

SEQ ID NO: 36235 - RNA, 22 nt, Human
gggcgaggacugacucugggca

SEQ ID NO: 36236 - RNA, 22 nt, Human
gggcgccgugggaaacagccgg

SEQ ID NO: 36237 - RNA, 22 nt, Human
gggcgcgcacgccagacagccu

SEQ ID NO: 36238 - RNA, 18 nt, Human
gggcggaagggaagauaa

SEQ ID NO: 36239 - RNA, 19 nt, Human
gggcggagccugaccuggg

SEQ ID NO: 36240 - RNA, 22 nt, Human
gggcgugaccaucugggagcuc

SEQ ID NO: 36241 - RNA, 21 nt, Human
gggcuaagagugaccaggcag

SEQ ID NO: 36242 - RNA, 22 nt, Human
gggcuacagacaugcucuaagc

SEQ ID NO: 36243 - RNA, 22 nt, Human
gggcuagaaauucugcagugga

SEQ ID NO: 36244 - RNA, 22 nt, Human
gggcuagaauccgcgucucuug

SEQ ID NO: 36245 - RNA, 22 nt, Human
gauuucuuugaauuagagaggu

SEQ ID NO: 36246 - RNA, 22 nt, Human
gauuucuuugcaagcuguguuc

SEQ ID NO: 36247 - RNA, 22 nt, Human
gauuuuacaaacugcaggaccc

SEQ ID NO: 36248 - RNA, 22 nt, Human
gauuuuauauggcauacugugg

SEQ ID NO: 36249 - RNA, 22 nt, Human
gauuuucauuauagcuaguuuc

SEQ ID NO: 36250 - RNA, 22 nt, Human
gauuuucugagccuucaaauuu

SEQ ID NO: 36251 - RNA, 22 nt, Human
gauggggaugagaagugagcag

SEQ ID NO: 36252 - RNA, 22 nt, Human
gaugggggccagggccugcuuu

SEQ ID NO: 36253 - RNA, 18 nt, Human
gaugggguccaggcauag

SEQ ID NO: 36254 - RNA, 22 nt, Human
gaugggguuuugccaggcuggu

SEQ ID NO: 36255 - RNA, 22 nt, Human
gauggucaggucaucucaugga

SEQ ID NO: 36256 - RNA, 22 nt, Human
gauggucuguauuaaacagaug

SEQ ID NO: 36257 - RNA, 22 nt, Human
gauggucuuugucucugauaag

SEQ ID NO: 36258 - RNA, 22 nt, Human
gauggugcaauuaucgugcaug

SEQ ID NO: 36259 - RNA, 22 nt, Human
gaugguggcaagagccaagucu

SEQ ID NO: 36260 - RNA, 22 nt, Human
gauguaaacugggacuuccuag

SEQ ID NO: 36261 - RNA, 22 nt, Human
gauguacaagauuguaggaaug

SEQ ID NO: 36262 - RNA, 22 nt, Human
gauguacaaugucacuaugacc

SEQ ID NO: 36263 - RNA, 22 nt, Human
gauguacacucagaaaagucau

SEQ ID NO: 36264 - RNA, 22 nt, Human
gauguacaggaguuuuucaagg

SEQ ID NO: 36265 - RNA, 22 nt, Human
gauguacuugccuuaucuaucc

SEQ ID NO: 36266 - RNA, 22 nt, Human
gauguagacacuuggaggcuua

SEQ ID NO: 36267 - RNA, 22 nt, Human
gauguagcggcagcuguuuuuc

SEQ ID NO: 36268 - RNA, 22 nt, Human
gauguauauaccugguguggaa

SEQ ID NO: 36269 - RNA, 22 nt, Human
gauguccauuucaaaccucauu

SEQ ID NO: 36270 - RNA, 17 nt, Human
gauguccucuggacuac

SEQ ID NO: 36271 - RNA, 22 nt, Human
gauguccugcagaaacaugaga

SEQ ID NO: 36272 - RNA, 22 nt, Human
gaugucucugacuaaggcagug

SEQ ID NO: 36273 - RNA, 22 nt, Human
gaugucuggcuaccacucgcac

SEQ ID NO: 36274 - RNA, 22 nt, Human
gaugucuuaagcccagaaguuc

SEQ ID NO: 36275 - RNA, 20 nt, Human
gaugucuuggucacaguggc

SEQ ID NO: 36276 - RNA, 22 nt, Human
gaugucuuuagggcaaaauauu

SEQ ID NO: 36277 - RNA, 22 nt, Human
gaugucuuucuaauacuggcuu

SEQ ID NO: 36278 - RNA, 22 nt, Human
gaugucuuuuuccaggcucuuu

SEQ ID NO: 36279 - RNA, 22 nt, Human
gauguggcugccauggagccug

SEQ ID NO: 36280 - RNA, 22 nt, Human
gaugugucauuuggucaucugc

SEQ ID NO: 36281 - RNA, 22 nt, Human
gaugugucccuuucaacucaga

SEQ ID NO: 36282 - RNA, 22 nt, Human
gauguguccuaguacggguggg

SEQ ID NO: 36283 - RNA, 22 nt, Human
gaugugucuccauacaccaccc

SEQ ID NO: 36284 - RNA, 22 nt, Human
gaugugugugcccugggccugc

SEQ ID NO: 36285 - RNA, 22 nt, Human
gauguguuuguuucuggaggag

SEQ ID NO: 36286 - RNA, 22 nt, Human
gauguuaacuuguucugccucu

SEQ ID NO: 36287 - RNA, 22 nt, Human
gauguuaagaaggaauugaagu

SEQ ID NO: 36288 - RNA, 22 nt, Human
gauguucuuauaccauuguggg

SEQ ID NO: 36289 - RNA, 21 nt, Human
gauuaaauuuaagcuacaugc

SEQ ID NO: 36290 - RNA, 22 nt, Human
gauuagaauaugucagucauaa

SEQ ID NO: 36291 - RNA, 22 nt, Human
gauuagaauggauagaucccca

SEQ ID NO: 36292 - RNA, 22 nt, Human
gauuaggacauggauguauguu

SEQ ID NO: 36293 - RNA, 22 nt, Human
gauuaguaagaguuuaccuauu

SEQ ID NO: 36294 - RNA, 22 nt, Human
gauuauauaauggaagcucuug

SEQ ID NO: 36295 - RNA, 22 nt, Human
gauuauggagaaauaauuagaa

SEQ ID NO: 36296 - RNA, 22 nt, Human
gauuauggauggacaguggagc

SEQ ID NO: 36297 - RNA, 22 nt, Human
gauucaaaaauaagcuccuauu

SEQ ID NO: 36298 - RNA, 22 nt, Human
gauucaaaaguuugagcuccaa

SEQ ID NO: 36299 - RNA, 22 nt, Human
gauucaauguugcagauggaau

SEQ ID NO: 36300 - RNA, 22 nt, Human
gauucacaacugcccugaaggg

SEQ ID NO: 36301 - RNA, 22 nt, Human
gauucacaguuuaggcugggcu

SEQ ID NO: 36302 - RNA, 22 nt, Human
gauucagcuucugagcaguaau

SEQ ID NO: 36303 - RNA, 22 nt, Human
gauucaggccugcaucucagca

SEQ ID NO: 36304 - RNA, 22 nt, Human
gauucagugggcuuugggacag

SEQ ID NO: 36305 - RNA, 22 nt, Human
gauucauguuauagagagucag

SEQ ID NO: 36306 - RNA, 22 nt, Human
gauucccauccucagcagcagc

SEQ ID NO: 36307 - RNA, 22 nt, Human
gauucucucuggaucccaugga

SEQ ID NO: 36308 - RNA, 22 nt, Human
gauucucuuggauguaggcaua

SEQ ID NO: 36309 - RNA, 22 nt, Human
gauucuggcaaaauccuggcuu

SEQ ID NO: 36310 - RNA, 22 nt, Human
gauucuuaugagugaacuuuac

SEQ ID NO: 36311 - RNA, 22 nt, Human
gauucuugggccuucugaaguu

SEQ ID NO: 36312 - RNA, 22 nt, Human
gauucuuugacaggguguuggg

SEQ ID NO: 36313 - RNA, 22 nt, Human
gauucuuuggccuuuauugaca

SEQ ID NO: 36314 - RNA, 22 nt, Human
gauugaaacauaggcagucgag

SEQ ID NO: 36315 - RNA, 22 nt, Human
gauugaaagacuguuugggaga

SEQ ID NO: 36316 - RNA, 22 nt, Human
gauugaaaggaaaaccagagug

SEQ ID NO: 36317 - RNA, 22 nt, Human
gauugaaucauaugaaauugug

SEQ ID NO: 36318 - RNA, 22 nt, Human
gauugcugcaaucaacaaguau

SEQ ID NO: 36319 - RNA, 22 nt, Human
gauugcugugcgccccaggugu

SEQ ID NO: 36320 - RNA, 22 nt, Human
gauugcuuauacacaagaugaa

SEQ ID NO: 36321 - RNA, 22 nt, Human
gauugucugugaucaugagcaa

SEQ ID NO: 36322 - RNA, 22 nt, Human
gauuuaaaguagaccuuuguuu

SEQ ID NO: 36323 - RNA, 22 nt, Human
gauuuagagcaggaaugcaugg

SEQ ID NO: 36324 - RNA, 22 nt, Human
gauuuagauucgcuggggcugg

SEQ ID NO: 36325 - RNA, 21 nt, Human
gauuuauaagccuuaagccua

SEQ ID NO: 36326 - RNA, 22 nt, Human
gauuuauuggucuuucauuggu

SEQ ID NO: 36327 - RNA, 22 nt, Human
gauuuauugucccuguccugcu

SEQ ID NO: 36328 - RNA, 22 nt, Human
gauuucaaccuaacaguaugac

SEQ ID NO: 36329 - RNA, 22 nt, Human
gauuucaauccagcuuucuucu

SEQ ID NO: 36330 - RNA, 22 nt, Human
gauuucaccugaucuugucauc

SEQ ID NO: 36331 - RNA, 21 nt, Human
gauuucacuuaccuucauuua

SEQ ID NO: 36332 - RNA, 22 nt, Human
gauuuccucacuaacauccauc

SEQ ID NO: 36333 - RNA, 22 nt, Human
gauuucucaauccuaguacuau

SEQ ID NO: 36334 - RNA, 22 nt, Human
gauuucucacuguggauuuccu

SEQ ID NO: 36335 - RNA, 22 nt, Human
gauuucucauuuguggauugaa

SEQ ID NO: 36336 - RNA, 22 nt, Human
gauuucuucaggagcagaggag

SEQ ID NO: 36337 - RNA, 22 nt, Human
gauuucuucucucccaagagga

SEQ ID NO: 36338 - RNA, 22 nt, Human
gauuucuuggcccacucucaga

SEQ ID NO: 36339 - RNA, 21 nt, Human
gauuugcagaaacuagacagg

SEQ ID NO: 36340 - RNA, 22 nt, Human
gauuuguagcuuuucagucugu

SEQ ID NO: 36341 - RNA, 22 nt, Human
gauuuguaguuuuaugugucag

SEQ ID NO: 36342 - RNA, 22 nt, Human
gauuugugcucauuuuccauua

SEQ ID NO: 36343 - RNA, 22 nt, Human
gauuuguggugugaggaagagc

SEQ ID NO: 36344 - RNA, 22 nt, Human
gauuuuacaugucauaucuauu

SEQ ID NO: 36345 - RNA, 22 nt, Human
gauuuuaucgucauccuucugg

SEQ ID NO: 36346 - RNA, 22 nt, Human
gauuuucaugauaaacuuguga

SEQ ID NO: 36347 - RNA, 22 nt, Human
gauuuucauuugcacucuagaa

SEQ ID NO: 36348 - RNA, 22 nt, Human
gauuuugaauauuaaagaagag

SEQ ID NO: 36349 - RNA, 22 nt, Human
gauuuuuauauaaagugagaaa

SEQ ID NO: 36350 - RNA, 22 nt, Human
gauuuuucaguauaaaauauau

SEQ ID NO: 36351 - RNA, 22 nt, Human
gcaaaaaccacaauuacuuuua

SEQ ID NO: 36352 - RNA, 22 nt, Human
gcaaaacagucgaugccuccca

SEQ ID NO: 36353 - RNA, 22 nt, Human
gcaaaacucgcaauuacuuuug

SEQ ID NO: 36354 - RNA, 20 nt, Human
gcaaaauaggcucuguuggu

SEQ ID NO: 36355 - RNA, 22 nt, Human
gcaaacagaaaugcaggacgcu

SEQ ID NO: 36356 - RNA, 22 nt, Human
gcaaacauaauaugaagacacu

SEQ ID NO: 36357 - RNA, 22 nt, Human
gcaaacauccacugcccuugua

SEQ ID NO: 36358 - RNA, 22 nt, Human
gcaaacaugugcucauuuugug

SEQ ID NO: 36359 - RNA, 22 nt, Human
gcaaacauguugugagauacca

SEQ ID NO: 36360 - RNA, 22 nt, Human
gccuccugacuuacacugagcu

SEQ ID NO: 36361 - RNA, 22 nt, Human
gccuccugguugcuucuccaac

SEQ ID NO: 36362 - RNA, 21 nt, Human
gccucuccaaauccugccuuc

SEQ ID NO: 36363 - RNA, 22 nt, Human
gccucugcaggugcgguuaucc

SEQ ID NO: 36364 - RNA, 21 nt, Human
gccucugcugucuuauuguga

SEQ ID NO: 36365 - RNA, 22 nt, Human
gccucugggguuaauagaguuu

SEQ ID NO: 36366 - RNA, 22 nt, Human
gccucugggugacgaaagguga

SEQ ID NO: 36367 - RNA, 22 nt, Human
gccucuguggcucagccuugcu

SEQ ID NO: 36368 - RNA, 18 nt, Human
gccucuguugcuugccug

SEQ ID NO: 36369 - RNA, 22 nt, Human
gccugagaaggauaggaagcga

SEQ ID NO: 36370 - RNA, 22 nt, Human
gccugagauuggacauuauuua

SEQ ID NO: 36371 - RNA, 22 nt, Human
gccugagcuacuagggagucug

SEQ ID NO: 36372 - RNA, 22 nt, Human
gccugcaagauggcuggucacu

SEQ ID NO: 36373 - RNA, 20 nt, Human
gccugcagagaaggucagag

SEQ ID NO: 36374 - RNA, 22 nt, Human
gccugcagaggugcugcuagcu

SEQ ID NO: 36375 - RNA, 22 nt, Human
gccugcaggcuguaguuuguga

SEQ ID NO: 36376 - RNA, 22 nt, Human
gccugcagggugaugggcugcc

SEQ ID NO: 36377 - RNA, 22 nt, Human
gccugcagugagugcagaaggu

SEQ ID NO: 36378 - RNA, 22 nt, Human
gccugccagccacaguggcagc

SEQ ID NO: 36379 - RNA, 22 nt, Human
gccugccaugagcuaaugacac

SEQ ID NO: 36380 - RNA, 21 nt, Human
gccugcccucugugauggcca

SEQ ID NO: 36381 - RNA, 20 nt, Human
gccugccucagcuagcugag

SEQ ID NO: 36382 - RNA, 22 nt, Human
gccugccugcugugugcaaguu

SEQ ID NO: 36383 - RNA, 22 nt, Human
gccugccuguuggcugaggugc

SEQ ID NO: 36384 - RNA, 22 nt, Human
gccugccuucggugcgcagcgg

SEQ ID NO: 36385 - RNA, 22 nt, Human
gccugccuuuguaugacccuga

SEQ ID NO: 36386 - RNA, 22 nt, Human
gccugccuuugugaggaagcgg

SEQ ID NO: 36387 - RNA, 22 nt, Human
gccugcucugacauccauccca

SEQ ID NO: 36388 - RNA, 18 nt, Human
gccugcucugcucucccc

SEQ ID NO: 36389 - RNA, 22 nt, Human
gccugcugaaccucaugcaguc

SEQ ID NO: 36390 - RNA, 22 nt, Human
gccugcugagggaaguugggca

SEQ ID NO: 36391 - RNA, 21 nt, Human
gccugcugccuguggccgguc

SEQ ID NO: 36392 - RNA, 22 nt, Human
gccugcuggcuggaaauucucc

SEQ ID NO: 36393 - RNA, 23 nt, Human
gccugcuggucaccuaaucugcc

SEQ ID NO: 36394 - RNA, 22 nt, Human
gccugcuucacggacaggccuc

SEQ ID NO: 36395 - RNA, 22 nt, Human
gccuggaaauugaggcacaguu

SEQ ID NO: 36396 - RNA, 22 nt, Human
gccuggaagugugucgugggaa

SEQ ID NO: 36397 - RNA, 22 nt, Human
gccuggagaaaggaagguggga

SEQ ID NO: 36398 - RNA, 22 nt, Human
gccuggagaagauggaacuagc

SEQ ID NO: 36399 - RNA, 22 nt, Human
gccuggagaccugcuccucuac

SEQ ID NO: 36400 - RNA, 22 nt, Human
gccuggagagcacugugcgcuu

SEQ ID NO: 36401 - RNA, 22 nt, Human
gccuggagcuacuggacacuga

SEQ ID NO: 36402 - RNA, 20 nt, Human
gccuggaggcagagauaaag

SEQ ID NO: 36403 - RNA, 22 nt, Human
gccuggagggauagaaugcaag

SEQ ID NO: 36404 - RNA, 22 nt, Human
gccuggaguacuccuugaagug

SEQ ID NO: 36405 - RNA, 22 nt, Human
gccuggagugcaguggcgugau

SEQ ID NO: 36406 - RNA, 22 nt, Human
gccuggaguggacuuggccccu

SEQ ID NO: 36407 - RNA, 16 nt, Human
gccuggaguggcaggg

SEQ ID NO: 36408 - RNA, 22 nt, Human
gccuggagugguccugcugccc

SEQ ID NO: 36409 - RNA, 22 nt, Human
gccuggaguguugguauuucuc

SEQ ID NO: 36410 - RNA, 22 nt, Human
gccuggaucccagggagucagg

SEQ ID NO: 36411 - RNA, 22 nt, Human
gccuggauuacaaacagccaac

SEQ ID NO: 36412 - RNA, 22 nt, Human
gccuggcaauggccucaggaag

SEQ ID NO: 36413 - RNA, 20 nt, Human
gccuggcacccggggcuggc

SEQ ID NO: 36414 - RNA, 22 nt, Human
gccuggcaggccuguuggggcu

SEQ ID NO: 36415 - RNA, 22 nt, Human
gccuggcaggggccugggagug

SEQ ID NO: 36416 - RNA, 21 nt, Human
gccuggcagguggaagggcuc

SEQ ID NO: 36417 - RNA, 22 nt, Human
gccuggcagugaugucuuuugg

SEQ ID NO: 36418 - RNA, 22 nt, Human
gccuggcaguguaauuccuguc

SEQ ID NO: 36419 - RNA, 22 nt, Human
gccuggcauuacagcacuccug

SEQ ID NO: 36420 - RNA, 23 nt, Human
gccuggccaccccagggcugcuu

SEQ ID NO: 36421 - RNA, 21 nt, Human
gccuggcuagaagcuccuagc

SEQ ID NO: 36422 - RNA, 22 nt, Human
gccuggcuauggccucccccau

SEQ ID NO: 36423 - RNA, 22 nt, Human
gccuggcucgggcacucgccag

SEQ ID NO: 36424 - RNA, 21 nt, Human
gccuggcucucacuggccugg

SEQ ID NO: 36425 - RNA, 22 nt, Human
gccuggcucugaguuucucucc

SEQ ID NO: 36426 - RNA, 22 nt, Human
gccuggcugagguggggaggca

SEQ ID NO: 36427 - RNA, 22 nt, Human
gccuggcugcucagccacucac

SEQ ID NO: 36428 - RNA, 22 nt, Human
gccuggcugcuuagccuacuuc

SEQ ID NO: 36429 - RNA, 22 nt, Human
gccuggcugguagagggggcuc

SEQ ID NO: 36430 - RNA, 22 nt, Human
gccuggcugucaaacccagaag

SEQ ID NO: 36431 - RNA, 22 nt, Human
gccuggcuucccuuggagcauu

SEQ ID NO: 36432 - RNA, 22 nt, Human
gccuggcuuuugccucauguuc

SEQ ID NO: 36433 - RNA, 22 nt, Human
gccugggaaagaguagggaaau

SEQ ID NO: 36434 - RNA, 22 nt, Human
gccugggaacucugaucuccug

SEQ ID NO: 36435 - RNA, 22 nt, Human
gccugggacugcagauccccag

SEQ ID NO: 36436 - RNA, 23 nt, Human
gccugggacugguagugugaccu

SEQ ID NO: 36437 - RNA, 21 nt, Human
gccugggauaguggccuccgg

SEQ ID NO: 36438 - RNA, 22 nt, Human
gccugggauucccagaggggca

SEQ ID NO: 36439 - RNA, 22 nt, Human
gccugggauuguguaagugaau

SEQ ID NO: 36440 - RNA, 22 nt, Human
gccuggggucccuuguuggcac

SEQ ID NO: 36441 - RNA, 22 nt, Human
gccuggguaggagacaaaaggu

SEQ ID NO: 36442 - RNA, 22 nt, Human
gccuggguccacugaucaugcu

SEQ ID NO: 36443 - RNA, 23 nt, Human
gccugggucuagagauaagagcc

SEQ ID NO: 36444 - RNA, 22 nt, Human
gccugggucuccuccgcuuccc

SEQ ID NO: 36445 - RNA, 22 nt, Human
gccugggugcccaaugaugaga

SEQ ID NO: 36446 - RNA, 23 nt, Human
gccuggguuguaacuagugcauc

SEQ ID NO: 36447 - RNA, 22 nt, Human
gccuggucucuuucaugucagu

SEQ ID NO: 36448 - RNA, 22 nt, Human
gccuggugauaagcagugaccu

SEQ ID NO: 36449 - RNA, 22 nt, Human
gccuggugcuaugagggccagc

SEQ ID NO: 36450 - RNA, 22 nt, Human
gccugguguccagaggcgagug

SEQ ID NO: 36451 - RNA, 22 nt, Human
gccuguccuauacaggcggcug

SEQ ID NO: 36452 - RNA, 22 nt, Human
gccugucuacacuuucucugca

SEQ ID NO: 36453 - RNA, 22 nt, Human
gccugugaugcccccauaagua

SEQ ID NO: 36454 - RNA, 23 nt, Human
gccugugccuaugcccagcucug

SEQ ID NO: 36455 - RNA, 22 nt, Human
gccugugccucagccugcagcc

SEQ ID NO: 36456 - RNA, 22 nt, Human
gccuguggggcugaggcugccu

SEQ ID NO: 36457 - RNA, 20 nt, Human
gccugugucuucucugcugu

SEQ ID NO: 36458 - RNA, 22 nt, Human
gccuguguggaugcgccggugc

SEQ ID NO: 36459 - RNA, 22 nt, Human
gccuguuccuuaguggcuucac

SEQ ID NO: 36460 - RNA, 22 nt, Human
gccuguucugcccugagagccu

SEQ ID NO: 36461 - RNA, 22 nt, Human
gccuguuggugacuuucuguug

SEQ ID NO: 36462 - RNA, 22 nt, Human
gccuguuuggaaucuguuuaau

SEQ ID NO: 36463 - RNA, 22 nt, Human
gccuguuuggcaucauugguug

SEQ ID NO: 36464 - RNA, 22 nt, Human
gccuguuuggcugcugacauug

SEQ ID NO: 36465 - RNA, 22 nt, Human
gccuguuuuagaugcauugaug

SEQ ID NO: 36466 - RNA, 22 nt, Human
gccuguuuuccugcugugguug

SEQ ID NO: 36467 - RNA, 22 nt, Human
gccuuaauuuaugucuaacaua

SEQ ID NO: 36468 - RNA, 22 nt, Human
gccuuauuaccugcacuuugaa

SEQ ID NO: 36469 - RNA, 23 nt, Human
gcucagccucagcaggcccagga

SEQ ID NO: 36470 - RNA, 22 nt, Human
gcucagcuaucaguguuccuga

SEQ ID NO: 36471 - RNA, 18 nt, Human
gcucagcuaugggagguu

SEQ ID NO: 36472 - RNA, 22 nt, Human
gcucagcuggaccaucguguuu

SEQ ID NO: 36473 - RNA, 22 nt, Human
gcucagcuggagagggacgggu

SEQ ID NO: 36474 - RNA, 22 nt, Human
gcucagcugggaccaauguguu

SEQ ID NO: 36475 - RNA, 22 nt, Human
gcucaggacuggaggagcgggg

SEQ ID NO: 36476 - RNA, 23 nt, Human
gcucuaucaggaacaagccaggu

SEQ ID NO: 36477 - RNA, 21 nt, Human
gcucuaucaggccaaaauguc

SEQ ID NO: 36478 - RNA, 22 nt, Human
gcucuaugaaccugaaucucac

SEQ ID NO: 36479 - RNA, 22 nt, Human
gcucucagggugauggcauacu

SEQ ID NO: 36480 - RNA, 19 nt, Human
gcucucccucucaguugag

SEQ ID NO: 36481 - RNA, 22 nt, Human
gcucucugccauaugaggauac

SEQ ID NO: 36482 - RNA, 22 nt, Human
gcucucuggaagguaucauuau

SEQ ID NO: 36483 - RNA, 22 nt, Human
gcucucuugacagcuugcuguu

SEQ ID NO: 36484 - RNA, 22 nt, Human
gcucucuugguggcuguccugg

SEQ ID NO: 36485 - RNA, 22 nt, Human
gcucucuuuaaacugcauggcu

SEQ ID NO: 36486 - RNA, 22 nt, Human
gcucucuuucacagagguagga

SEQ ID NO: 36487 - RNA, 22 nt, Human
gcucucuuuccauguggaggau

SEQ ID NO: 36488 - RNA, 22 nt, Human
gcucucuuuuuccagugguggu

SEQ ID NO: 36489 - RNA, 22 nt, Human
gcucugaagggugagcuguucg

SEQ ID NO: 36490 - RNA, 22 nt, Human
gcucugacacauuuguucuacc

SEQ ID NO: 36491 - RNA, 22 nt, Human
gcucugacuuccugcgcuccag

SEQ ID NO: 36492 - RNA, 22 nt, Human
gcucugagaggaugcugagcag

SEQ ID NO: 36493 - RNA, 23 nt, Human
gcucugaggaaguugggcacggg

SEQ ID NO: 36494 - RNA, 22 nt, Human
gcucugaggaccaauuccugug

SEQ ID NO: 36495 - RNA, 22 nt, Human
gcucugaggcugggagcacucu

SEQ ID NO: 36496 - RNA, 23 nt, Human
gcucugagggcuuaucccuccca

SEQ ID NO: 36497 - RNA, 22 nt, Human
gcucugagucacacugcccugu

SEQ ID NO: 36498 - RNA, 22 nt, Human
gcucugagugaucagcugggaa

SEQ ID NO: 36499 - RNA, 17 nt, Human
gcucugccaggaaagag

SEQ ID NO: 36500 - RNA, 22 nt, Human
gcucugcccaaagcuguggcug

SEQ ID NO: 36501 - RNA, 22 nt, Human
gcucugcccagugcccugagac

SEQ ID NO: 36502 - RNA, 22 nt, Human
gcucugccuucucacuggguuc

SEQ ID NO: 36503 - RNA, 22 nt, Human
gcucugcuaauauuguaguacc

SEQ ID NO: 36504 - RNA, 19 nt, Human
gcucugcuacuauuaccac

SEQ ID NO: 36505 - RNA, 22 nt, Human
gcucugcucccucaaaugacau

SEQ ID NO: 36506 - RNA, 23 nt, Human
gcucugcucuguuucauagacag

SEQ ID NO: 36507 - RNA, 16 nt, Human
gcucugcugaggccca

SEQ ID NO: 36508 - RNA, 22 nt, Human
gcucugcugcuuacuagauggu

SEQ ID NO: 36509 - RNA, 22 nt, Human
gcucugcugggugggcaguuau

SEQ ID NO: 36510 - RNA, 22 nt, Human
gcucugcugucuucuugcaggc

SEQ ID NO: 36511 - RNA, 22 nt, Human
gcucuggagauggagccuugag

SEQ ID NO: 36512 - RNA, 23 nt, Human
gcucuggagcugggccuggcagg

SEQ ID NO: 36513 - RNA, 17 nt, Human
gcucuggcacaggauug

SEQ ID NO: 36514 - RNA, 22 nt, Human
gcucuggcacuggcgcgggaug

SEQ ID NO: 36515 - RNA, 22 nt, Human
gcucuggcuacuccacccuguu

SEQ ID NO: 36516 - RNA, 22 nt, Human
gcucuggcuaguuaccucuuac

SEQ ID NO: 36517 - RNA, 22 nt, Human
gcucugggaauucagaaagccu

SEQ ID NO: 36518 - RNA, 22 nt, Human
gcucugggccgggcaccagccu

SEQ ID NO: 36519 - RNA, 22 nt, Human
gcucugggcugaaucauuuauc

SEQ ID NO: 36520 - RNA, 22 nt, Human
gcucuggguagccacugccugg

SEQ ID NO: 36521 - RNA, 22 nt, Human
gcucugggugaacuuggagcaa

SEQ ID NO: 36522 - RNA, 20 nt, Human
gcucugggugguaaaugacu

SEQ ID NO: 36523 - RNA, 22 nt, Human
gcucugguagauccucaggcuc

SEQ ID NO: 36524 - RNA, 22 nt, Human
gcucuguaaagaagagaaaugc

SEQ ID NO: 36525 - RNA, 22 nt, Human
gcucuguacgcaggaugagggg

SEQ ID NO: 36526 - RNA, 21 nt, Human
gcucuguacguuggugccuuc

SEQ ID NO: 36527 - RNA, 22 nt, Human
gcucuguaguauuuaguaaaua

SEQ ID NO: 36528 - RNA, 22 nt, Human
gcucuguagugggcaugugauu

SEQ ID NO: 36529 - RNA, 22 nt, Human
gcucuguaucuuacaacagggu

SEQ ID NO: 36530 - RNA, 22 nt, Human
gcucugucuucagcacacagua

SEQ ID NO: 36531 - RNA, 22 nt, Human
gcucugugaaggguguugcuca

SEQ ID NO: 36532 - RNA, 22 nt, Human
gcucugugcaaauagcaccccu

SEQ ID NO: 36533 - RNA, 22 nt, Human
gcucugugcaguucagggacac

SEQ ID NO: 36534 - RNA, 22 nt, Human
gcucugugccacaugcaguguu

SEQ ID NO: 36535 - RNA, 22 nt, Human
gcucuguguaaauguagggucc

SEQ ID NO: 36536 - RNA, 22 nt, Human
gcucuguguauguggcaggugc

SEQ ID NO: 36537 - RNA, 21 nt, Human
gcucuguuauuuucuaugcag

SEQ ID NO: 36538 - RNA, 22 nt, Human
gcucuguuuaucccugacaauu

SEQ ID NO: 36539 - RNA, 22 nt, Human
gcucuugaggaagugcagggca

SEQ ID NO: 36540 - RNA, 22 nt, Human
gcucuugucaaaaauuaguuga

SEQ ID NO: 36541 - RNA, 22 nt, Human
gcucuuuggauuccuuuacaaa

SEQ ID NO: 36542 - RNA, 23 nt, Human
gcucuuuguucauguggaugccu

SEQ ID NO: 36543 - RNA, 22 nt, Human
gcugaaaggggugacauucuuu

SEQ ID NO: 36544 - RNA, 22 nt, Human
gcugaaaucccagcauucccca

SEQ ID NO: 36545 - RNA, 22 nt, Human
gcugaaaugcagaucccucacu

SEQ ID NO: 36546 - RNA, 22 nt, Human
gcugaaauucagauuccuaggc

SEQ ID NO: 36547 - RNA, 22 nt, Human
gcugaaauuggaaccugggccu

SEQ ID NO: 36548 - RNA, 22 nt, Human
gcugaagacaauggaauugacu

SEQ ID NO: 36549 - RNA, 22 nt, Human
gcugaagagaggccuugagcac

SEQ ID NO: 36550 - RNA, 22 nt, Human
gcugaagauaagugaagaggcu

SEQ ID NO: 36551 - RNA, 22 nt, Human
gcugaagauaggcauuucagca

SEQ ID NO: 36552 - RNA, 22 nt, Human
gcugaagcccacguggcuugua

SEQ ID NO: 36553 - RNA, 22 nt, Human
gcugaaggagccugggguggga

SEQ ID NO: 36554 - RNA, 22 nt, Human
gcugaaggaggcucugguacua

SEQ ID NO: 36555 - RNA, 22 nt, Human
gcugaagggagugcugagucug

SEQ ID NO: 36556 - RNA, 22 nt, Human
gcugaagguaugaguuuuaucu

SEQ ID NO: 36557 - RNA, 22 nt, Human
gcugaagguguguggagagagg

SEQ ID NO: 36558 - RNA, 22 nt, Human
gcugaaguccuaaucccaagua

SEQ ID NO: 36559 - RNA, 22 nt, Human
gcugaaguugaauauucuggga

SEQ ID NO: 36560 - RNA, 22 nt, Human
gcugaaguugccuauuuuaaua

SEQ ID NO: 36561 - RNA, 22 nt, Human
gcugaaguuuaugucuucuuuu

SEQ ID NO: 36562 - RNA, 22 nt, Human
gcugaaguuuugcagagaguaa

SEQ ID NO: 36563 - RNA, 22 nt, Human
gcugaauaagagucuacuuugc

SEQ ID NO: 36564 - RNA, 22 nt, Human
gcugaauacagcaugccuuaug

SEQ ID NO: 36565 - RNA, 20 nt, Human
gcugaccauaaaucacacug

SEQ ID NO: 36566 - RNA, 20 nt, Human
gcugaccccugcugucaugc

SEQ ID NO: 36567 - RNA, 22 nt, Human
gcugacucagaugcagcuggau

SEQ ID NO: 36568 - RNA, 22 nt, Human
gcugacugcucagggccagcug

SEQ ID NO: 36569 - RNA, 22 nt, Human
gcugacugguucaggucccgcu

SEQ ID NO: 36570 - RNA, 22 nt, Human
gcugacugguugcacagagggu

SEQ ID NO: 36571 - RNA, 22 nt, Human
gcugacuguccgcugcucccgg

SEQ ID NO: 36572 - RNA, 22 nt, Human
gcugagagaucaaggcaggauu

SEQ ID NO: 36573 - RNA, 22 nt, Human
gcugagagcacauagaaggggc

SEQ ID NO: 36574 - RNA, 22 nt, Human
gcugagagcaguguggccuuaa

SEQ ID NO: 36575 - RNA, 22 nt, Human
gcugagaggcacuaucuccgga

SEQ ID NO: 36576 - RNA, 22 nt, Human
gcugagaguguaggauguuuac

SEQ ID NO: 36577 - RNA, 22 nt, Human
gcugagaugucguuagauaucu

SEQ ID NO: 36578 - RNA, 22 nt, Human
ggaaugugcugacacgcgagag

SEQ ID NO: 36579 - RNA, 22 nt, Human
ggaauguuuuccagaccuagau

SEQ ID NO: 36580 - RNA, 22 nt, Human
ggaauguuuuucauugcucucu

SEQ ID NO: 36581 - RNA, 22 nt, Human
ggaauucucuaugcucuguucc

SEQ ID NO: 36582 - RNA, 22 nt, Human
ggacaaaacuucuugcauuucu

SEQ ID NO: 36583 - RNA, 19 nt, Human
ggacacagaaagcugcauu

SEQ ID NO: 36584 - RNA, 17 nt, Human
ggacacagcucauggcu

SEQ ID NO: 36585 - RNA, 23 nt, Human
ggacacauuuauuucagaauuca

SEQ ID NO: 36586 - RNA, 21 nt, Human
ggacaccagucacacuggauu

SEQ ID NO: 36587 - RNA, 22 nt, Human
ggacaccccggguaccaggucu

SEQ ID NO: 36588 - RNA, 22 nt, Human
ggacacuaaauggaagugucug

SEQ ID NO: 36589 - RNA, 22 nt, Human
ggacacuggccacauuucaaaa

SEQ ID NO: 36590 - RNA, 20 nt, Human
ggacacuguagauuucaaac

SEQ ID NO: 36591 - RNA, 22 nt, Human
ggacacuguauaaguuagagua

SEQ ID NO: 36592 - RNA, 22 nt, Human
ggacacuguucauggggagggg

SEQ ID NO: 36593 - RNA, 22 nt, Human
ggacagacaaaaauaguaagca

SEQ ID NO: 36594 - RNA, 22 nt, Human
ggacagagagugaauaugacau

SEQ ID NO: 36595 - RNA, 22 nt, Human
ggacagagcagacgagcagcgg

SEQ ID NO: 36596 - RNA, 21 nt, Human
ggacagaggagaaggcacccu

SEQ ID NO: 36597 - RNA, 22 nt, Human
ggacagcacagcucuugacaac

SEQ ID NO: 36598 - RNA, 22 nt, Human
ggacagcauaucagcagggcag

SEQ ID NO: 36599 - RNA, 22 nt, Human
ggacagcauuccuaguuccaaa

SEQ ID NO: 36600 - RNA, 22 nt, Human
ggacagcccauacacaugucug

SEQ ID NO: 36601 - RNA, 22 nt, Human
ggacagcuccugcacuugagua

SEQ ID NO: 36602 - RNA, 21 nt, Human
ggacagcugcgcgcagggcuc

SEQ ID NO: 36603 - RNA, 20 nt, Human
ggacaggaagacaaccuacc

SEQ ID NO: 36604 - RNA, 22 nt, Human
ggacaggauaagagacacugcc

SEQ ID NO: 36605 - RNA, 22 nt, Human
ggacaggcaggugauuuccaga

SEQ ID NO: 36606 - RNA, 23 nt, Human
ggacagggcccugcccuauggcc

SEQ ID NO: 36607 - RNA, 22 nt, Human
ggacaggugcaaagggcacaug

SEQ ID NO: 36608 - RNA, 22 nt, Human
ggacagguucagcaguuuauaa

SEQ ID NO: 36609 - RNA, 22 nt, Human
ggacagugaaucuggagguaua

SEQ ID NO: 36610 - RNA, 22 nt, Human
uacuuacacugaagcaaagaua

SEQ ID NO: 36611 - RNA, 22 nt, Human
uacuuacagagcuuauaaguua

SEQ ID NO: 36612 - RNA, 22 nt, Human
uacuuacaugaauucaagagca

SEQ ID NO: 36613 - RNA, 22 nt, Human
uacuuacauuagcaaacaaggu

SEQ ID NO: 36614 - RNA, 22 nt, Human
uacuuacauuucuguaaucggc

SEQ ID NO: 36615 - RNA, 22 nt, Human
uacuuagacucuaucuagagau

SEQ ID NO: 36616 - RNA, 22 nt, Human
uacuuagucuuucugaugaaau

SEQ ID NO: 36617 - RNA, 22 nt, Human
uacuuauuguugaacugaauca

SEQ ID NO: 36618 - RNA, 22 nt, Human
uacuucaaccuucucuauuaga

SEQ ID NO: 36619 - RNA, 22 nt, Human
uacuucauaccugcuagaaugg

SEQ ID NO: 36620 - RNA, 22 nt, Human
uacuucauuauucuaguuuuga

SEQ ID NO: 36621 - RNA, 22 nt, Human
uacuuccaggcggacaaagccc

SEQ ID NO: 36622 - RNA, 22 nt, Human
uacuucugcaccaaccuuaaua

SEQ ID NO: 36623 - RNA, 22 nt, Human
uacuucuguucuuaaaccaaga

SEQ ID NO: 36624 - RNA, 20 nt, Human
uacuugaauguugcagcagu

SEQ ID NO: 36625 - RNA, 22 nt, Human
uacuugccaucagaguuuauua

SEQ ID NO: 36626 - RNA, 22 nt, Human
uacuuguagcagguggcauuua

SEQ ID NO: 36627 - RNA, 22 nt, Human
uacuuguuaaaauauuagcuau

SEQ ID NO: 36628 - RNA, 22 nt, Human
uacuuguuaucccuuacucuug

SEQ ID NO: 36629 - RNA, 22 nt, Human
uacuuuacaguauuagauaauu

SEQ ID NO: 36630 - RNA, 22 nt, Human
uacuuuagaaggaaauaaguuc

SEQ ID NO: 36631 - RNA, 18 nt, Human
uacuuuauucccccucca

SEQ ID NO: 36632 - RNA, 22 nt, Human
uacuuuauuguaaaugcugaug

SEQ ID NO: 36633 - RNA, 22 nt, Human
uacuuucuguccuucuguuaaa

SEQ ID NO: 36634 - RNA, 22 nt, Human
uacuuucuuguuccuuucauaa

SEQ ID NO: 36635 - RNA, 22 nt, Human
uacuuugaagacaauaucugga

SEQ ID NO: 36636 - RNA, 21 nt, Human
uacuuugcaauguaucuccuu

SEQ ID NO: 36637 - RNA, 22 nt, Human
uacuuugcaugcuugugugauc

SEQ ID NO: 36638 - RNA, 22 nt, Human
uacuuuggauccuuacaauagc

SEQ ID NO: 36639 - RNA, 22 nt, Human
uacuuuggguuuagaauaaacu

SEQ ID NO: 36640 - RNA, 22 nt, Human
uacuuugguuaaugaaauguga

SEQ ID NO: 36641 - RNA, 22 nt, Human
uacuuuguccauuugcaggcag

SEQ ID NO: 36642 - RNA, 22 nt, Human
uacuuuuaugugaugaaaucug

SEQ ID NO: 36643 - RNA, 22 nt, Human
uacuuuucuguguggcagucac

SEQ ID NO: 36644 - RNA, 22 nt, Human
uacuuuuuagcacagugugugc

SEQ ID NO: 36645 - RNA, 22 nt, Human
uagaaaagaauuuuauuugaua

SEQ ID NO: 36646 - RNA, 22 nt, Human
uagaaacaaaaucugaugacuc

SEQ ID NO: 36647 - RNA, 22 nt, Human
uagaaacagaaaacuguaauag

SEQ ID NO: 36648 - RNA, 22 nt, Human
uagaaacauauguuugagacau

SEQ ID NO: 36649 - RNA, 22 nt, Human
uagaaacauguucuguucuguu

SEQ ID NO: 36650 - RNA, 22 nt, Human
uagaaacccugccuuaguagcu

SEQ ID NO: 36651 - RNA, 22 nt, Human
uagaaacuagauugauagcgga

SEQ ID NO: 36652 - RNA, 22 nt, Human
uagaaacucucaaucugggaug

SEQ ID NO: 36653 - RNA, 22 nt, Human
uagaaacucucacgagugaaac

SEQ ID NO: 36654 - RNA, 22 nt, Human
uagaaacugauagucuugugcu

SEQ ID NO: 36655 - RNA, 22 nt, Human
uagaaagaaauucagauuggcu

SEQ ID NO: 36656 - RNA, 22 nt, Human
uagaaagacaugggccagcagc

SEQ ID NO: 36657 - RNA, 22 nt, Human
uagaaagagcauaguauuauaa

SEQ ID NO: 36658 - RNA, 22 nt, Human
uagaaagaucuguaggcaagag

SEQ ID NO: 36659 - RNA, 19 nt, Human
uagaaagccagaaaacaga

SEQ ID NO: 36660 - RNA, 22 nt, Human
uagaaagcuugggguguuuaaa

SEQ ID NO: 36661 - RNA, 22 nt, Human
uagaaaggagcauuuuagacua

SEQ ID NO: 36662 - RNA, 22 nt, Human
uagaaaggauauugagaugaau

SEQ ID NO: 36663 - RNA, 22 nt, Human
uagaaagucaugaauuacacca

SEQ ID NO: 36664 - RNA, 22 nt, Human
uagaaagugguugagaguuuag

SEQ ID NO: 36665 - RNA, 22 nt, Human
uagaaauaaaucugcagcuggg

SEQ ID NO: 36666 - RNA, 22 nt, Human
uagaaaucagguuuuuagaaag

SEQ ID NO: 36667 - RNA, 22 nt, Human
uagaaaugauugagcuguaaua

SEQ ID NO: 36668 - RNA, 22 nt, Human
uagaaaugauuuugaugcuuca

SEQ ID NO: 36669 - RNA, 22 nt, Human
uagaaauggagaacagauuaau

SEQ ID NO: 36670 - RNA, 22 nt, Human
uagaaauggggaaguaguuagg

SEQ ID NO: 36671 - RNA, 22 nt, Human
uagaaauggguuacauuuagag

SEQ ID NO: 36672 - RNA, 22 nt, Human
uagaaaugucgucuccacauuu

SEQ ID NO: 36673 - RNA, 22 nt, Human
uagaaaugugauaauagcuuaa

SEQ ID NO: 36674 - RNA, 22 nt, Human
uagaacaaugaauuucuggagg

SEQ ID NO: 36675 - RNA, 22 nt, Human
uagaacaguauaggcuaaacau

SEQ ID NO: 36676 - RNA, 22 nt, Human
uagaacauaagucauucauuug

SEQ ID NO: 36677 - RNA, 22 nt, Human
uagaacaucagguugaauuugg

SEQ ID NO: 36678 - RNA, 23 nt, Human
uagaacaucggugucuuggagca

SEQ ID NO: 36679 - RNA, 22 nt, Human
uagaaccuauuagaaauguauu

SEQ ID NO: 36680 - RNA, 22 nt, Human
uagaaccucauaagaaucgaaa

SEQ ID NO: 36681 - RNA, 22 nt, Human
uagaacugacguuagggaagaa

SEQ ID NO: 36682 - RNA, 22 nt, Human
uagaacuuagcacuagacuugu

SEQ ID NO: 36683 - RNA, 22 nt, Human
uagaacuugagaucaggucuuc

SEQ ID NO: 36684 - RNA, 22 nt, Human
uagaacuuucagaaauuccaaa

SEQ ID NO: 36685 - RNA, 22 nt, Human
uagaagacaggaaauacaaacc

SEQ ID NO: 36686 - RNA, 22 nt, Human
uagaagaugccuuaaaguugaa

SEQ ID NO: 36687 - RNA, 22 nt, Human
uagcaaaguuuuguggugauua

SEQ ID NO: 36688 - RNA, 22 nt, Human
uagcaaaugucugaaggaauag

SEQ ID NO: 36689 - RNA, 21 nt, Human
uagcaaauugcuauuaaggca

SEQ ID NO: 36690 - RNA, 22 nt, Human
uagcaacaccaucuggugagaa

SEQ ID NO: 36691 - RNA, 22 nt, Human
uagcaacauaagaaacauuuug

SEQ ID NO: 36692 - RNA, 22 nt, Human
uagcaacgguaugcaaucuguc

SEQ ID NO: 36693 - RNA, 22 nt, Human
uagcaagaucgugucucuaaaa

SEQ ID NO: 36694 - RNA, 22 nt, Human
uagcaagcagauuagaagaucc

SEQ ID NO: 36695 - RNA, 22 nt, Human
uagcaaggacaacauaugagag

SEQ ID NO: 36696 - RNA, 22 nt, Human
uagcaaguggcaccacauuucu

SEQ ID NO: 36697 - RNA, 22 nt, Human
uagcaauguguguguauaaauu

SEQ ID NO: 36698 - RNA, 21 nt, Human
uagcaauuauagaugucuaaa

SEQ ID NO: 36699 - RNA, 22 nt, Human
uagcacaagaaguacacauaga

SEQ ID NO: 36700 - RNA, 22 nt, Human
uagcacacacugcaucuacaaa

SEQ ID NO: 36701 - RNA, 22 nt, Human
uagcacagcuucuugaugucac

SEQ ID NO: 36702 - RNA, 22 nt, Human
uagcacauacauaauagauaga

SEQ ID NO: 36703 - RNA, 22 nt, Human
uagcacauuguugaccagaagg

SEQ ID NO: 36704 - RNA, 22 nt, Human
uagcaccaauaugugcuuuuca

SEQ ID NO: 36705 - RNA, 22 nt, Human
uagcaccacaaucaagauacag

SEQ ID NO: 36706 - RNA, 22 nt, Human
uagcaccacuucaugcuuucag

SEQ ID NO: 36707 - RNA, 22 nt, Human
uagcaccauacccggcagcucg

SEQ ID NO: 36708 - RNA, 22 nt, Human
uagcacccaccucgugggguuu

SEQ ID NO: 36709 - RNA, 22 nt, Human
uagcaccggcagugguaggugc

SEQ ID NO: 36710 - RNA, 22 nt, Human
uagcaccuagaguauuuuauca

SEQ ID NO: 36711 - RNA, 22 nt, Human
uagcaccuuaacucugcugcgu

SEQ ID NO: 36712 - RNA, 22 nt, Human
uagcacuacuuagguacagcca

SEQ ID NO: 36713 - RNA, 22 nt, Human
uagcacuauuuuucacuauccu

SEQ ID NO: 36714 - RNA, 22 nt, Human
uagcacuguucuagcauguuuu

SEQ ID NO: 36715 - RNA, 22 nt, Human
uagcagaggaaaagagaacauu

SEQ ID NO: 36716 - RNA, 22 nt, Human
uagcagaguaauacuuuggagc

SEQ ID NO: 36717 - RNA, 22 nt, Human
uagcagcaaagcaggaucugcu

SEQ ID NO: 36718 - RNA, 22 nt, Human
uagcagcacagaaagccuggag

SEQ ID NO: 36719 - RNA, 22 nt, Human
uagcagcacuauuuguuguagu

SEQ ID NO: 36720 - RNA, 18 nt, Human
uagcagcacuggccgcuu

SEQ ID NO: 36721 - RNA, 22 nt, Human
uagcagcaggggaaacagcugu

SEQ ID NO: 36722 - RNA, 22 nt, Human
uagcagcauguaagugaguaga

SEQ ID NO: 36723 - RNA, 22 nt, Human
uagcagcccaguuucuggccaa

SEQ ID NO: 36724 - RNA, 22 nt, Human
uagcagcuaccuggcuaagagu

SEQ ID NO: 36725 - RNA, 22 nt, Human
gcugccugucccaggaugagga

SEQ ID NO: 36726 - RNA, 22 nt, Human
gcugccuguccugaggaguccg

SEQ ID NO: 36727 - RNA, 22 nt, Human
gcugccuuagagggagugguuc

SEQ ID NO: 36728 - RNA, 18 nt, Human
gcugccuucccagucaag

SEQ ID NO: 36729 - RNA, 22 nt, Human
gcugccuucuggaggaagugaa

SEQ ID NO: 36730 - RNA, 22 nt, Human
gcugccuucuucugacucuauu

SEQ ID NO: 36731 - RNA, 22 nt, Human
gcugccuugaacuuggccuggg

SEQ ID NO: 36732 - RNA, 22 nt, Human
gcugccuugguagugaccaucu

SEQ ID NO: 36733 - RNA, 22 nt, Human
gcugccuuugugagccaagggg

SEQ ID NO: 36734 - RNA, 22 nt, Human
gcugcuagggcauuaugauaaa

SEQ ID NO: 36735 - RNA, 22 nt, Human
gcugcucacugaaggacccugu

SEQ ID NO: 36736 - RNA, 22 nt, Human
gcugcuccgcagagugugugug

SEQ ID NO: 36737 - RNA, 21 nt, Human
gcugcucgagauccagugcuu

SEQ ID NO: 36738 - RNA, 22 nt, Human
gcugcucucauagauggcuuca

SEQ ID NO: 36739 - RNA, 19 nt, Human
gcugcucugggucucaucu

SEQ ID NO: 36740 - RNA, 22 nt, Human
gcugcucuugaggggcucacug

SEQ ID NO: 36741 - RNA, 22 nt, Human
gcugcucuuuucagagaugaga

SEQ ID NO: 36742 - RNA, 20 nt, Human
gcugcugagcuucccugggg

SEQ ID NO: 36743 - RNA, 22 nt, Human
gcugcugccuguagccagggug

SEQ ID NO: 36744 - RNA, 22 nt, Human
gcugcuggaugcgcuugauggu

SEQ ID NO: 36745 - RNA, 22 nt, Human
gcugcuggcacuggagugagcc

SEQ ID NO: 36746 - RNA, 22 nt, Human
gcugcuggccccacaugcucca

SEQ ID NO: 36747 - RNA, 22 nt, Human
gcugcuggccgcccagcuucuc

SEQ ID NO: 36748 - RNA, 22 nt, Human
gcugcuggcgcugggcguccgg

SEQ ID NO: 36749 - RNA, 22 nt, Human
gcugcugggggaacaguuaaaa

SEQ ID NO: 36750 - RNA, 22 nt, Human
gcugcugggguggagaaacgcu

SEQ ID NO: 36751 - RNA, 22 nt, Human
gcugcugucuggucugagggcu

SEQ ID NO: 36752 - RNA, 21 nt, Human
gcugcugugggccagggaggc

SEQ ID NO: 36753 - RNA, 22 nt, Human
gcugcuguguucucuugaccca

SEQ ID NO: 36754 - RNA, 22 nt, Human
gcugcuguugauuuaguccaau

SEQ ID NO: 36755 - RNA, 22 nt, Human
gcugcuucagggacgugccagc

SEQ ID NO: 36756 - RNA, 22 nt, Human
gcugcuugauuagguugacacu

SEQ ID NO: 36757 - RNA, 22 nt, Human
gcuggaaguaaaaacuuacuag

SEQ ID NO: 36758 - RNA, 22 nt, Human
gcuggacuucaugcauuccugu

SEQ ID NO: 36759 - RNA, 22 nt, Human
gcuggagaaacaggaggaggaa

SEQ ID NO: 36760 - RNA, 22 nt, Human
gcuggagaguaguaagcaguua

SEQ ID NO: 36761 - RNA, 22 nt, Human
gcuggagccaagcugcucuugg

SEQ ID NO: 36762 - RNA, 22 nt, Human
gcuggagcggguucgggccgcu

SEQ ID NO: 36763 - RNA, 22 nt, Human
gcuggaggauggacuggaagaa

SEQ ID NO: 36764 - RNA, 22 nt, Human
gcuggaggcaguucagacacca

SEQ ID NO: 36765 - RNA, 22 nt, Human
gcuggaguaucuggggaaggag

SEQ ID NO: 36766 - RNA, 22 nt, Human
gcuggagucuacauucaagaau

SEQ ID NO: 36767 - RNA, 22 nt, Human
gcuggagucuggaggugugcca

SEQ ID NO: 36768 - RNA, 22 nt, Human
gcuggagucuugaaaguggacu

SEQ ID NO: 36769 - RNA, 22 nt, Human
gcuggagugaugccugugucuc

SEQ ID NO: 36770 - RNA, 22 nt, Human
gcuggagugcaguugcacaguc

SEQ ID NO: 36771 - RNA, 22 nt, Human
gcuggaucauauggugguucua

SEQ ID NO: 36772 - RNA, 22 nt, Human
gcuggcaaugguguggucuggu

SEQ ID NO: 36773 - RNA, 22 nt, Human
gcuggcacagguggaugcuggc

SEQ ID NO: 36774 - RNA, 22 nt, Human
gcuggcacuugggacaaaaucu

SEQ ID NO: 36775 - RNA, 22 nt, Human
gcuggcagagacaagaagacua

SEQ ID NO: 36776 - RNA, 22 nt, Human
gcuggcagagcucugggcuggg

SEQ ID NO: 36777 - RNA, 22 nt, Human
gcuggcagcauuagacccuggg

SEQ ID NO: 36778 - RNA, 22 nt, Human
gcuggcaggagaaacggggugc

SEQ ID NO: 36779 - RNA, 22 nt, Human
gcuggcagggacagcugcgugu

SEQ ID NO: 36780 - RNA, 22 nt, Human
gcuggcagguaaagccccgggg

SEQ ID NO: 36781 - RNA, 22 nt, Human
gcuggcagguccaagauagagc

SEQ ID NO: 36782 - RNA, 22 nt, Human
gcuggcagugugaaugacaagc

SEQ ID NO: 36783 - RNA, 22 nt, Human
gcuggcaguuuccucaccgagg

SEQ ID NO: 36784 - RNA, 22 nt, Human
gcuggcauggagacucuggguc

SEQ ID NO: 36785 - RNA, 22 nt, Human
gcuggccagggcugcucgcgga

SEQ ID NO: 36786 - RNA, 22 nt, Human
gcuggccaggugcuuugguucu

SEQ ID NO: 36787 - RNA, 22 nt, Human
gcuggccagugucccagggauc

SEQ ID NO: 36788 - RNA, 22 nt, Human
gcuggccauagaagccaaagag

SEQ ID NO: 36789 - RNA, 22 nt, Human
gcuggccauauauuuugcuguu

SEQ ID NO: 36790 - RNA, 22 nt, Human
gcuggccauggggagugaggag

SEQ ID NO: 36791 - RNA, 22 nt, Human
gcuggccauucucuuugagaug

SEQ ID NO: 36792 - RNA, 22 nt, Human
gcuggccugcaaagcccggcug

SEQ ID NO: 36793 - RNA, 22 nt, Human
gcuggccugggcagccugucgg

SEQ ID NO: 36794 - RNA, 22 nt, Human
gcuggcucccagaggccccagc

SEQ ID NO: 36795 - RNA, 22 nt, Human
gcuggcucgggaagcaggggau

SEQ ID NO: 36796 - RNA, 22 nt, Human
ggaaacuagaagaauacuaguc

SEQ ID NO: 36797 - RNA, 22 nt, Human
ggaaagaacccuggauggcugg

SEQ ID NO: 36798 - RNA, 22 nt, Human
ggaaagaaucaagugauccugu

SEQ ID NO: 36799 - RNA, 22 nt, Human
ggaaagaggauaguggguaggu

SEQ ID NO: 36800 - RNA, 22 nt, Human
ggaaagagggacccagcuuggu

SEQ ID NO: 36801 - RNA, 22 nt, Human
ggaaagaguuuugguauauuug

SEQ ID NO: 36802 - RNA, 22 nt, Human
ggaaagauuugucacaugaaug

SEQ ID NO: 36803 - RNA, 22 nt, Human
ggaaagcucagaucuuguugga

SEQ ID NO: 36804 - RNA, 22 nt, Human
ggaaaggcuaacagucauggaa

SEQ ID NO: 36805 - RNA, 22 nt, Human
ggaaagggaguuuugcuuauga

SEQ ID NO: 36806 - RNA, 22 nt, Human
ggaaagggcagaggccuuggag

SEQ ID NO: 36807 - RNA, 22 nt, Human
ggaaaggggccuggaucuuuug

SEQ ID NO: 36808 - RNA, 22 nt, Human
ggaaauauugauugcucuguau

SEQ ID NO: 36809 - RNA, 22 nt, Human
ggaaauauuuugucuaauuugu

SEQ ID NO: 36810 - RNA, 20 nt, Human
ggaaaucaccaggcuccacc

SEQ ID NO: 36811 - RNA, 22 nt, Human
ggaaaucaucugauuggcuuuc

SEQ ID NO: 36812 - RNA, 22 nt, Human
ggaaaucucagaucucccagau

SEQ ID NO: 36813 - RNA, 22 nt, Human
ggaaaugacuuggugcuucguu

SEQ ID NO: 36814 - RNA, 22 nt, Human
ggaaaugguggaggaaggcuua

SEQ ID NO: 36815 - RNA, 22 nt, Human
ggaaaugugggcuguuucugua

SEQ ID NO: 36816 - RNA, 22 nt, Human
ggaacacaaaugggagagcugg

SEQ ID NO: 36817 - RNA, 22 nt, Human
ggaacacagaagggcugaaaaa

SEQ ID NO: 36818 - RNA, 22 nt, Human
ggaacacugccuuuuauuuucc

SEQ ID NO: 36819 - RNA, 20 nt, Human
ggaacacuguucauucugua

SEQ ID NO: 36820 - RNA, 22 nt, Human
ggaacagggauuuggccugguu

SEQ ID NO: 36821 - RNA, 22 nt, Human
ggaacaguugcgucaugggccu

SEQ ID NO: 36822 - RNA, 21 nt, Human
ggaacauuguuaauagucucu

SEQ ID NO: 36823 - RNA, 22 nt, Human
ggaacauuuaaauucuuauuug

SEQ ID NO: 36824 - RNA, 22 nt, Human
ggaaccaguaacuggucauugc

SEQ ID NO: 36825 - RNA, 22 nt, Human
ggaacccaugauuaugguuagg

SEQ ID NO: 36826 - RNA, 22 nt, Human
ggaaccuuaguguucuuuuacc

SEQ ID NO: 36827 - RNA, 22 nt, Human
ggaacugaaugucucgguauaa

SEQ ID NO: 36828 - RNA, 22 nt, Human
ggaacugagcaauggcaugaaa

SEQ ID NO: 36829 - RNA, 22 nt, Human
ggaacuggagaaugcccucuuu

SEQ ID NO: 36830 - RNA, 22 nt, Human
ggaacuugaaaaucaagguggu

SEQ ID NO: 36831 - RNA, 22 nt, Human
ggaacuugcaaccucuggucac

SEQ ID NO: 36832 - RNA, 21 nt, Human
ggaacuuucaugaaucuagca

SEQ ID NO: 36833 - RNA, 22 nt, Human
ggaagaaaagcuuccagcgccu

SEQ ID NO: 36834 - RNA, 22 nt, Human
ggaagaagggucauuggcagcc

SEQ ID NO: 36835 - RNA, 22 nt, Human
ggaagacaagcaguggcugagc

SEQ ID NO: 36836 - RNA, 22 nt, Human
ggaagacugcauggcauaguga

SEQ ID NO: 36837 - RNA, 22 nt, Human
ggaagagaauuucucucuuuuu

SEQ ID NO: 36838 - RNA, 22 nt, Human
ggaagaguaacaggagguggaa

SEQ ID NO: 36839 - RNA, 22 nt, Human
ggaagaugagaaguggggcucc

SEQ ID NO: 36840 - RNA, 22 nt, Human
uagcagcucugauucugggccc

SEQ ID NO: 36841 - RNA, 22 nt, Human
uagcaggaauaaaaauguaccc

SEQ ID NO: 36842 - RNA, 22 nt, Human
uagcaggacaugugcagagaag

SEQ ID NO: 36843 - RNA, 22 nt, Human
uagcaggaccaugacaagaaaa

SEQ ID NO: 36844 - RNA, 22 nt, Human
uagcaggaggcaguuccucgcu

SEQ ID NO: 36845 - RNA, 22 nt, Human
uagcaggauuugaagaagaucu

SEQ ID NO: 36846 - RNA, 22 nt, Human
uagcaggcucgcaauaaaaugu

SEQ ID NO: 36847 - RNA, 23 nt, Human
uagcaggcuuucuuuucucucac

SEQ ID NO: 36848 - RNA, 22 nt, Human
uagcagggaaggugugcugagc

SEQ ID NO: 36849 - RNA, 22 nt, Human
uagcaggguuuugaagaggguu

SEQ ID NO: 36850 - RNA, 22 nt, Human
uagcaguauauuuuaaggaagc

SEQ ID NO: 36851 - RNA, 22 nt, Human
uagcagugcacaguaggacacc

SEQ ID NO: 36852 - RNA, 22 nt, Human
uagcagugcccuguggaauaag

SEQ ID NO: 36853 - RNA, 22 nt, Human
uagcaucaugaucagaacuguu

SEQ ID NO: 36854 - RNA, 22 nt, Human
uagcaucucaaccuccugaaag

SEQ ID NO: 36855 - RNA, 22 nt, Human
uagcaucuccuuaggguaagga

SEQ ID NO: 36856 - RNA, 22 nt, Human
uagcaucugcauuuguaacuag

SEQ ID NO: 36857 - RNA, 22 nt, Human
uagcaucuguuucucuuuguga

SEQ ID NO: 36858 - RNA, 22 nt, Human
uagcaucuugauuucagaccag

SEQ ID NO: 36859 - RNA, 20 nt, Human
uagcaugggugaggguagag

SEQ ID NO: 36860 - RNA, 22 nt, Human
uagcauuauuuccucuuuuugu

SEQ ID NO: 36861 - RNA, 20 nt, Human
uagcauuccagaaaacucag

SEQ ID NO: 36862 - RNA, 22 nt, Human
uagcauuccaucuuggacuugu

SEQ ID NO: 36863 - RNA, 22 nt, Human
uagcauuccuuguggcuucuga

SEQ ID NO: 36864 - RNA, 22 nt, Human
uagcauuuagaacaccuugaga

SEQ ID NO: 36865 - RNA, 17 nt, Human
uagcauuuaucuuccuu

SEQ ID NO: 36866 - RNA, 22 nt, Human
uagcauuuauuccagauuugga

SEQ ID NO: 36867 - RNA, 22 nt, Human
uagccaaaguagcuguuauagc

SEQ ID NO: 36868 - RNA, 22 nt, Human
uagccacaugcagacuuucaug

SEQ ID NO: 36869 - RNA, 23 nt, Human
uagccaggcccagcauggacacc

SEQ ID NO: 36870 - RNA, 22 nt, Human
uagccaggcugcagcugauccg

SEQ ID NO: 36871 - RNA, 21 nt, Human
uagccauguuccuuaugguuc

SEQ ID NO: 36872 - RNA, 22 nt, Human
uagcccagaagagggaagcaac

SEQ ID NO: 36873 - RNA, 19 nt, Human
uagcccagagccuggcuac

SEQ ID NO: 36874 - RNA, 22 nt, Human
uagcccagagucccaauuccag

SEQ ID NO: 36875 - RNA, 22 nt, Human
uagcccagauacaaaucaugau

SEQ ID NO: 36876 - RNA, 22 nt, Human
uagcccagcaugagcagagcug

SEQ ID NO: 36877 - RNA, 22 nt, Human
uagcccaggagaauugucuuuc

SEQ ID NO: 36878 - RNA, 22 nt, Human
uagcccaggcuggagggcagug

SEQ ID NO: 36879 - RNA, 22 nt, Human
uagcccucaucugcucaaaagg

SEQ ID NO: 36880 - RNA, 22 nt, Human
uagcccuguccuuggccugugc

SEQ ID NO: 36881 - RNA, 20 nt, Human
uagcuaccuugauccccugg

SEQ ID NO: 36882 - RNA, 22 nt, Human
uagcuagaaaguuucagcugug

SEQ ID NO: 36883 - RNA, 22 nt, Human
uagcuaucuguguccagaucca

SEQ ID NO: 36884 - RNA, 22 nt, Human
uagcuauuuagcccagauaagu

SEQ ID NO: 36885 - RNA, 22 nt, Human
uagcucagcaggugggacaggu

SEQ ID NO: 36886 - RNA, 22 nt, Human
uagcuccuacaaguacagcaaa

SEQ ID NO: 36887 - RNA, 22 nt, Human
uagcuccuggcugcagggccuc

SEQ ID NO: 36888 - RNA, 22 nt, Human
uagcuccuggugagccuacucu

SEQ ID NO: 36889 - RNA, 22 nt, Human
uagcucugaccaagagacugag

SEQ ID NO: 36890 - RNA, 22 nt, Human
uagcucugucacauacacugca

SEQ ID NO: 36891 - RNA, 18 nt, Human
uagcucuuguugguccau

SEQ ID NO: 36892 - RNA, 22 nt, Human
uagcugaaugugaccuuaaaga

SEQ ID NO: 36893 - RNA, 22 nt, Human
uagcugaugaauaauuauucuu

SEQ ID NO: 36894 - RNA, 20 nt, Human
uagcugcacagcccuaggag

SEQ ID NO: 36895 - RNA, 22 nt, Human
uagcugcacaggaaguaagauu

SEQ ID NO: 36896 - RNA, 22 nt, Human
uagcugcccaucuuuccuuuag

SEQ ID NO: 36897 - RNA, 22 nt, Human
uagcugccuaugugauaagaga

SEQ ID NO: 36898 - RNA, 22 nt, Human
uagcugcuucucacaugggcaa

SEQ ID NO: 36899 - RNA, 22 nt, Human
uagcugggacuacuggcccugc

SEQ ID NO: 36900 - RNA, 22 nt, Human
uagcugucaccagaaauggcca

SEQ ID NO: 36901 - RNA, 22 nt, Human
uagcugucagcugcaggcaggc

SEQ ID NO: 36902 - RNA, 22 nt, Human
uagcuguccagugagucccuuu

SEQ ID NO: 36903 - RNA, 22 nt, Human
uagcugugaagagcuaaaaaau

SEQ ID NO: 36904 - RNA, 22 nt, Human
uagcuguggagcagaggucucc

SEQ ID NO: 36905 - RNA, 22 nt, Human
ggacaaaggguggagccucuga

SEQ ID NO: 36906 - RNA, 22 nt, Human
ggacaaaucucauuauuucuga

SEQ ID NO: 36907 - RNA, 21 nt, Human
ggacaauuguucauuuucuuu

SEQ ID NO: 36908 - RNA, 22 nt, Human
ggacacaaaagugaauaaaaua

SEQ ID NO: 36909 - RNA, 22 nt, Human
ggacacacaaguuaucuaauga

SEQ ID NO: 36910 - RNA, 22 nt, Human
ggacacagaccuuucuguucua

SEQ ID NO: 36911 - RNA, 22 nt, Human
ggacacagcugcagccacaccc

SEQ ID NO: 36912 - RNA, 23 nt, Human
ggacacaggccuugucugcgccu

SEQ ID NO: 36913 - RNA, 22 nt, Human
ggacacagguaaauaccacuga

SEQ ID NO: 36914 - RNA, 22 nt, Human
ggacacaguggaagacagcuug

SEQ ID NO: 36915 - RNA, 21 nt, Human
ggacacugauaaucuuguugc

SEQ ID NO: 36916 - RNA, 22 nt, Human
ggacagaaauucuuguuggaca

SEQ ID NO: 36917 - RNA, 19 nt, Human
ggacagacgcagagaucug

SEQ ID NO: 36918 - RNA, 22 nt, Human
ggacagacuuuacagccccggg

SEQ ID NO: 36919 - RNA, 22 nt, Human
ggacagagcccugguggccuaa

SEQ ID NO: 36920 - RNA, 22 nt, Human
ggacagaggguugacagaguau

SEQ ID NO: 36921 - RNA, 22 nt, Human
ggacagcagccucuuacaugaa

SEQ ID NO: 36922 - RNA, 22 nt, Human
ggacagcauucuacuguaggca

SEQ ID NO: 36923 - RNA, 22 nt, Human
ggacagcguggcugguggaggg

SEQ ID NO: 36924 - RNA, 22 nt, Human
ggacagcucugccaggagcuca

SEQ ID NO: 36925 - RNA, 18 nt, Human
ggacaggagacaugggug

SEQ ID NO: 36926 - RNA, 22 nt, Human
ggacaggaugcugaagaugaag

SEQ ID NO: 36927 - RNA, 22 nt, Human
ggacaggccauauggaauacau

SEQ ID NO: 36928 - RNA, 22 nt, Human
ggacaggcccucuggucagcuu

SEQ ID NO: 36929 - RNA, 22 nt, Human
ggacaggccgccucgguggggg

SEQ ID NO: 36930 - RNA, 22 nt, Human
ggacaggguuggggcauauaaa

SEQ ID NO: 36931 - RNA, 21 nt, Human
ggacaguaguagucaggagag

SEQ ID NO: 36932 - RNA, 22 nt, Human
ggacaguccaccucagugaaga

SEQ ID NO: 36933 - RNA, 22 nt, Human
ggacagugcgagacacaguaac

SEQ ID NO: 36934 - RNA, 22 nt, Human
ggacauggaaguauggagugga

SEQ ID NO: 36935 - RNA, 22 nt, Human
ggacauggagcauguagagaaa

SEQ ID NO: 36936 - RNA, 22 nt, Human
ggacauguuccuuuucaucuuu

SEQ ID NO: 36937 - RNA, 22 nt, Human
ggacauuuagaacagaguauuu

SEQ ID NO: 36938 - RNA, 22 nt, Human
ggacauuucauaagaccauucu

SEQ ID NO: 36939 - RNA, 22 nt, Human
ggacauuugcaccuaccucagc

SEQ ID NO: 36940 - RNA, 22 nt, Human
ggaccaaaauuacagucgcucc

SEQ ID NO: 36941 - RNA, 22 nt, Human
ggaccaggacuggugguaucuc

SEQ ID NO: 36942 - RNA, 22 nt, Human
ggaccaggagcucagagcccuc

SEQ ID NO: 36943 - RNA, 22 nt, Human
ggaccaggcugagcaccugccu

SEQ ID NO: 36944 - RNA, 22 nt, Human
ggaccaugaggagaugggccuc

SEQ ID NO: 36945 - RNA, 22 nt, Human
ggacccagaggggagucuggca

SEQ ID NO: 36946 - RNA, 22 nt, Human
ggacccugggcagcuggcugcu

SEQ ID NO: 36947 - RNA, 22 nt, Human
ggacccuguaaagucgugucca

SEQ ID NO: 36948 - RNA, 22 nt, Human
ggaccugcauuuuaacaagauc

SEQ ID NO: 36949 - RNA, 23 nt, Human
ggacuaggcaacagaugggacag

SEQ ID NO: 36950 - RNA, 22 nt, Human
ggacuccucuagaaguugaggc

SEQ ID NO: 36951 - RNA, 22 nt, Human
ggacucuggcucaguguugcuu

SEQ ID NO: 36952 - RNA, 22 nt, Human
ggacucuguuuuccugaucacu

SEQ ID NO: 36953 - RNA, 22 nt, Human
ggacugaaagcgaagaauuugu

SEQ ID NO: 36954 - RNA, 22 nt, Human
ggacugaaggacaaucugguuc

SEQ ID NO: 36955 - RNA, 22 nt, Human
uaggaaggaggccaucuuggcg

SEQ ID NO: 36956 - RNA, 22 nt, Human
uaggaaggccugucacuacuug

SEQ ID NO: 36957 - RNA, 22 nt, Human
uaggaagggcucagggcucggu

SEQ ID NO: 36958 - RNA, 22 nt, Human
uaggaagguccaugucuuaucu

SEQ ID NO: 36959 - RNA, 22 nt, Human
uaggaagguguuuuuaaggagc

SEQ ID NO: 36960 - RNA, 22 nt, Human
uaggaaugcagaugcauaauaa

SEQ ID NO: 36961 - RNA, 22 nt, Human
uaggaaugggcaagacaaagaa

SEQ ID NO: 36962 - RNA, 22 nt, Human
uaggaauuaugaugcuaucaag

SEQ ID NO: 36963 - RNA, 22 nt, Human
uaggaauuuuuguaaugguacu

SEQ ID NO: 36964 - RNA, 20 nt, Human
uaggacaggcagccgagggg

SEQ ID NO: 36965 - RNA, 22 nt, Human
uaggacauaaguauucuaacuu

SEQ ID NO: 36966 - RNA, 22 nt, Human
uaggacauguguuuuauauaug

SEQ ID NO: 36967 - RNA, 22 nt, Human
uaggaccagcagggucaggguc

SEQ ID NO: 36968 - RNA, 22 nt, Human
uaggaccaggggcugccaggaa

SEQ ID NO: 36969 - RNA, 22 nt, Human
uaggaccccugugguagauggg

SEQ ID NO: 36970 - RNA, 22 nt, Human
uaggacuuagucuaauuuuucu

SEQ ID NO: 36971 - RNA, 22 nt, Human
uaggacuuugagaauuguuauu

SEQ ID NO: 36972 - RNA, 22 nt, Human
uaggagaggugaauggcacacu

SEQ ID NO: 36973 - RNA, 22 nt, Human
uaggagggcccugaaaauggca

SEQ ID NO: 36974 - RNA, 22 nt, Human
uaggauaugcauuuuuauacau

SEQ ID NO: 36975 - RNA, 22 nt, Human
uaggauaugugaaaucauauua

SEQ ID NO: 36976 - RNA, 22 nt, Human
uaggaugaucuuguagagagau

SEQ ID NO: 36977 - RNA, 22 nt, Human
uaggauggucacagagauggac

SEQ ID NO: 36978 - RNA, 22 nt, Human
uaggauuauuuguucuauuucu

SEQ ID NO: 36979 - RNA, 22 nt, Human
uaggauuccagaacagugcugc

SEQ ID NO: 36980 - RNA, 22 nt, Human
uaggauuuaauaaaagaauaga

SEQ ID NO: 36981 - RNA, 22 nt, Human
uaggauuuaggcuuuaacaucu

SEQ ID NO: 36982 - RNA, 22 nt, Human
uaggauuuggcuuuagucaggu

SEQ ID NO: 36983 - RNA, 22 nt, Human
uaggcaaggcauuuggcucuug

SEQ ID NO: 36984 - RNA, 22 nt, Human
uaggcaaguggaccagagguuu

SEQ ID NO: 36985 - RNA, 20 nt, Human
uaggcaauuaguagauaaca

SEQ ID NO: 36986 - RNA, 22 nt, Human
uaggcacuagacaugguuacca

SEQ ID NO: 36987 - RNA, 22 nt, Human
uaggcacugaggggagcaaggu

SEQ ID NO: 36988 - RNA, 22 nt, Human
uaggcagaauucauugugcugc

SEQ ID NO: 36989 - RNA, 22 nt, Human
uaggcagaauugugggcucuaa

SEQ ID NO: 36990 - RNA, 22 nt, Human
uaggcagagaggccauaagaau

SEQ ID NO: 36991 - RNA, 20 nt, Human
uaggcagagcugugcagccu

SEQ ID NO: 36992 - RNA, 22 nt, Human
uaggcagagguaugguaaggac

SEQ ID NO: 36993 - RNA, 22 nt, Human
uaggcagaguuuaaugguuaag

SEQ ID NO: 36994 - RNA, 22 nt, Human
uaggcagauguuaacaggaaaa

SEQ ID NO: 36995 - RNA, 22 nt, Human
uaggcagcagugcuaugauucu

SEQ ID NO: 36996 - RNA, 22 nt, Human
uaggcagcuuagguuagaagug

SEQ ID NO: 36997 - RNA, 22 nt, Human
uaggcaggcugaauguagauuu

SEQ ID NO: 36998 - RNA, 22 nt, Human
uaggcaggugugcacugcccac

SEQ ID NO: 36999 - RNA, 22 nt, Human
uaggcauuuaagauggauaagg

SEQ ID NO: 37000 - RNA, 22 nt, Human
uaggccaguggcagguugugug

SEQ ID NO: 37001 - RNA, 22 nt, Human
uaggccaguugguggcccugga

SEQ ID NO: 37002 - RNA, 22 nt, Human
uaggccauucuuggagcuuacu

SEQ ID NO: 37003 - RNA, 22 nt, Human
uaggcccaguuccgccucccgg

SEQ ID NO: 37004 - RNA, 22 nt, Human
uaggccucaggaccccagggcu

SEQ ID NO: 37005 - RNA, 23 nt, Human
uaggccucccuggagcacccagc

SEQ ID NO: 37006 - RNA, 22 nt, Human
uaggccuggaucucugggagca

SEQ ID NO: 37007 - RNA, 22 nt, Human
uaggcucacauagcacuaagug

SEQ ID NO: 37008 - RNA, 22 nt, Human
uaggcucauuaaguccccaggg

SEQ ID NO: 37009 - RNA, 22 nt, Human
uaggcucuagauguggucuuug

SEQ ID NO: 37010 - RNA, 23 nt, Human
uaggcucuguagguagagauggg

SEQ ID NO: 37011 - RNA, 22 nt, Human
uaggcugaaaggagaggugaag

SEQ ID NO: 37012 - RNA, 22 nt, Human
uaggcugcucaccaggcucaga

SEQ ID NO: 37013 - RNA, 22 nt, Human
uaggcuggaggaagcagugccu

SEQ ID NO: 37014 - RNA, 22 nt, Human
uaguguauguucagcuuauaug

SEQ ID NO: 37015 - RNA, 23 nt, Human
uagugucaagagggaguguaauu

SEQ ID NO: 37016 - RNA, 22 nt, Human
uagugucagggagugauaaaug

SEQ ID NO: 37017 - RNA, 22 nt, Human
uagugucuagugaguuugaugc

SEQ ID NO: 37018 - RNA, 22 nt, Human
uagugucucuuccuguuugaaa

SEQ ID NO: 37019 - RNA, 22 nt, Human
uagugucuguugcuuuuguuca

SEQ ID NO: 37020 - RNA, 22 nt, Human
uagugugucccuggggaguguu

SEQ ID NO: 37021 - RNA, 22 nt, Human
uaguguuccagaagcaaacaag

SEQ ID NO: 37022 - RNA, 22 nt, Human
uaguguuuaguacauaugcaua

SEQ ID NO: 37023 - RNA, 19 nt, Human
uaguguuuuucuggagcag

SEQ ID NO: 37024 - RNA, 22 nt, Human
uaguuacagagaaaugauuuga

SEQ ID NO: 37025 - RNA, 22 nt, Human
uaguuaggaaaguccagggagc

SEQ ID NO: 37026 - RNA, 22 nt, Human
uaguuaggggaaaaacgacagg

SEQ ID NO: 37027 - RNA, 22 nt, Human
uaguuauauccagucuuuaaaa

SEQ ID NO: 37028 - RNA, 23 nt, Human
uaguuauuuucucuguaauuugc

SEQ ID NO: 37029 - RNA, 22 nt, Human
uaguucaaccgucuucuccccu

SEQ ID NO: 37030 - RNA, 22 nt, Human
uaguucaccccucuuuauuuuc

SEQ ID NO: 37031 - RNA, 22 nt, Human
uaguucaggaagagaaacaaca

SEQ ID NO: 37032 - RNA, 22 nt, Human
uaguucaggguuauuucaaggu

SEQ ID NO: 37033 - RNA, 22 nt, Human
uaguucuacucaaagugugauc

SEQ ID NO: 37034 - RNA, 22 nt, Human
uaguucuagggcaucaucccag

SEQ ID NO: 37035 - RNA, 22 nt, Human
uaguucucaggacgucaagguu

SEQ ID NO: 37036 - RNA, 22 nt, Human
uaguucuggacacacguuccca

SEQ ID NO: 37037 - RNA, 22 nt, Human
uaguugacaucaucagccugga

SEQ ID NO: 37038 - RNA, 22 nt, Human
uaguugacuucucuaucccagc

SEQ ID NO: 37039 - RNA, 20 nt, Human
uaguugccaaaaugcccugc

SEQ ID NO: 37040 - RNA, 22 nt, Human
uaguuuaaaaguuagggaugau

SEQ ID NO: 37041 - RNA, 22 nt, Human
uaguuuaauggucaacuaauga

SEQ ID NO: 37042 - RNA, 22 nt, Human
uaguuuaccaaauugaucuucc

SEQ ID NO: 37043 - RNA, 22 nt, Human
uaguuuacuguucacuuugccc

SEQ ID NO: 37044 - RNA, 22 nt, Human
uaguuuagacuucaacccuuug

SEQ ID NO: 37045 - RNA, 22 nt, Human
uaguuuagagaauuggggauga

SEQ ID NO: 37046 - RNA, 22 nt, Human
uaguuuagcacuaagaaaaaca

SEQ ID NO: 37047 - RNA, 22 nt, Human
uaguuuaggaacaaguagugga

SEQ ID NO: 37048 - RNA, 22 nt, Human
uaguuuaggugggguagacaga

SEQ ID NO: 37049 - RNA, 21 nt, Human
uaguuucuacccaguuaaugg

SEQ ID NO: 37050 - RNA, 22 nt, Human
uaguuucuagacaguaagaauu

SEQ ID NO: 37051 - RNA, 22 nt, Human
uaguuucuuucacguaguaaua

SEQ ID NO: 37052 - RNA, 22 nt, Human
uaguuugagaauugaaauagaa

SEQ ID NO: 37053 - RNA, 22 nt, Human
uaguuuguagaaaucuagaaau

SEQ ID NO: 37054 - RNA, 22 nt, Human
uaguuugucaaccacugucaca

SEQ ID NO: 37055 - RNA, 22 nt, Human
uaguuuuacuugcgaugauaau

SEQ ID NO: 37056 - RNA, 22 nt, Human
uaguuuuagcagcaaugggaug

SEQ ID NO: 37057 - RNA, 22 nt, Human
uaguuuuaugaauugguauaau

SEQ ID NO: 37058 - RNA, 22 nt, Human
uauaaaacagaaagcacuaccu

SEQ ID NO: 37059 - RNA, 22 nt, Human
uauaaaauggcaucagcuccaa

SEQ ID NO: 37060 - RNA, 22 nt, Human
uauaaacuauauguuagccaga

SEQ ID NO: 37061 - RNA, 22 nt, Human
uauaaagagucuaucugguggc

SEQ ID NO: 37062 - RNA, 22 nt, Human
uauaaaugccaggacuuuagau

SEQ ID NO: 37063 - RNA, 22 nt, Human
uauaaauuaaugugcccaugag

SEQ ID NO: 37064 - RNA, 22 nt, Human
uauaacacucagaaagaaucau

SEQ ID NO: 37065 - RNA, 20 nt, Human
uauaacaguguugggugugu

SEQ ID NO: 37066 - RNA, 18 nt, Human
uauaaccuguuuugaugg

SEQ ID NO: 37067 - RNA, 22 nt, Human
uauaaccuuuucuuuauccucc

SEQ ID NO: 37068 - RNA, 22 nt, Human
uauaagaaacaaggcaaauuuu

SEQ ID NO: 37069 - RNA, 20 nt, Human
uauaagcagcuccaggcaga

SEQ ID NO: 37070 - RNA, 22 nt, Human
uauaagugugucagcuuccaac

SEQ ID NO: 37071 - RNA, 22 nt, Human
ggaacauucuagaguguuguga

SEQ ID NO: 37072 - RNA, 15 nt, Human
ggaacauuucuguuu

SEQ ID NO: 37073 - RNA, 22 nt, Human
ggaacauuuuuuaaggcagaaa

SEQ ID NO: 37074 - RNA, 22 nt, Human
ggaaccacagcccccagcaggc

SEQ ID NO: 37075 - RNA, 19 nt, Human
ggaaccuuagagcuucagc

SEQ ID NO: 37076 - RNA, 22 nt, Human
ggaacugaggaacgaacuggga

SEQ ID NO: 37077 - RNA, 22 nt, Human
ggaacugauuaagucaugagaa

SEQ ID NO: 37078 - RNA, 17 nt, Human
ggaagaaaaggaucauc

SEQ ID NO: 37079 - RNA, 22 nt, Human
ggaagaaaguagaaaaccgugg

SEQ ID NO: 37080 - RNA, 22 nt, Human
ggaagaaaugcucuucuaugcg

SEQ ID NO: 37081 - RNA, 22 nt, Human
ggaagacaucugcuugcaccag

SEQ ID NO: 37082 - RNA, 22 nt, Human
ggaagagagaucccauagaugu

SEQ ID NO: 37083 - RNA, 22 nt, Human
ggaagagagggcugggccucaa

SEQ ID NO: 37084 - RNA, 18 nt, Human
ggaagauuggcuaugugc

SEQ ID NO: 37085 - RNA, 22 nt, Human
ggaagauuucccguagcugugc

SEQ ID NO: 37086 - RNA, 22 nt, Human
ggaagauuuuccauuccucuuu

SEQ ID NO: 37087 - RNA, 22 nt, Human
ggaagcaaauuccagaaccaca

SEQ ID NO: 37088 - RNA, 22 nt, Human
ggaagccaggcugggggaucug

SEQ ID NO: 37089 - RNA, 22 nt, Human
ggaagccaugagggacaguucu

SEQ ID NO: 37090 - RNA, 22 nt, Human
ggaagcuaagauaauuuaagua

SEQ ID NO: 37091 - RNA, 22 nt, Human
ggaagcuaguuguguuucagga

SEQ ID NO: 37092 - RNA, 23 nt, Human
ggaagcucacguaguccugcacu

SEQ ID NO: 37093 - RNA, 22 nt, Human
ggaagcuccccaagccugcccu

SEQ ID NO: 37094 - RNA, 22 nt, Human
ggaagcugaauccagagacagg

SEQ ID NO: 37095 - RNA, 22 nt, Human
ggaagcugaggcccagugaagg

SEQ ID NO: 37096 - RNA, 22 nt, Human
ggaagcugccaguccaccagcu

SEQ ID NO: 37097 - RNA, 22 nt, Human
ggaagcuggacaggcuuugagu

SEQ ID NO: 37098 - RNA, 22 nt, Human
ggaagcugggaucucucucccg

SEQ ID NO: 37099 - RNA, 22 nt, Human
ggaagcugugcucucaggccuc

SEQ ID NO: 37100 - RNA, 22 nt, Human
ggaagcuguugugagugcagca

SEQ ID NO: 37101 - RNA, 22 nt, Human
ggaagcuucauaccuuuauuua

SEQ ID NO: 37102 - RNA, 22 nt, Human
ggaaggaagaggaccgagcugg

SEQ ID NO: 37103 - RNA, 22 nt, Human
ggaaggaauuccaagacuaaag

SEQ ID NO: 37104 - RNA, 19 nt, Human
ggaaggagagaaaugcaug

SEQ ID NO: 37105 - RNA, 22 nt, Human
ggaaggagccauaucauaucca

SEQ ID NO: 37106 - RNA, 22 nt, Human
ggaaggagucuuuaacacccau

SEQ ID NO: 37107 - RNA, 18 nt, Human
ggaaggaguggaccccag

SEQ ID NO: 37108 - RNA, 21 nt, Human
ggaaggcuaugguguauuuuu

SEQ ID NO: 37109 - RNA, 22 nt, Human
ggaaggcuccauacacaaagca

SEQ ID NO: 37110 - RNA, 22 nt, Human
ggaaggcuugaguucccagguc

SEQ ID NO: 37111 - RNA, 22 nt, Human
ggaagggcggauaguauaaguu

SEQ ID NO: 37112 - RNA, 22 nt, Human
ggaaggggagcuggaaagggua

SEQ ID NO: 37113 - RNA, 22 nt, Human
ggaaggggccuugagcaaacug

SEQ ID NO: 37114 - RNA, 21 nt, Human
ggaagggguccucccaacagu

SEQ ID NO: 37115 - RNA, 22 nt, Human
ggaaggguuuaagcaggagagu

SEQ ID NO: 37116 - RNA, 17 nt, Human
ggaaggucaaggggagg

SEQ ID NO: 37117 - RNA, 22 nt, Human
ggaagguuuuucuccugguggg

SEQ ID NO: 37118 - RNA, 22 nt, Human
ggaaguauuuguuuuugcaucc

SEQ ID NO: 37119 - RNA, 22 nt, Human
ggaaucuuugaaggauuuuaag

SEQ ID NO: 37120 - RNA, 20 nt, Human
ggaaucuuugcaggaaaaua

SEQ ID NO: 37121 - RNA, 22 nt, Human
ggaaucuuuuucauaagccuca

SEQ ID NO: 37122 - RNA, 22 nt, Human
ggaaugauggugccuagauuau

SEQ ID NO: 37123 - RNA, 22 nt, Human
uauuuggaggccacuguugagu

SEQ ID NO: 37124 - RNA, 22 nt, Human
uauuuggagugauggaaauguu

SEQ ID NO: 37125 - RNA, 22 nt, Human
uauuuguagcuucccaaagcuu

SEQ ID NO: 37126 - RNA, 22 nt, Human
uauuuguauuucaugcaguaaa

SEQ ID NO: 37127 - RNA, 22 nt, Human
uauuugucacuagaaaggguaa

SEQ ID NO: 37128 - RNA, 22 nt, Human
uauuugucuaagaggcugacag

SEQ ID NO: 37129 - RNA, 23 nt, Human
uauuugucucuuaccacugcugu

SEQ ID NO: 37130 - RNA, 22 nt, Human
uauuuguugcgggaauugcuau

SEQ ID NO: 37131 - RNA, 22 nt, Human
uauuuuacuauuuggcaaaguc

SEQ ID NO: 37132 - RNA, 22 nt, Human
uauuuucaccauguaucccugu

SEQ ID NO: 37133 - RNA, 23 nt, Human
uauuuuccuggcaacaggggaac

SEQ ID NO: 37134 - RNA, 22 nt, Human
uauuuucuggacagucuugcuu

SEQ ID NO: 37135 - RNA, 22 nt, Human
uauuuugaaagucuguuuugaa

SEQ ID NO: 37136 - RNA, 22 nt, Human
uauuuugacuauuaaaccaaca

SEQ ID NO: 37137 - RNA, 22 nt, Human
uauuuugcaaaccugaguuuga

SEQ ID NO: 37138 - RNA, 22 nt, Human
uauuuugugccaugcacugccu

SEQ ID NO: 37139 - RNA, 22 nt, Human
ucaaaacaacacucagguguaa

SEQ ID NO: 37140 - RNA, 19 nt, Human
ucaaaacacaaaugguuga

SEQ ID NO: 37141 - RNA, 22 nt, Human
ucaaaaggacagaagaccuaaa

SEQ ID NO: 37142 - RNA, 22 nt, Human
ucaaaagucugcauucuucaca

SEQ ID NO: 37143 - RNA, 22 nt, Human
ucaaaaguuucacauagagaua

SEQ ID NO: 37144 - RNA, 23 nt, Human
ucaaacagguuucagagcaucuu

SEQ ID NO: 37145 - RNA, 22 nt, Human
ucaaacauaggcacacauucag

SEQ ID NO: 37146 - RNA, 22 nt, Human
ucaaacauaucugauuuuccau

SEQ ID NO: 37147 - RNA, 22 nt, Human
ucaaacauccccaccagggacu

SEQ ID NO: 37148 - RNA, 22 nt, Human
ucaaacaucuaaacuacccacu

SEQ ID NO: 37149 - RNA, 21 nt, Human
ucaaacaugaucugggucauc

SEQ ID NO: 37150 - RNA, 22 nt, Human
ucaaacauguuagcagucugug

SEQ ID NO: 37151 - RNA, 22 nt, Human
ucaaaccugcugucuuguucau

SEQ ID NO: 37152 - RNA, 22 nt, Human
ucaaacugaacuaagauccaac

SEQ ID NO: 37153 - RNA, 22 nt, Human
ucaaacuguucagaacuccuuu

SEQ ID NO: 37154 - RNA, 22 nt, Human
ucaaacuugguaagagaaauac

SEQ ID NO: 37155 - RNA, 22 nt, Human
ucaaagaagugcaaaccucauc

SEQ ID NO: 37156 - RNA, 22 nt, Human
ucaaagacagacaucagucaaa

SEQ ID NO: 37157 - RNA, 22 nt, Human
ucaaagacauggggaagcugag

SEQ ID NO: 37158 - RNA, 22 nt, Human
ucaaagacuauauauuuuauuu

SEQ ID NO: 37159 - RNA, 22 nt, Human
ucaaagaucagaugguuguagg

SEQ ID NO: 37160 - RNA, 21 nt, Human
ucaaagcacauauuugcacau

SEQ ID NO: 37161 - RNA, 22 nt, Human
ucaaagccuguggauaguuugg

SEQ ID NO: 37162 - RNA, 22 nt, Human
ucaaagcuuagauaauuucuuu

SEQ ID NO: 37163 - RNA, 22 nt, Human
ucaaaggcauugccaauaagua

SEQ ID NO: 37164 - RNA, 22 nt, Human
ucaaaggcuugugguucuggga

SEQ ID NO: 37165 - RNA, 22 nt, Human
ucaaaguaccagagugaacuga

SEQ ID NO: 37166 - RNA, 22 nt, Human
ucaaaguaccauuaucagugga

SEQ ID NO: 37167 - RNA, 23 nt, Human
ucaaaguaguuuuauccaauaaa

SEQ ID NO: 37168 - RNA, 22 nt, Human
ucaaagucacaacucucuaauu

SEQ ID NO: 37169 - RNA, 18 nt, Human
ucaaagucuggcuccacu

SEQ ID NO: 37170 - RNA, 22 nt, Human
ucaaaguuggaaaagcuggccc

SEQ ID NO: 37171 - RNA, 22 nt, Human
ucaaaguuuguggcaauuuauu

SEQ ID NO: 37172 - RNA, 22 nt, Human
ucaaauaaugccauucaucauc

SEQ ID NO: 37173 - RNA, 22 nt, Human
ucaaauacagaagauccuuucc

SEQ ID NO: 37174 - RNA, 22 nt, Human
ucaaauagguaugaguagaaau

SEQ ID NO: 37175 - RNA, 22 nt, Human
ucaaauaguugacauuaacuug

SEQ ID NO: 37176 - RNA, 22 nt, Human
ucaaauauuggcuauuucacau

SEQ ID NO: 37177 - RNA, 22 nt, Human
ucaaaucagcaagcagcuuccc

SEQ ID NO: 37178 - RNA, 21 nt, Human
ucaaaucauguacugaccaca

SEQ ID NO: 37179 - RNA, 22 nt, Human
ucaaaugagaggcagggcagcu

SEQ ID NO: 37180 - RNA, 22 nt, Human
ucaaaugaggcugaugaaugug

SEQ ID NO: 37181 - RNA, 22 nt, Human
ucaaaugagugacucacacagg

SEQ ID NO: 37182 - RNA, 22 nt, Human
ucaaaugcacguagagaaaaua

SEQ ID NO: 37183 - RNA, 22 nt, Human
ucaaauuauuuaggauagugcu

SEQ ID NO: 37184 - RNA, 22 nt, Human
ucaaauuuuaacaugcauuaga

SEQ ID NO: 37185 - RNA, 22 nt, Human
ucaacacuauccaggcaaucuu

SEQ ID NO: 37186 - RNA, 22 nt, Human
ucaacacuggcuacaguuaugc

SEQ ID NO: 37187 - RNA, 22 nt, Human
ucaacagaagugauagcuauua

SEQ ID NO: 37188 - RNA, 22 nt, Human
ucaacagacauuuuuaagcacu

SEQ ID NO: 37189 - RNA, 22 nt, Human
ucaacaguggcaaagaggcacg

SEQ ID NO: 37190 - RNA, 22 nt, Human
ucaacauacauacauggucagg

SEQ ID NO: 37191 - RNA, 22 nt, Human
ucaacauucauauauagccaca

SEQ ID NO: 37192 - RNA, 22 nt, Human
ucaacccuguuuucuuugcaau

SEQ ID NO: 37193 - RNA, 22 nt, Human
ucaacguuuguuaaaugaguau

SEQ ID NO: 37194 - RNA, 22 nt, Human
ucaagaaagggcuucaccagga

SEQ ID NO: 37195 - RNA, 22 nt, Human
ucaagaagauaaugucuagggu

SEQ ID NO: 37196 - RNA, 22 nt, Human
ucaagaaggagacuccacugug

SEQ ID NO: 37197 - RNA, 22 nt, Human
ucaagagacaggacguguuuca

SEQ ID NO: 37198 - RNA, 22 nt, Human
ucaagagagugcugcuuggggu

SEQ ID NO: 37199 - RNA, 22 nt, Human
ucaagagccagguaagcacagg

SEQ ID NO: 37200 - RNA, 22 nt, Human
ucaagaguuggucaaauccaaa

SEQ ID NO: 37201 - RNA, 22 nt, Human
ucaagaugaaccaggacauuca

SEQ ID NO: 37202 - RNA, 20 nt, Human
ucaagaugaggucauacugg

SEQ ID NO: 37203 - RNA, 22 nt, Human
ucaagaugcauggguggcauaa

SEQ ID NO: 37204 - RNA, 22 nt, Human
ucaagcaaaguuuagcugguua

SEQ ID NO: 37205 - RNA, 22 nt, Human
ucaagcaacagaacugugagac

SEQ ID NO: 37206 - RNA, 22 nt, Human
ggcacacaggcagauggagugu

SEQ ID NO: 37207 - RNA, 22 nt, Human
ggcacacauagaucugcacugg

SEQ ID NO: 37208 - RNA, 22 nt, Human
ggcacacucaccacguggaggg

SEQ ID NO: 37209 - RNA, 22 nt, Human
ggcacagagcaggccacuaauc

SEQ ID NO: 37210 - RNA, 22 nt, Human
ggcacagagcuccagccuuggc

SEQ ID NO: 37211 - RNA, 22 nt, Human
ggcacagagcuuugucccaguu

SEQ ID NO: 37212 - RNA, 22 nt, Human
ggcacagaguuggcagagcugc

SEQ ID NO: 37213 - RNA, 22 nt, Human
ggcacagcacuguaggccuggg

SEQ ID NO: 37214 - RNA, 22 nt, Human
ggcacagccacuuuggagaacu

SEQ ID NO: 37215 - RNA, 22 nt, Human
ggcacagcgacuaccaucgaaa

SEQ ID NO: 37216 - RNA, 22 nt, Human
ggcacagggagccgcaguugca

SEQ ID NO: 37217 - RNA, 22 nt, Human
ggcacagggugauguugcaguu

SEQ ID NO: 37218 - RNA, 22 nt, Human
ggcacaguuuucuacauaugcu

SEQ ID NO: 37219 - RNA, 20 nt, Human
ggcacaguuuuugcaccugc

SEQ ID NO: 37220 - RNA, 22 nt, Human
ggcacauguaugugggagugug

SEQ ID NO: 37221 - RNA, 22 nt, Human
ggcaccaggacaugacucccag

SEQ ID NO: 37222 - RNA, 20 nt, Human
ggcaccaggcuaggauugga

SEQ ID NO: 37223 - RNA, 22 nt, Human
ggcaccagggcaagggucuuuc

SEQ ID NO: 37224 - RNA, 22 nt, Human
ggcaccaggggauguaaugucc

SEQ ID NO: 37225 - RNA, 22 nt, Human
ggcaccaucagcugugcagggg

SEQ ID NO: 37226 - RNA, 22 nt, Human
ggcaccucugggcucuguuagg

SEQ ID NO: 37227 - RNA, 22 nt, Human
ggcaccuguguaagaucuggaa

SEQ ID NO: 37228 - RNA, 22 nt, Human
ggcaccuuggcuagugaucaac

SEQ ID NO: 37229 - RNA, 22 nt, Human
ggcacuaggagaccuggggguc

SEQ ID NO: 37230 - RNA, 22 nt, Human
ggcacuagugacaaggggacau

SEQ ID NO: 37231 - RNA, 22 nt, Human
ggcacuaugaguuauaagugga

SEQ ID NO: 37232 - RNA, 22 nt, Human
ggccccugcggacugccuagag

SEQ ID NO: 37233 - RNA, 22 nt, Human
ggcccucucuacauguuagacg

SEQ ID NO: 37234 - RNA, 22 nt, Human
ggcccucugccugugcuggcga

SEQ ID NO: 37235 - RNA, 22 nt, Human
ggcccucugcucacuuccuauu

SEQ ID NO: 37236 - RNA, 22 nt, Human
ggcccucuguggcugccaugga

SEQ ID NO: 37237 - RNA, 22 nt, Human
ggcccucuuuuauccaucauaa

SEQ ID NO: 37238 - RNA, 22 nt, Human
ggcccugaagugauugugaguu

SEQ ID NO: 37239 - RNA, 22 nt, Human
ggcccugaucuccuggauucuu

SEQ ID NO: 37240 - RNA, 22 nt, Human
ggcccugcaagguacccaggcc

SEQ ID NO: 37241 - RNA, 22 nt, Human
ggcccugcucaggcugcgauga

SEQ ID NO: 37242 - RNA, 21 nt, Human
ggcccugguuacgccuccucu

SEQ ID NO: 37243 - RNA, 22 nt, Human
ggcccugucccuggccgucugu

SEQ ID NO: 37244 - RNA, 22 nt, Human
ggcccugucugucugcccagcu

SEQ ID NO: 37245 - RNA, 22 nt, Human
ggcccuuggagccuccacagug

SEQ ID NO: 37246 - RNA, 22 nt, Human
ggccgcugcgccuccaaccgag

SEQ ID NO: 37247 - RNA, 22 nt, Human
ggccgggcaggucucagccagc

SEQ ID NO: 37248 - RNA, 22 nt, Human
ggccgggcuguggagaaggggu

SEQ ID NO: 37249 - RNA, 22 nt, Human
ggccggggccuccccgcgucgc

SEQ ID NO: 37250 - RNA, 22 nt, Human
ggccgugcuccaaagucaucgu

SEQ ID NO: 37251 - RNA, 22 nt, Human
ggccuaagugguuaaauggcuu

SEQ ID NO: 37252 - RNA, 22 nt, Human
ggccuaggauucugcauuucua

SEQ ID NO: 37253 - RNA, 22 nt, Human
ggccuagggaguggccaugccu

SEQ ID NO: 37254 - RNA, 22 nt, Human
ggccuagggcuuggucauggca

SEQ ID NO: 37255 - RNA, 22 nt, Human
ggccucacccaucggugccuuu

SEQ ID NO: 37256 - RNA, 22 nt, Human
ggccucagaaauagaguaaaau

SEQ ID NO: 37257 - RNA, 22 nt, Human
ggccucagagaaggcugugcgg

SEQ ID NO: 37258 - RNA, 23 nt, Human
ggccucagcgcacagaaacugcu

(The sequence listing continues in the following parts.)

The invention claimed is:

1. An isolated nucleic acid, wherein the sequence of the nucleic acid consists of:
   (a) SEQ ID NO: 4204050;
   (b) a DNA encoding the nucleic acid of (a), wherein the DNA is identical in length to (a); or
   (c) the complement of (a) or (b), wherein the complement is identical in length to the nucleic acid of (a) or (b).

2. A vector comprising an isolated nucleic acid, wherein the sequence of the nucleic acid consists of:
   (a) SEQ ID NO: 4204050;
   (b) a DNA encoding (a), wherein the DNA is identical in length to (a); or
   (c) a complement of (a) or (b), wherein the complement is identical in length to the nucleic acid of (a) or (b).

3. A probe comprising a heterologous sequence, wherein the heterologous sequence is selected from the group consisting of
   (a) SEQ ID NO: 4204050;
   (b) a DNA encoding (a), wherein the DNA is identical in length to (a); and
   (c) a complement of (a) or (b), wherein the complement is identical in length to the nucleic acid of (a) or (b).

4. An isolated nucleic acid, wherein the sequence of the nucleic acid consists of :
   (a) SEQ ID NO: 117937;
   (b) a DNA encoding the nucleic acid of (a), wherein the DNA is identical in length to (a);
   (c) a sequence at least 80% identical to (a) or (b), wherein the nucleic acid is 19-24 nucleotides in length; or
   (d) the complement of (a)-(c), wherein the complement is identical in length to the nucleic acid of (a)-(c).

5. A vector comprising an isolated nucleic acid, wherein the sequence of the nucleic acid consists of:
   (a) SEQ ID NO: 117937;
   (b) a DNA encoding (a), wherein the DNA is identical in length to (a); or
   (c) a complement of (a) or (b), wherein the complement is identical in length to the nucleic acid of (a) or (b).

6. A probe comprising a heterologous sequence, wherein the heterologous sequence is selected from the group consisting of
   (a) SEQ ID NO: 117937;
   (b) a DNA encoding the nucleic acid of (a), wherein the DNA is identical in length to (a);
   (c) a sequence at least 80% identical to (a) or (b), wherein the nucleic acid is 19-24 nucleotides in length; and
   (d) the complement of (a)-(c), wherein the complement is identical in length to the nucleic acid of (a)-(c).

* * * * *